United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 28

SEQ ID NO: 158251 - protein, 249 aa, Glycine max
  Coding DNA Sequence Number=SeqID_66566
  Gene Ontology: Mol. function=nucleic acid binding; Cellular component= ribonucleoprotein complex; Biological process=mRNA processing
  Homolog annotation: Hit_ID=A7PC82; Match level="QueryCoverage=97%, HitCoverage=89%, E-value=5e-61, Identity=52%"; Hit description =Chromosome chr2 scaffold_11, whole genome shotgun sequence
  Pfam annotation: Domain name=RRM_1; Domain location=172-244; Score =44.9; E_value=2.8e-10; Accession=PF00076.13; Description=RNA recognition motif. (a.k.a. RRM, RB
  Pfam annotation: Domain name=RRM_1; Domain location=75-145; Score =82.3; E_value=1.6e-21; Accession=PF00076.13; Description=RNA recognition motif. (a.k.a. RRM, RB
  Pfam module annotation: Pfam domain module=RRM_1::RRM_1; Domain location=172-244::75-145
  Subcellular localization annotation: CTP_CleavageSite=49; ConfidenceScore=5.33e-01
MATLESALTLFAPQRFSAKAPISIKLHASTSHIFSSKSFFKTGRLCFQLCSTLQEVAPTEQTLEPIQPTDNVKKLYVVNLSWSLTAADITDLFAQCGTVTDVEIIKSKDGRSKGYAFVTMASGEEAQAAVDKFDSYELSGRIIRVELAKRLKKPPSLPPPPGPRPGETRHVIYASNLAWKARSTHLRQVFTENFKTPSSARVVFDSPSGRSAGYGFVSFLTREDAEAAISTVDGKVQENYPIAFLDTKP

SEQ ID NO: 158252 - protein, 152 aa, Glycine max
  Coding DNA Sequence Number=SeqID_66567
  Subcellular localization annotation: CTP_CleavageSite=37; ConfidenceScore=5.24e-01
MSIFFRIKADNSEILLPPPPPPPPPQITPSTLIFFTVAVVVFCFVGFSILFFCRRADDGDQSMQEQKIEFCTFTLNGPGHSIVMIRGEGRDDGDDDKYTLRLPENVALKIVKGGHNYSKICSSSKDMARLNAAPCKKVMFKLYLTVPHPVML

SEQ ID NO: 158253 - protein, 111 aa, Glycine max
  Coding DNA Sequence Number=SeqID_66568
MAMAVTVTPYPFFWFGSKGKIQHSPRHTTIDYTATLFHTCALTTLNLDVSRHVPYQCYEMNPLPILAAAIYIRAFPSYRPTMNLCSGGARKIIKSGQKFKDSKFTLYIICK

SEQ ID NO: 158254 - protein, 537 aa, Glycine max
  Coding DNA Sequence Number=SeqID_66569
  Gene Ontology: Mol. function=nucleic acid binding; Cellular component= nucleus; Biological process=ribosome biogenesis and assembly
  Homolog annotation: Hit_ID=A7PC68; Match level="QueryCoverage=95%, HitCoverage=99%, E-value=1e-109, Identity=46%"; Hit description =Chromosome chr2 scaffold_11, whole genome shotgun sequence
  Pfam annotation: Domain name=RRM_1; Domain location=195-282; Score =24.9; E_value=0.00031; Accession=PF00076.13; Description=RNA recognition motif. (a.k.a. RRM, RB
  Pfam annotation: Domain name=RRM_1; Domain location=306-380; Score =49.7; E_value=1e-11; Accession=PF00076.13; Description=RNA recognition motif. (a.k.a. RRM, RB
  Pfam module annotation: Pfam domain module=RRM_1::RRM_1; Domain location=195-282::306-380
  Subcellular localization annotation: CTP_CleavageSite=37; ConfidenceScore=5.54e-01
MGKRKQKDLQQSSQTDTVSTPSSIFSKLFAIAPERTTATTAASLFSDDNPFRRKPTPLSDSTNRTQNPNDGDHPVNTDSGEEKKRKRNKEKTDKTPAPAIDTVVSVIEASDKSEKKRKRDSDEGKDLIVGAEASGKRKRKRGEVEKDWEEKKYGIVEEGLENKTVGIKRKTLDDPADMMVSKEGFDDEDKLLRTVFVGNLPLKVKKKTLLKEFKKFGEVESVRIRSVPIQDTKKPRKGAILAKKINDAADSVHAYIVFKTEQSAQASLSHNMSLVEGNHIRVDRACPPRKKHKGESTPLYDDKRTVFVGNLPFDVKDEELYQLFCGISNLESSIEAVRVVRDPHLNVGKGIAYVLFKTKEAAKFVVKKRNLKLRDRELRLSHAKVDATPSKRPNPSSAHAPSTPAKRPYPLAHAPSTPAKEFSVASRSPSSSNNMSKSNRKTNASYQGLRATKSDVHKKIQGGEKPKERMTKRPSVAARKAKAKLGKESDLPKQAGMKRKLDSRTPDSTLRNRKAMFSADLKAHLTANGEELRKISG

SEQ ID NO: 158255 - protein, 202 aa, Glycine max
  Coding DNA Sequence Number=SeqID_66570
  Gene Ontology: Mol. function=metal ion binding; Cellular component =intracellular; Biological process=positive regulation of growth rate
  Homolog annotation: Hit_ID=A7PC55; Match level="QueryCoverage=69%, HitCoverage=20%, E-value=2e-45, Identity=61%"; Hit description =Chromosome chr2 scaffold_11, whole genome shotgun sequence
MLNSEKDRQNLSQLKEDQKRREREKINEMLNMKEIHRDSKLCPSCDMAISRTEGCNKMKCGNCEQYFCYRCNKAIDASDPYGHFRDGSCELFPREMVDSWEERINHRQAVGQLQAELFPQHGLACPSCRQYNPKDSFSVITNNFLYCHFEFFNRLEIIITCFAGHANAITATYAKRLSGVALSIMDQRAANSTLRDSISTIP

SEQ ID NO: 158256 - protein, 101 aa, Glycine max
  Coding DNA Sequence Number=SeqID_66571
MLKTSSRIFYGHQGTAFSSSTRLRTQMQIMAAIMLVGSSLCEGMGEGCCTQPYPCICKEAVSGFEPMTNKSPRHNFTAAPGLALITINSITPFFLSLNISY

SEQ ID NO: 158257 - protein, 197 aa, Glycine max
  Coding DNA Sequence Number=SeqID_66572
ARKEEWSKNKFRGALWGNNNKLKLRRAKRDELRMESMVLEDKLKACQRAKRSLMEQLSRTKENMLTIIDQYKEKVNLAASHGQTLEDEHAKVSALHIERQARERVIESLHGEAMKWMDRFALALNGSQELPRLLARAKAMADVYLAPDEVHGLFDYCEHMVDKSGALAPTYPPSKRKSDLLSSFLRGESSDSFYLEG

SEQ ID NO: 158258 - protein, 73 aa, Glycine max
  Coding DNA Sequence Number=SeqID_66573
MMTKVMTKSSKSKFKTQEENLKNTSRFKKKDEFKNQDSRIKLQESRSRFKIHDSRIKRRLNQDKYEKDFSKTE

SEQ ID NO: 158259 - protein, 27 aa, Glycine max
  Coding DNA Sequence Number=SeqID_66574
MCYFKRAHDFVLNRRGNDPEEARLKEI

SEQ ID NO: 158260 - protein, 81 aa, Glycine max
  Coding DNA Sequence Number=SeqID_66575
  Gene Ontology: Mol. function=hydrogen-translocating pyrophosphatase activity; Cellular component=membrane; Biological process=proton transport
  Homolog annotation: Hit_ID=Q42651; Match level="QueryCoverage=77%, HitCoverage=8%, E-value=8e-26, Identity=96%"; Hit description =Pyrophosphatase
MYGIAMAALGMLSTIATGLAIDAYGPISDNAGGIAEMAGMSHCIRERTDALDAAGNTTAAIRKVYVFVNVIKMVLNFLYSN

SEQ ID NO: 158261 - protein, 274 aa, Glycine max
  Coding DNA Sequence Number=SeqID_66576
  Homolog annotation: Hit_ID=A2Q6B4; Match level="QueryCoverage=36%, HitCoverage=41%, E-value=2e-09, Identity=33%"; Hit description =Ribosomal protein L33; Nucleic acid-binding, OB-fold
MDLKENCTYVMHNFKVLKNNSQYRVCDHQFKLVFTRVTVVRQSVLDYLPFRKYRFAGFANVVAGQFEPGLLVDIIGVVDEVVFRHVLGKGRRVVFKLKDLRILSAIGLQSWTLRPGQFLNPMVKAVHSFQVLPNYHQRNHSLERLRYRLEVMVNHRDESTKFLLWDRECTKLIGQSADANNRLKIEDGDVDLNASPQALDKLLGYVLAFKIKVQPKFRNSAILKCSTDSSLIDVVMDMLPDAETSSKINVPVFGSNDPTQHEFVSFNHDPHLLM

SEQ ID NO: 158262 - protein, 157 aa, Glycine max
  Coding DNA Sequence Number=SeqID_66577
  Gene Ontology: Mol. function=helicase activity
  Homolog annotation: Hit_ID=Q94LS7; Match level="QueryCoverage=80%, HitCoverage=12%, E-value=1e-17, Identity=32%"; Hit description =Putative helicase
MLDEYNVRAKTFRMARDRLEDGQVDNVRLKLIANREKDGRAYNVPTVPEVATLIVALQYPLLFPYGEDGYRLDILHSSAPGYTMVESERLSYIRNNQEKLQVDKFCSLQHSLDDGSTKGLNKGLKSVNFRERRAEQGAKFSSFREISEFLSDCEIPK

SEQ ID NO: 158263 - protein, 208 aa, Glycine max
  Coding DNA Sequence Number=SeqID_66578
  Gene Ontology: Mol. function=excinuclease ABC activity; Cellular component=excinuclease repair complex; Biological process=response to DNA damage stimulus
  Homolog annotation: Hit_ID=P0A196; Match level="QueryCoverage=100%, HitCoverage=76%, E-value=1e-108, Identity=72%"; Hit description =UvrABC system protein A
MDKIEVRGARTHNLKNINLIIPRDKLIVVTGLSGSGKSSLAFDTLYAEGQRRYVESLSAYARQFLSLMEKPDVDHIEGLSPAISIEQKSTSHNPRSTVGTITEIHDYLRLLFARVGEPRCPDHNVTLAAQTVSQMVDQVLAQEEGRRLMLLAPVVKDRKGEHTKTLENLAAQGYIRARIDGEVCDLSDPPKLELQKKHTIEVVIDRFR

SEQ ID NO: 158264 - protein, 131 aa, Glycine max
  Coding DNA Sequence Number=SeqID_66579
  Gene Ontology: Mol. function=phosphoprotein phosphatase activity; Biological process=intracellular signaling cascade
  Homolog annotation: Hit_ID=A7PHV0; Match level="QueryCoverage=85%, HitCoverage=35%, E-value=3e-22, Identity=42%"; Hit description =Chromosome chr13 scaffold_17, whole genome shotgun sequence
MWAWERCTTLAPKRTPPVIQNKPLGHRWLGRGNQHIGNDDLIVFRRKLDIMKRHEFLWEPYTTSIMSSLPPICLVGSVAWCAVVPLICFHVVEWHQPDRVLRQFGMQQPIPECIQHLYIGSSSCSRNHKLQ

SEQ ID NO: 158265 - protein, 255 aa, Glycine max
  Coding DNA Sequence Number=SeqID_66580
  Homolog annotation: Hit_ID=A2Q6B4; Match level="QueryCoverage=45%, HitCoverage=46%, E-value=9e-10, Identity=33%"; Hit description =Ribosomal protein L33; Nucleic acid-binding, OB-fold
MARSPDKIKNIDDSKETLNLLPLCCNFNEIQGDEIHDVCKQDQLKSWKMDLKENCTYVMHNFKVLKNNGQYRVCDHQFKLVFIGVAVVRQCVLNDLPFRKYKFAGFADVVAGQFEPGLLVDVIDVVDEVVFRHVSRKGRRVVFKLKDLRLAGLGIEARPVFKSHGQGSSQLSGSIQLSSKESFFGKAEAKTIAEINTISEEIVCVTVGTITRIVMDNHSWCYIACIQCHKKIDAKMAPFTCACGKYNQEVVLRSL

SEQ ID NO: 158266 - protein, 620 aa, Glycine max
  Coding DNA Sequence Number=SeqID_66581
  Gene Ontology: Mol. function=oxidoreductase activity; Cellular component=membrane; Biological process=electron transport
  Homolog annotation: Hit_ID=A8GBV9; Match level="QueryCoverage=37%, HitCoverage=90%, E-value=1e-128, Identity=93%"; Hit description =Oxidoreductase molybdopterin binding
  Pfam annotation: Domain name=Oxidored_molyb; Domain location=461-611; Score=243.2; E_value=5.6e-70; Accession=PF00174.10; Description =Oxidoreductase molybdopterin binding
MAQPCLPGNSVQENVMITRHRIAGLLLSTLLLSSGLAAAAQTPGKVIAPLRGTISQVADGNLQLTDRKGETLSVKLNDQTKVLSVSKATLDDIKPDSFIGTAAVPQPDGTLKALEVHVFAASLRGTGEGHSAWESADGKVDTMTNGTVGKLVKSNGRTLTVTYGNQQKTVVVPEDVPIVTLDPGDLSLLKPGVHIVLFSAVNDKGERVATRISAGKDGTVPPIHENQRVAAGASLAGSNHSLDQPVRHDDAGRLAGRRDWLAFGGDVANGAQRRLLSAVEPVQRPFSPRSVAASRRRAAAGYLAGADAAPAPPAWPLQRHSKADVSRRAGAGPIAGAVRPGDLEAGSAAGIGRPVWRLRFRALRAFLRHGRHWPVRGDPRLYGDRRAQNARRLMLRSGLTLGGIAMLTGCNLQDGDRVDKVLWAMSRWNDRVQAWLFSGQRLAQTYRPDQITQPFPFNAFYPEYNVPEIDLAGYRLEVAGKVEKKAPWTLEQLQRLPQQSQITRLICIEGWSAIGQWGGVPLRTFLQHVGADLNAGYVGFKCADRYYSSLDMATALHPQTILALDFGGKALPADYGYPLRLRVPTKLGFKNAKHIAAIFVSDVNPGGYWEDQGYNWFSGI

SEQ ID NO: 158267 - protein, 95 aa, Glycine max
  Coding DNA Sequence Number=SeqID_66582
MKYYRSKIDEWVVINKKGDIVEAMPSKVILMMPKNQELSKVSSKDSRIKFQVSRFKIQESSFKNQVSRIKNNQDQDLRLKTQDSRIKRRLNQDKY

SEQ ID NO: 158268 - protein, 172 aa, Glycine max
  Coding DNA Sequence Number=SeqID_66583
MSCPMIITSTFLCRSVSWCMPPTRHPLDPDKSNRALGVPVTPSKVIRPPITRAFIEKYCTPRQTQGDAPQAAHAPPPPHQADPAGSLGVERYLQHLIHECLYQLSLSQQGQGSAPFTCPTPDQFRAEVAWPEDWPKAQEEEAPAGAPSDAEEARMDEEMIDLLDFLGGSGGT

SEQ ID NO: 158269 - protein, 72 aa, Glycine max
  Coding DNA Sequence Number=SeqID_66584
MHETSGFSSPGDNIEHMNVVRESAIYLPEASFIADEHQQRVTLEDYSSSSVPQFFTSIARCLASGKCTGLHK

SEQ ID NO: 158270 - protein, 210 aa, Glycine max
  Coding DNA Sequence Number=SeqID_66585
MASRKCKSSDSRPQAQYDTRRFQSLEAWNRYTDNILDRRILPEKNVEIYHTEFNEFKAELERRNFHKHLIQEGSIDVAVVKEFYANLYSPEDQSPKCARGESLPTYSRLCKLRTDPREMEASLCISGKGFILNAEEQPWKLLRKDLTTLAQTWSVFSYSNLAPTSHTSYLNTDRARLVYGLITKMDMNIGGLISGQITMIAQSNSSRLGF

SEQ ID NO: 158271 - protein, 188 aa, Glycine max
  Coding DNA Sequence Number=SeqID_66586
  Gene Ontology: Mol. function=protein kinase activity; Biological process=protein amino acid phosphorylation
  Homolog annotation: Hit_ID=A7Q5D4; Match level="QueryCoverage=98%, HitCoverage=14%, E-value=2e-56, Identity=54%"; Hit description =Chromosome undetermined scaffold_53, whole genome shotgun sequence
  Pfam annotation: Domain name=Ank; Domain location=155-188; Score =28.8; E_value=2e-05; Accession=PF00023.21; Description=Ankyrin repeat
MYMECTVLSPHYTAPEAWGQLLKKSLNLFWEDAIGISAESDAWSFACTLVEMGTGFVPWAGLSSEEIYQAVVKAKKLLPHYASVVGGGIPSDLWRMIGECLQFKPSKSDRVVPCERIRSFSEKPIPSSSIDLLFKAASDYGSNSLSSLLEAQNADEQTALHLACRCGSAELVEAILEYEEANVDVWTR

SEQ ID NO: 158272 - protein, 78 aa, Glycine max
  Coding DNA Sequence Number=SeqID_66587
  Gene Ontology: Cellular component=integral to membrane
  Homolog annotation: Hit_ID=A9IUT1; Match level="QueryCoverage=65%, HitCoverage=60%, E-value=1e-16, Identity=72%"; Hit description =Putative uncharacterized protein
MNTVHLAAPMPAKPWYREFWPWFLMAGPFLAVIGCAITIYLAYTQFGNQPIQEGVVKRGLVIEQVEPLPTPPAAVGVR

SEQ ID NO: 158273 - protein, 121 aa, Glycine max
  Coding DNA Sequence Number=SeqID_66588
MHGKSSASDLVPLDLEIEANYRRNNTERRRKFLQDRTTLPILKESQSSESSSSFPDTRESKNAVLEADIMAEEQSRRVTLEDYSASTVPQFFTSIVQPEVQAQNITYPHSLIQLVQGNLFH

SEQ ID NO: 158274 - protein, 207 aa, Glycine max
  Coding DNA Sequence Number=SeqID_66589
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=19%, E-value=1e-113, Identity=100%"; Hit description=DNA- directed RNA polymerase subunit beta
  Pfam annotation: Domain name=RNA_pol_Rpb2_1; Domain location=14-190; Score=139.5; E_value=9.3e-39; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWARVSRKQKISILVLSSAMGSNLSEILENVCYPEIFVSS

SEQ ID NO: 158275 - protein, 28 aa, Glycine max
  Coding DNA Sequence Number=SeqID_66590
MAHKTPVIVEERENLCAYSRFALLRPDP

SEQ ID NO: 158276 - protein, 287 aa, Glycine max
  Coding DNA Sequence Number=SeqID_66591
  Gene Ontology: Mol. function=ATP-dependent helicase activity; Cellular component=phycobilisome; Biological process=regulation of transcription, DNA-dependent
  Homolog annotation: Hit_ID=A7MFT9; Match level="QueryCoverage=100%, HitCoverage=25%, E-value=1e-153, Identity=94%"; Hit description =Putative uncharacterized protein
  Pfam annotation: Domain name=CarD_TRCF; Domain location=1-64; Score =54.9; E_value=2.8e-13; Accession=PF02559.7; Description=CarD -likeTRCF domain
  Pfam annotation: Domain name=DEAD; Domain location=93-257; Score =156.1; E_value=9.4e-44; Accession=PF00270.20; Description=DEADDEAH box helicase
  Pfam annotation: Domain name=ResIII; Domain location=89-251; Score =21.7; E_value=7.3e-07; Accession=PF04851.6; Description=Type III restriction enzyme, res subunit
  Pfam module annotation: Pfam domain module=CarD_TRCF::DEAD::ResIII; Domain location=1-64::93-257::89-251
MLSYAGDAKLYVPVSSLHLISRYAGGADENAPLHKLGSDAWSRARQKAAEKVRDVAAELLDIYAQRAAKAGFAFKHDREQYQLFCEGFPFETTPDQAQAINAVLSDMCQPLAMDRLVCGDVGFGKTEVAMRAAFLAVENGKQVAVLVPTTLLAQQHYDNFRDRFANWPVRIEMLSRFRSAKEQAQVLEQASEGKIDILIGTHKLLMSDLKWRDLGLLIVDEEHRFGVRHKERIKAMRADVDILTLTATPIPRTLNMAMSGMRDLSIIATPPARRLAVKTFVREYDSL

SEQ ID NO: 158277 - protein, 412 aa, Glycine max
  Coding DNA Sequence Number=SeqID_66592
  Gene Ontology: Mol. function=thiamin kinase activity; Biological process=phosphorylation
  Homolog annotation: Hit_ID=A7MFT2; Match level="QueryCoverage=60%, HitCoverage=95%, E-value=8e-37, Identity=40%"; Hit description =Putative uncharacterized protein
  Pfam annotation: Domain name=APH; Domain location=145-380; Score =51.7; E_value=2.5e-12; Accession=PF01636.14; Description =Phosphotransferase enzyme family
  Pfam annotation: Domain name=Choline_kinase; Domain location=189-364; Score=-17.9; E_value=1.6e-05; Accession=PF01633.11; Description =Cholineethanolamine kinase
  Pfam module annotation: Pfam domain module=APH::Choline_kinase; Domain location=145-380::189-364
  Subcellular localization annotation: CTP_CleavageSite=63; ConfidenceScore=5.19e-01
MLTGCVVKQQTPAPVEPTQPTTPTQPEQPPAQPVPPPQTVPQPPKLKTINWNASVQPLVANMVQSAGVNPGSVLLVDRIKNSTNGSLQTEKATAAIENALANNGKFSLVSNDQLNQAKQTLGLSPEDSLNSRSKAIGLARIVNAQCKPAKSSGRATALHNPDPRLQHLVQQQWPTAQAAGHFFALPGLSGNSVQPIPFVDRQREYRILRQLRTTALAPQPLTWQAPWLLQRWLPGEVLSPDQFSAQRAAVLTLLLRLHHQPLTGYRLRLAPLLQRYWQLCQQRHWRWQRRLNQLLQRGEPSPLRLAPLHMDVHPGNLIATPDGLRLIDWEYAADGDVALELAAVGAVDGVQHDHWITDYAAEARLSATALRRQSRRWQPWLQLLMASWYQLRAEQSHDQTLQRLAQASWQDL

SEQ ID NO: 158278 - protein, 359 aa, Glycine max
  Coding DNA Sequence Number=SeqID_66593
  Gene Ontology: Mol. function=lyase activity
  Homolog annotation: Hit_ID=A7MFR2; Match level="QueryCoverage=88%, HitCoverage=93%, E-value=1e-119, Identity=66%"; Hit description =Putative uncharacterized protein
  Pfam annotation: Domain name=ADC_lyase; Domain location=37-329; Score= 466.0; E_value=4.8e-137; Accession=PF02618.7; Description =Aminodeoxychorismate lyase
MKKIVAGAVVIAGLAAALSYWQIKRFAATPLTIHQETLYTLPAGSGRVVLEAQLESQHIIPQSIWFGPLLKLEPDLANFKAGTYRLETGMTVRQLLQLLASGKEAQFPLRFVEGSRLKEWLAELRKAPYLKHTLPDDEFASVAAALKLDVSQLEGGFYPDTYLYTANTSDVALLERAHARMNKLVDEVWQGRMASLPYKTPQQMVTMASIIEKETGVSEERARVASVFINRLRTGMKLQTDPTVIYGMGDSYTGTLTRKDLETPTAYNTYTISGLPPGPIAMPGRASLEAAAHPEKTNYLYFVADGKGGHTFTTNLASHNKAVQVYRLAMKEKNEKALKTWSLPVSRAARLWPNSCACW

SEQ ID NO: 158279 - protein, 215 aa, Glycine max
  Coding DNA Sequence Number=SeqID_66594
  Gene Ontology: Mol. function=serine-type endopeptidase activity; Biological process=proteolysis
  Homolog annotation: Hit_ID=A4WBK5; Match level="QueryCoverage=100%, HitCoverage=31%, E-value=1e-109, Identity=86%"; Hit description =Oligopeptidase B
  Pfam annotation: Domain name=Peptidase_S9_N; Domain location=1-214; Score=-28.9; E_value=2.6e-10; Accession=PF02897.6; Description =Prolyl oligopeptidase, N-terminal beta-propeller domain
MPPKARRTPYAITTHGDTRIDNYYWLRDDSRSRPEVLDYLHEENDYGRKVMSSQQALQDQLLNEMVQRIPQRDISAPWTKNGYRYRHIYEPGSEYPIYQRQSVLSAEWDEWDILLDANQRAAHSEFYTLGGMSISPDNTIMALAEDYLSRRQYGLRFRNLETGNWYPEMLENVSPDFVWANDSETVYYVKKHAATLLPYQVWRHSVGTDSADDEL

SEQ ID NO: 158280 - protein, 194 aa, Glycine max
  Coding DNA Sequence Number=SeqID_66595
  Homolog annotation: Hit_ID=Q2HW90; Match level="QueryCoverage=87%, HitCoverage=31%, E-value=1e-24, Identity=39%"; Hit description =Putative uncharacterized protein
MASQEKWGPFADILDLLIFGVVLFPNVDGLVDLAAIDAFLAYHHSKESPVVAILADLFDTFDRRCEKNSARIVCCLPALSVWLVSHLFQQDTRYPCPLQSYRSCAEKGRVDWDQHLAGIGGNAINWFPRWKEGKEGVLFSCGDYPNVPLIGTRGCINYNPALAIRQLGYPMRGAPTEESLSPFLVRDLNAQSLK

SEQ ID NO: 158281 - protein, 186 aa, Glycine max
  Coding DNA Sequence Number=SeqID_66596
MTGRLLAGSLAFESRILHYLIVRILFPRTSNLAQVSEEDLIVMWAFIKALRLNAPLPYHHLVTLFLQHFNIPLDSEPYVPIKRSFLIGASVIASFGYIKEYDGSWVKKDARNVGEEGHEGEDSSLLSKIMDRFDGLQTFVCERFDTLELQVDMRFNEMESRITKVEEDVSYIHSSFDLPPPSPPSS

SEQ ID NO: 158282 - protein, 220 aa, Glycine max
  Coding DNA Sequence Number=SeqID_66597
MEAGNTYVSHEMRRVYYHSTRRLCVVRWLRRGNQHIGNDDVKVFRRKFDIMKRHDGEVAEALQYMVSPQGRKTCTFDDLVPYVEKITILSEEQERVTEPVSHGPASERQFPTQQFHMLQSSIETQGIDRRRDTVEAEEYSQQMAERGHGIYYTPQTFAEYPTQMYQYPFQGHDTDTSATQQSFGGFAETQAHFSWPTMTPSQQYHGPIPTPNAPLGTQWN

SEQ ID NO: 158283 - protein, 163 aa, Glycine max
  Coding DNA Sequence Number=SeqID_66598
MAEVDEVQERMKVGMEAMKEQMATMMEAMMSMKKIMEVNTATVAIVGVVFRVDLTPPSGLNLINRPTSDTGGPHFVQVLNKHVFPPYGLLPNYTPPNKNVNNFTPILIESQQPQTDHAHVSQPMGETHEISHRNLADFEPRLGYATEGQVVGDIPLQNTLEGP

SEQ ID NO: 158284 - protein, 145 aa, Glycine max
  Coding DNA Sequence Number=SeqID_66599
  Subcellular localization annotation: CTP_CleavageSite=36; ConfidenceScore=5.16e-01
MGLKAAALDSNSNGRRLTSGICKGRRGRWGEQTKLRVASKRSSRQTLNTSWEFLFPHLMHKPARTGAASVCQTAWHRCGMRALKSHIFWQLFNLSKSFLPFWQECTISGHRYSWLRSQVIRERQIFKFSIYMFKRRAASRRAAQI

SEQ ID NO: 158285 - protein, 97 aa, Glycine max
  Coding DNA Sequence Number=SeqID_66600
MERYLQHLVRQQAANHKDQVQIHECLYQLSISQQSQGFAPFACPTPDQFRAEVAWPRDWPEAQAGKAPAEAPGDAEEARMDEEMIDLLGFLGGSGAT

SEQ ID NO: 158286 - protein, 190 aa, Glycine max
  Coding DNA Sequence Number=SeqID_66601
MEKTHSQEFIPWRFRKSCFTHLLKKNKPFSGIVGMFGCPVALDEDTKSLSRLDFAKVLVKHSSHNSIVKNETIRVDRVVHNVRSIEEMHMKMNNSSFFDKHDSLEVEEEALWKGGNVKDDKFRAGQRRKGCNRDVFVLAPSDKDVKGSVATYPSAGERRGAHGCVFQERKMRGVATNAYLRKTSEKPEKV

SEQ ID NO: 158287 - protein, 142 aa, Glycine max
  Coding DNA Sequence Number=SeqID_66602
MDERSRGPGMAPTRHPLDPEKSNRALGFPALITGLCQSYGVPVTPSKAQGDAHQDAGAPSPPRQADLVGPLRVERLSQQRQGSAPFICPTLGQFGAEVAWPGDWPDAQAREEPARSPGEADESRMDEDMTDLLGFLGGSGAT

SEQ ID NO: 158288 - protein, 67 aa, Glycine max
  Coding DNA Sequence Number=SeqID_66603
MVQWKHGEGHGVKLRWNKRGTQHQGSRLRDMREGYRGEACIENEGRMNEQGKRDMRVVYDKGKRMIP

SEQ ID NO: 158289 - protein, 62 aa, Glycine max
  Coding DNA Sequence Number=SeqID_66604
  Subcellular localization annotation: CTP_CleavageSite=46; ConfidenceScore=5.32e-01
MLQPYGINIGLKEHSNRVTPKAYTPKSPSGSLPPDSVLTRRPLRVLALTRRPLRVLALTRCP

SEQ ID NO: 158290 - protein, 128 aa, Glycine max
  Coding DNA Sequence Number=SeqID_66605
  Gene Ontology: Mol. function=cysteine-type endopeptidase activity; Cellular component=vacuole; Biological process=proteolysis
  Homolog annotation: Hit_ID=Q39044; Match level="QueryCoverage=71%, HitCoverage=18%, E-value=1e-27, Identity=64%"; Hit description =Vacuolar-processing enzyme beta-isozyme precursor
  Pfam annotation: Domain name=Peptidase_C13; Domain location=22-128; Score=-33.0; E_value=3.8e-09; Accession=PF01650.9; Description =Peptidase C13 family
MHLVPNPLEVHAGHSKNATGKRWVVLVAGLSGYDNYRHQADVCHAYQILKNGGLKDENIIVFMYDDIAHHNLNPRLGTKINKPNDPHVYKGVPKFLPNNIFGIGMSPLDKYISDSSVSLLLHSPIQDR

SEQ ID NO: 158291 - protein, 30 aa, Glycine max
  Coding DNA Sequence Number=SeqID_66606
MKMNGRRMEKEERKEMSLQGEDESRRNSPP

SEQ ID NO: 158292 - protein, 807 aa, Glycine max
  Coding DNA Sequence Number=SeqID_66607
  Gene Ontology: Mol. function=electron carrier activity; Cellular component=mitochondrion; Biological process=electron transport
  Homolog annotation: Hit_ID=A7PLX3; Match level="QueryCoverage=99%, HitCoverage=99%, E-value=0.0, Identity=56%"; Hit description =Chromosome chr14 scaffold_21, whole genome shotgun sequence
  Pfam annotation: Domain name=PPR; Domain location=248-282; Score =22.5; E_value=0.0016; Accession=PF01535.11; Description=PPR repeat
  Pfam annotation: Domain name=PPR; Domain location=289-323; Score =19.9; E_value=0.0096; Accession=PF01535.11; Description=PPR repeat
  Pfam annotation: Domain name=PPR; Domain location=324-358; Score =39.5; E_value=1.2e-08; Accession=PF01535.11; Description=PPR repeat
  Pfam annotation: Domain name=PPR; Domain location=359-393; Score=2.0; E_value=4.5; Accession=PF01535.11; Description=PPR repeat
  Pfam annotation: Domain name=PPR; Domain location=487-521; Score =19.8; E_value=0.011; Accession=PF01535.11; Description=PPR repeat
  Pfam annotation: Domain name=PPR; Domain location=529-563; Score =17.1; E_value=0.068; Accession=PF01535.11; Description=PPR repeat
  Pfam annotation: Domain name=PPR; Domain location=564-598; Score =19.3; E_value=0.014; Accession=PF01535.11; Description=PPR repeat
  Pfam annotation: Domain name=PPR; Domain location=599-633; Score =31.9; E_value=2.3e-06; Accession=PF01535.11; Description=PPR repeat
  Pfam annotation: Domain name=PPR; Domain location=634-668; Score =21.7; E_value=0.0028; Accession=PF01535.11; Description=PPR repeat
  Pfam annotation: Domain name=PPR; Domain location=669-703; Score =44.4; E_value=3.9e-10; Accession=PF01535.11; Description=PPR repeat
  Pfam annotation: Domain name=PPR; Domain location=704-738; Score =18.1; E_value=0.034; Accession=PF01535.11; Description=PPR repeat
  Pfam module annotation: Pfam domain module=PPR::PPR::PPR::PPR::PPR::PP R::PPR::PPR::PPR::PPR::PPR; Domain location=248-282::289-323::324 -358::359-393::487-521::529-563::564-598::599-633::634-668::669 -703::704-738
  Subcellular localization annotation: CTP_CleavageSite=70; ConfidenceScore=5.06e-01
MISTWPFKVNHLVVPCFEIGPSGVTDLNRRRRVKQGIIFSVSHSSKVSVSQCSRGYGTVVFSGHAKLDLRCGILLGFSKPKFGIIFKPHKSHVGDLAPPLGWALDEEGVGSELVEENIDSDDSSVNSESKCVNSLNLDHVKDSDHEGKMRGDDNSKESGGSELVEEQTDSNDASVNSDLEGVMSLKLDQVQESDCEVKMHGDDNSKEGADEECDGKVDVRALALRLQTVKTVEDVEEILKDKGDLPLQVFSTIISGFSKEKKMDSALILFNWMKKRKIETNGSYGPNLFTYNGLLGVVKQSGQFAEMEAILNEMAEDGIAYNVVTYNTLMAIYIEKGECDKALNMLEEIRRNGLTPSPVSYSQALLAYRRMEDGNGALNFFVEFREKYHQGEIGKDDDGEDWEKEFMKIEKFTIRVCYQVMRCWLVSRDNLSNNVLKFLFDMDNARIPLPQVDLERLAWACTREDHYIVVKELYTRIRGRYDKISLSVCNHAIWLMGKAKKWWAALEIYEDLLDKGPKPNNLSYELIVSHFNFLLSAAKRKGIWRWGVKLLNKMEDKGLKPGSREWNAVLLACSKASETTAAVQIFKRMVENGEKPTIISYGALLSALEKGKLYDDALRVWNHMVKVGVEPNAYAYTIMASIYTAQGNFNRVDAIIQEMVTLGIEVTVVTYNAIITGCARNGMSSAAYEWFHRMKVQNISPNEITYEMLIEALANDGKPRLAYQLYTRAKNEGLTLSSKAYDAVVQSSQANGATIELGLLGPRPADKKKKVQIRKTLNEFYNLAGVPKRSQPFDRSEIYHSQTQENP

SEQ ID NO: 158293 - protein, 248 aa, Glycine max
  Coding DNA Sequence Number=SeqID_66608
MKVSVHHEHTAMLAERGCWWVGYFGLTKLLRASETMAGDVKGGFEYGLVGDGSDKVNVNASITVKVGPRLLQFLRPKGRLRFNIIGKVAWARMVDKEVSTVGEQRREAGWKLPSSKYRKYGRVEIPEYDPEIERARHKNNNDTRKRRMVEANAGNRGRNLMHKMTNATVDIGKAMASNAYNGTSDKRILKRPMGVHQVVVNSSILALDKKLDETGHMIGACPFSQPLEDVNYAGRRSNSYDPYSNTYN

SEQ ID NO: 158294 - protein, 92 aa, Glycine max
  Coding DNA Sequence Number=SeqID_66609
  Gene Ontology: Mol. function=succinate dehydrogenase (ubiquinone) activity; Cellular component=mitochondrial inner membrane; Biological process=tricarboxylic acid cycle
  Homolog annotation: Hit_ID=Q8LB02; Match level="QueryCoverage=64%, HitCoverage=21%, E-value=1e-23, Identity=84%"; Hit description =Succinate dehydrogenase [ubiquinone] iron-sulfur subunit 2, mitochondrial precursor
MLVAHHQDSSNIRGVALIFLGEIEGDRKLVLEYVSMWISDSRDEYTKERLDAINDEFKLYRCHTILNCARACPKGLNPGKQISHIKSLQPKA

SEQ ID NO: 158295 - protein, 48 aa, Glycine max
  Coding DNA Sequence Number=SeqID_66610
  Homolog annotation: Hit_ID=Q41368; Match level="QueryCoverage=60%, HitCoverage=10%, E-value=8e-08, Identity=93%"; Hit description =Voltage-dependent anion channel protein
MSLNACAFQLFTTITVNEPAPGLKAIFSFKVPDQRSGKNHFLPQAKKE

SEQ ID NO: 158296 - protein, 115 aa, Glycine max
  Coding DNA Sequence Number=SeqID_66611
MRCREKGSREKREREIGMLLGTPSIIAVLLLSSLRTSPPICVASVVERRRPTASARRQWEVVAIAEDAPHVDDTVEEVFQHAEEVVDDAEGFPGRLCDPSVLTAYLDHVAVIVWN

SEQ ID NO: 158297 - protein, 44 aa, Glycine max
  Coding DNA Sequence Number=SeqID_66612
MMDEDQWMYDNIMFEKVDMNDENEDEADMNEEEYADCSDVFNTS

SEQ ID NO: 158298 - protein, 204 aa, Glycine max
  Coding DNA Sequence Number=SeqID_66613
MERTMIPTSKAFDIKLWLHGQSYKDHLTLTLTSIPKANYSLRIKIDTWLCSILKFTINPSQRPIFRAHETCKADVCFGVLQGVGLWKSCKLQGLGFCSQGRRKASRLRAIVLDLTAIVTVWVRAKLHDESRVIQRCFDDNKDDNKSDDKKLKGQSKNEFKMFKNTSRFKRKVEFKNQESRFKRSRFKTQDSRIKKRLFKNQEKA

SEQ ID NO: 158299 - protein, 164 aa, Glycine max
  Coding DNA Sequence Number=SeqID_66614
MRAQPEEEAIAQLLCISGQDFSHATAKRRVQIMRTNMTTLTQIWMTLLLSNILPSNHNADLPIRKDRAHKTPSGPGGVQQGPGVSSFCCGPQSILQGARPPQQGIAPARHPVDPKKSNRVLGFPALITGLCQFYGVPVAPNKVIRPPINRAFIKKYCAPQASAG

SEQ ID NO: 158300 - protein, 66 aa, Glycine max
  Coding DNA Sequence Number=SeqID_66615
MARRLQEDWARDAGEGPRVLMSLRWHLQSAFLLLHSTAIDLQEAKDSIDEEDPRPTSSTWSYISSK

SEQ ID NO: 158301 - protein, 89 aa, Glycine max
  Coding DNA Sequence Number=SeqID_66616
MVPRKEEWGQNKFRWALWGSNNELKLQRVERDQSRVEGIILEDELKACQRSKRCLSDQLSKTEENMWAIIDQYKEKLSLAATHEQRLED

SEQ ID NO: 158302 - protein, 128 aa, Glycine max
  Coding DNA Sequence Number=SeqID_66617
MRGGGCMTACPSELLAFSKSNLAHPSELFASPSSFSWAQANRTEIILKTIKMNDHDGLCMPSDLIVSGSQRGVDDHDGLRMPSDLIVSGWKADDHNLSSRANGHDCLWMGADDHDGLRMPSDLIVSGW

SEQ ID NO: 158303 - protein, 195 aa, Glycine max
  Coding DNA Sequence Number=SeqID_66618
MRELLRAPSIFVGAPNNFHKCRRSVSKRIWSTVVYAHCSRVYCEFWSVFVAGEEEMDEDQWMYDSMMSEEVDINVENEEDVGVKVEHADCSDAFNTSQLFASCDEVLQWAQSLAHDIGFIVVIMRLDTNTGVRGRASFLLIACERSGEYSLKVPKHDFVIMVIESLFPVCKLLSANSTQHGRAGRMDVKPGVPNE

SEQ ID NO: 158304 - protein, 246 aa, Glycine max
  Coding DNA Sequence Number=SeqID_66619
MEKEALEEAMVQSVIKASLNESKDNIIEIDPGVEPIRSRPMYHANGSQIDIVLSIVVGEDNARRFEAIYGPPTFDTILDVQVGLERRKRTYSFRMENLQQSLEKQDEPVFKTFPPWQTVALNPNSMIFEHLPTNKKTLNHFCFTQETPFNMICSWQRDFYATSNDTLSFMVILLFSRFFFTHHVNPIIEEVEFDTDVVEAIAPDLKDRSHIEKEARKWSLISDFFYKKAIEWKPPHSLTPQYWGFI

SEQ ID NO: 158305 - protein, 310 aa, Glycine max
  Coding DNA Sequence Number=SeqID_66620
  Gene Ontology: Cellular component=ribosome
  Homolog annotation: Hit_ID=A2Q6B4; Match level="QueryCoverage=68%, HitCoverage=82%, E-value=1e-21, Identity=28%"; Hit description =Ribosomal protein L33; Nucleic acid-binding, OB-fold
MACSPDKVKNIDGSKETLKLAVRITDLWFIGTPNKSELAKMVFVDSDIYYLLFRPLCCNFNGIQGAEIHAVCKQDQLKSWKMDLKENCTYVMHNFKVLKNNGQYRVYDHQFKLVFIGVTVVRQCVLDDLPFRKYRFAGFTDVVAGQFELGLLVDVIGVVEEVFFCHVSGKGRRVVFKLKDLSQQLLSCTLWDDYCLQFLKFLDDHEGHGPITVLSTHGRIKEAQGSYLPSVSNSFKASKLVINQPVMEIQEFNEGLAELGIEARSVFKSHGEGSSQLSGSIQLSSKELFFGKAEAKTIAEINTISEVIIL

SEQ ID NO: 158306 - protein, 42 aa, Glycine max
  Coding DNA Sequence Number=SeqID_66621
MHRCQCLIHRIPVNTQKLATINARASANGLVGGRKVFHFMSI

SEQ ID NO: 158307 - protein, 142 aa, Glycine max
  Coding DNA Sequence Number=SeqID_66622
MVGTNNNVVIEVFDKEDYVVSLAKLVINLSNKFTFERGPFTIYQYLCGSNIEGGGDQGVAIYAVFLPILKGDFKAVLETVEKHLQTFAHHKQKNKSRYDSNNSTLDSTPEGLEYTRPTRNHNRPTHLKDYVRRGPSRSAQFC

SEQ ID NO: 158308 - protein, 325 aa, Glycine max
  Coding DNA Sequence Number=SeqID_66623
MAPMKCPPVLGRPTAPIPIGVIIGTGRRECGGVCVNGPMKRTECMAACEVIIESTASTIEEHGRYNGREDGGLTYITSNGEKPMPTCTEDSIKDLSLVVGLWVVCCTQMKVSATQAEQFSPTCTNENGVAIGNQAVWEVVELANGVQEQHYNFVSYEMLGKRTEMGTLRISINNDHDCCETLGNCFIFHLLADNALDHITKNILTHARPKEMVLNATKCYGNTHMTYKRGFMKSVHDLVSEIMAGREPNLIIKEKEALINSETGDDERMAQKVMAPLAYCICNCMKLMDAMGWEFCNRTAPIVVLEASVSMVNRMLNSRVARTRA

SEQ ID NO: 158309 - protein, 81 aa, Glycine max
  Coding DNA Sequence Number=SeqID_66624
MSVKNLVGRLGVHDKTNHTLGDQSWSQYFARMIQSYGINIGLKEHSNRVTPKAYTPKSPSGPLPPNSGPTQKNILAHRLYL

SEQ ID NO: 158310 - protein, 566 aa, Glycine max
  Coding DNA Sequence Number=SeqID_66625
  Homolog annotation: Hit_ID=A7PLV5; Match level="QueryCoverage=95%, HitCoverage=94%, E-value=0.0, Identity=57%"; Hit description =Chromosome chr14 scaffold_21, whole genome shotgun sequence
  Pfam annotation: Domain name=DUF23; Domain location=267-515; Score =134.8; E_value=2.5e-37; Accession=PF01697.18; Description=Domain of unknown function
  Subcellular localization annotation: CTP_CleavageSite=50; ConfidenceScore=5.16e-01
MKDRRRRNAVVSWSALFWCTLLLVFSTIIFTTLIFSPFITTFSHPFKWIKTTTTNSRATITIRETVILPDQALIFLNYPPSFRLYTKHDLSCVYFSPDDDSSSRGVTQPPIQLHLARLREQIVRCTLPPRGGTVSLLIKSNGVVIPRQDSSGSTHEWTPLVYDALFDRDNTTVAFVKGLNLRPEKLMEPSRFQCIYGWDFTKPKFLLKSDVVSAAQEIIRCKTPKSILIGKAQAQDIKVTIHAKDMGVFPSIARPGLRLQHTTPKQKAHEMCICTMLRNQAGFMKEWVMYHAKIGVQRWFIYDNNSDDDIENVISFLQSVGYNISQHLWPWVKTQEAGFAHCALQARSSCDWVGFIDVDEFFNVKIKGGMHGVIWHHAKPGSNVGEIRTPCYSFGPSGLREVPKEGVAVGYTCRLAARERHKSIVRPEALNQSLINVVHHFHLGAPFVTVDVEKSEMMINHYKYQVWKVFKEKFYRRVATYVADWQEEQNVGSRDRVPGLGTKPVEPADWANRFCEVRDNGLRNWVLRNLEDRRTRLLPWQSEFEHHLRKRRRRKEKKPFMIQPLF

SEQ ID NO: 158311 - protein, 152 aa, Glycine max
  Coding DNA Sequence Number=SeqID_66626
MDAHPCQDGIHQLTPRQREIGVIITRQDIAEQQRHTHLGQGGHAGAHDPHPSPGSGPGEILPHHGSDQRRPMSANYLFLKIRVLIVPELDAPLFVEQPSFHGPEALLVLGTLKRWLSNSRVALVPSAAASLLDLFAESFYGAISCEDKHLES

SEQ ID NO: 158312 - protein, 56 aa, Glycine max
  Coding DNA Sequence Number=SeqID_66627
MADQQATKSKAKEALLGGNLELAKKKLPAKRSRKGTIEEDSSVAPQDDTGFEKHRL

SEQ ID NO: 158313 - protein, 119 aa, Glycine max
  Coding DNA Sequence Number=SeqID_66628
  Pfam annotation: Domain name=zf-CCHC; Domain location=78-95; Score =29.3; E_value=1.4e-05; Accession=PF00098.14; Description=Zinc knuckle
EHEIELQRLNQNEETDKRKRSIAIKTYSSMQEEEEESDDEEDFSLFVKKFHKFVKNRRMERSHNFNNGKRSQEVSPTLKCYKCNQPNHIKANCPSNESWPEKNEKKSYKERRSKKAYIA

SEQ ID NO: 158314 - protein, 317 aa, Glycine max
  Coding DNA Sequence Number=SeqID_66629
LPIDPKRIKVILEWPTPPTPHIEWVRNYILSWEDGQERGVEERIHEFQEPLDLRSNPFQGGGNDAISSPIFLESSIQCPCGAIAGLDMGGVRKFEESAYGYNKMQNYIDIMFKSHQLVDYKFPYVVPALRFIDYFNVSNEIVDFTKASSEITERHLKKLGMRAEAQQEPVQQWSPFESLMIQKMDAMLHLHQEHSVDVHSTLENTTTRMENLGTRLTLSNLFNPNEDEAYGECEGTWSTCWSSYWATDATKDVLYLTMFLCSMLSPGLLNPDVSCMFSLILAKRHPQIPLVGLNLTKTALRHTYQQLGYRTPIPREI

SEQ ID NO: 158315 - protein, 104 aa, Glycine max
  Coding DNA Sequence Number=SeqID_66630
MANNIINSKENGGTTLETSSIEIKVDHPQGHNNKDLKSIESAIKNFEVQVGQLAKQLADRSSRSFTANTEKNPKEECKAVMTRSRMAIQGDDSEAGKKMEEHKQ

SEQ ID NO: 158316 - protein, 69 aa, Glycine max
  Coding DNA Sequence Number=SeqID_66631
MVIGGGVGVTCEGVRVAFYREIVAFWLAEVGGRSNGEECDQGLFQSLLVVASSRDFEHNNIQLQYTQLM

SEQ ID NO: 158317 - protein, 105 aa, Glycine max
  Coding DNA Sequence Number=SeqID_66632
MLAIVNRYQEELNLSTAHDHKVVDEYARVYAKKVARGRVIDSLHQEATIWMDRFALTLNGSQELPRMLAKAKAMADTYSAPEEIHGLLSYCQHMIDLMAHIIRNR

SEQ ID NO: 158318 - protein, 365 aa, Glycine max
  Coding DNA Sequence Number=SeqID_66633
MAPKKLSTKRSRRDVAVEASSVAPKFDSHRFRSAEHQQRFEAIKGWLFHRERRVHLREDEYTDFQEEIACRHWTSLVTPMAKFDPKVVLEFYANAWPTEEGVRDMCSWVRDQWIPFDTDALSQFLGDPLVLGEGQQCEFSQRRNMADGFDEEDFTRTAARRRVQIMRTSMTTLTQTWMTLLLSNVLPSDHNSDLPLPKCQLVYAILTRMSVHVAQVIADAIYLFGGMSPTKHPLDPNKFNRALGFPALITGLCQSFGVPVTPTKVIRPLITRAFIEKYCTPRQAQDAPPPPHQPDPARSLGMECYLQHLVRQQAANHWGQVAWPRDWTEAQAREEPAGSPGAAEEARMDEEMTDLLGFLGGSGAT

SEQ ID NO: 158319 - protein, 89 aa, Glycine max
  Coding DNA Sequence Number=SeqID_66634
MAIYRKTHLVQGKLTQASCLLKPEGISSPRRVACIGLKFPLSPSELDASLGEFRVRKLYEKTIFPFLVALFLDLTNNHQNPKRPLGLAL

SEQ ID NO: 158320 - protein, 46 aa, Glycine max
  Coding DNA Sequence Number=SeqID_66635
MVTNEKVEEKVSYHCMAWGQAYFSGGGKAYEDEDMEDPIDYYIGGD

SEQ ID NO: 158321 - protein, 133 aa, Glycine max
  Coding DNA Sequence Number=SeqID_66636
MTSSDQRGCLHPLSKTRRLSTETTLVSPLSSRDGKSDDTQRQHIIIRHPCHPETASPISCGDSSWSSATFAIQRQSSLIARGDKLCLFCHPETIKSDDVQRLSFAIRKRSSPIACEDHHGYPSLSLSRHQGFC

SEQ ID NO: 158322 - protein, 192 aa, Glycine max
  Coding DNA Sequence Number=SeqID_66637
LESITWAFGIIKIAWFIIMKLASTKETEKLLEKELIGASNFVTSPSPLRGVLSEKGFLDLGVPLRGRNVDLELKLGHVVTNDVDIDMNFDCDKGRVVGDEAVFGGNPHQSCWAIPVGRVIEESVLKEKDGYTMAHGDAQSMEMEWKDYNKTQRMRRIPLEQTRFGNQGFMLRGEEEEEEEEEEEEEEEEEEG

SEQ ID NO: 158323 - protein, 156 aa, Glycine max
  Coding DNA Sequence Number=SeqID_66638
MGDVEEAQEQMKADMSALKDQMAFMMEAMLGMKRLIESNAATTAAASTAAEVDSVLPSTANLAHQLAPDMVGRGRDTLGNTNNPYLGYNRIAYPYGLPPKFTPLAMHENTDHAVPFTFEGQPPQPAGGAHEEPRERAQGDIDSYPPFTTKGSGLEK

SEQ ID NO: 158324 - protein, 269 aa, Glycine max
  Coding DNA Sequence Number=SeqID_66639
  Gene Ontology: Mol. function=protein serine/threonine kinase activity; Cellular component=integral to membrane; Biological process=protein amino acid phosphorylation
  Homolog annotation: Hit_ID=A7NUP1; Match level="QueryCoverage=37%, HitCoverage=10%, E-value=6e-40, Identity=75%"; Hit description =Chromosome chr18 scaffold_1, whole genome shotgun sequence
MAKKVAFGFLFSEVVPCLILFLVIAADKTHGWSGDSFDRYKEYRFKVESNDGSAIVVTPETYSCSLRLKNTVEEDAIRLQPGSSEVHMFFPDSLGDDLIVEFQESKGKHFGRVLVQVATIADDPADKLRWWPIYREPNHELMGKLQLYVNYSTSADDNSHLKVIAMEVPKTWLAKVHPSKGTPLNATLFLVRIDGMRHKQGVMHRDLKPENFLFANKKETAALKAIDFRLSVFFKPVLDDFCFNIYIQVDRNTAMGYGAFGFYYKKTSF

SEQ ID NO: 158325 - protein, 140 aa, Glycine max
  Coding DNA Sequence Number=SeqID_66640
MILDATTRVTMMSKSLEEAIVIIDSIAANDYQSHHDMARVQRMAIVQHLEVANRKRRPIICKTKADLNISSKEITKATRVDQAQISLMARGHKIIMHIQVPLTLLLQVLLTTLMQVLQIGVHNNNNNKLSRIECQRWKIL

SEQ ID NO: 158326 - protein, 101 aa, Glycine max
  Coding DNA Sequence Number=SeqID_66641
MVVETEPFGSDENGKEEEEEGVVEICVPDRGETHNRKGEADVGGMDAVAGRLCVGPETGGREGVRGEGGGIVFAVGGGGVVFAIGGGLAEEKDGLVTLGSC

SEQ ID NO: 158327 - protein, 86 aa, Glycine max
  Coding DNA Sequence Number=SeqID_66642
  Gene Ontology: Mol. function=structural constituent of ribosome; Cellular component=intracellular; Biological process=translation
  Homolog annotation: Hit_ID=Q2QW49; Match level="QueryCoverage=54%, HitCoverage=9%, E-value=2e-09, Identity=66%"; Hit description =Ribulose bisphosphate carboxylase large chain, putative
MNSQYICFYLMPFFVHGSIFWCPRRRGTTPIHPELGAQRIRARGYEPRCRGFESLLAHNRPKKGRIFPSGGRKIMIGLADPKLWNL

SEQ ID NO: 158328 - protein, 72 aa, Glycine max
  Coding DNA Sequence Number=SeqID_66643
MQTASTPSWRHLWYWLRENPYPLTPDIEGCLLISEKLRLLCHPGKILRKDLTTLAQEKKEQECELAIRIVSQ

SEQ ID NO: 158329 - protein, 147 aa, Glycine max
  Coding DNA Sequence Number=SeqID_66644
MHKALRSSAPLPYPQLVTLFLRYFEIPLNSEPFVQVKHSFVIGAGAVTSFGYCKDMDGQWLKKDVQPPQEERTPSPLPQRDDSLALMHEVLSELRDLRTYVGEQFDSLDGRIDAIDARFEGMDTHITQLEEDVSYLRRWFDLPPPSS

SEQ ID NO: 158330 - protein, 113 aa, Glycine max
  Coding DNA Sequence Number=SeqID_66645
MAQLISDVIYCLQGSRPQDAQWTRRSPTGPWGFQLWLRASVVLQGARSPRQGIAPARHPVDPKKSNRFYGVLVAPSKVIWPPTNRAFIKKYCVPRQAQGETPQQPGDGRRKLR

SEQ ID NO: 158331 - protein, 54 aa, Glycine max
  Coding DNA Sequence Number=SeqID_66646
NQELSKVSSKDSRFKNQVSRFKIQESRFKNLDSRKIKIKIQDSRLKNQEKTQSR

SEQ ID NO: 158332 - protein, 101 aa, Glycine max
  Coding DNA Sequence Number=SeqID_66647
  Homolog annotation: Hit_ID=A5B090; Match level="QueryCoverage=94%, HitCoverage=13%, E-value=3e-10, Identity=36%"; Hit description =Putative uncharacterized protein
MVLWRGKNRSLGEGAKTLLNETKLPEYFWANADKDYALENETRVEVLEQSKEITAMPPKDLPREWRTQKDLSLDNIIGEISKGVSTHSRLRILCNNMVFVS

SEQ ID NO: 158333 - protein, 76 aa, Glycine max
  Coding DNA Sequence Number=SeqID_66648
  Subcellular localization annotation: CTP_CleavageSite=27; ConfidenceScore=5.01e-01
MLVRMIRTRLFAAARVKSCPGMHTRCVIASLSGCARTVGRPPISGGVDMELLKMRTRSLLKAKVQPSAGEDVQSSD

SEQ ID NO: 158334 - protein, 255 aa, Glycine max
  Coding DNA Sequence Number=SeqID_66649
  Homolog annotation: Hit_ID=A2Q1D6; Match level="QueryCoverage=43%, HitCoverage=20%, E-value=6e-07, Identity=32%"; Hit description =Ovarian tumour, otubain, related
MVSRYALNQIAPEFERVHYAGKNPSTCGCVMRITHGLPCACELAKYVVGCIPLDSIHMFWRRLSFSDQGLFGPEVTIKEEMKTISKRFEELDVCGKFILCELREIAYLKNKNGSINANDTTGKEKRLTSTVNGGAAQCTSSMPDEKNLQSTTNTPVRKTKKKGAQAEEEGAEEEEEDSQSRPIMLGAPSITPTINTPLEPHVIQYSIYHPCSTTYHHPITCETRIMHAPMLTLHCAKEYSKLSHNADNHDHDINL

SEQ ID NO: 158335 - protein, 69 aa, Glycine max
  Coding DNA Sequence Number=SeqID_66650
MKRKKWKGRNEKKEKKRKRRIPDRRSEERLPFKVAPDWRCPAPHKQRGKDRNTQLPLQKHYPRENPIDP

SEQ ID NO: 158336 - protein, 313 aa, Glycine max
  Coding DNA Sequence Number=SeqID_66651
SSCRRISVINFAQDLARAARQQLFRQLNAHPFGLGGRAAALAAHHLAAVRRADQGTQPQAVAIQFGIAADRHVAAAFQTGVHRPFGAHAGFGGRMVQRRQQRAGDAVVETAFNADRTLADRRQALFGAQRAADALLQPQAFQAGHRQNNCVIVAVVQLGQASADVAAQVAHDQIRAAFTQLALAAQAGSADHAALRQLIERGETVGNKSVARIFAFANGGQTQAGGEIDRHVFHRVHGDVGAAFQQRQLEFFNKQALTADFRQRRIQNNVAARHHRHQLDLQAGMAGHQTLLHIMCLPECKRALSGGNSNNFV

SEQ ID NO: 158337 - protein, 201 aa, Glycine max
  Coding DNA Sequence Number=SeqID_66652
MKLCFYTTYSRFCRLRSNPLEIEARLCIPRKGLVLNAEIQPWKLLRKDLATLAQTWSVFSYSNLAPISHTSDLNMDRDRLVYGLVTHMDMNISALISSQISSIAQSNSSRLLFPALMTALYRARGVTSDSLTYESLSPTINLAYIKKNYWNVDDMTINFRGARKVRARPADVPSSSTPPAPSTSTTVTSWNFYLEFCKYYI

SEQ ID NO: 158338 - protein, 92 aa, Glycine max
  Coding DNA Sequence Number=SeqID_66653
MASMMDAMLGMRQLMENNVAISAAVSSAVEANPTLLATAHHPLLNVSDEVHEDCREYALGDIDFYPPVSVEGPAPNTLPHPNLTGEPRSLPA

SEQ ID NO: 158339 - protein, 86 aa, Glycine max
  Coding DNA Sequence Number=SeqID_66654
MDSFASWKMNGSGMEKEERERRRHFKEKMSLEEAQHHRRPWIRAWRNKEMNEGRGREEHEILCSKRALKSEPTNPRSIPRFSTKCT

SEQ ID NO: 158340 - protein, 55 aa, Glycine max
  Coding DNA Sequence Number=SeqID_66655
MILVGNQREKGKVYGELGLWLKACRADGHDICQGADLVQGYKGMSHIISMTQMQQ

SEQ ID NO: 158341 - protein, 140 aa, Glycine max
  Coding DNA Sequence Number=SeqID_66656
MKMKANKTRNELKVSNSNTYWLKNEERTKNSEEWRKIFTNLLTETSRKRYGSTSTRFFFAETEKGRCSPPRGILRKISKRTLVTKFTTLFVLYGKLVGLGSSSSMDSFASWKMNGSGMEKEEREETSLQGEDESRRSSPP

SEQ ID NO: 158342 - protein, 136 aa, Glycine max
  Coding DNA Sequence Number=SeqID_66657
  Subcellular localization annotation: CTP_CleavageSite=36; ConfidenceScore=5.29e-01
KGSRQNGSVTSGKGLALRAGHGGPSPEPVGCRWTARAASAARAGRRVPVGGRIGNGPFGASSPGVEQSTQNCALNVKVKKFNQARVNGGSNYDSLKRGTAPLFGPKVGFGRSIRAEDIVSGEFGWGGTSVKRYAVS

SEQ ID NO: 158343 - protein, 146 aa, Glycine max
  Coding DNA Sequence Number=SeqID_66658
MEAMKEQMATMMEVMMSMKKIIEVNAAAVAATNTVAEEKSWEVRAALFCANKHAFPPYGLPPNYTPPNVAHAPDENVNNSTPILIESQQPHSNHAHISQPMGETHEIPHHNLADFESRLGYATKGQEDGGVPLPNTLEGPQFRPQP

SEQ ID NO: 158344 - protein, 138 aa, Glycine max
  Coding DNA Sequence Number=SeqID_66659
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPGLGFRGTELEFVIMVIAVSFGKPVVPAALMNRPTRGERRFAYWALFRFLAH

SEQ ID NO: 158345 - protein, 273 aa, Glycine max
  Coding DNA Sequence Number=SeqID_66660
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=100%, E-value=1e-124, Identity=76%"; Hit description =Apocytochrome f precursor
  Pfam annotation: Domain name=Apocytochr_F_C; Domain location=163-273; Score=234.5; E_value=2.5e-67; Accession=PF01333.10; Description =Apocytochrome F, C-terminal
MQTRNAFSCIKEGITRSISISIMIYIIIRAPISNAYPIFAQQGYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGTGERGQIYLDGSKTGMVKKSYERKGGYEITIVDALDGREVIDIIPPGPELLVSEGESIKLDQPLTSNPNVGGFGQGDAEIVLQDPLRVQGLLFFFASIILAQIFLVLKKKQFEKVQLSEMNF

SEQ ID NO: 158346 - protein, 125 aa, Glycine max
  Coding DNA Sequence Number=SeqID_66661
MKLTKYRLKAQVEKDEGPSGEGQSPRVEKDEGPEAETLSRLLIKTLGHLIKFGESFSLGSLLNQYHTYQGNPCGVYPDLSSFTGSGVYPDLSSFTGSGVIQISVTCIKRSAPTQVHIIWYQSFSS

SEQ ID NO: 158347 - protein, 65 aa, Glycine max
  Coding DNA Sequence Number=SeqID_66662
MLENVIDGLTSGVATNVYWRKTLEKPKRQRSAYFENEGLGAVYAWERVLPLLLRILEGDEEIRPT

SEQ ID NO: 158348 - protein, 159 aa, Glycine max
  Coding DNA Sequence Number=SeqID_66663
MKSGDMRGYRMVTRTFRQPGANEPVDAKRLTSSYTPFAIQGQRVRWQAEIPYGHPHLSSTEGNEFDGVRMMFYSRRPETFKPNDVRDSSLLGKDDRVQWRREVSWLSNFVAFKTLKGVQIATRPTWAFQDVPTKGGVFWWKQPSSPGRAERQPPPSFPL

SEQ ID NO: 158349 - protein, 512 aa, Glycine max
  Coding DNA Sequence Number=SeqID_66664
  Gene Ontology: Mol. function=signal transducer activity; Cellular component=membrane; Biological process=signal transduction
  Homolog annotation: Hit_ID=Q93ET6; Match level="QueryCoverage=99%, HitCoverage=92%, E-value=1e-153, Identity=59%"; Hit description =Putative methyl-accepting chemotaxis protein I
  Pfam annotation: Domain name=HAMP; Domain location=188-257; Score =64.8; E_value=2.9e-16; Accession=PF00672.16; Description=HAMP domain
  Pfam annotation: Domain name=MCPsignal; Domain location=288-509; Score=318.6; E_value=1.2e-92; Accession=PF00015.12; Description =Methyl-accepting chemotaxis protein (MCP) signaling domain
  Pfam module annotation: Pfam domain module=HAMP::MCPsignal; Domain location=188-257::288-509
MKVGVRLGIAFGLVVALLVVIGITSIMKINNIKSGITSIVEDRYVKVRLGFDVRDGVNDQIKYLRGIVIDTTRPQFNVQRFQQLADATARTNAAMKKIEAIQITAVGKKKIASLLAASQQFEQQKNEVLDLVRAGKADDASYYVLKKITAVQNAYLDLAVAFADSQSSQLQQEGAGIIDDGTTAIEVTLVFSALAILAAVVMGWLLTRSIVHPLNEAVTIASKVAAGDLSSRIEIRSKDETGALMQALQAMNDNLLTIVSDVRAGSDTIAVASNQISSGNIDLSSRTEQQASSLEETASAMEQMTATVKHNADNAREANSLVAKTSGVAKEGGEVMEQVIVKMEAIALSSKKIVDIISVIDSIAFQTNILSLNAAVEAARAGEQGRGFAVVATEVRNLAQRSASAAKEIKVLIEDSVAKVDEGSRLVTHAGSTIGEVVNSVSSVAEIMSEITIASSEQSSGISEINQAITQMEAVTQQNAALVQEASAASQALQEQADRLAQSMSVFKTAAV

SEQ ID NO: 158350 - protein, 947 aa, Glycine max
  Coding DNA Sequence Number=SeqID_66665
  Gene Ontology: Mol. function=structural molecule activity; Cellular component=flagellin-based flagellum filament; Biological process =ciliary or flagellar motility
  Homolog annotation: Hit_ID=Q1LLE7; Match level="QueryCoverage=59%, HitCoverage=89%, E-value=1e-123, Identity=44%"; Hit description =Flagellin-like protein precursor
  Pfam annotation: Domain name=Flagellin_C; Domain location=866-929; Score=53.6; E_value=7.1e-13; Accession=PF00700.12; Description =Bacterial flagellin C-terminus
  Pfam annotation: Domain name=Flagellin_N; Domain location=366-493; Score=153.3; E_value=6.5e-43; Accession=PF00669.11; Description =Bacterial flagellin N-terminus
  Pfam module annotation: Pfam domain module=Flagellin_C::Flagellin_N; Domain location=866-929::366-493
MILRDAFQQNHIAAHQCDGLNKLKYQHGDGDNAKGGGPDVFRHVGGDKDQAEYRNQLFGNHPHGRSGGAPAAETAAIERDVFINEGAAQAVAVQPFVDVVHDKQQVFEIGDLFVEPQPVLTNDIAAKHLVADTVARVVIEQIVNRRRHRQRVRLFTVGGKIQRCAVRVEQPAARGANAPVACRRDARVGLADKVELRITGVALQDRQRVIAGAVINKNGLKANLILLQQAVDASFQISCGVIHRHNDANQHVVNGSLSGDLKGKNRRLPPLAYSDQRAGILFGAFSGVKKGRCTPQSSVIYQPVSPNTSCTATYLLRCCRENGNCRPRLKSEPGNDQPANQSVCPQRQQAICQKWRGAGRCDPPFIVGARDDAAGQAIGNRFSSQQNGLAVAQRNTGDGLSLVETAESALDEINNRLQRIRQLAVQGLNSTNSQSDSDAIQAEINLNLKEIDRLNTTSSFNGIRLLDGSAGKLGFQVGANDNEKISLDLSAPGFSVEALGLKDLVISGISGKVTNVTTLTGLATNMAFSNPAITVNYLPASGSPQLVRSSGDNRQYVQSSDADGKPVYYLAAVSARWDTATAAGNVSISRSNPAPLYSNVSSIASRTIPAVNYQDSSGSALSTTPAATLTQDNGQYYIEQNNSWYPATLSFGSSGAVTARMTGGAAKTDSDFATLPTTVTDTPAIDTSTASLSFSDASGNAVSNGRLLRSGGQYVMEVDNGGGSYQYYNAAVSATSDGTSNALSIVATSASSINSFSAVNSVTGTSYIRLDPANVDVRYTDVDGNSSNDVLKLDADGNYYMDVPNGNLDKTATFVRSDSSGNLMLKTLQGVGDVQIYFQAALSSVTDASTNFTTLRVAETGSEIRLKHPDDPLATLDRAIGQIDSQRTRLGAVANRLLSAQTLQGNATAAIAASRSRIEDADYATEVLQPVASANSAAGQQRPAGAG

SEQ ID NO: 158351 - protein, 81 aa, Glycine max
  Coding DNA Sequence Number=SeqID_66666
MPLITARVVAAQFIAHSATVREMKCAMNRAATDAADNRTGSSGAIYCAMPFNCASQVTINGDPAVSARFCRVRNFAHRHRP

SEQ ID NO: 158352 - protein, 191 aa, Glycine max
  Coding DNA Sequence Number=SeqID_66667
ILAFRGLHVLAFGGLHALAFKGLHVLAFRGLHVLTFRGLHALTFRGLHVLALRGLHALAFRGLHVLLLRGLHVLAFRGLHALTFRGLLVLTFRGLACPRLQRAAQDYTSLLQRTTRPRLWWVARPRLQRTARPCLQRTAHPRLQRAARPRLQRQHVLNFKGLHTLTFRGLRVLTFSGLHSYTLGEFKVLCP

SEQ ID NO: 158353 - protein, 69 aa, Glycine max
  Coding DNA Sequence Number=SeqID_66668
MSVILTREVRVTLWLPAPFVNQGSNEPVHAQRLTSSSAPFAIQGQRVRWQVKIPYGHSHFSSTEGNKFD

SEQ ID NO: 158354 - protein, 130 aa, Glycine max
  Coding DNA Sequence Number=SeqID_66669
MRGYHMVTRTFRQQGENEPIDARRLTSSSTPFVVLTREVRGHAGLPYGYPHLSSTRGKRALDARRLTSFSAPFVILTRQVSQPGTNEPVDARRLTSSSAPFVVLTHEVRGHTGLPYCYPHRSSTMGKRAK

SEQ ID NO: 158355 - protein, 554 aa, Glycine max
  Coding DNA Sequence Number=SeqID_66670
  Gene Ontology: Mol. function=aspartic-type endopeptidase activity; Cellular component=endoplasmic reticulum; Biological process =proteolysis
  Homolog annotation: Hit_ID=A7PIR8; Match level="QueryCoverage=72%, HitCoverage=93%, E-value=1e-159, Identity=69%"; Hit description =Chromosome chr13 scaffold_17, whole genome shotgun sequence
  Pfam annotation: Domain name=Asp; Domain location=74-432; Score= -82.6; E_value=1e-08; Accession=PF00026.14; Description=Eukaryotic aspartyl protease
  Subcellular localization annotation: CTP_CleavageSite=86; ConfidenceScore=5.47e-01
MFSILLLLLPPLTITLFTVFLQIQTTSSLSSSLQTPLILPLKTQTLPYGLVSLPTPSSTRKVSFYHNVTLTVSLTVGTPPQSVTMVLDTGSELSWLHCKKQQNINSVFNPHLSSSYTPIPCMSPICKTRTRDFLIPVSCDSNNLCHVTVSYADFTSLEGNLASDTFAISGSGQPGIIFGSMDSGFSSNANEDSKTTGLMGMNRGSLSFVTQMGFPKFSYCISGKDASGVLLFGDATFKWLGPLKYTPLVKMNTPLPYFDRVAYTVRLMGIRVGSKPLQVPKEIFAPDHTGAGQTMVDSGTRFTFLLGSVYTALRNEFVAQTRGVLTLLEDPNFVFEGAMDLCFRVRRGGVVPAVPAVTMVFEGAEMSVSGERLLYRVGGDGDVAKGNGDVYCLTFGNSDLLGIEAYVIGHHHQQNVWMEFDLVNSRVGFADTKCELASRRLGKWRQQRSINGRLLRRDVNAAARRHHDAHALVNDVDALEHIHRVVVVGNGDVEHVNVVHEVVHDAVATLDIDDDLAAGRRQGIVANGLRGIGVVGRGVLNGGEGAARLTKGRE

SEQ ID NO: 158356 - protein, 109 aa, Glycine max
  Coding DNA Sequence Number=SeqID_66671
  Homolog annotation: Hit_ID=A7PIS5; Match level="QueryCoverage=67%, HitCoverage=50%, E-value=1e-13, Identity=54%"; Hit description =Chromosome chr13 scaffold_17, whole genome shotgun sequence
  Pfam annotation: Domain name=DVL; Domain location=84-102; Score=40.4; E_value=6.4e-09; Accession=PF08137.3; Description=DVL family
  Subcellular localization annotation: CTP_CleavageSite=73; ConfidenceScore=5.60e-01
MVSSNCAPTCSNGTTTAGNNNNNNNNTDQTTAPPLYFSNSEKLRLPKKEGRSSTTSSPLIKNSSSSSSTQRKCAFARKCARLVKEQRARFYIMRRCVIMLICWHEYNDS

SEQ ID NO: 158357 - protein, 682 aa, Glycine max
  Coding DNA Sequence Number=SeqID_66672
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=A7QEA5; Match level="QueryCoverage=100%, HitCoverage=77%, E-value=0.0, Identity=75%"; Hit description =Chromosome chr1 scaffold_84, whole genome shotgun sequence
  Pfam annotation: Domain name=APC2; Domain location=621-680; Score =122.0; E_value=1.8e-33; Accession=PF08672.2; Description=Anaphase promoting complex (APC) subuni
  Pfam annotation: Domain name=Cullin; Domain location=236-578; Score =204.9; E_value=1.9e-58; Accession=PF00888.13; Description=Cullin family
  Pfam module annotation: Pfam domain module=APC2::Cullin; Domain location=621-680::236-578
MDGEFCDDASQNKDGMNLDEKGKICNKVGEMDVDECYSDHRFSENSRLVKNIGKVVLDLRNLGFTSMAEDAYASAIFLLLKAKVHDVAGDDFRSSVLQSIKSWIQAVPLQFLHALLVYLGDVVSYESTSSGLKSPLAPQPSSCCPGIDTPSEGLVRWKLRLEYFAYETLQDLRIAKLFEIIVDYPESSPAIEDLKLCLEYTGQHSKLVESFISALRYRLLTAGASTNDILHQYVSTIKALRTIDPAGVFLEAVGEPIRDYLRGRRDTIKCIVTMMTDGTGAHSSSSGNPGDSLLEELNRDEEIQENAGVDDFNTDDRQAWINAMRWQPDPVEADPLKGSRNQRKVDILGMIVSIIGSKDQLVHEYRTMLAEKLLNKSDYDIDSEIRTLELLKIHFGESSLQKCEIMLNDLIGSKRTNSNIKATINQPSQTSVEVGDNAISMDAISATIISSNFWPPIQDEPLNLPEPVDQLLSDYAKRFNEIKTPRKLQWKKSLGTIKLELQFQDREIQFTVAPVHASIIMKFQDQPNWTSKNLAAAIGIPADVLNRRINFWISKGIIAESQGADSSDHVYTIVENMAETSKNGASTGCAQELLGGEEEEERSVASVENQLRKEMTVYEKFILGMLTNFGSMALDRIHNTLKMFCIADPPYDKSLQQLQSFLSGLVSEEKLELRDGMYFLKK

SEQ ID NO: 158358 - protein, 31 aa, Glycine max
  Coding DNA Sequence Number=SeqID_66673
MEFEMVRGIRLELCAGICGWSTSWTPEVFIP

SEQ ID NO: 158359 - protein, 273 aa, Glycine max
  Coding DNA Sequence Number=SeqID_66674
  Gene Ontology: Mol. function=transferase activity, transferring glycosyl groups; Cellular component=membrane
  Homolog annotation: Hit_ID=Q9CAY4; Match level="QueryCoverage=99%, HitCoverage=54%, E-value=1e-80, Identity=54%"; Hit description =Putative uncharacterized protein F24K9.9
  Pfam annotation: Domain name=DUF604; Domain location=1-246; Score =457.2; E_value=2.2e-134; Accession=PF04646.3; Description=Protein of unknown function, DUF604
MAFGGGGFAISYALATQLAKIMDGCLSRYFFFYGSDQRVWACIHEIGVPLTRENGFHQFDIRGNPYGFLAAHPLVPLVSLHHLDQLSSLFPNQTQINSMKKLISAYHIDPARIVQQIICYDHKRGWSISISWGYTIQIYTALLIAADLQMPLQTFQTWRSSMNGPFIFNTRPMSSDPCQQPTMFFLDQATKVGKSGSITIYKRHEGNESKCLRSGTNNLELQRIRVTALKLDPEYWKNVPRRHCCQLLGGGSIKNGSMDIRIKKCRSHETITI

SEQ ID NO: 158360 - protein, 1257 aa, Glycine max
  Coding DNA Sequence Number=SeqID_66675
  Gene Ontology: Mol. function=ARF guanyl-nucleotide exchange factor activity; Cellular component=intracellular; Biological process =regulation of ARF protein signal transduction
  Homolog annotation: Hit_ID=A5BJQ1; Match level="QueryCoverage=100%, HitCoverage=87%, E-value=0.0, Identity=82%"; Hit description =Putative uncharacterized protein
  Pfam annotation: Domain name=Sec7; Domain location=561-748; Score =400.6; E_value=2.3e-117; Accession=PF01369.11; Description=Sec7 domain
MGRLKLQAGINAIEEEEPEECDAAYPNKTTLACMINSEFGAVLAVMRRNVRWGGRYMSGDDQLEHSLIQSFKTVRRQIFLWHHHQWQAINPSLYLQPFLDVIRSDETGAPITGVALSSVYKILTLDVIDHNTVNVEDAMHLVVDAVTSCRFEVTDPSSEEVVLMKILQVLLACMKSKASIMLSNQHVCTIVNTCFRIVHQAGSKEVGNTDHALVNGSTNLKQELVGKKFIQRGIGAGERTILFITGGLDNEYAFGSRQLENGSMTSEYDNQSLSTNSAPNDASVVKATVMDKNTAITISGKEGGPYDMHLMTEPYGVPCMVEIFHFLCSLLNVVEHTGMGPRSNTLAFDEDVPLFALNLINSAIELAGPSICRHPRLLNLIQDELFHNLMQFGLSMSPLILSMVCSIVLNLYRHLRTELKLQLEAFFSCVILRLAQSRYGASYQQQEVAMEALVDFCRQKTFMVDMYANFDCDITCSNVFEDLANLLSKSAFPVNCPLSAMHILALDGLIAVIQGMAERIANGSVSSEYSPVNLEEYTPFWMVKCENYNDPNHWVPFVRRRKYIKRRLMIGADHFNRDPKKGLEFLQGTHLLPDKLDPQSVACFFRYTAGLDKNLVGDFLGNHDEFCVQVLHEFAGTFDFQDMNLDTALRLFLETFRLPGESQKIHRVLEAFSERYYEQSPHILANKDAALVLSYSMIMLNTDQHNVQVKKKMTEEDFIRNNRHINGGNDLPREMLTEIYHSICKNEIRTTPEQGVGFPEMTPSRWIDLMHKSKKTAPFIVSDSKAYLDHDMFAIMSGPTIAAISVVFDHAEQEEVYQTCMDGFLAIAKISACHHLEDVLDDLVVSLCKFTTLLNPSSVEEPVLAFGDDMKARLATVTVFTIANRYGDYIRTGWRNILDCILRLHKLGLLPARVASDAADESEHSAETVHGKPIMNSLSSAHMQSIGTPRRSSGLMGRFSQLLSLDTEEPRSQPTEQQLAAHQRTLQTIQKCHIDSIFTESKFLQAESLLQLARALIWAAGRPQKGNSTPEDEDTAVFCLELLIAITLNNRDRIGILWQGVYEHISNIVQSTVMPCALVEKAVFGLLRICQRLLPYKENIADELLRSLQLVLKLDARVADAYCEQITQEVSRLVKANASHIRSQLGWRTITSLLSITARHIEASEAGFDALLFIMSDGTHLLPANYVLCVDTARQFAESRVGQAERSVRALDLMAGSVNCLALWTSEAKEAMEEEQVSKLSQDIGEMWLRLVQGLRK

SEQ ID NO: 158361 - protein, 831 aa, Glycine max
  Coding DNA Sequence Number=SeqID_66676
  Gene Ontology: Mol. function=oxidoreductase activity; Cellular component=mitochondrion; Biological process=metabolic process
  Homolog annotation: Hit_ID=A7PIP6; Match level="QueryCoverage=97%, HitCoverage=97%, E-value=1e-103, Identity=70%"; Hit description =Chromosome chr13 scaffold_17, whole genome shotgun sequence
  Pfam annotation: Domain name=adh_short; Domain location=578-746; Score=80.1; E_value=7e-21; Accession=PF00106.16; Description=short chain dehydrogenase
MVAESQQSSSSSINRGARWSLNGMTALVTGGTRGIGHAIVNDLAAFGAAVHTCSRNQTELNKCLQEWQSQGFEVTGSVCDVSSPPQREKLIQEAASTFNGKLNIYVNHCPIVVKNKVYGWGSKPFRILNGWFQDRRFFEVVKEAWKKQDVEQGDLNEAQFKLKLQLQEDSWIVATFNESLLLQKSRGMYMDGMWLEEPIKVKEEVKNFFENRFMEDKYKRPKLDGVNFKRILNEDNGMLLEEFEEDEEFWEMMKLNIMIFLKEFHRHGVLPSGTNSSFTALIAKVALELLGWRAIERCANVLNCKVLTLPFIYLGLLIGANHRRDSLWGQVLTSKYGGWHGLMGNSALSWKSLWWKDLKKLCGSEVDNPWFDENILWKIGRGDKCRFWKDVNNVGVNYRKPTIEYSAEEYSEMMTVNLNSAFHLCQLAYPLLKASGKGSIVFLSSVAGVTSMGTGSVYAASKAAINQLTKNLACEWAKDNIRSNCVVPWTTRTPLIEHLLQNQTFVEDVMSRTPLKRIAEPEEVSSLVAFLCLPAASYITGQVICADGGVTEEELVIEEMADAAKGTYRASRWSLNGMTALVTGGTRGIGHAIVEDLCGFGATVHTCSRNQAELDKCLTEWRSKGFLVSGSVCDVSSQPHREKFIQEVTSIFNGKLNIYVNNVGVNYRKPTIEYTAEVYSQIMAVNLDSAYHLCQLAYPLLKASGMGSIVFISSIAGVVSLGTGSVYAACKAATNQLTKYLACEWAKDNIRSNCVVPATTNTPLVEHLLRNKKYVEEMLSRTPLGRIAEPEEVSALVAYLCLPAASYITGQVVLVDGGLSVNGFQTSMRIT

SEQ ID NO: 158362 - protein, 79 aa, Glycine max
  Coding DNA Sequence Number=SeqID_66677
MGVNDEERWRPIQLLVNNNGGGGGGSSQQDTLASDDDRIGDGERVEVCERREWNWRELIRKWSEEKVRVHGIGGVQKGN

SEQ ID NO: 158363 - protein, 435 aa, Glycine max
  Coding DNA Sequence Number=SeqID_66678
  Gene Ontology: Mol. function=metal ion binding
  Homolog annotation: Hit_ID=Q0WSN2; Match level="QueryCoverage=54%, HitCoverage=44%, E-value=7e-93, Identity=72%"; Hit description =Putative uncharacterized protein At2g39830
MESAITDTGECQPLYHSIRDYYEGMNMKIDQQVPMLLVGREALNEAIVGEKNGFHHLPETRGLCLSEEQTVTSVYRWPRIGGHRLISMRSQAQRLPRKCEVTAILVLYGLPRLLTGAILAHELMHAWLRLKGYQNLSLEVEEGICQVLSYMWLDAEVMSCARTTPSTSSSASSSSYSNSSKKGVKSLVENKLGEFFMNQIANDSSPAYGGGFRAANQAVNKYGLRCTLEHIRLTGWTAISSCYFIPQGECGVPIYVWMSMWRWVVAFGCGDGVGRRFWGETIKAFAWKMKDKMGDICHFGSAPNKNGASPFLLRLETVHPRSCAPLSLKVSFFLSSVVEVGFWWGWGWVLVKNEKDFYDVKLDLLCTSDGCGKKSWRRREKQKKGLDLRCGKKRRTGRSWDCGERRGRKEIEEEDKRGMLGFLKKWEVQDTFREV

SEQ ID NO: 158364 - protein, 87 aa, Glycine max
  Coding DNA Sequence Number=SeqID_66679
MNRKRGGRGSFIKGGKRGVGPPCAALERRDFQKVTLSNLFYLSLEVGRDKYRTMTLTSELKLKFCGYIPEIVSNIYLHYYIQFVLKT

SEQ ID NO: 158365 - protein, 69 aa, Glycine max
  Coding DNA Sequence Number=SeqID_66680
MATIGNCDCDFGINVDFLEGVGREDSMQKQKPLCAELPTWTTFLMFRIPNGHSDQKQQEQPYELAHLRN

SEQ ID NO: 158366 - protein, 28 aa, Glycine max
  Coding DNA Sequence Number=SeqID_66681
MACQGLDRRKSKRPTLTRKRMEFRWESN

SEQ ID NO: 158367 - protein, 78 aa, Glycine max
  Coding DNA Sequence Number=SeqID_66682
ACGWWCWVFDAVLVVGGVGCLTQCLWLVVLGGGSDAWLMVVVHGGGGWRFFVGSADGGGSRRRRVAVLCRLGCSGALT

SEQ ID NO: 158368 - protein, 109 aa, Glycine max
  Coding DNA Sequence Number=SeqID_66683
  Homolog annotation: Hit_ID=A2Q3D2; Match level="QueryCoverage=81%, HitCoverage=17%, E-value=1e-07, Identity=33%"; Hit description =Putative non-LTR retroelement reverse transcriptase, related
MVAAFMDEIDGVQIHLSRLDHLTWRADPSGSYSTKSAYNLLMEDGSSDYEDNASRILWNLKIPPRAAAFSWRIFKNRLPTKANLRRRQCICIYVLGKGRNSGGKIRGLD

SEQ ID NO: 158369 - protein, 238 aa, Glycine max
  Coding DNA Sequence Number=SeqID_66684
  Gene Ontology: Mol. function=catalytic activity; Cellular component =nucleus; Biological process=mRNA modification
  Homolog annotation: Hit_ID=A7R0D7; Match level="QueryCoverage=68%, HitCoverage=59%, E-value=2e-28, Identity=32%"; Hit description =Chromosome chr6 scaffold_305, whole genome shotgun sequence
MLLVSKFICKLKVLPLGLKLSVLLESAVSTNNYDPPYKVNGDDKMKSQSIRAVVHQDNKTINYENRTLTPIQTSSDQTQEALHLFVSQYRSGLSPDKYTIPCILNVCACSVDGTTSAHEHFQCVKSGLVRHVLVGSTLVDMYMKTGNVRDERRVFDEKGDRDVVFWTSLLAGYSLNGFNDQVWELFSLANQCKIVVGMQIHALVVKHSFEVKGRVCIPLITMLSKSGMIRDMPLVYSP

SEQ ID NO: 158370 - protein, 77 aa, Glycine max
  Coding DNA Sequence Number=SeqID_66685
MLQCEEFSSKLRYDFEIPNGENVRNWVANMILKFHDDPTVNGFEIVVFLRLVWWAAGKRKGFERRREKTKMRLKGDS

SEQ ID NO: 158371 - protein, 141 aa, Glycine max
  Coding DNA Sequence Number=SeqID_66686
MGEVEEVQEQMKADTEALKEQMATMMEAMMSIKEIMEVNAVAIAATCTITEVDLTPHRAQPNKSSNLKYANFEPCLGYATEGQAVGDIPLQNILEGPQFRPQPQPFYGKMVGYTPSSFADLIFAGEKIKVGLERGKSDHPP

SEQ ID NO: 158372 - protein, 55 aa, Glycine max
  Coding DNA Sequence Number=SeqID_66687
MDEFIELMKEHNLETLGLSGILIPSPKQRIAESPQGRANRMLKPDFPKKGTGKEK

SEQ ID NO: 158373 - protein, 61 aa, Glycine max
  Coding DNA Sequence Number=SeqID_66688
MAEDIVVFEMHCRLLKTLSSSKCKGADDLDCLCKTKDYDSLWKVKADDPDCLRKTKDYDSL

SEQ ID NO: 158374 - protein, 65 aa, Glycine max
  Coding DNA Sequence Number=SeqID_66689
MENASNALLRSGFAGFAHMSSALSLILWITVLPPLSELIPLAAAERPSAARNSYDHDYEFELGTL

SEQ ID NO: 158375 - protein, 192 aa, Glycine max
  Coding DNA Sequence Number=SeqID_66690
AAASGDKSCLPGWTQDDSYRDKAQRATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIRPAGKQAMTMITNSSSVPHFTRDTAPQRPQHPSTVSGARPMSFPYENSCAVPW

SEQ ID NO: 158376 - protein, 130 aa, Glycine max
  Coding DNA Sequence Number=SeqID_66691
MNVLNGVTLFCKITRAPNIFMICVHRDSLGSDQGVPMNPKRIKVIPEWPTPPTPLIELVRNHVPSWEDAQEMGFQTLPYFNIPNTTNIYAFILFTGVKEKSPEFLEPRDLRSNPFQGGGNDAILPRKGIG

SEQ ID NO: 158377 - protein, 95 aa, Glycine max
  Coding DNA Sequence Number=SeqID_66692
MAKRCADNHNFLHMSSGSPPLDDKRCRMTIICVCVPPDSIVSGWDKGSPPLDDKRVQLDNNLSLRAIGLNRLWMAKSCADYHNLSPHVIGLAASG

SEQ ID NO: 158378 - protein, 324 aa, Glycine max
  Coding DNA Sequence Number=SeqID_66693
  Homolog annotation: Hit_ID=A7P547; Match level="QueryCoverage=25%, HitCoverage=10%, E-value=3e-07, Identity=39%"; Hit description =Chromosome chr4 scaffold_6, whole genome shotgun sequence
MVEELEAYEQLYDIFKGPQVQGNLSQVWRMKIPLKLGASNVFCPLCNSESESVNHILFRAQRFYKYGRGVEEDFNDFVIWVTINECTVYGMTEVVIVLFGWDDEAFCVFTNPIMIVMMSIWETTGGGSFLKGEKPQGIAFNYWLDAFCEIGVYAKDTFLLPWGSGVSNTQTHQIAARKEKQMEALKAALGIVSSEANEINEDGTDGLGNDGKNGPNVEGNSKPEHSFLDRDFSRKKQMVEDQKDENTKKKSVKDTKHHKKVETRKKKYEDDSSDSDSSLSDEKRGTRKRGKEYTSSSDESDSDSDAKRKLKAEKKRKIPKHRKK

SEQ ID NO: 158379 - protein, 64 aa, Glycine max
  Coding DNA Sequence Number=SeqID_66694
  Gene Ontology: Mol. function=DNA topoisomerase (ATP-hydrolyzing) activity; Cellular component=chromosome; Biological process=DNA topological change
  Homolog annotation: Hit_ID=A8UPF5; Match level="QueryCoverage=100%, HitCoverage=7%, E-value=5e-21, Identity=68%"; Hit description=DNA topoisomerase IV subunit A
MTEENSHEGESLKKVSGLYKDWFLDYASYVILDRAIPSVYDGLKPVQRRIMHSMRELEDGRYNK

SEQ ID NO: 158380 - protein, 114 aa, Glycine max
  Coding DNA Sequence Number=SeqID_66695
MTLVSACYRTLSLTDNERVFIRITYLGISACHLTSQRKNVYTDNRLGISAYHLSSRVRINRNHLCRQSLVYLHTSPDFMGQDNRKCGVVDKSEALAPTYPQFVMRNSDLRSSFL

SEQ ID NO: 158381 - protein, 321 aa, Glycine max
  Coding DNA Sequence Number=SeqID_66696
AEFDIPEAFDQRTKKKILQTMGERDPSWEDVPKKAQAIQKQNTALLVLSRRGYEYLEKKMMDEKTKKKLEEAAQTGSIDTVIDPSSSIRQHVKWKMARIKKIGQMTSEAAKQIADKIDSLEEQASQGSFVTHGRQDMQSQFQSQRQSQGLALPPEPEVGPSVACVSIKESCVDPLGNDLDTGRVYEGSTTIHNIPLLHDQVKFGIEEVKDADAPIPIPTEEVKLVGHALNTFLAWPTNLVKRLSEQGAVGPTKSADRPDHEVDDPLYLMTLIIQQLFLKPLQVMWDATVFGVFNEDFPLYIKHEDLSEIAHSGQCLSISVI

SEQ ID NO: 158382 - protein, 372 aa, Glycine max
  Coding DNA Sequence Number=SeqID_66697
  Subcellular localization annotation: CTP_CleavageSite=11; ConfidenceScore=5.24e-01
MPAAAAAQTPAAAAGRNSLQTPRPAHPPRWSNSFLPSDYTGCHHVGNLCRQRGEKTAGAIVNLSGQQQMRQLVRLRIDLLLRIKADVAALAKAQCRVAGTKVPFTVNHADVTVNHIALRLLTGFRLRLPDVDTERKCRGDRRKAGLLPRPEPRNMTMAATKPRQQRNGLTRRQALPLAPDAPHRQAERKQQQHQPAAQQQAGMQVVIEKQHHAKNHLAAAQHKMPHPALALNQRRAQAAKQAVKQQADFHHRQQQFLQLPFVTVPQRAGQQRTDKNQGKQQIEPALQRHLAAQQIDMPIDQHVRHDHAGQQHAAQRQAINQQTITHQQLASGQQQQDGASLAATGTPLRWGLTHRWLSFSELRAAFRKDGFT

SEQ ID NO: 158383 - protein, 629 aa, Glycine max
  Coding DNA Sequence Number=SeqID_66698
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GKS3; Match level="QueryCoverage=49%, HitCoverage=72%, E-value=1e-132, Identity=74%"; Hit description =Integral membrane sensor signal transduction histidine kinase precursor
  Pfam annotation: Domain name=HATPase_c; Domain location=509-616; Score=129.8; E_value=7.9e-36; Accession=PF02518.17; Description =Histidine kinase-, DNA gyrase B-, and HSP90-like ATPase
  Pfam annotation: Domain name=HisKA; Domain location=410-470; Score =56.2; E_value=1.1e-13; Accession=PF00512.16; Description=His Kinase A (phosphoacceptor) domain
  Pfam annotation: Domain name=Response_reg; Domain location=5-117; Score=146.9; E_value=5.5e-41; Accession=PF00072.15; Description =Response regulator receiver domain
  Pfam annotation: Domain name=Trans_reg_C; Domain location=156-228; Score=45.0; E_value=2.7e-10; Accession=PF00486.19; Description =Transcriptional regulatory protein, C t
  Pfam module annotation: Pfam domain module=HATPase_c::HisKA::Response_ reg::Trans_reg_C; Domain location=509-616::410-470::5-117::156-228
MQENYKILVVDDDMRLRALLERYLTEQGFQVRSVANAEQMDRLLTRESFHLMVLDLMLPGEDGLSICRRLRSQSNPMPIIMVTAKGEEVDRIVGLEIGADDYIPKPFNPRELLARIRAVLRRQANELPGAPSQEEAVIAFGKFKLNLGTREMFREDEPMPLTSGEFAVLKALVSHPREPLSRDKLMNLARGREYSAMERSIDVQISRLRRMVEEDPAHPRYIQTAIALLTPQFVCPHPVVDRYLAVRQPGNDLPGGAQFRHSSQPAAVQQSPRLRSAYADDRSAAAGGWYAAGSAAGLPARNLSEQMAQQLGGPTDVRVEVNKNSPVVWLKTWLSPDIWVRVPTDRNPSGRLLAAVPLYPGDNAAGDWRRLAVGKGIIPPPLREYGASEVRSVTRAFNQMAAGVKQLADDRTLLMAGVSHDLRTPLTRIRLATEMMGEEDGYLAESINKDIEECNAIIEQFIDYLRTGQEMQTERADLNSVLGEVVAAESGYEREIENAVMDAELMLDINPLSIKRAVANLVVNAARYGNGWIKVSSGQELNRAWFQVEDDGPGIKPDQLQHLFQPFVRGDSARSTSGTGLGLAIVQRIIDAHDGSLEIGDSERGGLRIRAWLPIPENSATTAVSSTVS

SEQ ID NO: 158384 - protein, 354 aa, Glycine max
  Coding DNA Sequence Number=SeqID_66699
  Gene Ontology: Cellular component=1-2nm peptidoglycan-based cell wall; Biological process=regulation of cell growth
  Homolog annotation: Hit_ID=A8GKR6; Match level="QueryCoverage=89%, HitCoverage=53%, E-value=6e-41, Identity=63%"; Hit description =Intracellular growth attenuator IgaA precursor
  Pfam annotation: Domain name=IgaA; Domain location=37-354; Score= -154.3; E_value=8.6e-13; Accession=PF07095.2; Description =Intracellular growth attenuator protein IgaA
MTSAYRSPQHCATRSAGHHGDIHLPTAANNFLLSAHMSTLIVILAVMLACSLVAGIGYWYAMRHRPPLAKPLPFISPPCRKLTDEERAAVEKYIASLGKARQHSGGRSTRSSREPEALALTAQSNNVYPVTRSITRYGLSTDDPHKWRYYLDEVEVHLPPLWEQYIAEENYVELIRTQTLPLGDLAQRPLAGELCGGTTGAATAGAADVDQRFDSERHLLRLPAVFPQSGAARQPDAVDCAARRRDRCCQPVEQSNISLGIIDLIYPAHWQPYVAHDLGQVTDVDIYLNRQVVRQGRFLSLQDEVRNFPVQRWRKNLVLACGSLLVLVMLVSWIPLSMPIKLSLAWLKGTESVE

SEQ ID NO: 158385 - protein, 122 aa, Glycine max
  Coding DNA Sequence Number=SeqID_66700
MLTKPPSSSSPYSILHCTRRGKVMRIMKLAKYRLKAQVEKDKGLSGEGQSPRVEKDEGPSNPCGVYPDLSSFTGSGVYPDLLMRIMKLAKYRLKAQVEKDKGLSGEGQSPRVEKDEGPSGEG

SEQ ID NO: 158386 - protein, 52 aa, Glycine max
  Coding DNA Sequence Number=SeqID_66701
MLQPCGIDTGLKEHSNWVTPKGYTPKSPSGPLPPDSNTVHELYNTHDLTLVF

SEQ ID NO: 158387 - protein, 196 aa, Glycine max
  Coding DNA Sequence Number=SeqID_66702
  Gene Ontology: Mol. function=nucleoside-triphosphatase activity; Cellular component=chloroplast
  Homolog annotation: Hit_ID=Q2PMM5; Match level="QueryCoverage=95%, HitCoverage=15%, E-value=3e-52, Identity=92%"; Hit description =Protein ycf2
MNIPDSEGKNLHQYLNFNSNMGLIHTPCSEKYLPSEKRKKRSPCLKKCLEKGQMYRTFQQDSVFSTLSKWNLFQTYIPWFLTSTGVRYIIGEIHIYELKGPNNPLCNQLLESIGLQIFHLKKWKPLLLDDQDTSQKSKFLINGGTISPFLFNKIPKWMIDSFHTRKNRRKSFDNTDSYFSMISHDPDIAESRETIS

SEQ ID NO: 158388 - protein, 267 aa, Glycine max
  Coding DNA Sequence Number=SeqID_66703
MAPRKLFAKRSRKDAAAEGTSATPEFDNHRFRSAEHQQRFEAIKGWSFHRERRVQLRDDDYTDFQEEIARRRWMSLVTPMAKFDPDIVLEFYANAWPMEESVRHIRSWVRGQWIPFDANAISQFLRDPLVLEEGQEGQECEFSQRRSRADRFDEEAIAQLLCILGQDFARTAAGRRVRIMRTSMTTLTQMWMTLLLSNVLPSDHNSDLPLPKCPLVYAILTRMSVHVAQLIADAVYLFAGMPPTRHPLDPDKSNRALGFPALITGLC

SEQ ID NO: 158389 - protein, 165 aa, Glycine max
  Coding DNA Sequence Number=SeqID_66704
MSEVEEVQEQMKADMEAKKDQMATMMEAMLSMKRIMESNATAVATTSATAEVDPTHLSGINQMSRPVLNVVGQGGEALGSMGGPHVVQSKNSLLLYGLPPNYTPPNVRASIAKRSFSALSMVEEFGRASISRPRAKREISALSATIVFSQAQCMTDAKLKSTYSR

SEQ ID NO: 158390 - protein, 829 aa, Glycine max
  Coding DNA Sequence Number=SeqID_66705
  Gene Ontology: Mol. function=methyltransferase activity; Cellular component=nucleus; Biological process=rRNA processing
  Homolog annotation: Hit_ID=A7P8Y6; Match level="QueryCoverage=95%, HitCoverage=93%, E-value=0.0, Identity=65%"; Hit description =Chromosome chr3 scaffold_8, whole genome shotgun sequence
  Pfam annotation: Domain name=FtsJ; Domain location=22-203; Score =275.6; E_value=1e-79; Accession=PF01728.10; Description=FtsJ-like methyltransferase
  Pfam annotation: Domain name=Spb1_C; Domain location=599-806; Score =280.1; E_value=4.5e-81; Accession=PF07780.3; Description=Spb1 C -terminal domain
  Pfam module annotation: Pfam domain module=FtsJ::Spb1_C; Domain location=22-203::599-806
MGKAKGKHRLDKYYHLAKEHGYRSRASWKLVQLNNKFHFLESARAVLDLCAAPGGWMQVAVKSMPVNHLVIGVDLSPIAPVRGAIAIQEDITRPECKSRIKKLMNDHGCRAFDVILHDGSPNVGGAWAQEATSQNALVIDAVKLATQFLAPKGIFVTKIFRSQDYSSVVYCLKQLFEKVEVDKPAASRSESAEIYVLGLKYKAPAKIDPRLLDVKHLFQGSVEPQPKVVDVLRDSKQKRHRDGYEDGDTTLRKLSSAANFIWSNSPLEILGSVTSITFTDPADSPIKDHDLTTEEVKSLCDDLRVLGKQDFKHLLKWRIQIRKALSPTQKPDSTTTEQMGNEPKVDEEDRILNEMEELTYVMDRKKKRAKKLLAKRRAKDKARKATGMQMDAIDDGYVDQELFALSSIKGKKDLVAVDNTEYEGDEGELEDSENEETHESPEHSSGDLEDSDEERKRYNEQMEDLMDKAYERFVIRKEGSAKQRKRIKKSYDAKDQLLEGGEDDDIVQSKYDSDEDQGDQEANPLMVPLNDGAELTQEEVMNKWFSQDVFAEAAEEGDFEKDESKDEMDIDEPKEKISIAKKVKENKTAAPAVVAHPQPQPSKAADDFEIVPAPDTDSSDDSSSDEWEEDTEAKAEILAYAKKMMRKKQREQMLDDAYNKYMFDDEGLPKWFLDEERRHRQPIKPITKEEIAAMKAQFKEIDARPAKKVAEAKARKKRVAMRKLEKVRKKANAISDQTEISDSSKRKQIEQLYKRAVPKRPKKEYVVAKKGVQVRAGKGKVLVDRRMKKDARKHGMGKAGKGGSKTKGKAPKGKGSSKASAKKGKQRTK

SEQ ID NO: 158391 - protein, 655 aa, Glycine max
  Coding DNA Sequence Number=SeqID_66706
  Gene Ontology: Mol. function=transcription regulator activity; Cellular component=nucleus; Biological process=regulation of transcription
  Homolog annotation: Hit_ID=A7P900; Match level="QueryCoverage=51%, HitCoverage=93%, E-value=7e-85, Identity=54%"; Hit description =Chromosome chr3 scaffold_8, whole genome shotgun sequence
  Pfam annotation: Domain name=HLH; Domain location=218-268; Score =34.7; E_value=3.2e-07; Accession=PF00010.17; Description=Helix-loop -helix DNA-binding domain
MLHCLNTSGNLGATCSDMTVLERQREATIKWQQHLQNNQPPYLTDFNVNVNAVFSSSSSSSQSQGLVMNICADSALGEVLTHSVKPDPGVWPEFDAGFGSSSGFLPTISPTCSRGGDLVSPKENMASAKENTKKRKPQNSKVVAASDNKQDKRVKASGEEGESKVTEQTSNKNGKSNANKNNNRETTSAETSKDNSKGSEVQNQKPEYIHVRARRGQATDSHSLAERVRREKISERMKYLQDLVPGCNKVAGKAGMLDEIINYVQSLQRQVEFLSMKLAAVNPRLDFNLDELFTKEVFPSCAQSFPNIGMPLDMSMSNNPSYLPFNSAQQLVSCCGGLINNMGISPPNMGLRRNISTSPVPLPETFLDSSCFTQILPSSNWEGGDFQSLYNVAFDQGRTASFPSQPFTGDHLSKHNIYEMGLRKHPSPYQMNMSFVRIGDPVSNLPLLRYEEIVKSILGVSECLGTGKYLGMPSMVGRRKRAVFNYLKDREFRKVDKLVGVGSVSSAERKWKFVFDQDAMVSRVFKAKYLPKRADLVDDRTKHWNLELAGNLLQQRDLGDDALVWSLAKDGRFSVRDDSSCFISAKSALFLSSLKPVEAEAMAFLEAINWLTEMGYDKAILESDCQDMVEGILANCIANIELGAIISKGGTIYYQ

SEQ ID NO: 158392 - protein, 172 aa, Glycine max
  Coding DNA Sequence Number=SeqID_66707
  Gene Ontology: Mol. function=DNA binding; Cellular component=nucleus; Biological process=regulation of transcription
  Homolog annotation: Hit_ID=A7P902; Match level="QueryCoverage=44%, HitCoverage=79%, E-value=3e-30, Identity=80%"; Hit description =Chromosome chr3 scaffold_8, whole genome shotgun sequence
  Pfam annotation: Domain name=Myb_DNA-binding; Domain location=13-62; Score=32.7; E_value=1.3e-06; Accession=PF00249.22; Description=Myb -like DNA-binding domain
MASSSLSKQKASDSSWTPKQNKLFEKALAKYDKDTPERWQNVAKAVGGKSADEVKRHYEILLEDLRHIESGRVPLPKYKSTGSSTNVDEEESFCQVTWIEASRMALHRFRNTSSGSIWYELAYIEAKCKVKKENRMWQIAFGSGFKCNNAVWKAELLGYQYSVYCNLYYYLL

SEQ ID NO: 158393 - protein, 180 aa, Glycine max
  Coding DNA Sequence Number=SeqID_66708
MGSRFGKGRSVAVFCGSIAKGSTGGDKFVLGLGWWETTIGSGADMGTSVGRDCAEEEDTESWLGIMLKVHGGLGCGQAELSGSEFDNDNLETVQVDGGRGRDPARSCNLVVALHEVSKELGLLLYPFGLVPHRDREDGWFGKKIMWVNIMYIQHTELFRGIAWSNKMLRSLSHYGRLIFH

SEQ ID NO: 158394 - protein, 397 aa, Glycine max
  Coding DNA Sequence Number=SeqID_66709
  Gene Ontology: Mol. function=microtubule motor activity; Cellular component=microtubule associated complex; Biological process =microtubule-based movement
  Homolog annotation: Hit_ID=A7P7W1; Match level="QueryCoverage=87%, HitCoverage=33%, E-value=1e-157, Identity=81%"; Hit description =Chromosome chr3 scaffold_8, whole genome shotgun sequence
  Pfam annotation: Domain name=Kinesin; Domain location=106-395; Score =402.9; E_value=5e-118; Accession=PF00225.14; Description=Kinesin motor domain
  Subcellular localization annotation: CTP_CleavageSite=80; ConfidenceScore=6.00e-01
MASSSRARSSSPFSHRKPSTPLSSASSSTSSFTNGRVMPRSCSSSTSSFYNSGGGGRSMTPSRGHSESVCYDYGNPSPVEFGMDEEVITEPVDSSRARDSISVTIRFRPLSEREYQRGDEIAWYADGDKIVRNEYNPATAYAFDRVFGPHTNSDEVYEVAAKPVVKAAMEGVNGTVFAYGVTSSGKTHTMHGDQYSPGIIPLAIKDVFSIIQDTPGREFLLRVSYLEIYNEVINDLLDPTGQNLRVREDAQGTYVEGMKEEVVLSPGHALSFIAAGEEHRHVGSNNFNLFSSRSHTIFTLMIESSAHGEDYDGVIFSQLNLIDLAGSESSKTETTGLRRKEGSYINKSLLTLGTVIGKLSEGKASHVPYRDSKLTRLLQSSLSGHGHVSVSLDSTAL

SEQ ID NO: 158395 - protein, 386 aa, Glycine max
  Coding DNA Sequence Number=SeqID_66710
  Homolog annotation: Hit_ID=A5C3T2; Match level="QueryCoverage=40%, HitCoverage=19%, E-value=4e-31, Identity=45%"; Hit description =Putative uncharacterized protein
MENQTSSMQFLILEQVQFLKVNDDSLLQWELVDVVDAEEEIDGFGSSSDSSSVSWFESDSSPIDASIEEIRQLLLHPDVGLQDPRESEQESGLENHHYRYHQHHYHHDDVDDDDVGGDNDDGEDDDGYGLDDELVPWNVSNKFERQRMRKLGKRAFSKMHNSKKSPYLFVRPGCVRGKHGDNYKIWKEIILLQLGWMNIDYAIRKDESPVITDESSPAAHEKARYFLKTIDDQFIASDKALVSTLIMKFSPLQFTSVKSEEEKLAMERGESALLTTACGKNKAIKSQANEKGNGKIPPQANIKKVTKYFFFKKKGHMKKNFPRFQIWYEKKDAKKVMRYLQGTKDYMLMYRQTDNLDVISVKQTLTITSTMKAEFVSCFEATSRGV

SEQ ID NO: 158396 - protein, 360 aa, Glycine max
  Coding DNA Sequence Number=SeqID_66711
  Homolog annotation: Hit_ID=A7QRU5; Match level="QueryCoverage=75%, HitCoverage=61%, E-value=6e-92, Identity=63%"; Hit description =Chromosome chr13 scaffold_152, whole genome shotgun sequence
  Subcellular localization annotation: CTP_CleavageSite=46; ConfidenceScore=5.19e-01
MACLQPPWFSSLRVVSPAKLAAGPPPSTTYKPAKLLFWAVGPDNAESSEPASPDAPEPAAPVDPVELAFSKANAYKADYNNDENSAEERNVGDETPKDLPDSVKIAIEKAKKYKQNKAVAAVTETTQGSLGVSERSSGKNKVGKKGELSVSRMDFAGLDFADKKMTRGLPPGLVPISEPYFDGDLPEVELIIGDTSKFDDATTPEPEQTNKEDEAELYKPKVSTWGVFPRPGNISKTFGGGRVIRPGEVLETKEEKAVKEARTKQLLAAYKKKTGLNVDPKLKSECEEALKDGDLLMNVGKLKEALPYYEKVMDKLTFQSELHGLAALQWSICQDSLSRYVQKLHDISELLKETTRLCST

SEQ ID NO: 158397 - protein, 499 aa, Glycine max
  Coding DNA Sequence Number=SeqID_66712
  Gene Ontology: Mol. function=hydrolase activity; Cellular component =membrane; Biological process=proton transport
  Homolog annotation: Hit_ID=A7P7V7; Match level="QueryCoverage=96%, HitCoverage=50%, E-value=1e-160, Identity=76%"; Hit description =Chromosome chr3 scaffold_8, whole genome shotgun sequence
  Pfam annotation: Domain name=V_ATPase_I; Domain location=1-493; Score= 141.9; E_value=1.8e-39; Accession=PF01496.10; Description=V-type ATPase 116kDa subunit family
MFQRQTEIIRLAATRVAKYQEANPTVYTVVTFPFLFAVMFGDWGHGICLLLAALYFIIREKKLSSQPMLVIKTLECTLLPYNYVISLRQLAKSILPEINVLKLRLNRLGTTQVQSLAETILAQALLTSRLNFGLVRKLDDITEMTFGGRYVILLMAIFSIYTGFIYNEFFSVPFAIFAPSAYDCRDLSCRDATTVGLIKVRDTYPFGVDPVWHGTRSELPFLNSLKMKMSILLGVAQMNLGIVMSYFNAIFFRNSVNVWFQFIPQMIFLNSLFGYLSLLIIVKWATGSQADLYHILIYMFLSPTDDLGENQLFAGQKNLQLVLLLLAVISVPWMLLPKPFILKKQHEARHGVESYAPLQSTDESLQVESNHDSHGHEEFEFSEVFVHQLIHTIEFVLGAVSNTASYLRLWALSLAHSELSSVFYEKVLMMAWGYNNVIILIVGLIVFIFATVGVLLVMETLSAFLHALRLHWVEFQNKFYEGDGYKFHPFSFSWLDDEE

SEQ ID NO: 158398 - protein, 64 aa, Glycine max
  Coding DNA Sequence Number=SeqID_66713
MKHSQKKDIAMQHPNSELAFSLLSLNKIANTRQDIFNLKTPEKTTIPCFSMMSKISKHKQVPRP

SEQ ID NO: 158399 - protein, 217 aa, Glycine max
  Coding DNA Sequence Number=SeqID_66714
  Homolog annotation: Hit_ID=A5BRH5; Match level="QueryCoverage=93%, HitCoverage=92%, E-value=6e-35, Identity=44%"; Hit description =Putative uncharacterized protein
MDSFSFNNLQAEKANVILKHRKLQRVASLFRIIEVCIILVLISRFSMQLPVAVKNSSVYLRDLSLFMNSPRFVFLVGNVIIIALFAQFSTQGNNAPEPDLYQEFVQNTTKNHRHTETVVAEYSKKKQRMKTGEVNIGLKKDYRRCETEILSEKPHRVLRRCETENGRKSIEPATIQEVAQISCPEDGMSNEEFRQTVEAFIARQQRMRREEEEDYYL

SEQ ID NO: 158400 - protein, 288 aa, Glycine max
  Coding DNA Sequence Number=SeqID_66715
  Homolog annotation: Hit_ID=A7P8K6; Match level="QueryCoverage=98%, HitCoverage=96%, E-value=5e-59, Identity=47%"; Hit description =Chromosome chr3 scaffold_8, whole genome shotgun sequence
  Pfam annotation: Domain name=DUF241; Domain location=48-285; Score =197.1; E_value=4.5e-56; Accession=PF03087.5; Description=Arabidopsis protein of unknown function
MEASQSHFHVRSNSLPSRPHPLILQCNEHLDRLRSSNETSSSSSSLSHKLGGLQDLHECVEKLFHLSLSQEALHHECQENRVDELLNGSLRLLDVCTAAKDSLLHTKECMRELQSVMRRRKGGEVELKAEVKKFLISRKVVKKAISKALANLKGTRKNCNISSANKDNQLVSLLESVEVITLSTFQSLLQLISGTTQSKSNSWSLVSKLMQTKKVGCSQLADESEFAQLDEELQSCMFAQTSKFENTNNLQTQLEKVESLSQDLEEGLEFLFRRLIKTRVALLNILNH

SEQ ID NO: 158401 - protein, 404 aa, Glycine max
  Coding DNA Sequence Number=SeqID_66716
  Homolog annotation: Hit_ID=A7P8L2; Match level="QueryCoverage=100%, HitCoverage=94%, E-value=5e-64, Identity=47%"; Hit description =Chromosome chr3 scaffold_8, whole genome shotgun sequence
  Pfam annotation: Domain name=DUF241; Domain location=55-287; Score =146.7; E_value=6.4e-41; Accession=PF03087.5; Description=Arabidopsis protein of unknown function
  Subcellular localization annotation: CTP_CleavageSite=42; ConfidenceScore=5.41e-01
MTFTPFSPKSHHQSRSKSLPCRQHPLILQCNQHLGSLEASPSDNSTSSSSSLFRHKLTGLQTLHDCIEKLVRLPLTQEVLVQERQEKWVDELLDGSLRLLDVCTVAKDSLLHMKECARELQSIMRRKRGGEMEVAAEVRKFLASRKVIKKAILKALENLQATVKKAKFPPSNKDNPTVTLASLFKDVQVITLSILESLLNFISGPAQSKPSKWSLVSKLMHNKKVTTTTQESDPNEFSNVDAALQSFVFHMTRKADSISHLQNQLEDLESVIQGFVEGLETLFKPNHRSGIETLYALPSTHLFPKKKKWQPLKRKHKALYIFAATACPLVSQLEEQLQRLRCSEATSSLSSSSVCHKLNDTLDLHDYTDKLLQLPIEQQVLAQECNDKCVDDLLEGSLRLLDIC

SEQ ID NO: 158402 - protein, 125 aa, Glycine max
  Coding DNA Sequence Number=SeqID_66717
  Homolog annotation: Hit_ID=A5BB03; Match level="QueryCoverage=61%, HitCoverage=25%, E-value=2e-19, Identity=62%"; Hit description =Putative uncharacterized protein
  Pfam annotation: Domain name=DUF241; Domain location=15-125; Score= -69.7; E_value=0.089; Accession=PF03087.5; Description=Arabidopsis protein of unknown function
MSSHETSSSSSFLSHKLGRLQDLHECVEKLFQLPLIQEALHHERQEKWVDELLNGSLRLLDGCTNAKDSLLHTKECMRELQSVMRRRNRTELKTYLAREQERAKGTEREQGTQNDSDRQSDGGRM

SEQ ID NO: 158403 - protein, 64 aa, Glycine max
  Coding DNA Sequence Number=SeqID_66718
  Subcellular localization annotation: CTP_CleavageSite=26; ConfidenceScore=5.19e-01
TYQGNPCGFYPDLSSFTGSGVYPDLSSFTGSGVYPDLSSFTGSGVIQISVTCIKRSTPSQVHVI

SEQ ID NO: 158404 - protein, 142 aa, Glycine max
  Coding DNA Sequence Number=SeqID_66719
MSPRKLSTKRSRRDVAAEGTSVAPKFDSHRFRSAEHQQHFEAIKGWSFHRERRVQLKDDEYADFQEEIARRRWTSLGVRDMRSWVRGQWIPFDADALSQFLGDPLVLEEGQECEFSQRRNRADGFDEEAIAQLLCIPGQDFA

SEQ ID NO: 158405 - protein, 93 aa, Glycine max
  Coding DNA Sequence Number=SeqID_66720
MVTKGWSFVGQQWWVRKEGESYPQEEEKNLTFETLKSCLGLRAISLVPVPRVSLHPSGPVFESKQYIYQNAQNETPSMVQRLVLLNFKLHAKR

SEQ ID NO: 158406 - protein, 60 aa, Glycine max
  Coding DNA Sequence Number=SeqID_66721
  Homolog annotation: Hit_ID=A2X1A0; Match level="QueryCoverage=56%, HitCoverage=16%, E-value=1e-09, Identity=85%"; Hit description =Putative uncharacterized protein
NLQDSGTLKRVAWGLDVGTRSYTDTSNFTLHCGVCQMGVIGQKTAVENAQATGCKKLSEL

SEQ ID NO: 158407 - protein, 21 aa, Glycine max
  Coding DNA Sequence Number=SeqID_66722
MRLPMTDGEDECAYNNKGTPK

SEQ ID NO: 158408 - protein, 119 aa, Glycine max
  Coding DNA Sequence Number=SeqID_66723
MHKALRVNAPLAHPQLVTLFLRHFQIPLDDEPFVQVKHSFAIGAGAVTSFGYRKDCNGQWLKKDALPPQDERTPSPPPQRDDSALMTEVLSELRGLRTYVGEHFDSLDNRFAGMDIRLT

SEQ ID NO: 158409 - protein, 147 aa, Glycine max
  Coding DNA Sequence Number=SeqID_66724
MAPTRQPLDPDKSNRALGFPALITGLYQLVEVPVTPSKKYCTPRQAQGDAHQAVDAPPPRQADPAGSLGMERYLQHLVHQQAANHRGQGQGSTPFACPTPEQFGAEVAWLEAQAGEEPAGSPGEADESHMDEEMTDLLGFLGGSGAT

SEQ ID NO: 158410 - protein, 69 aa, Glycine max
  Coding DNA Sequence Number=SeqID_66725
MLGFTSDSPQISARPHQLDFAPYALRSYSAQWNVPELLHDMHMLRSSRILRKWRLRKPSGGYGYHCIIK

SEQ ID NO: 158411 - protein, 143 aa, Glycine max
  Coding DNA Sequence Number=SeqID_66726
MEVVVASFIMMQKPVVARSDLYNSSSGVASMPVAQYYSPPHLISDRVDEVSCASSAAHMRRRKKVIDERLVSSIVAKSLVFAFGAALLLPSSASHTFYFVLEQLPPYLHQDISANNYQPPFLTVVLLLHEQSRVCGGELSQEA

SEQ ID NO: 158412 - protein, 321 aa, Glycine max
  Coding DNA Sequence Number=SeqID_66727
  Homolog annotation: Hit_ID=Q2HW90; Match level="QueryCoverage=54%, HitCoverage=35%, E-value=4e-19, Identity=32%"; Hit description =Putative uncharacterized protein
MAVGIISDFAWRPLGGESAVEIDLVTGVAEGPLESSCLKASYKVDTLPEATRAAEVGMSAASVGSVVVLSSIVVAPLMSVDVATTSASLTQYYDQPLRCFTFGDFQLSPMVEEFEEILGCPLEGRKPYLFSGFYPSLARISKIVQISAQELDHMKQVENGVVGIPRKYLEAKARILAGKGKWAPFIDILALLIFGGVLFPNVDGLLDLAAIDAFLAYHNHNESPVVAMLADLYDTFNRRSEKRNTRIVCCTPALYVWLVSHLFCQEVRHAWPLESHRSCTEKGGANWDQLLASKERASVNWFPRWKEGRTGVHISCGGFPN

SEQ ID NO: 158413 - protein, 83 aa, Glycine max
  Coding DNA Sequence Number=SeqID_66728
MLTDKSKEDRLRRWTLKRFLVIFRTKLDLKKGEEVAAQLAQATLARLALRVSQKPRNPIFQQNGGCGGHLARPGGRGYFNLKQ

SEQ ID NO: 158414 - protein, 480 aa, Glycine max
  Coding DNA Sequence Number=SeqID_66729
  Gene Ontology: Mol. function=alkanesulfonate monooxygenase activity; Cellular component=membrane; Biological process=sulfur metabolic process
  Homolog annotation: Hit_ID=A3KUZ3; Match level="QueryCoverage=46%, HitCoverage=67%, E-value=6e-59, Identity=54%"; Hit description =Putative uncharacterized protein
  Pfam annotation: Domain name=NMT1; Domain location=277-478; Score =4.8; E_value=5.7e-08; Accession=PF09084.2; Description=NMT1THI5 like
LSRPRWRPQLASLDHLPTATGRAYYQRRLDSEQRRDGDFLSKAERYARTDEFLSVLKQSLESPQPYDHQGRFYQAEQAFSAIKPLQHKLPIYFGGSSPEAIDVAARHADVFALWGEPLKGAAETVRNVRAAAAAQGRQIAFNISFRPILGNTEKEAWERAEHIRATAEKQLAESGYTFGLPKPQSVGAQRLLAAAHESDRHDKVLWTGVAKLVQGGYNSTALVGTPDQERLMRLAALFAGVALALASLQPLLAADKVTLRLGDVKGDRFAALKASGELNNLPYDFKLTAFDSGAPVQEALNAGALDVGFTGDLPFLFVYAAGAPVKAVGAWQNNPDSIALLTRPDAGIHRLQDLKGKQIAVNRGGWGHYLLLGLLERAGLTPQDVTLRFLGPVDGRAALTSGAVAAWAPWEPYIATSTAIDGTVRVPDGGGKGIMSGYSYALARNEALQDAGKRAAIADLLARLAKAQIWAQHHPQEFAG

SEQ ID NO: 158415 - protein, 195 aa, Glycine max
  Coding DNA Sequence Number=SeqID_66730
MKIIISIPLMNCDLARGEQHKDSCYFYSINNHDRRQEPIMYEYLKEERVLDLESILADFMTYQDSSKGSCYGMQQQGTQFQRNQSFAGYHWESCWQPNYDDKVEGVINLDDLLMQFKDIVESMQHSFRRTATQISKLVDDMAKTTAREEEECIEIETYQESIFQVTSIHHQITTEEEMSIISNTLEYSCSAVTGY

SEQ ID NO: 158416 - protein, 170 aa, Glycine max
  Coding DNA Sequence Number=SeqID_66731
MTFLGETSSQIIANLRLAFIFPNGSITHNQTGVYFQSSTIKPMRVPNDFSFETLKSKMHNTLQLTNDQLVVEIYYRLSFIDAELLCTINRTPDDILNLLQSTITPTHDVILYYNGKWNIPRQGGFLGYSFTKTNPIRFDIPLGCSMDKLKDLIKQVAPMGFPLWNSQITD

SEQ ID NO: 158417 - protein, 42 aa, Glycine max
  Coding DNA Sequence Number=SeqID_66732
MNSLSEHAMLNELAKRAYRAKRVHLVRMNTHPPVEIPLAKRG

SEQ ID NO: 158418 - protein, 79 aa, Glycine max
  Coding DNA Sequence Number=SeqID_66733
MENWRTALRNNFTGLRKIWRIGEQRYAITSRGSRLDVLGNKFMGLRKKSGEWRIGEQRYAITSRGSRLEGGGHMNSARQ

SEQ ID NO: 158419 - protein, 84 aa, Glycine max
  Coding DNA Sequence Number=SeqID_66734
  Subcellular localization annotation: CTP_CleavageSite=36; ConfidenceScore=5.04e-01
MESPTVATYPSAGGRRGAHGCVFQERKMRGVTTNVYSRKTSEKPERCGLRTLSVKRLGVVFTHGEGCFPCSYVFLNCDKEIRPT

SEQ ID NO: 158420 - protein, 64 aa, Glycine max
  Coding DNA Sequence Number=SeqID_66735
MALVNNINILMFLVFNSALKGVDDTSQPKSMAAGARWIVVKYFNDVRPLESDTLKALRIQWANY

SEQ ID NO: 158421 - protein, 59 aa, Glycine max
  Coding DNA Sequence Number=SeqID_66736
MGLMAMSMRMQLALIQVVLVIVPASMGTTAANQTLLGCPRFCGSVPIPYPFGIGKSSET

SEQ ID NO: 158422 - protein, 125 aa, Glycine max
  Coding DNA Sequence Number=SeqID_66737
MAHRCTNPMLNVILQKRGEVAAYVAWPTRPRDQSNLGQGGVDDGSDDLVPRKDHFESGLVASQIRLDLDEALESAVGDKVFGVTIGVEPTLDVELVVGDSSGEADRGFHDVEGDRALEEARNNYA

SEQ ID NO: 158423 - protein, 88 aa, Glycine max
  Coding DNA Sequence Number=SeqID_66738
  Subcellular localization annotation: CTP_CleavageSite=48; ConfidenceScore=5.52e-01
MNHFFRKVPGRGFPGVFRKKCSSGRRLVTSGRTPNGSSGRLRLHNKTKAKKKATYLESKWVQGLSEKLAEKKLVGEERREEAFAEETQ

SEQ ID NO: 158424 - protein, 162 aa, Glycine max
  Coding DNA Sequence Number=SeqID_66739
  Gene Ontology: Mol. function=drug transporter activity; Cellular component=membrane; Biological process=response to nematode
  Homolog annotation: Hit_ID=A7QXZ0; Match level="QueryCoverage=58%, HitCoverage=18%, E-value=9e-34, Identity=74%"; Hit description =Chromosome undetermined scaffold_235, whole genome shotgun sequence
  Pfam annotation: Domain name=MatE; Domain location=1-104; Score= -14.7; E_value=0.012; Accession=PF01554.9; Description=MatE
MGSALETLCGQAYGAGQVHMLGVYMQRSWVIVNATAILLSLLYIFAGPMLRAIRQTEAISAAGGEFAVWMIPQLFAYAVNYPAQKFLQAQSRIMVMAWIAAAALRRRGAERVVVVHRHWTAAHFFFNLIEDDTSSPSELEDERAKSVSSLSRAHYDGNEESG

SEQ ID NO: 158425 - protein, 31 aa, Glycine max
  Coding DNA Sequence Number=SeqID_66740
MDTEFVKRFRKSSSSQAGLGQLLLLEQSATA

SEQ ID NO: 158426 - protein, 49 aa, Glycine max
  Coding DNA Sequence Number=SeqID_66741
MRRGGSLQSKTKTHVNGVRTRIEENKKWKKCRRERVDGTEMEKIQENRE

SEQ ID NO: 158427 - protein, 127 aa, Glycine max
  Coding DNA Sequence Number=SeqID_66742
MCKVGQITTNLSMIDQLAINNRKGQEVLTDTKERDVLGVFSENLRILQSELLPYKEDLIGFSSHHITPLGKVKFHITFGKARDQNHHHQVHCGNATIILQHHTGQTNLECPESCDFDSSLGHEVPHQ

SEQ ID NO: 158428 - protein, 51 aa, Glycine max
  Coding DNA Sequence Number=SeqID_66743
MVVRVDKKNKIEREKEKEEKEASEKEEKKRTKEKEQRSKNSGPEAHLYVFS

SEQ ID NO: 158429 - protein, 72 aa, Glycine max
  Coding DNA Sequence Number=SeqID_66744
MMDRLTENKSNNHSFSSHYFAMLFYMNFPRQNSSWTPVSEKQDEGRILGDCTRFRNYEADSRTLSFSILKVS

SEQ ID NO: 158430 - protein, 155 aa, Glycine max
  Coding DNA Sequence Number=SeqID_66745
MHSEAEPLEHKKKRDTAIKVVVSPAKPPPKPDPEVDDPLYLMTLTIPELFLRPYQVRWDATMFGVFNPDFPLYIKHEDLSEIIHGGQCLSISVLQLWILHLTETCMRVGNSDIYGFLKPQSIQRSGQLQFESESYIKSWIQSSQRDVYLGAYLNG

SEQ ID NO: 158431 - protein, 109 aa, Glycine max
  Coding DNA Sequence Number=SeqID_66746
MGVEANMEEEFFYHEIDMVAAFLAEIEIAHILQSSRDFLFWKADPNGLYSTKSAYKVLQEADNNVNEDKASKILWSLKIPSRASIEQEEILIGSDQQSTIILTVVIVLD

SEQ ID NO: 158432 - protein, 225 aa, Glycine max
  Coding DNA Sequence Number=SeqID_66747
  Subcellular localization annotation: CTP_CleavageSite=67; ConfidenceScore=5.44e-01
MEEPSKKRKGVATSSAVTGTQSHGTSKAQTFLPPYHLLCCFARKNNTSSSSLNSLNYPVTVFHLRVHLMMSASLIFSVSDGRQMVCTNQADMTGRLLTGSLAFECRIMHYLIVCILLPRSSNLAQAHLVRYRMHKTLRSNAPLPHPHLITLFLQHFNVPLDSKPFVKVKRSFSIGVNVVSSFGYRKERDGSWVKKDAPVQAAEDRSPSPHSQRDDSSSLMHNILD

SEQ ID NO: 158433 - protein, 314 aa, Glycine max
  Coding DNA Sequence Number=SeqID_66748
  Pfam annotation: Domain name=Transposase_23; Domain location=80-145; Score=-9.0; E_value=0.011; Accession=PF03017.5; Description =TNP1ENSPM transposase
MAPKELEQLTQQMKDQLEELITEKVTRQLMLSFSQMQSQFQSQIQSHGLALPLEPEVDPLAACVSTKGSCVDPLTTDPDTSDTDKCGLYIEENPSRLVALGRVYEGSAVVHNIPLLHGQVKVGVKEVKDADAPVPIPTDEVAVSPAKPTDRPDPEVMWDASPFGPFNSDFPLHLIEISMQEGNSDVYGFLEPQSIQRYGQSQFESESYMKSWMQNSKRDVYLGAYPNGALKGLDDTPQPKSKAGARWIIVKCNKQKGSTECGYFVMHWMSTIILGSFRNNWETYFNDIRPLEVERLKALRIQWAQYYLKVRNET

SEQ ID NO: 158434 - protein, 244 aa, Glycine max
  Coding DNA Sequence Number=SeqID_66749
  Homolog annotation: Hit_ID=Q0PJE3; Match level="QueryCoverage=25%, HitCoverage=40%, E-value=2e-08, Identity=52%"; Hit description=MYB transcription factor MYB167
GGCSPRDSATDSFQTIRGMIMLGFCLLAQNNTDSSSPTLKDNEIFHSDKKYHVEDESMAEDSKGQVLLSSNSYCFGGSDNESTASDKGSYEQRPSSFSPKAYKMEGSCNSKINNTKNDNNLMSNCSNKDMFLDSYTTTFAKRNTHGLSTRKTLEDELYRLLGYGKLNPLLDLPCRAKLSYYHEELGCDNLVVYVYLNAVLVEFSPTREIYGRCLIRIRLNYHEELRERKGIANLSTEWEKKGVS

SEQ ID NO: 158435 - protein, 144 aa, Glycine max
  Coding DNA Sequence Number=SeqID_66750
  Gene Ontology: Mol. function=amino acid transmembrane transporter activity; Cellular component=integral to membrane; Biological process=amino acid transport
  Homolog annotation: Hit_ID=Q9C6S5; Match level="QueryCoverage=50%, HitCoverage=14%, E-value=1e-25, Identity=76%"; Hit description=Amino acid permease, putative
  Subcellular localization annotation: CTP_CleavageSite=4; ConfidenceScore=5.45e-01
MRTRALLFSSRSIFLLLPRFFFFVTSQYKLLLLHVTQVVTARRFMLASYKVLKVVAFSPLVRKVLVRCFVLPRELWTDGYFSIIAEIVGGVWLRWWLQAAAAMSNMEIFVAEMSSDSFQLLGMAERGMLLEFFGKSSCYGTPYT

SEQ ID NO: 158436 - protein, 300 aa, Glycine max
  Coding DNA Sequence Number=SeqID_66751
  Pfam annotation: Domain name=Transposase_23; Domain location=34-104; Score=9.0; E_value=0.00012; Accession=PF03017.5; Description =TNP1ENSPM transposase
MASFSQMQSQFQSQGPRVSTKESCVDPSGNDPETGDSERCCLYIEAHLARLVALGRLYEGSTIVHNTPLLPGQVKVGVEEVKDPDALVHVPTDEVSLVGQAIHAFLAWPTHLVKPLSQQAVVSPAKPPQQPDPEVDDLLYLMTLTIPELFLRPYQVTWDPTVFGVFNPDFPLYIKHEDLSEIAHGDQCLSILVLQLWILHLTKTKFRTRCLPWSLPEWSSPLQRTLADGGHRAQGTPSCLCNIQKGSTECSYYVMHWMSTIILGSFRNNWEAFNDPLELERLKALRIQWAQYYLRVRAQS

SEQ ID NO: 158437 - protein, 91 aa, Glycine max
  Coding DNA Sequence Number=SeqID_66752
MVDLKKLTYQNEPFNIAEQAKQVFYVQDSCDERWSVVLGRQLASAPNRSSSIKGLILIKRRPQMSLVGLNLTITALRHNISKTKLSYPDVL

SEQ ID NO: 158438 - protein, 174 aa, Glycine max
  Coding DNA Sequence Number=SeqID_66753
MVPRPIVGVIPGEALTLLGDRINVMPAFDLLYVETMASSSLSVKVGNFIFRCSVETMISPVKVGNFIFRCGMETMALSSLSVFLQIKEKALGCEAPNTGGLASHDNERLYTLGADVDRRMDIDRGFSLFEILGLKIYSLESYESPRLSRDWYPDVYLSFASYSFYRPKVAYFSR

SEQ ID NO: 158439 - protein, 144 aa, Glycine max
  Coding DNA Sequence Number=SeqID_66754
MNPGIGPLFYSNPWVLRMQCKECEIDNSYLHFTQFNKMHTQSFTFPQLLKIGLTPKKVPSGVANCRNVPFCGRARRRSRVRFPKEEKCAESPPTFICGKRRKNQRKPIETKILSSGVVFTFEEGRQKRGFCSYIPSIEEEIRPT

SEQ ID NO: 158440 - protein, 477 aa, Glycine max
  Coding DNA Sequence Number=SeqID_66755
  Gene Ontology: Biological process=electron transport
  Homolog annotation: Hit_ID=A5BT99; Match level="QueryCoverage=93%, HitCoverage=53%, E-value=1e-144, Identity=63%"; Hit description =Putative uncharacterized protein
MTQLLVFLVLVVLVATFSSFVSAYHLLSKPLLRDDGRIYVCSHDNFFAFESNGTIAWIMHLDYKCNLGTAPVHGGHGKIYLVADNRILVISYGNIGTSEPEAEVFFGPGPGHVAEAEIIGLSVSTLGSTIYINVKNRGLFAYQSRGHLLWSVEPVLYQFGYRQGCRKNLTNCYFASVPLLDHCEGSIYISNTEGELYCLSVRSRYFRWIQDFSSLDKNFTITLGNNGHLYVTVPAKALVLALDVFSGNVLWQRSIGPLSKVDSAPVVDSNGWISIGSLDGFLYSFSPTGVLKKFSRMNAENSIIQVGPFLDCSGFAIYSSQIEMEGKISHTIGEYTVVSAIQPKAALFTMLVPATGSIYWSESYPGHVSTLFSKSDLSQFVMNEEILLAFLAASKIGTPLQCRTIGQKLASSCSQERTKLVSVYTGNERAIVLFLLFESALLLILIGLVRFCCTFWAKEKLKDQGLGSFLDNRVSSK

SEQ ID NO: 158441 - protein, 139 aa, Glycine max
  Coding DNA Sequence Number=SeqID_66756
  Homolog annotation: Hit_ID=A4Q3V3; Match level="QueryCoverage=89%, HitCoverage=61%, E-value=9e-17, Identity=39%"; Hit description =Putative uncharacterized protein
MFHDIPHSLLHSRDSNLNPSISTTIERIAKKFHSLGITKPLTSSSEIHVLFPHDLSKRQMGHTFEPSWSTPLKPMSVPGTGIAALSKSEVRRQNKLRAEELRRKELVPTLVELSLSNSEIRHLTTLGFVTKKKGDTRQQ

SEQ ID NO: 158442 - protein, 145 aa, Glycine max
  Coding DNA Sequence Number=SeqID_66757
MKRLYDQVEVQIEKKNESYAKQANKKRKKVVLEPGDDLGHLRANVFQEGGNDENPKIVQIQGPMTRSRTKQSQDPSREGQKPKLRRTKAEGRSGKGRSPNWRRMKAQVEKDEGPTGEGRKTQVEKDEGPKAKALLSILIVAEGLD

SEQ ID NO: 158443 - protein, 70 aa, Glycine max
  Coding DNA Sequence Number=SeqID_66758
MDLGDARVRYPILKSCIKSEVVDTMLIMTPHDVRPTMMPPCSRPMHELNIMIASFPYFDAKDQLVRNKMQ

SEQ ID NO: 158444 - protein, 50 aa, Glycine max
  Coding DNA Sequence Number=SeqID_66759
MDKCLKVEEDEWRERERRSTKFCASNEPTNPTSSPRFSTKCARCHEACKA

SEQ ID NO: 158445 - protein, 92 aa, Glycine max
  Coding DNA Sequence Number=SeqID_66760
  Subcellular localization annotation: CTP_CleavageSite=73; ConfidenceScore=5.10e-01
MSPPPLGISQSLQNSLISLKDENLAPCSALCSLIFTLFRPLTVFQLLALSFNFVQIKLKKGFLILSSCLAGVSEFELSANLALSLESDRRLA

SEQ ID NO: 158446 - protein, 246 aa, Glycine max
  Coding DNA Sequence Number=SeqID_66761
KRKSIGTRPTTQYDTRRFHSFEAWTRYTDNVLGRHILAERKVEIYHTKLDEFKAELERRNFHKRLTNLADSSIDLALVKEFYANLYSPEGPSPKQVRIQGHLIKIDADSLNTFLETPVVLAEGESLPAYSRYCRMPIDIREIEAALCIPVRGFVLNAEGHPGKILKKDLTTLAQELSSLAQSNSSRLGFPTLITALCRSRGFAFDSLVFKRLSPIINLAYIRKNCWNPTDLTITIRGARRVRERPS

SEQ ID NO: 158447 - protein, 16 aa, Glycine max
  Coding DNA Sequence Number=SeqID_66762
MWDTLQLTHEGTTDVK

SEQ ID NO: 158448 - protein, 177 aa, Glycine max
  Coding DNA Sequence Number=SeqID_66763
MMNMSTTMVDSHTCTTTSLGCARDNNDDANKSMVGNGNDQKSLKRRMIRIPQEEWRDREILTGCCRFGLRGGSMKVRHFGAGDRVEQKTITGKETWWLGMLEKGGLLYMVLIPTIKGPMVEKRIHGGAKGTSVIVDGGCGMVVIVGDKLCMVGGMGLPFAVVAVAGEGNINGHMLWW

SEQ ID NO: 158449 - protein, 181 aa, Glycine max
  Coding DNA Sequence Number=SeqID_66764
  Homolog annotation: Hit_ID=Q84VH5; Match level="QueryCoverage=83%, HitCoverage=31%, E-value=7e-37, Identity=80%"; Hit description =Envelope-like protein
MCRFSPAVINKYLGRPTEGVVDIAVSEHQIAKEITAKQVQHWPKKGKLSAGKLSVKYAILHRIGAANWVPTNHTSTVATENLLYPLHYKLFEGTHVPDIVSTSGKAAASGAVSKDDLIAELKDTCKVLEATIKANTEKKMELERLIKRLSDNGVDDGEAAEEEEDAAEDTESDDDDSDATP

SEQ ID NO: 158450 - protein, 337 aa, Glycine max
  Coding DNA Sequence Number=SeqID_66765
  Gene Ontology: Mol. function=transporter activity; Biological process= transport
  Homolog annotation: Hit_ID=Q2JYZ3; Match level="QueryCoverage=84%, HitCoverage=69%, E-value=3e-30, Identity=30%"; Hit description =Putative sugar ABC transporter, substrate-binding protein
  Pfam annotation: Domain name=SBP_bac_1; Domain location=8-334; Score =118.1; E_value=2.6e-32; Accession=PF01547.16; Description=Bacterial extracellular solute-binding protein
MKKLRVGAVVAVAGVAVAMTGCASSGGSGGSADGDTIVVDMWAGSEADVEALEAQVAFAQEQNPDITIKLQTSPWSDFFTKLTTNMASGNMACVTGMSGAQLGGYTGGFRELSADDLKTAGIDWADFNPSADGILSFEGKVYGVPFDVATMLVYYNQDMLTAAGAATPEIGWTFDDFDAIAADATKDGKYGFGMGMGGYQWMSMPIAYSAKQPASEDGALHIDDEDFVDAASWYAGLVTDKKVAAPVASASDTGWGENQYTGGNAAMAVDGTWNAVSYLNNESGFAAGMVPLPAGVDGNPGPILGSGYGISANCKNPEAALKVMGSLHRIPAARGIH

SEQ ID NO: 158451 - protein, 117 aa, Glycine max
  Coding DNA Sequence Number=SeqID_66766
  Subcellular localization annotation: CTP_CleavageSite=67; ConfidenceScore=5.06e-01
MSLGNYFLKIPSGNQLQDLCNRLQLKNPSTISRPWKILFARINCVFHSSSLRGCENKTTIGTSKPYTGAMKGPMHKPQTNLGQIRSSHSIGPRYKVMTKDNDWYLKALHWGNEGHRA

SEQ ID NO: 158452 - protein, 42 aa, Glycine max
  Coding DNA Sequence Number=SeqID_66767
LIRQVCEVLIMIYSLSQSAGLASRPLSTPLLRLSARKNLEEG

SEQ ID NO: 158453 - protein, 203 aa, Glycine max
  Coding DNA Sequence Number=SeqID_66768
MRSWVRGQWIPFEADALSQFLGDPLVLEEGQQCEFSQRRNRADGFDEEAIAQLLCTPRQVRIMRTNMTTLTQTWMTLLLSNVLPRDHNSDLPLPKCQLVYAILTLMSVHVAQVIADAIYLFVGMPPTRHPLDQDKSNRALGFLALITGLCQSFGVPITPSKVIRPPITQAFIEKYCTPSRRRVMHIRPQTHRHHLDRPIPLDH

SEQ ID NO: 158454 - protein, 193 aa, Glycine max
  Coding DNA Sequence Number=SeqID_66769
  Gene Ontology: Mol. function=aspartic-type endopeptidase activity; Biological process=proteolysis
  Homolog annotation: Hit_ID=A5BAI2; Match level="QueryCoverage=69%, HitCoverage=12%, E-value=1e-24, Identity=41%"; Hit description =Putative uncharacterized protein
  Subcellular localization annotation: CTP_CleavageSite=25; ConfidenceScore=5.22e-01
MKAKILENVIIMSRLLRSFSHISFRSNSSSSSSPRNSNLLSDQDNQTHEVAPKHNLFDKEVRFEDIVQNMDDWNIPEIPQDQLYVPETIKDKHNFDYIIKTVENNIPLGQDIGEEFHLLSKNSIYEHSRKYKYLHIGCVQVAIKPLIDMGIDATVLMCLRDIRHNKFEDSLIGTVETSLGQGPVYFNCYPTKT

SEQ ID NO: 158455 - protein, 68 aa, Glycine max
  Coding DNA Sequence Number=SeqID_66770
MDKAISRICPLDLMMKFVQFQWAKCASIAKRKFSMLSAIEESGRASISKSHAKREISVLSAVVVFGQA

SEQ ID NO: 158456 - protein, 31 aa, Glycine max
  Coding DNA Sequence Number=SeqID_66771
MGELLQAQAKKVDSPLEIMGRAASLGLNNGS

SEQ ID NO: 158457 - protein, 144 aa, Glycine max
  Coding DNA Sequence Number=SeqID_66772
  Homolog annotation: Hit_ID=Q8CM40; Match level="QueryCoverage=44%, HitCoverage=60%, E-value=1e-07, Identity=48%"; Hit description =Putative uncharacterized protein
GLAGDPGCFPLDDEAYPPSSHWPTLTLVILSQLLRLNAFRGEPASSGFEWHFTPNHNSSADSSTSVGSDLHLVSPKLHPATAYESPAHSSTGTRSESRASSHCLGAYGFMFYFTPRWGFFSPFPHGTTSLSVTQEYLALQGGPC

SEQ ID NO: 158458 - protein, 432 aa, Glycine max
  Coding DNA Sequence Number=SeqID_66773
  Gene Ontology: Mol. function=monooxygenase activity; Cellular component=cell outer membrane; Biological process=amino acid transport
  Homolog annotation: Hit_ID=A4XUV6; Match level="QueryCoverage=55%, HitCoverage=90%, E-value=3e-87, Identity=65%"; Hit description=NLPA lipoprotein precursor
  Pfam annotation: Domain name=Lipoprotein_9; Domain location=194-430; Score=353.9; E_value=2.7e-103; Accession=PF03180.5; Description=NLPA lipoprotein
CSFVNASSPAALREQAQRLRHAAVAAGRQADDLRIFMGVSVIVAVSEREAQEKHRSYLEYASAEAGIAHFSSSIGVDLAAFGLDEPIHSGDTRAIESVSKAYNGWTRRQLLEQHALGSRYPVIVGNPSQVADQLIRWIDEGDIDGFNLTRILNPQSYRDFIELGVRMKFASLVVLSAAILTASAFAAGDYSGALKVGTTAAFAPPLETAVAEAKKQGLQVELVEFTDWTAPNVSVENGDIDVNLFQHKPFLDNANREGGFHLVPYAPAIINNIGLYSKKHTAIDQIPDGGTVAIANDPINGARGLLLLQKAQLITLKPGSGLKSTVDDIASNPQHLKIIEVEAVQLSRSLDEVDLAQGYPHYLRLSKTIDPNKALLFDGLEHPEYVIQFVIRDGHQDDPRLKKFVDIYQHSPVVRAKLDEFYGKLYQPGWSQ

SEQ ID NO: 158459 - protein, 99 aa, Glycine max
  Coding DNA Sequence Number=SeqID_66774
  Homolog annotation: Hit_ID=A5BEV8; Match level="QueryCoverage=57%, HitCoverage=7%, E-value=2e-09, Identity=52%"; Hit description =Putative uncharacterized protein
MSLHVDGLTKVTTDKWMDIIEMGHVIASRYNVIVVSLSMTFFPLRSQPLTNSSLHRIICIGHVYDIHFVEHCYGLAIVILRRSRDQLHILAEYSITRAS

SEQ ID NO: 158460 - protein, 100 aa, Glycine max
  Coding DNA Sequence Number=SeqID_66775
MVAVGGGGLDDEGMSSALALFLEAIVKFSQILLSYGSLAKWVVSSITIVKNFARHKDTGSAHDYYDKKEILSCLGLVNQPRLATSTYPKDEYSSSIDPIA

SEQ ID NO: 158461 - protein, 178 aa, Glycine max
  Coding DNA Sequence Number=SeqID_66776
MASRKRARTDDIPSSSIPALQSIAIEPDVQHPQTLVPMLQSLFRGQLIIMHSLRELAQNRPIVPLEYFLEKVAWPEAQLPLVRTDEVAPSEPTLARVEPMPAEPRTLVVNPPPSSELEVVPPSPPLIIISYASSDEAVAPTDSPAEETVDPLASLVRGIVDLSYSSSREVVALTNSPV

SEQ ID NO: 158462 - protein, 76 aa, Glycine max
  Coding DNA Sequence Number=SeqID_66777
MVRTRGLGRALGQVTGRGVGRGDRDDSDDASQRRRPTASARRQRVAVTVAHDESVIPAPDVQDDPMEAPAAVEDIV

SEQ ID NO: 158463 - protein, 134 aa, Glycine max
  Coding DNA Sequence Number=SeqID_66778
MLTDHLIRKQLQASLLRHQWRKMIEMLTSTADADDARRWTLVHGSWLLLTATRLPSRWFVAEEEDEDGSARKKNGCKENARKKNGFVGGKKKNARKKMNARKKKSAGCARRRERVAGERESQTFFFLKLTEGHK

SEQ ID NO: 158464 - protein, 146 aa, Glycine max
  Coding DNA Sequence Number=SeqID_66779
  Homolog annotation: Hit_ID=Q6UUU1; Match level="QueryCoverage=41%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTRKTCKSTTAAAT

SEQ ID NO: 158465 - protein, 185 aa, Glycine max
  Coding DNA Sequence Number=SeqID_66780
MQLLCVFGARFHPDRHRETKCGSCAPPQLRSPPTERIAPIRHPVDPEKSNRTLGFPTLVTSLCQSYKVPVPSARSCHCDIGIAPARHPVDPKKSNRVLGFPTLITSLRQFYGVPVTPSRVIKPLLTGLSSRSTVSPGRHRARHHSSEQQTHCHQLQSSPQLIHKKTEALPTTHGRPVGDQVQSQR

SEQ ID NO: 158466 - protein, 68 aa, Glycine max
  Coding DNA Sequence Number=SeqID_66781
MSPDLGISACPLTSRQKNVYTDNHLGIFACPLTSRVSIDKDCGAADKSEALAPTYPQFVMRNSDLRSS

SEQ ID NO: 158467 - protein, 104 aa, Glycine max
  Coding DNA Sequence Number=SeqID_66782
MVHLLWISSSGGYIHLVVQREQGRVHPLWIFACKGFYNVERNLKDRRSLGNWMPLDPTLFDVILPRKGPITRAMARRLQEDWARDAGEGPRVLMNLRVDFGPMG

SEQ ID NO: 158468 - protein, 154 aa, Glycine max
  Coding DNA Sequence Number=SeqID_66783
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
  Subcellular localization annotation: CTP_CleavageSite=48; ConfidenceScore=5.06e-01
MPDSTKYTNGTQPYMPPNYIFQIVHTNNPPFSPKSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 158469 - protein, 249 aa, Glycine max
  Coding DNA Sequence Number=SeqID_66784
  Gene Ontology: Mol. function=ligase activity, forming aminoacyl-tRNA and related compounds; Cellular component=cytoplasm; Biological process=alanyl-tRNA aminoacylation
  Homolog annotation: Hit_ID=A2TU46; Match level="QueryCoverage=87%, HitCoverage=26%, E-value=1e-55, Identity=51%"; Hit description =Alanyl-tRNA synthetase
  Pfam annotation: Domain name=tRNA-synt_2c; Domain location=3-244; Score=-217.3; E_value=4.8e-10; Accession=PF01411.10; Description =tRNA synthetases class II (A)
MPSRGGRPYQSSFFAMQMDSFLLTEEPGMKEPFLFELVAVLKDQMGPFFPELEKQGNLVTEVIKSEEESFLKTIESGLVRVERLIQQTISDGSKVLPSVEVFELYDTYGFPDDLTRIIAEEKGLTIDEVGFQAEMEKQKQRSKKDSASKVYDWVVLEEKPETFVGYDQLEAETYITRYRKVENKDGEFYQVVLSNSPFYPEGGGQVGDKGVLENAAESFEVLETKKENGLIISLINGLPKDAGAVFYAK

SEQ ID NO: 158470 - protein, 44 aa, Glycine max
  Coding DNA Sequence Number=SeqID_66785
MPSWVLLLGFALVASRMDGSGMEKEEREEMPLQGEDESRRSSPP

SEQ ID NO: 158471 - protein, 170 aa, Glycine max
  Coding DNA Sequence Number=SeqID_66786
MTIIVNAEACGYVSMYYYQYIDVVYTNEHILKAYSAQWWPLGNEATIPPFDDAWTLIPDPTTIHAKVLQRYGKRISIKGKRGSVFSKKGCTNSNQAHLGLLGCSNRRRCLLVEATQLAWASWAANEKNCFREENSSRGASVMLPRRFREQFREDYPLFFIVLRRSSVFNR

SEQ ID NO: 158472 - protein, 81 aa, Glycine max
  Coding DNA Sequence Number=SeqID_66787
  Subcellular localization annotation: CTP_CleavageSite=53; ConfidenceScore=5.46e-01
MEWFYLISHPFMRQTDNLRSIYVLSMSSVCSTRRLSLPALSVPSSLSGYSLTRAKRAFEDRKPFLRMKLEKSSIRLKESMD

SEQ ID NO: 158473 - protein, 29 aa, Glycine max
  Coding DNA Sequence Number=SeqID_66788
MDEEHWRYDTIMSEEVDMNVENEEDVGVK

SEQ ID NO: 158474 - protein, 436 aa, Glycine max
  Coding DNA Sequence Number=SeqID_66789
  Gene Ontology: Cellular component=cytoplasm; Biological process =protein transport
  Homolog annotation: Hit_ID=A5AP88; Match level="QueryCoverage=97%, HitCoverage=98%, E-value=1e-118, Identity=53%"; Hit description =Putative uncharacterized protein
  Pfam annotation: Domain name=Snf7; Domain location=222-402; Score =18.2; E_value=1.4e-06; Accession=PF03357.12; Description=Snf7
MESATNLRVRDFIAKEVADWDDELIAVARFKAFSGQRCDWEPTFRFWKHFIIKIATHFGLLLIRPSQVKNDWFNRGGLTPLCLDDVLSLMYNEGDITRTVDLEDPTSGRFSQLVRRVGNLITRPPTPDIMAEQCVIVTAMLKDKAAEVVKHLSESHWNSSCIVTMKKFQDMCGGPDEASVMLRYLSGCRTAQYLSVNKKDFLEGVKVSLSAGALSSITNLDYDVLHLIWTTEKLQLQLDVTDRRYELLRKSALASLQSGNKKLALNYARELKLVTQSREKCSSLLNRVEEVLSVIADAESTKKVTEAMQIGARAIKENKISVEDVDLCLRDIQESIDSHKEVENALERMPSYVDIEDEDIEEEFKKLELAVGQDAQVPALEKAFNEEGRMASEAADFISDTFSNLKLSDRPAEKPGITQAVSEGDKITKKLEMEAV

SEQ ID NO: 158475 - protein, 147 aa, Glycine max
  Coding DNA Sequence Number=SeqID_66790
  Gene Ontology: Mol. function=DNA binding; Cellular component=nucleus; Biological process=regulation of transcription
  Homolog annotation: Hit_ID=A7Q102; Match level="QueryCoverage=57%, HitCoverage=84%, E-value=8e-26, Identity=67%"; Hit description =Chromosome chr7 scaffold_42, whole genome shotgun sequence
MDDFAKSLCGWSWEENKLFELALAAVDEQHPERWEVVAAMVGGEKSAGDVQEHYVILLEDLLVIESGKLDNTLGEVMPVVLVECKESMCLSHDDTSSKETEPGKRQCMSVALTDLSLSLLSFLTSPFSVDSSIRALPVPSLCPVSSS

SEQ ID NO: 158476 - protein, 420 aa, Glycine max
  Coding DNA Sequence Number=SeqID_66791
  Gene Ontology: Mol. function=translation release factor activity, codon specific; Cellular component=cytoplasm; Biological process =translational termination
  Homolog annotation: Hit_ID=A7Q103; Match level="QueryCoverage=77%, HitCoverage=92%, E-value=1e-109, Identity=61%"; Hit description =Chromosome chr7 scaffold_42, whole genome shotgun sequence
  Pfam annotation: Domain name=PCRF; Domain location=110-225; Score =175.9; E_value=1.1e-49; Accession=PF03462.9; Description=PCRF domain
  Pfam annotation: Domain name=RF-1; Domain location=265-375; Score =68.9; E_value=1.7e-17; Accession=PF00472.11; Description=Peptidyl -tRNA hydrolase domain
  Pfam module annotation: Pfam domain module=PCRF::RF-1; Domain location=110-225::265-375
MKGKKQSTEEELRNSSLHLSETDRKSINDEVSRNLCYYFPLSLSAAKPFQFKLLNFRHRASFFLRSYSAEVQAQLSPELLNIMEQRLSAIEYMTASFNNFLNQEIDGLKSLIAECSEDKDMLNMATEEIGQAVEEERRLQNFLLKSLLPKDDADDRDCILEVRPGTGGEEASLFAMDIFRMYEKYALKNGWKFEVVDIAQSDLKGYNEASAAIAGVGVFGKLKFESGIHRVQSLRILVTEKSGCINTNAVSVAILPQADEVDEWNYKDQVDVQLKHEDLRIDTYRSGGSGGQHANTTNSAVRVTHIPTGTMITIQDECSQHMASVSKYLASSCAFHLTWMKPLARFQLSELHATFVFSVEAGRQLKFGGRVTDHTVGITYHSVDDVMQGENLDSLMLFYCKKKWMQWPLLARLSKTCGFN

SEQ ID NO: 158477 - protein, 147 aa, Glycine max
  Coding DNA Sequence Number=SeqID_66792
AKHNEVLSNKNGKVAGAKEEDGWEKKKQFWEIFRRYGAVKEILIAVKRNRWGRQYGFLRFVDVKNPKRLDTREMGSSKHNRNSGMEDENQTKPKSGRKGKATRHKFAGINMRCIGDDMILISGIGEKDAREMIDKGRDNLLSVFQAS

SEQ ID NO: 158478 - protein, 111 aa, Glycine max
  Coding DNA Sequence Number=SeqID_66793
  Gene Ontology: Mol. function=structural constituent of ribosome; Cellular component=intracellular; Biological process=translation
  Homolog annotation: Hit_ID=Q2PER2; Match level="QueryCoverage=72%, HitCoverage=19%, E-value=6e-23, Identity=73%"; Hit description =Putative 60S ribosomal protein L1
MAKPTMLAKEPLKTRIVVPACSPQPRSDATIVSFTVASVIPSLVLAYDQRIEFVLELPLVVSDSAEGVEKTKEAIKVLKQIRAFPDVEKAKDSHNICLYKGKMHNRRYISH

SEQ ID NO: 158479 - protein, 449 aa, Glycine max
  Coding DNA Sequence Number=SeqID_66794
  Gene Ontology: Mol. function=adenosine kinase activity; Cellular component=nucleus; Biological process=purine ribonucleoside salvage
  Homolog annotation: Hit_ID=A7PI27; Match level="QueryCoverage=71%, HitCoverage=86%, E-value=1e-135, Identity=75%"; Hit description =Chromosome chr13 scaffold_17, whole genome shotgun sequence
  Pfam annotation: Domain name=PfkB; Domain location=50-368; Score =115.0; E_value=2.3e-31; Accession=PF00294.15; Description=pfkB family carbohydrate kinase
MVSEGTLLGMGNPLLDISAVVDEDFLKKYHRTLFNFHAVLLHSPRRFVTLENTVPYDITSNNAILAEDKHKPMYQELAEKYNVEYIAGGATQNSIKVAQWMLQVPGATSYMGGIGKDKFGEEMKKNSKLAGVNVHYYEDETTPTGTCAVCIVGGERSLVANLAAANCYKSDHLKRPENWALVEKAKYIYIAGFFLTVSPDSIQLVAEHSAANNKIFSMNLSAPFICEFFRDVQEKALPYTDFVFGNETEARTFSKVHGWETDNVEEIAVKISQWPKASGTHKRITVITQGADPICVAEDGKVKKFPVKLLPKEKLVDTNGAEKKKPEHVHTFAVAAALRLSCACFRGARVRGGAAAVVAPLCVMLETAVAIHAVAVRRAGVSFCRWHSGRVGLGRGVKLGNHMQHATRAPIIVEIAAALEEVVDGIEGGRDKEVVVIGEDNGVDEGGEE

SEQ ID NO: 158480 - protein, 379 aa, Glycine max
  Coding DNA Sequence Number=SeqID_66795
  Gene Ontology: Mol. function=sequence-specific DNA binding; Cellular component=nucleus; Biological process=DNA recombination
  Homolog annotation: Hit_ID=A7PT54; Match level="QueryCoverage=95%, HitCoverage=95%, E-value=8e-79, Identity=47%"; Hit description =Chromosome chr8 scaffold_29, whole genome shotgun sequence
  Pfam annotation: Domain name=Translin; Domain location=77-356; Score =5.6; E_value=2.8e-06; Accession=PF01997.7; Description=Translin family
  Subcellular localization annotation: CTP_CleavageSite=53; ConfidenceScore=5.71e-01
MQYTKPAFRNAAFYCHVFSRSLTLNPNPLLLVSPFRKPETFRLASPVSCLSSSSMAVPPSSLEKQFDDFRVQLEESGTLRERIRSVVSEIESSTRLIYATLLLVHQSRPTPELLEKAKSHVNVLKKQYKQLAEVVGGCPGQYYRYHGDWKSETQSVVSMLTFMHWLETGSLLEHKEAEEKLGSSACNAGSVSSLGKVLKDLNVNSSEFGLDVEDYLIGESSKHASFLQEVLTNLNMIVILKNMGVAVRISRVSKAKELNNQMRYPRYVVNQVTAGDYDCPRKVLKFLTDLHAAFRMLNLRNDFLRKKFDDNGTDVAFPMLSQIFIILKQDWSTNYSMKYDLRKVEEVYYDVKIRGLTPNGEPVGDLEIKESQDNLNLKL

SEQ ID NO: 158481 - protein, 105 aa, Glycine max
  Coding DNA Sequence Number=SeqID_66796
MMRKVSKDSVDPKRRKVSKDNVDPNWRKFTTNKFDPKRRKVPNDDADSKGRKVYKNIVDSKYRKTRLKSKKNPSVVVNRAKPLSGRLPKLVQVHFLVTPGSNLQQ

SEQ ID NO: 158482 - protein, 93 aa, Glycine max
  Coding DNA Sequence Number=SeqID_66797
MTSVVEDVLRRHLYHHETNALIVVVQIHTTNLSLSHGWKRAAKVNPDLQVVVEDIETIVEPDYGDAGEDECDGAEEKECDDAGEKKETDRTFD

SEQ ID NO: 158483 - protein, 349 aa, Glycine max
  Coding DNA Sequence Number=SeqID_66798
  Homolog annotation: Hit_ID=A2Q3D2; Match level="QueryCoverage=76%, HitCoverage=52%, E-value=5e-10, Identity=25%"; Hit description =Putative non-LTR retroelement reverse transcriptase, related
MVLAALSYYLQFSMCRTTCPISSFYGGITIAKDNQRNSDGCYCNSEGLFVDAAGLLDFMGGLHTRWREVAAVGWCGGDSVKGLSGLIRKAEWKGLFLKDDLKETSPFVYLGLSVGVGARKLSTWQQVINKMRKKLTPFGGGSTYLLGEDLLGFKEAFCGMLRGFNMALLGKWAWRLLSDKECLWRDVLVSKYELRVVGTGSEVSFWNALWVGGTYHGGGHHLVNKLWETIGEFRPNHNTQDGWEWKSKEYMWLEKSTQGAINGGVTLWANTIAHFWQHFGMIKGRKKQMAWWVAWVTVIWSIWKLKNDIFSNSSCDLEELLEAIKFRSWSWSRSFVEGLDIEECLRHLA

SEQ ID NO: 158484 - protein, 515 aa, Glycine max
  Coding DNA Sequence Number=SeqID_66799
  Homolog annotation: Hit_ID=Q2HV37; Match level="QueryCoverage=88%, HitCoverage=97%, E-value=1e-156, Identity=65%"; Hit description =Putative uncharacterized protein
  Pfam annotation: Domain name=Methyltransf_11; Domain location=157 -232; Score=1.4; E_value=0.062; Accession=PF08241.3; Description =Methyltransferase domain
  Subcellular localization annotation: CTP_CleavageSite=60; ConfidenceScore=5.22e-01
MTMMRLHNHITDRNFTGFAFAASLCPFYIFTRSTTLPTPHFFFFFFFFFIAQCIHKHEVMSSIARRVLLRTILLACAVSFVSLYRALSLFDFGTLAPIATYFDCVSGFQSVTFRPGSPLLRTRFGVSANCEKDANLTLTVVTELTGSRLLHPGAKSLCVGEGSSMAVTAMKQLGFFSSVSAVQTHRFEQRNVLYEDNSFDFVFSRDLDKVSVPALLVLEVERVLKPGGVGVFLVGTTSSHPNDMIRAATPVSSLLRSSNVVHVGSVNDHNLVVFKKRVENATLFYQHGLPADCPSVTFTKPLIELMEPLVSEKQQQPPIEFHKRNIPYLPKFVDVSTRKRLVYIDIGVGELLDANVSDCWFLPSYPIDQKDFNVYFVHYNTSIMLSYVKRPGITFVYHPGLAGIDKVNAKLGSDDDDDMDPLLGEEEKFDFPAWFKETVQYADFVVLKMNAGSVELKFLSDIFENGAICFVDELFLKCPERRGGDEKSVTSKESCMDIYKALRSNGVYVHQWWGD

SEQ ID NO: 158485 - protein, 199 aa, Glycine max
  Coding DNA Sequence Number=SeqID_66800
  Gene Ontology: Mol. function=structural constituent of ribosome; Cellular component=ribonucleoprotein complex; Biological process =translation
  Homolog annotation: Hit_ID=A9PG49; Match level="QueryCoverage=76%, HitCoverage=74%, E-value=8e-49, Identity=63%"; Hit description =Putative uncharacterized protein
  Pfam annotation: Domain name=Ribosomal_L13; Domain location=28-153; Score=63.1; E_value=9.7e-16; Accession=PF00572.9; Description =Ribosomal protein L13
MKMVTAFNGNMKKAAAGLRRINLDGLRWRVFDAKGQVLGRLASQIATVVQGKDKPTYTPNRDDGDMCIVLNAKDICVTGRKLTDKVYYWHTGQYYPVYFDISHGIINSFTISNPHSPIIIRSQSVDGKDRDRKLRIFPGSEHPFVDRPLEPYVMPPRSVREMRPRARRAMIRAQKKAEQQQQKADGMKGKNGEAQEESA

SEQ ID NO: 158486 - protein, 264 aa, Glycine max
  Coding DNA Sequence Number=SeqID_66801
  Gene Ontology: Mol. function=SNAP receptor activity; Cellular component=integral to membrane; Biological process=intracellular protein transport
  Homolog annotation: Hit_ID=A7PT16; Match level="QueryCoverage=83%, HitCoverage=86%, E-value=9e-99, Identity=79%"; Hit description =Chromosome chr8 scaffold_29, whole genome shotgun sequence
  Pfam annotation: Domain name=SNARE; Domain location=181-245; Score =43.0; E_value=1.1e-09; Accession=PF05739.10; Description=SNARE domain
MAEASKKEAVGVHSCYRLDGVRVLVDSICKKYDKYDVEKQRDSNLSADDAFAKLYASVDADIEALLQKAETADKEKSKASTVAINAEIRRTKARLLEEVPKLQRLAMKKVKGLSSQEFAARNDLALALPDRIQAIPDGAPAAPKQTGSWAASASRPGIKFDSDGKFDDEYFQQTEESSRFRQEYEMRKMKQAKGLDTLKNMAHDMNEELDRQVPLMDEIDTKVDRASSDLKNTNVRLRDTVNQIKIYASLYSLLLCGFIAQFIF

SEQ ID NO: 158487 - protein, 225 aa, Glycine max
  Coding DNA Sequence Number=SeqID_66802
  Homolog annotation: Hit_ID=A7PT13; Match level="QueryCoverage=47%, HitCoverage=20%, E-value=5e-17, Identity=50%"; Hit description =Chromosome chr8 scaffold_29, whole genome shotgun sequence
  Pfam annotation: Domain name=Mlo; Domain location=5-193; Score= -364.4; E_value=0.037; Accession=PF03094.6; Description=Mlo family
MTLFVGKLTLLTFMVDNQTLIDSDIQGKQHLEDGTYLLAHFSARNNDFDFQNYIEQSLEEDFRIIPCDVVHCCYFFAGGRTWICVNTPTLHFIRGKPSSIMHSSLPSLYGYQVAVQVLCSYVTLPLYALVAQMGSEVKSKALAKMLKQWHLEVRERRRNREQLKSFSFRHTNMSSEWSQENKSAPDFSSTLCESIRSSDEGEIVEELEHMEKTKASSSSDPPCVV

SEQ ID NO: 158488 - protein, 981 aa, Glycine max
  Coding DNA Sequence Number=SeqID_66803
  Gene Ontology: Mol. function=binding; Cellular component=nucleus; Biological process=metabolic process
  Homolog annotation: Hit_ID=Q9LFI1; Match level="QueryCoverage=74%, HitCoverage=96%, E-value=0.0, Identity=57%"; Hit description =Putative uncharacterized protein F4P12_60
  Pfam annotation: Domain name=PPR; Domain location=285-319; Score =11.3; E_value=0.35; Accession=PF01535.11; Description=PPR repeat
  Pfam annotation: Domain name=PPR; Domain location=351-385; Score =40.1; E_value=7.7e-09; Accession=PF01535.11; Description=PPR repeat
  Pfam annotation: Domain name=PPR; Domain location=386-420; Score=5.5; E_value=1.7; Accession=PF01535.11; Description=PPR repeat
  Pfam annotation: Domain name=PPR; Domain location=452-486; Score =21.8; E_value=0.0026; Accession=PF01535.11; Description=PPR repeat
  Pfam annotation: Domain name=PPR; Domain location=554-587; Score =23.9; E_value=0.00058; Accession=PF01535.11; Description=PPR repeat
  Pfam annotation: Domain name=PPR; Domain location=655-689; Score =37.7; E_value=4.3e-08; Accession=PF01535.11; Description=PPR repeat
  Pfam annotation: Domain name=PPR; Domain location=756-790; Score =45.0; E_value=2.7e-10; Accession=PF01535.11; Description=PPR repeat
  Pfam annotation: Domain name=PPR; Domain location=791-825; Score =11.4; E_value=0.35; Accession=PF01535.11; Description=PPR repeat
  Pfam annotation: Domain name=PPR; Domain location=893-927; Score=1.9; E_value=4.7; Accession=PF01535.11; Description=PPR repeat
  Pfam module annotation: Pfam domain module=PPR::PPR::PPR::PPR::PPR::PP R::PPR::PPR::PPR; Domain location=285-319::351-385::386-420::452 -486::554-587::655-689::756-790::791-825::893-927
MEELEIINIGKASKVYNAVEPVVLNVLKCKIPLFCGIGFSFHNNPQQWLRNQLYSICQPSQKHCLVGILGFTGMVSGIGAIQILLTFVVRFDISLGCGANSVLFETATLVEKREDLPVGAKPVKTPIKKHREKWSMAFFHRRTFFFDLSSEPIFFEPPEAQSSGNTLVYTILRSNAACPVIPLSVESAHGEESRGHPPVKNHEAIRRDSTTIQEQKPDKLRFILVAAGIVYNRAMRMVNRTILTTMEELSTNSYINLMCKQQHYREALDTFNFHLKNSSIQLEPSTYVNLILACTNVRSLKYGKRIHDHILKSNCQPDLVLQNHILNMYGKCGSLKDARKAFDTMQLRSVVSWTIMISGYSQNGQENDAIIMYIQMLRSGYFPDQLTFGSIIKACCIAGDIDLGGQLHGHVIKSGYDHHLIAQNALISMYTKFGQIAHASDVFTMISTKDLISWASMITGFTQLGYEIEALYLFRDMFRQGVYQPNEFIFGSVFSACRSLLKPEFGRQIQGMCAKFGLGRNVFAGCSLCDMYAKFGFLPSAKRAFYQIESPDLVSWNAIIAALANSDVNEAIYFFCQMIHMGLMPDDITFLNLLCACGSPMTLNQGMQIHSYIIKMGLDKVAAVCNSLLTMYTKCSNLHDAFNVFKDISENGNLVSWNAILSACSQHKQPGEAFRLFKLMLFSENKPDNITITTILGTCAELVSLEVGNQVHCFSVKSGLVVDVSVSNRLIDMYAKCGLLKHARYVFDSTQNPDIVSWSSLIVGYAQFGLGQEALNLFRMMRNLGVQPNEVTYLGVLSACSHIGLVEEGWHLYNTMEIELGIPPTREHVSCMVDLLARAGCLYEAENFIKKTGFDPDITMWKTLLASCKTHGNVDIAERAAENILKLDPSNSAALVLLSNIHASAGNWKEVARLRNLMKQMGVQKVPGQSWIEVKDQIHVFFSEDSSHPQRGNIYTMLEDLWLQMLDDGYDPCQRLDISIW

SEQ ID NO: 158489 - protein, 238 aa, Glycine max
  Coding DNA Sequence Number=SeqID_66804
  Gene Ontology: Mol. function=structural constituent of ribosome; Cellular component=ribonucleoprotein complex; Biological process =translation
  Homolog annotation: Hit_ID=Q9SF35; Match level="QueryCoverage=59%, HitCoverage=100%, E-value=6e-69, Identity=92%"; Hit description=40S ribosomal protein S23-1
  Pfam annotation: Domain name=Ribosomal_S12; Domain location=104-237; Score=264.8; E_value=1.8e-76; Accession=PF00164.16; Description =Ribosomal protein S12
MGREKVGDTGKGKKEKGGLKKFEVGTKGYFDNKVGINSSTLINKVYVYESLEPNLVITRMPRTTPIRLGFYTAAATSAPSSSISQTLSAQNQSYITMGKTHGMGAARKLKSHRRRQRWADKSYKKSHLGNEWKKPFAGSSHAKGIVLEKIGIEAKQPNSAIRKCARVQLIKNGKKIAAFVPNDGCLNYIEENDEVLIAGFGRKGHAVGDIPGVRFKVVKVSGVSLLALFKEKKEKPRS

SEQ ID NO: 158490 - protein, 120 aa, Glycine max
  Coding DNA Sequence Number=SeqID_66805
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=65%, E-value=2e-33, Identity=100%"; Hit description=LacZ protein
MLLENGGVLGRSPTQDLKLKGMKFGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 158491 - protein, 401 aa, Glycine max
  Coding DNA Sequence Number=SeqID_66806
  Gene Ontology: Mol. function=structural constituent of ribosome; Cellular component=ribonucleoprotein complex; Biological process =translation
  Homolog annotation: Hit_ID=Q2PER2; Match level="QueryCoverage=99%, HitCoverage=99%, E-value=0.0, Identity=81%"; Hit description =Putative 60S ribosomal protein L1
  Pfam annotation: Domain name=Ribosomal_L4; Domain location=20-264; Score=436.0; E_value=5.3e-128; Accession=PF00573.13; Description =Ribosomal protein L4L1 family
MAAAARPLVSVQTLEGDAAPTVPLPDVMKASIRPDIVNFVHSNISRNSRQPYAVSKRAGHQTSAESWGTGRAVSRIPRVPGGGTHRAGQGAFGNMCRGGRMFAPTKIWRRWHRKINVQQKRHAVVSAIAASAIPSLVQARGHRIESVPELPLVVSDTVESVEKSKEAVKILQKIGAFPDAEKAKLSHGIRPGKGKMRNRRHISRKGPLIVYGTEGAKVVKAFRNIPGVEVANVDRLNLLKLAPGGHLGRFIIWTKSAFEKLDSIYGSFHKASEKKKGYLLPRPRMVNSDLARIINSDEVQSVVRPIKKDVKRAPLKKNPLTNLNAMLKLNPYAKTAKRMALLAEKQRIVAKKEKLDKKRNIVSKEEASAIKSAGKSWYQTMVSDSDYADFDNFSKWLGVSQ

SEQ ID NO: 158492 - protein, 389 aa, Glycine max
  Coding DNA Sequence Number=SeqID_66807
  Gene Ontology: Mol. function=transferase activity, transferring glycosyl groups; Cellular component=chloroplast; Biological process =histidine biosynthetic process
  Homolog annotation: Hit_ID=A7QCI8; Match level="QueryCoverage=92%, HitCoverage=86%, E-value=1e-156, Identity=79%"; Hit description =Chromosome chr12 scaffold_78, whole genome shotgun sequence
  Pfam annotation: Domain name=HisG; Domain location=104-284; Score =263.2; E_value=5.6e-76; Accession=PF01634.9; Description=ATP phosphoribosyltransferase
  Pfam annotation: Domain name=HisG_C; Domain location=285-372; Score =67.4; E_value=4.8e-17; Accession=PF08029.2; Description=HisG, C -terminal domain
  Pfam module annotation: Pfam domain module=HisG::HisG_C; Domain location=104-284::285-372
MLTTMNLPLHTSVWVKSRRSWCCYASLSQPDRKEIRLGLPSKGRMSADTLQLLQVIPISIQFAIVTVIFYSTNSHSLCILCEELSIVSEAGQSSTLSNLDVWFQRPKDIVRKLLSGDLDLGIVGLDTFSEHGQGNDDLIIVHEALEYGDCRLSLAIPQYGIFENVNSLDELAKMPQWTEEKPLRVATGFTYLGPKFMKENGLKHVTFSTADGALEAAPAMGIADAILDLVSSGTTLRENNLKEIKGGVVLESQAVFITSRKSVIQRKGVLETTHEMLERLEAHLRAIGQFTVTANMRGSSAEEVAERILSQPSLMGLQGPTVSPVFCKRDGKVTADYYAIVICVPQKALYKSIQQLRAIGGSGVLISPLTYIFDEETPRWRQLLSKLGL

SEQ ID NO: 158493 - protein, 267 aa, Glycine max
  Coding DNA Sequence Number=SeqID_66808
  Gene Ontology: Mol. function=oxidoreductase activity; Cellular component=cytoplasm; Biological process=response to red or far red light
  Homolog annotation: Hit_ID=Q4W8C2; Match level="QueryCoverage=82%, HitCoverage=64%, E-value=1e-105, Identity=84%"; Hit description =Gibberellin 2-oxidase
  Pfam annotation: Domain name=2OG-FeII_Oxy; Domain location=174-265; Score=53.3; E_value=8.5e-13; Accession=PF03171.11; Description=2OG -Fe(II) oxygenase superfamily
MVVPSPSPTSIKTSYKKKKTIIKIPTIDLSMERTELSETVVKACEEYGFFKVVNHNVPKEVIARMEEEGAEFFGKATYEKRGAGPASPFGYGFSNIGPNGDMGDLEYLLLHANPLSVSERSKTIANDSTKFSCVVNDYVEAVKEVTCEILDLVVEGLGVPDKFALSRLIRDVNSDSVLRINHYPPLNQKVKGNKNSIGFGAHSDPQILTIMRSNDVGGLQIYTRDGLWIPVPPDPNQFFVMVGDVFQGINQHIEGKDVNDVLCSTTT

SEQ ID NO: 158494 - protein, 445 aa, Glycine max
  Coding DNA Sequence Number=SeqID_66809
  Gene Ontology: Mol. function=DNA binding; Cellular component=nucleus; Biological process=negative regulation of transcription
  Homolog annotation: Hit_ID=A7Q0S3; Match level="QueryCoverage=95%, HitCoverage=94%, E-value=1e-160, Identity=67%"; Hit description =Chromosome chr7 scaffold_42, whole genome shotgun sequence
  Pfam annotation: Domain name=DMAP1; Domain location=255-419; Score= -55.0; E_value=0.077; Accession=PF05499.3; Description=DNA methyltransferase 1-associated protein 1 (DMAP1)
  Pfam annotation: Domain name=Myb_DNA-binding; Domain location=160 -206; Score=37.0; E_value=6.7e-08; Accession=PF00249.22; Description =Myb-like DNA-binding domain
  Pfam module annotation: Pfam domain module=DMAP1::Myb_DNA-binding; Domain location=255-419::160-206
MDAKDILGLPKNSFPTLEKKSRPPKESQRKPDGISREVYALTGGLAPLMPATEASQLKKKPPPLEKITWQWLPFTSSARKDNLHLYHWVRVVNGVPPTGDYSFAKYNKSVDVIKYTDEEYDKYLTDPPYRGGVIFMYSGFLLASSFGRDSFLCGALALLGEMWTKEETDQLFDLCERFDLRFIVIADRFPSSRTVEELKDRYYSVSRAILIARAPSSGDVAAHPIVKETYNFAQEMERKRALSMVLSQTRQQERRDEEVLVEAKKIAEKRLPPKVAEQSQLVASNAGAEATERAVPGETISPSNVQIPMAVPDNASTLASLRMLRVYLRTYALEQMVQAANASAGLRTIKRVEQTLQDLGVNLKPRVPTKAVCAEHLELRKEILTWLNLQKQVQYKEAEGSSFRDGSYGERNTKVERVGKKDQKRKAPGAPSAHKRPRKLKASDL

SEQ ID NO: 158495 - protein, 433 aa, Glycine max
  Coding DNA Sequence Number=SeqID_66810
  Gene Ontology: Mol. function=hydrolase activity, acting on glycosyl bonds; Cellular component=extracellular region; Biological process =cell wall organization and biogenesis
  Homolog annotation: Hit_ID=A7Q0T9; Match level="QueryCoverage=89%, HitCoverage=86%, E-value=1e-179, Identity=74%"; Hit description =Chromosome chr7 scaffold_42, whole genome shotgun sequence
  Pfam annotation: Domain name=Glyco_hydro_28; Domain location=79-415; Score=337.4; E_value=2.5e-98; Accession=PF00295.8; Description =Glycosyl hydrolases family 28
MAVMGRTWEACRLPTNLISCYSVSALFRTTPKPAPPPSPPHNENYNNASGILDVRKFGAIGDGETDDTGSFKMAWDSACQSESAVNVILVPQGFSFLIQSTIFTGPCQGVLVLKVDGTLMPPDGPESWPKNNSRHQWLVFYRINGMSLEGSGLIDGRGEKWWDLPCKPHKAIRFFMSSNLTVQGLRIKNSPQFHFRFDGCKNVHIESIYITAPKLSPNTDGIHIENTNDMKIYNSVISNGDDCVSIGSGCNDVDIKNITCGPGHGISIGSLGNHNSRACVSNIMVRDSFIKVTDNGVRIKTWQGGSGSVSGVTFSNIHMVSVRNPIIIDQFYCLTKECTNKTSAVSVSNIIYTNIKGTYDIRSPPMRFACSDSVPCTNLTLSDIELLPSQGDIVHDPFCWNAYGDLETLTIPPVSCLLEGTPQSVLDYDITRC

SEQ ID NO: 158496 - protein, 130 aa, Glycine max
  Coding DNA Sequence Number=SeqID_66811
  Gene Ontology: Mol. function=transferase activity; Cellular component= cytoplasm; Biological process=metabolic process
  Homolog annotation: Hit_ID=Q76KW1; Match level="QueryCoverage=50%, HitCoverage=33%, E-value=2e-15, Identity=56%"; Hit description =Glutathione S-transferase
MDNRVGVTEEGVVVGQKQRVWVTKDKMLQVGEKELEGTFVGAQRKGLRRKSSFDKIIDANFEGAPLFPTDPAKREFVAYPTFKEDPVQQTSNAFDYLENALGKFEDGPFFLGQSCLESIEILINLGILST

SEQ ID NO: 158497 - protein, 691 aa, Glycine max
  Coding DNA Sequence Number=SeqID_66812
  Gene Ontology: Mol. function=RNA-directed DNA polymerase activity; Cellular component=exocyst; Biological process=exocytosis
  Homolog annotation: Hit_ID=A7PSW5; Match level="QueryCoverage=80%, HitCoverage=79%, E-value=1e-169, Identity=55%"; Hit description =Chromosome chr8 scaffold_29, whole genome shotgun sequence
  Pfam annotation: Domain name=Exo70; Domain location=63-639; Score =662.6; E_value=3.3e-196; Accession=PF03081.6; Description=Exo70 exocyst complex subunit
  Subcellular localization annotation: CTP_CleavageSite=90; ConfidenceScore=5.71e-01
MKGQYSSKHPFSPSAKHSKFHSWNPESKTLGHFDRVANMRKLCFNPQTESFALARSSPSSPLSLTSSPTPPRLSFSEAEALILKWNPDTSAYAKVTSLFYEDKTEAKHYIDSVNQLQKSMHSLLSQNPSSEKLILAHNLMQMAMKRLKKEFYQILSMNRAHLDPESVSARSSRTSANSSASDYDDDFAAEDDDIRAAGDSISEVEQVSSGAMADLKLIADCMVSSGYAKECVSVYILIRKSIIDEGIYRLGVEKLSSSRANKMDWNVLDLKIKSWLEAIRISVRTLFNGERILCDHVFSYSDSVRESCFAEISRDGASLLFGFPELVAKTKKSSLEKLFRVLDMHAVVSELWPEIESIFSSDYNSGARSQVLVSLQRLTESAQILLAEFESTIQKDSSKSAVNGGGVHPLTIQTMNYLSVLADYINVLSDIFPRDWLPPPKSSSLPESYLYSPESDYSASKPALTARFAWLILVLLCKLDGKAKHCKDVSLSYLFLANNLWYVVARVRSSNLQYVLGDDWILKHEAKAKRFVANYEKVAWGEVVSSLPENPAAAEAREVFESFNRKFEEGYRKQNSFVVADRELRDEIKGSIARSIVPRYREWYNVVLATVGTVRDLTATEYVTFTPEDIENYLCCIVLASPALELSAQFERRVFYAVIFLGCSNSFDIANKSDNVFFSFLRGTRKHDFIA

SEQ ID NO: 158498 - protein, 242 aa, Glycine max
  Coding DNA Sequence Number=SeqID_66813
  Gene Ontology: Mol. function=glycerol-3-phosphate O-acyltransferase activity; Cellular component=integral to membrane; Biological process=phospholipid biosynthetic process
  Homolog annotation: Hit_ID=A7Q0Q8; Match level="QueryCoverage=91%, HitCoverage=43%, E-value=7e-60, Identity=56%"; Hit description =Chromosome chr7 scaffold_42, whole genome shotgun sequence
  Subcellular localization annotation: CTP_CleavageSite=70; ConfidenceScore=5.21e-01
MAKMVMMSTFFFKSIFIFWYRFFFRPLKNLQRSVSNMITFAAHQFKYQGYDSLLHRNSNLNDHALLFDVEGALLKSSSVFPYFMLVAFEAGGLLRAIVLLLGYPFVCLVGDEMGLKIMVMVCFFGIKAERFRVGRTVLPKYLLEDVGLEMYEVVKRGGKKVGLSKLPRVMVESFLKEYLEIDFVVGRELKVFNGFYVGLMEETKTMHANLELLVREGKGNCSHMIGISGFHNLDHSFFSICK

SEQ ID NO: 158499 - protein, 852 aa, Glycine max
  Coding DNA Sequence Number=SeqID_66814
  Gene Ontology: Mol. function=galactinol-raffinose galactosyltransferas e activity; Cellular component=cytoplasm; Biological process =oligosaccharide biosynthetic process
  Homolog annotation: Hit_ID=Q9SBZ0; Match level="QueryCoverage=100%, HitCoverage=99%, E-value=0.0, Identity=86%"; Hit description =Galactinol-raffinose galactosyltransferase
  Pfam annotation: Domain name=Raffinose_syn; Domain location=21-844; Score=1988.6; E_value=0; Accession=PF05691.3; Description=Raffinose synthase or seed imbibition protein Sip1
  Subcellular localization annotation: CTP_CleavageSite=44; ConfidenceScore=5.15e-01
MAPPNNPVNSTLGFKSLEKVFDLCDGKFTVRGVPLLSQVPNNVTFSSFSSICEPRDAPPSILQRVIAVSHKGGFFGFSQVSPSDRLTNSLGSFSGRNFLSIFRFKTWWSTQWVGNSGSDLQMETQWVLIEIPEIKSYVVIIPIIEKSFRSALHPGSDGHVMICAESGSTQVKASSFGAIAYVHVSENPYNVMKEAYSVLRVHLDSFRLLEEKTVPKIADKFGWCTWDAFYLTVNPVGVWHGLKDFAEGGVAPRFVIIDDGWQSVNFDGDDPNVDAKNLVLGGEQMTARLHRFEECDKFGSYQKGLLLGPNAPSFNPKTVKELIAKGIEVERLGKLRDEAVSSGVSDLSLTEIESRIVKVKKEIDDLFGGEGKENKELCGGCCCKANECGGIKAFIRDLRTEFKGLDDVYVWHALCGSWGGVRPGATHLNSKITPCKLSPGLDGTMQDLAVVKIVEGSIGLVHPDQANDLYDSMHSYLAQSGVTGVKIDVFHSLEYVCEEYGGRVELAKAYYDGLTNSIVKNFNGSGIIASMQQCNDFFFLGTKQIPMGRVGDDFWFQDPNGDPMGVFWLQGVHMIHCAYNSLWMGQMIQPDWDMFQSDHVCAKFHAGSRAICGGPVYVSDSVGSHDFDLIKMLVFPDGTVPKCIHFALPTRDCLFKNPLFDQKTVLKIWNFNKYGGVIGAFNCQGAGWDPKMKKIKGFSECYRPISCTVHVTEVEWDQKKEAVHMGKAEEYVVYLNQAEELHFMTPKSEPLQFTIQPSTFEIYNFVPVEKLGGSIKFAPIGLTNMFNSGGTIQELECVEKGAKVKVKGDGRFLAYSSESPKKFQLNGSDVAFEWLPDGKLTLNLAWIEENGG

SEQ ID NO: 158500 - protein, 686 aa, Glycine max
  Coding DNA Sequence Number=SeqID_66815
  Gene Ontology: Mol. function=DNA-dependent ATPase activity; Cellular component=nucleus; Biological process=DNA replication initiation
  Homolog annotation: Hit_ID=Q6UEJ2; Match level="QueryCoverage=98%, HitCoverage=97%, E-value=0.0, Identity=77%"; Hit description=Mini -chromosome maintenance 7
  Pfam annotation: Domain name=AAA_3; Domain location=332-491; Score= -16.6; E_value=0.022; Accession=PF07726.2; Description=ATPase family associated with various
  Pfam annotation: Domain name=MCM; Domain location=274-617; Score =642.6; E_value=3.3e-190; Accession=PF00493.14; Description=MCM235 family
  Pfam module annotation: Pfam domain module=AAA_3::MCM; Domain location=332-491::274-617
MSTKDLNFDADTALAKDFLSNFADANGEAKYMNILQDVANHKTRAVQIDLEDLFNYKDLDEEFLSRVTDNTRRYIGIFSNAIDELMPEPTEDFTDDDHDILMTQRSDEGAEGTDGSDPRQKMPAEIKRYYELYIKASSKGRPSTIREVKALNIGQLVRISGIVTRCSDVKPLMKVAVYTCEDCGFEIYQAKIQELAEHVPKGHIPRTMTVHLRGELTRKVAPGDVVELSGIFLPIPYTGFRAMRAGLVADTYLEAMSVTHFKKKYEEYEFRGDEEEQIARLAEDGDIYNKLSRSLAPEIFGHDDIKKALLLLLVGAPHRTLNDGMKIRGDLHICLMGDPGVAKSQLLKHIINVAPRGVYTTGRGSSGVGLTAAVQKDPVTNEMVLEGGALVMEASFLKYNSSFHPYCAGISDMGICAIDEFDKMDESDRTAIHEVMEQQTVSIAKAGITTSLNARTAVLAAANPAWGRYDLRRTPAENINLPHALLSRFDLLWLILDRADMDNDLEMARHVVYVHQNKESPALGFTPLEPSVLRAYISAARRLSPSVPRELEEYIATAYSCIRQEEARSNAPHSYTTVRTLLSILRISAALARLRFSETVAQSDVDEALRLMQMSKFSLYSEDRQKSGLDAISDIYSILRDEAARGNRMDVSYAHALNWISRKNGLDSSLTDETEELNNQKRSWNN

SEQ ID NO: 158501 - protein, 128 aa, Glycine max
  Coding DNA Sequence Number=SeqID_66816
IEPHIGSVIHENDGSGNGRFNGVENPAMNQHIAAIPSSERRIEGINRHRNCSVKKFELEFGSESASQRPRPRMVVGTIEEWCDLDGGGTVARMNKERTSRISRGIRRWRWCYTRWHSGGSKRNGSLGR

SEQ ID NO: 158502 - protein, 260 aa, Glycine max
  Coding DNA Sequence Number=SeqID_66817
MPNVSPSVILRNNKTRHLVTGNDNLIEFRRKLDVMKRDEGEIAETLHFMMSPVGRRVCTFDDLLPCIENITFLSEEKDRILEAHEDAPPSQPQFEHQQFNILQQSVETRALARRRKTVDAATYSLPPMPERQHGMYYTPPAFTQEPSQMPPMYSYPHDFQPGYSFAGIFGFSPPSTGTPSFTQSGQVSTPNAPLAGLWNVLGDIPDMDDLLGVNLHHDFSVEADQVDERASPRRRNPDRAARNWDRPCGTSSRHHRHSDD

SEQ ID NO: 158503 - protein, 113 aa, Glycine max
  Coding DNA Sequence Number=SeqID_66818
  Gene Ontology: Mol. function=DNA binding; Cellular component=nucleus; Biological process=regulation of transcription
  Homolog annotation: Hit_ID=A7Q0K4; Match level="QueryCoverage=77%, HitCoverage=23%, E-value=2e-40, Identity=87%"; Hit description =Chromosome chr7 scaffold_42, whole genome shotgun sequence
  Pfam annotation: Domain name=Myb_DNA-binding; Domain location=14-61; Score=41.0; E_value=4.1e-09; Accession=PF00249.22; Description=Myb -like DNA-binding domain
MVRAPCCEKVGLKKGRWTTEEDEILTKYIMANGEGSWRSLPKNAGLLRCGKSCRLRWINYLRADLKRGNFSVEEESTILKLHASFGSRGCNSFRRPDKGSNTGSNSLQYCRAI

SEQ ID NO: 158504 - protein, 269 aa, Glycine max
  Coding DNA Sequence Number=SeqID_66819
  Gene Ontology: Mol. function=DNA binding; Cellular component=nucleus; Biological process=regulation of transcription
  Homolog annotation: Hit_ID=A7BJW2; Match level="QueryCoverage=98%, HitCoverage=73%, E-value=3e-34, Identity=38%"; Hit description=MYB -related protein
MNNWSLIASHLPGRTDNEIKNYWNSHLSRKIYTFHGKTTSKGIITLPPRRKRGRTSRWAMKNKNQKGSSSTQQQQQQIHHHLNNEVAVPLPPKPPLETEKYLSTNIILMEEQVDGSSTASTITNDHKHENTTTMCVEGEKEEILNDDIWGPYVEEVINGGELVLNFDDFMDHCWQEASGVWTISDEQRESNINIVVGNEKVDDDMCTNVIMSSGDHDRLHSSSSIASDLDQNLLTWLWEDEDWEKDLQSLGEIHSDKLKAMVDWFLSSS

SEQ ID NO: 158505 - protein, 158 aa, Glycine max
  Coding DNA Sequence Number=SeqID_66820
  Subcellular localization annotation: CTP_CleavageSite=16; ConfidenceScore=5.25e-01
MASSLPLQSSLFILFLASTVFAINNITHATSVAKALVPCTMCTECENPCQPLLPPPPPPVVECPPPPSPPPPPAVNECPPPPKSPCPDNCEVPQGPVPRPPYPPVLYFPTGTPYPNYVPDNINNSGGKMKPYSIYFTKSLIIYVACLYLITCLFSELF

SEQ ID NO: 158506 - protein, 113 aa, Glycine max
  Coding DNA Sequence Number=SeqID_66821
  Homolog annotation: Hit_ID=O22262; Match level="QueryCoverage=75%, HitCoverage=90%, E-value=1e-08, Identity=38%"; Hit description =Putative uncharacterized protein At2g47480
MESYGSGHRPYGGGRRMEVVSGKSHGWSSTQSPDSTQASEKPWRFGDPEAKRKKRIAKYKVYGVEGKVKATLKKGLRWIKKKCSQIAHVERLCALIEDFYPVVCMITRGFHEI

SEQ ID NO: 158507 - protein, 76 aa, Glycine max
  Coding DNA Sequence Number=SeqID_66822
MKYRSISGFQIVLRRSLASPKPILFTYNQKEHLGRSLKLAMVDGDKISGTRLNLLRRGNTIVPPNLFRVITRSGCL

SEQ ID NO: 158508 - protein, 81 aa, Glycine max
  Coding DNA Sequence Number=SeqID_66823
MPLHIIVGGLTDEKTTSSALLLLVNPYLKSEPAGIPDFTSSLRRQAMELISLTAPHRALTVEDLRLGEVCPRAGITGSRRV

SEQ ID NO: 158509 - protein, 347 aa, Glycine max
  Coding DNA Sequence Number=SeqID_66824
MEEKRTAITNRQGLKKKMHPLISSLSIGGDGGIAGLFVFGGALALAGFMAVGSFASKKHKAKGTHDDHQPKPKPKPQQLLLEEHGCKTDHEEDRDTTQSLTSLIQHGDAACCWASNMRINQVSDSSELLSAQSLILEDKSELKPRSVEESPTDFHHQEIVFSDSSHPESAASSNEGGVAEECMMSLLNSPSGQNEEPQDDLTSSETETETEDDDIDVDDDMLSHDVSEIGEEDGSKLAATGTTSPEPIWPVELIEHAKQKLKGDSHVCCDSDMDGSDLDDEAIMTVANQATMNQNLNFFMVPNNQPLTTWVFPFLLLALLLSLVLLTRRPQESFYVLDEGTSVVTRI

SEQ ID NO: 158510 - protein, 416 aa, Glycine max
  Coding DNA Sequence Number=SeqID_66825
  Gene Ontology: Mol. function=hydrolase activity, hydrolyzing O -glycosyl compounds; Cellular component=extracellular region; Biological process=carbohydrate metabolic process
  Homolog annotation: Hit_ID=Q2LAH6; Match level="QueryCoverage=79%, HitCoverage=99%, E-value=1e-140, Identity=78%"; Hit description=Endo- 1,4-beta-glucanase
  Pfam annotation: Domain name=Glyco_hydro_9; Domain location=33-407; Score=647.8; E_value=9.3e-192; Accession=PF00759.10; Description =Glycosyl hydrolase family 9
MTFSCLFFLLSVFSTTLLLPCHSHHHPHSATHNYRDALTKSIIFFEGQRSGKLPSNQRMPWRRDSGLSDGSAMHVDLVGGYYDVGDNVKFGFPMAFTTTMLSWSVIEFGGVMKETAAALAVASLVFKKTDPTYSKTLIRRAIRVFQFADKYRGPYSNGLKPIVCPFYCSYSGYQDELLWGATWLHKATKNPMYLNYIKVNGKTLGVADSDNTFGWDNKHVGARILLSKEFLVRKVQTLHDYKGHADNFICSVIPGSSSSQFSPGGLLFKMGDSNMQYVTSTSFILLAYAKYLTKAHVVVNCGGSIVTPKRLRAIAKKQVDYLLGDNPLKMSYMVGGSSLPSVSVHPGKIQCSAGFSVMKSQSPNPNILVGAVVGGPDLHDGFPDERSDYEQSEPATYINAPLVGALAYLAHSFAQL

SEQ ID NO: 158511 - protein, 890 aa, Glycine max
  Coding DNA Sequence Number=SeqID_66826
  Gene Ontology: Mol. function=nucleotide binding; Cellular component =small subunit processome; Biological process=rRNA processing
  Homolog annotation: Hit_ID=A7Q0E7; Match level="QueryCoverage=99%, HitCoverage=99%, E-value=0.0, Identity=53%"; Hit description =Chromosome chr7 scaffold_42, whole genome shotgun sequence
  Pfam annotation: Domain name=Utp14; Domain location=103-852; Score =681.4; E_value=7.2e-202; Accession=PF04615.4; Description=Utp14 protein
MTEKKRKERDEGNRQRLKPKKKPNTQWKKRGPRLPSSLQKQLHRLNPTTSFDSVDSDDDNDVYEYEEERAEEESKKNKRYDPASVDDDLAQDIEDENVQSDDESEDDDYTGTKRNENAPSDDSGEEDDDRHARMLQAITGMPSEAFEENKKKKKVMKDTVIPELYPESEYNPSRDVVDGDGRISIEDLLNPLREKSGYGKLRKRYQQIEKNAKIIHVPLSKAVQAKVERKAAYEISKKDVTKWQHIIQRNREAPTIFFDENVNLGFSTVGAIASEFEPRTEFEKKIAALVYDEEVMEAHKKDGSKLLEMNKVSIEDEKDRQNRIAKMRSLLFRHEMKAKHIKKIKSRTFHRLLKKDRLKAEASQMQMDPEAAKEYAMKQERQRAEERMTLKHKNHNPWAARIIQRGLHNQDEGTRAAIHEQLQRHAELTRKMKSMKGSSSSSEDSSDEDEDDNSAGSDQDRDYKILGKAKEKTVKVLEEEDEVPKSGLLSLPFMRRGLEKRKEAAVEEANLAFHEYEDSLKKLENTGGSEDLKAASTSGRRVFGMAKAQMSDTSNKVKSDNCYDGSDSEDDLGISKSGNIENEGSDLLHTDVNKDLVVIQDDTDTHRESVFKNIDEIIKNPGPKTTYDVSIFVSDTWKKAKNKNEDMTIKKSPKLTELDMQAIKVTEKEFGEDSDTDCEGQMVDGILSSVSKVPYELPSQEELIRQAFAGDDVDDDFEKDKQEILNEENPEPEKPLLLPGWGQWTHVQQKKGLPSWMLKKHEDAQKKRAEALKKRKDAQLKNVIISEKIDKKAEKLHTKSLPYPFTSQEVFEQSMRVPIGPEFNPATAIGPLNRPEVVKRPGVIIKPIEFEEVNPHEKTEQRSGGDKRKFKKNKVNADNPMKKGKVGRKS

SEQ ID NO: 158512 - protein, 172 aa, Glycine max
  Coding DNA Sequence Number=SeqID_66827
  Gene Ontology: Mol. function=catalytic activity; Cellular component =Golgi apparatus; Biological process=cellular metabolic process
  Homolog annotation: Hit_ID=Q39077; Match level="QueryCoverage=100%, HitCoverage=34%, E-value=4e-74, Identity=80%"; Hit description =Homolog of dTDP-glucose 4-6-dehydratases
VRIARIFNTYGPRMCLDDGRVVSNFVAQALRKEPLTVYGDGKQTRSFQYVSDLGRRLHRVLRPRSVPVRLLVEGLMRLMEGEHVGPFNLGNPGEFTMLELAKVVQETIDPEAKIEYRPNTEDDPHKRKPDISRAKEQLGWEPKVDLRKGLPLMVSDFRQRIFGDQKEGTTSA

SEQ ID NO: 158513 - protein, 386 aa, Glycine max
  Coding DNA Sequence Number=SeqID_66828
  Gene Ontology: Mol. function=nucleic acid binding; Cellular component= nucleus; Biological process=embryonic development ending in birth or egg hatching
  Homolog annotation: Hit_ID=A7Q0B9; Match level="QueryCoverage=45%, HitCoverage=48%, E-value=2e-44, Identity=56%"; Hit description =Chromosome chr7 scaffold_42, whole genome shotgun sequence
  Pfam annotation: Domain name=RRM_1; Domain location=74-140; Score =13.4; E_value=0.0085; Accession=PF00076.13; Description=RNA recognition motif. (a.k.a. RRM, RB
MKNVVKTTQVNDVLPSQEGPMKHQHRHGHWTRHGHVDTCNVQNIERSTGVVSDTDTDACRTQTRQGTGVQGTKVIVGLSDQCLRLRWWVKIKYGHITHIDLKVPPRPPGYAFVEFEDAQDAEDAIRGRDGYDFDGHRLHNSGYPGIAYLGWPISKMTENNSPRLFNLNLYRWSLPMVGVVIHPQKIGTIVTAMAEVDVGYLGALNIVDHMRKAGDVCFSQVFHDGRGTTGIVDYTNYDDMKYAIKKLDDSEFRNAFSKGYVRVREYDSRRDSSRSPSHGPSHSRGRSYSRSRSRSHSYSRDRSQSKSPKGKSSQRSPAKSPKGKSSQRSPAKSPSRSPSRSRSRYGNLQHTGNWKLGSWWDLVQLSATHFVVEITVQVQVSIASGE

SEQ ID NO: 158514 - protein, 536 aa, Glycine max
  Coding DNA Sequence Number=SeqID_66829
  Gene Ontology: Mol. function=ATPase activity, coupled to transmembrane movement of substances; Cellular component=integral to membrane; Biological process=transport
  Homolog annotation: Hit_ID=Q7DM58; Match level="QueryCoverage=94%, HitCoverage=33%, E-value=1e-144, Identity=50%"; Hit description =Multidrug resistance-associated protein 4
  Pfam annotation: Domain name=ABC_membrane; Domain location=327-536; Score=-33.4; E_value=0.038; Accession=PF00664.14; Description=ABC transporter transmembrane region
  Subcellular localization annotation: CTP_CleavageSite=15; ConfidenceScore=5.12e-01
MSLASSSTWLTSLSCAFPEKQTSGYTFVSTLLQWFEFIFLSPCPQRAILSFIDVVLLFFLFVFAVTKFWKRSTNLNEPLIRNNNNISIFLTTWFKLTLTVAILLTLVYTVASVLAFSSSSEVPWNQVDEVFWLVQTITHAVLVVLIIHEKRFEAVKHPLLVRLYWIANFFVISLFAVSAVIRLVSVDVDGTINFKVNDVVSFISLPLSLFLLFVAVKGSTGIVIPTEETRPLLEEETKLYDGGDETESEVTGFASASILSKAFWSWINPLLRKGYKSALKIDEIPTLSPEHRAERMSSIFESKWPKSNERSKHPVRITLLRCFWKELAFNAFLAIIRLCVMFVGPVLIQSFVDFTSGKRSSEYEGYYLVLILLVSKFIEVLATHHLNFQAQKLGTLLRSTLIPSLYKKGLMLSFSARQDHGIGTIVNYMAVDTQQLSDMMLQFNAVWIMPFQVAIGMFLLYNCLGASSVTAFLGLLGVFVFAVIGTRRNNHFQYNVMRNRDSRMKAVNEMLNYMRVIKFQAWEEHFSQRIMGFRET

SEQ ID NO: 158515 - protein, 83 aa, Glycine max
  Coding DNA Sequence Number=SeqID_66830
MGSLLAIRCSSQCDFCVCGSCEGGVKGDEGWFCWSKEGSSASRLLYEDTGLLRSMLLYDNCCGGGNCSCVDMRVLETMVVVEE

SEQ ID NO: 158516 - protein, 247 aa, Glycine max
  Coding DNA Sequence Number=SeqID_66831
  Gene Ontology: Cellular component=cytoplasm; Biological process =electron transport
  Homolog annotation: Hit_ID=A7Q0A9; Match level="QueryCoverage=97%, HitCoverage=58%, E-value=1e-102, Identity=75%"; Hit description =Chromosome chr7 scaffold_42, whole genome shotgun sequence
  Pfam annotation: Domain name=WD40; Domain location=161-201; Score =18.3; E_value=0.03; Accession=PF00400.23; Description=WD domain, G -beta repeat
  Pfam annotation: Domain name=WD40; Domain location=61-101; Score =38.0; E_value=3.4e-08; Accession=PF00400.23; Description=WD domain, G-beta repeat
  Pfam module annotation: Pfam domain module=WD40::WD40; Domain location=161-201::61-101
MDVEEQPSPNASDVKRFGLKNSIQTNFGDDYVFQIVPNDDWSAMAVSLSTNAVKLYSPVAGQYYGECKGHSETINQILFSGPSNPHVLCSCSSDGTIRAWDIRTFQQVSSINAGPSQEVFSFCIGGTGGNLVAAGCKSQWYVSFVLKYDFVQILFWDWRNMKQVACLEDSHVDDVTQVHFVPNEQGKLISASVDGLICTFDATGDINDDDHLESVINMGTSIAKVGIFGENYQKLWCLTHIETLGYS

SEQ ID NO: 158517 - protein, 73 aa, Glycine max
  Coding DNA Sequence Number=SeqID_66832
MKPHVSGESSNLAKESSRSVGEKLHQVCKAAMVAITTDGSNQRSSRLLPNQREWRKNLISFHSLIYIYHTAAT

SEQ ID NO: 158518 - protein, 58 aa, Glycine max
  Coding DNA Sequence Number=SeqID_66833
  Homolog annotation: Hit_ID=A7Q091; Match level="QueryCoverage=79%, HitCoverage=16%, E-value=2e-10, Identity=63%"; Hit description =Chromosome chr7 scaffold_42, whole genome shotgun sequence
MAAKPAEEAPQGETLKYQSWVLKVLIHCDGCKRRVKKILQGIDGIYHSLHLYFFWHMT

SEQ ID NO: 158519 - protein, 370 aa, Glycine max
  Coding DNA Sequence Number=SeqID_66834
  Gene Ontology: Mol. function=metal ion binding; Cellular component =cytoplasmic vesicle membrane; Biological process=protein transport
  Homolog annotation: Hit_ID=A7PTV3; Match level="QueryCoverage=73%, HitCoverage=62%, E-value=1e-105, Identity=69%"; Hit description =Chromosome chr7 scaffold_31, whole genome shotgun sequence
  Pfam annotation: Domain name=WD40; Domain location=251-289; Score =5.1; E_value=7.6; Accession=PF00400.23; Description=WD domain, G -beta repeat
  Pfam annotation: Domain name=WD40; Domain location=296-334; Score =17.5; E_value=0.051; Accession=PF00400.23; Description=WD domain, G -beta repeat
  Pfam module annotation: Pfam domain module=WD40::WD40; Domain location=251-289::296-334
  Subcellular localization annotation: CTP_CleavageSite=28; ConfidenceScore=5.12e-01
GRGKLKRIFSFSKSTDLSHSSMATLSACASPPWPNPNSPNSNPDPNFLPDQSQTLDFDSLMPPQPESPPPHHHHSPDASPPESSPSLPPPSLLYLSFNQDQACFAAAADSGFRIYNCDPFRELFRRDFDGGGIGHVEMLFLCNIFALVGGGPNPQYPPNKVMIWDDHQGHCIGELSFRAAVRGVRLRRDRIIVVVEQKIFVYNFADLKLVHQIETVPNPKGLCAVSQLSDSLVLACPGLHKGQIRVEHYAQKKTKFISAHDSRIACFALTLDGQLIATASTKGTLIRIFDTDHGTLLQEVRRGANTAEICSLAFSSTAQWLAVSSDKGTVHVFSLKKHSNIPELEKTQSSSNSEAAVTLSNSSRSFIKLK

SEQ ID NO: 158520 - protein, 1628 aa, Glycine max
  Coding DNA Sequence Number=SeqID_66835
  Gene Ontology: Mol. function=zinc ion binding
  Homolog annotation: Hit_ID=A5BJN7; Match level="QueryCoverage=100%, HitCoverage=97%, E-value=0.0, Identity=41%"; Hit description =Putative uncharacterized protein
  Pfam annotation: Domain name=zf-CW; Domain location=604-652; Score =66.6; E_value=8.5e-17; Accession=PF07496.6; Description=CW-type Zinc Finger
DEKLQDVLGHFQKDFEGGVSAENLGAKFGGYGSFLPTYQRSPVWSHPRTPHKNYSQNTPRSPNNLQPEGGQGDGVQCSTGTQSSRLGPGSGNSSRMAANKGLSLDDGTNQEKYMTATKADTSTSKQESLNKKISSTSDQKTLKVRIKMGPDSLSTRKNAAIYSEIGLDVSPSSSLDDSPSESEGISRGPQDAPFESPTIILQIMTDLPQLLSPIPDDTIELTVKETHARDSIPGPVHMDDLESFDMYESNNVKGDRKLLGGSGRKMKSLEGCESSMEVKGSTKKNARNDVGVLSRKEQSTDALTMEELVSKTMKLPLLSSSYSFSDDLVKAVDGQCDSLKEANKVIVREKTFSDQGQKERMESTSTEVNGFAEKAKGSSGRKVVGDKVSLDDYPVKENHQGDKNFNSMIVENNVSKVRTEPNTEEPPKKANQRGNLSEQDGVEHPFPGGKKKPKGSHGTMVMEREKENLKVGSSLVPKIKKSSDDSSASRNETEDARIQKSLGKTRDTYKDFFGELEDEEDRLDSLETPYGEKLKESEVVERSAPTTSYGAKERSGGKKVDKPFTAEIYPKTATNISCTGNANGTDLENGKGIPVMIPPVEMDDKWVQCDRCQKWRLLPVGTNLDSLPEKWLCSMLDWLPDMNRCSFSEDETTKARIALYQGPPLDSQSNLQNVSGSVMLGGTMAMSQHPYQHQLNNDMHAAPGGKKKLMKERSNSINKDSFSQSSYSIKKNWQSAVKSRSLNDVNKSPVVSEADVPADKHKNKHWMLEHNSDRGNLNHIFIVLISSVLTNVQMFKDLLNLYDVMFISGNLFSGDTKNMKVKSRKDPDQDSSRPSKKSKSDKVHSTNEEWIVEQSGTTRKVGDHSSNSTFPNTSVGKDRHRQKDPSSLRDSKSGKDRLPVSAETTKDKGQGSLDEGSLDLGNCDSIGSVKKRKLKGYQDAQTYSPGNPRLQESKTSEHEFSNSRKEKKAKNSKYEGKESSASKGSGRSDKKVSHTKTQKFRQKPESSLSHRSLDGMDCSKRDLGSVHASVAATSSSSKVSGSHKTKASFQEVKGSPVESVSSSPIRISNADKFTNKEIIGKDDPHDIAAVDSPRRCSDHEDDGGSDRSGTAKKDKSFTIAHRSDFQDKGVNHMSDTKLKAQTTSYCTNGGVDTIVLDGTHPGTEQINHPGEDKIDVYYATTSQARKNGIESGLEDNNVNDSCKSESHADKVKSTSSPCQLKDQSPLHEAKHKDGKIKLQEKFGFKPDQNEIIHAGKKDYTGKNESRNKENHSNRGHDFQDVSTDAPCKQEVFHAPIQNQFPDCDTERSTKRSLLERTDQEVHGKGKPLSSLPYEGSQVEILGRCPRPVGLLKGNGDMEVDPSKVDDVSKLQKKQLKKTDHQNGNLQIGSRNPILNGHKSKELDAPSPARRDSSSHAANNALKEAKDLKHLADRLKNTGSSVEGTSLYFEAALKFLHGASLLESGNNDNAKHNEMIQSMQIYSSTAKLCEFCAHEYEKSKDMASAALAYKCMEVAYMRVVYSSHTSASRDRHELQTALQMAPLGESPSSSASDVDNANNSTAADKAQDVNFAMEAARKSRNAFAAANSSLAVDKNADGISSIKKALDFSFQDVEELLRLVKVAVEAINR

SEQ ID NO: 158521 - protein, 460 aa, Glycine max
  Coding DNA Sequence Number=SeqID_66836
  Gene Ontology: Mol. function=nucleoside-triphosphatase activity; Cellular component=peroxisomal membrane; Biological process=protein import into peroxisome matrix, translocation
  Homolog annotation: Hit_ID=A2Q4J2; Match level="QueryCoverage=99%, HitCoverage=48%, E-value=0.0, Identity=80%"; Hit description=AAA ATPase, central region; L-lactate dehydrogenase
  Pfam annotation: Domain name=AAA; Domain location=205-394; Score =280.8; E_value=2.8e-81; Accession=PF00004.20; Description=ATPase family associated with various cellular activities (AAA)
  Pfam annotation: Domain name=AAA_2; Domain location=201-334; Score= -44.7; E_value=0.028; Accession=PF07724.5; Description=ATPase family associated with various c
  Pfam annotation: Domain name=AAA_5; Domain location=205-339; Score= -12.9; E_value=0.027; Accession=PF07728.5; Description=ATPase family associated with various
  Pfam module annotation: Pfam domain module=AAA::AAA_2::AAA_5; Domain location=205-394::201-334::205-339
MSVKVEKNAEKTSGHQVLLIAAADSSEGLPSTIRRCFSHEISMGALTEEQRAEMLFQSLQSVSGLLSNTNSEALVKEIVGQTSGYMPRDICALIADAGANLFPRNNAKVDKDVHDDVGSSLSSKMAEDNNHGKVSPQITGKEDLLNALERSKKRNASALGTPKVPNVKWEDVGGLEDVKKSILDTVQLPLLHKDLFSSGLRKRSGVLLYGPPGTGKTLLAKAVATECSLNFLSVKGPELINMYIGESEKNVRDIFQKARSARPCVIFFDELDSLAPARGASGDSGGVMDRVVSQMLAEIDGLSDSTQDLFIIGASNRPDLIDPALLRPGRFDKLLYVGVNSDASYRERVLKALTRKFKLHEDVSLYSIAKKCPPNFTGADMYALCADAWFHAAKRKRRLHPVFTVTSNASIQISETLMLYKTIHKLLCDLEVLEELSPSLSMAELNKYEQLRDQFEGTSK

SEQ ID NO: 158522 - protein, 372 aa, Glycine max
  Coding DNA Sequence Number=SeqID_66837
  Gene Ontology: Mol. function=metal ion binding; Cellular component =intracellular; Biological process=regulation of transcription, DNA -dependent
  Homolog annotation: Hit_ID=A7PTY7; Match level="QueryCoverage=93%, HitCoverage=96%, E-value=3e-91, Identity=52%"; Hit description =Chromosome chr7 scaffold_31, whole genome shotgun sequence
  Pfam annotation: Domain name=CCT; Domain location=320-359; Score =42.5; E_value=1.5e-09; Accession=PF06203.5; Description=CCT motif
  Pfam annotation: Domain name=zf-B_box; Domain location=4-51; Score =55.4; E_value=1.9e-13; Accession=PF00643.15; Description=B-box zinc finger
  Pfam annotation: Domain name=zf-B_box; Domain location=52-94; Score =9.1; E_value=0.014; Accession=PF00643.15; Description=B-box zinc finger
  Pfam module annotation: Pfam domain module=CCT::zf-B_box::zf-B_box; Domain location=320-359::4-51::52-94
MSGAEARPCDYCGNSTALLYCRADSAKLCFSCDREVHSTNQLFSKHTRTLLCDACDDSPATILCSTDTSVLCQNCDWENHNPALSDSLHERRPLEGFTGCPSVSELLSIVGFSDISKKSLLFSPQGSVADGFFGASEIEGLSDMFVWDAPSFVTLDDLISSSPSSHSFQAMKVPPLPKNRKAACGQHKEEILSQLRELAKSEPLDLEPYVQSGNLSLGFERDPEADIFPSHELGLMPDDGLFVFSNHWHRESSEPMHQVVPPDPSMGTYTEEIPVKHSTSAVGENHTYGDNEGKPSISLKSETLSTTPKAAACELTSQERDSALLRYKQKKKTRRFDKHIRYESRKVRAESRTSVNQKQIYWGLGSCLESIL

SEQ ID NO: 158523 - protein, 107 aa, Glycine max
  Coding DNA Sequence Number=SeqID_66838
  Gene Ontology: Mol. function=protein disulfide oxidoreductase activity; Cellular component=cytoplasm; Biological process=cell redox homeostasis
  Homolog annotation: Hit_ID=A7PTY3; Match level="QueryCoverage=94%, HitCoverage=99%, E-value=1e-42, Identity=79%"; Hit description =Chromosome chr7 scaffold_31, whole genome shotgun sequence
  Pfam annotation: Domain name=Glutaredoxin; Domain location=13-75; Score=65.3; E_value=2e-16; Accession=PF00462.15; Description =Glutaredoxin
MDRVKDLASKKAAVIFTKSSCCMCHSIKQLFYELGASPAVHELDNDSYGKEMEWALRGMGCNPSVPAVFIGGKFVGSSKDVISLHVDGSLKQLLMDAKAIWDTPAFS

SEQ ID NO: 158524 - protein, 139 aa, Glycine max
  Coding DNA Sequence Number=SeqID_66839
MSMVMSVVTMMIMVVVHQECFVCSDSDESSGDSEMLVITIIIIMMVIVTISNRDGIIDNDSGGDNNGDIDGSGGDGNDGDSDSGGCVSGVGDEVTISYSDNDGDGSIDGDSDNNYGGGDSNDDNKKYHYQIGKSVCFLN

SEQ ID NO: 158525 - protein, 310 aa, Glycine max
  Coding DNA Sequence Number=SeqID_66840
  Gene Ontology: Mol. function=oxidoreductase activity; Cellular component=extracellular region; Biological process=response to oxidative stress
  Homolog annotation: Hit_ID=A7PU06; Match level="QueryCoverage=88%, HitCoverage=87%, E-value=1e-103, Identity=65%"; Hit description =Chromosome chr7 scaffold_31, whole genome shotgun sequence
  Pfam annotation: Domain name=peroxidase; Domain location=41-278; Score=367.9; E_value=1.7e-107; Accession=PF00141.14; Description =Peroxidase
MKMRFFLVACLAMFCILEVCQGGNLRKQFYKKTCPQAEQMVRTKIQEHVSGRSDLPAKLIRMHFHDCFVRGCDGSVLLDSTATNTAEKDAIPNLSLAGFDVIDEIKEALEAKMSRSSRDAVAVKFNKPMWEVLTGRRDGRVSISGETLANLPAPFFNFTQLKQSFASKGLTVHDLVVLSGAHAIGIGHCNLFSNRLFNFTGKGDQDPSLNPTYANFLKTKCQGLSDTTTTIEMDPNSSNTFDRDYYSILRQNKGLFQSDAALLTTKISRNIVNELCSRQYSECMHYFCIRVHLICVIVLRGGGGTLNKTM

SEQ ID NO: 158526 - protein, 233 aa, Glycine max
  Coding DNA Sequence Number=SeqID_66841
  Gene Ontology: Mol. function=structural constituent of ribosome; Cellular component=intracellular; Biological process=translation
  Homolog annotation: Hit_ID=Q10RZ3; Match level="QueryCoverage=69%, HitCoverage=98%, E-value=1e-82, Identity=90%"; Hit description=60S ribosomal protein L21, putative, expressed
  Pfam annotation: Domain name=Ribosomal_L21e; Domain location=2-100; Score=184.8; E_value=2.2e-52; Accession=PF01157.9; Description =Ribosomal protein L21e
MPAGHGLRSRTRDSFSRPFRKKGTIALTTYLRTYHVGDYVDVKVNGAVHKGMPHKFYHGRTGRVWNVTKRAVGVEVNKQVGNRIIRKRIHVRVEHVMPSRCTEEFRLRKIKNDQLKAEAKVKGEKISTKRQPQGPKPGFMVEGATLETVTPIPYDVVNDLKGEPRRSVVILAYALHRNDVRDGGLVGEDAKGEHVKGYGFERRVDNRVGVEVDEGVEVVLLEAVIIRNDDVVT

SEQ ID NO: 158527 - protein, 210 aa, Glycine max
  Coding DNA Sequence Number=SeqID_66842
  Gene Ontology: Mol. function=protein binding
  Homolog annotation: Hit_ID=A7PW21; Match level="QueryCoverage=89%, HitCoverage=54%, E-value=7e-83, Identity=74%"; Hit description =Chromosome chr8 scaffold_34, whole genome shotgun sequence
  Pfam annotation: Domain name=DUF620; Domain location=1-197; Score =232.4; E_value=1.1e-66; Accession=PF04788.3; Description=Protein of unknown function (DUF620)
MTTLERDLTMNCFNFFLLNNNTRNEQWRGMRIERGGLDPLAVSAVFSAAQYMGEKQISGIDCFVLKLSPDQKDLVDRSDNTAEMIKHVAFGYFSQRNGLLVHLEDSYLTRIQSPGTHPTYWETTMSTKIEDYKMVDGVMIAHAGHSTVIITRFGDNLKTGPAITRLEESWTIDDVAFNVQGLSMDCFIPPKELHKDYPQEDLDWRSPLHR

SEQ ID NO: 158528 - protein, 91 aa, Glycine max
  Coding DNA Sequence Number=SeqID_66843
  Subcellular localization annotation: CTP_CleavageSite=38; ConfidenceScore=5.05e-01
MVELGTRTSGRTHLRSLKNTVLATLSATSGLIILSRLRSNSATAAGLFVLIAFGAKLCAHPEKFCFIDSKIVSSSDLVKPPSYPSSFKYLN

SEQ ID NO: 158529 - protein, 410 aa, Glycine max
  Coding DNA Sequence Number=SeqID_66844
  Gene Ontology: Mol. function=ubiquitin thiolesterase activity; Cellular component=nucleus; Biological process=ubiquitin-dependent protein catabolic process
  Homolog annotation: Hit_ID=A7PGA4; Match level="QueryCoverage=34%, HitCoverage=12%, E-value=3e-39, Identity=52%"; Hit description =Chromosome chr6 scaffold_15, whole genome shotgun sequence
  Pfam annotation: Domain name=MATH; Domain location=18-137; Score =37.1; E_value=6.5e-08; Accession=PF00917.17; Description=MATH domain
MENQQVKGVALEKFTWKVEGFTKLNTKKQSSKAFKVGGYKWKIVLYPKGRNVEYLSLYMKVADSLPPYGWSRFVYFRLALINQVDSKKSIVKETQQKFNAGNSAWGSPSFIPLSEFHDLAQGYLVKDACIIEAQVLVSKVAFNIPGSLAQSITTIHEPNGDQARLTEVEMTPSDLTSSPTSTQGSKDDHVNEIELQLIHSEDQEIGPSASDFTPSPKQVQFAPSAPPMYPSLFDESEQVILTPLSDLIDFNSVEAEEASFIPLWEEVCSWHPSLIENQRRRSPRFILWAFIALGRVLHFLKTKTIRDMGNDDCMMHLQVLWEELQPFGFDLTWLEPHVQSAMSAKAYFERGEYVKSIRVNIASLEIELKKLKTKLAVAELDLEVARRDLAEVENDFQERDMDAELGYGIP

SEQ ID NO: 158530 - protein, 580 aa, Glycine max
  Coding DNA Sequence Number=SeqID_66845
  Gene Ontology: Mol. function=nucleic acid binding; Cellular component= nucleus
  Homolog annotation: Hit_ID=A7PW25; Match level="QueryCoverage=100%, HitCoverage=35%, E-value=1e-178, Identity=59%"; Hit description =Chromosome chr8 scaffold_34, whole genome shotgun sequence
  Pfam annotation: Domain name=CPSF_A; Domain location=40-467; Score= -80.8; E_value=0.00025; Accession=PF03178.6; Description=CPSF A subunit region
MGHGKRLNVQKFHLEGTPRKVLYHDESKMLLVMRTELNCGPCLSDICCVDSLSGSVLSSFRLELGETGKSMELVRVGSEQVLVVGTSLSSGPHTMPTGEAESCKGRLLVLCLDHVQNSDSGSMTFCSKAGSSSQKTSPFHEIVTYAPELLSSSSLGSSPDDNSSDGIKLHENEVWQFRLAYATKWPGVVLKICPYLDRYFLATAGNAVSSKTVAFSPFILSLAHCPILSQILYPNQKFYVCGFPNDNPQRVRRYAMGRTRYMITSLTAHLTRIAVGDCRDGILLYSYHEEAKKLELLYNDPSQRIVADCILMDADTAVVSDRKGSIAVLCSDHLEASDNAGAQCNMTLSCAYFMAEIAMSIKKAFLYVIYASNVNVLRLSDSTVMEMMGSYSYRLPADDVLEGGNGPKTNVDSLQNTIIASTLLGSIMIFIPLSRTEMAVVNLPGLVSHPPLNTPRSRESEPLMGMTCINYLPVWQGPREEEYELLEVVQARLVVHHLTAPVLGNDHHEFRSRENRVGVPKILDGDILTQFLELTSMQQKMILSLEQPDMVKPSLKPLLPSHVSVNQVVQLLERVHDALN

SEQ ID NO: 158531 - protein, 369 aa, Glycine max
  Coding DNA Sequence Number=SeqID_66846
  Homolog annotation: Hit_ID=A7QFV0; Match level="QueryCoverage=91%, HitCoverage=89%, E-value=1e-43, Identity=41%"; Hit description =Chromosome undetermined scaffold_89, whole genome shotgun sequence
  Subcellular localization annotation: CTP_CleavageSite=29; ConfidenceScore=5.30e-01
MAEVAKPSSVPPSSHRIGSGPLKSGSLVRKKTPSELRGELLKRASNVDLTDESQSTLADPTKTTEVDNGFKKTRLWKPPRYTDTRVDEVFAAKKPRFKIASGKENAKENPSLGQTSNLKNFSVFSTLEAKGQQGNSCLENSVTSSEVSKDSVLQSCQTFQKCSQGKFRSVSELSSAADNSCGTAAIDLGKALRGLSALEPSNANDTAADLAEGHKDLTTVTGNFLSEFLLPGKKDLCFSMPLGHSKVEQVSTEDLVELSEIEKQNLGQTRRAEDIAASSNGSIWKDVESAQGSSDSLCTIEIKDALLPPWIICGICALMASEGRSFVASLPRQLGLWSRLTLSDLVGMQAMCWRALTAMIGVGCLDTGA

SEQ ID NO: 158532 - protein, 507 aa, Glycine max
  Coding DNA Sequence Number=SeqID_66847
  Gene Ontology: Mol. function=receptor activity; Cellular component =nucleus; Biological process=biological_process
  Homolog annotation: Hit_ID=A5BXV5; Match level="QueryCoverage=99%, HitCoverage=98%, E-value=0.0, Identity=72%"; Hit description =Putative uncharacterized protein
  Pfam annotation: Domain name=F-box; Domain location=84-131; Score =29.1; E_value=1.6e-05; Accession=PF00646.24; Description=F-box domain
  Pfam annotation: Domain name=JmjC; Domain location=314-425; Score =30.8; E_value=1.3e-06; Accession=PF02373.13; Description=JmjC domain
  Pfam module annotation: Pfam domain module=F-box::JmjC; Domain location=84-131::314-425
MRSFRMRNLLSRVKKKTIKNRNRSCISITKELAHLVEQEEEEEEVNEEGFNIKSSAPSHTHGVQPLGNLYLNTSSTNSRDTGLGNLHTLSDELVLDILGFLDSTSLGVLASVSKSFYVFTNHEPLWRNLVLENLLGGFQYKGSWKSTYVSACYPSFDNFAVALGGFKVRDFYSDYLFQSWLCANLEMKPEWLERDNVVRKRGISVEEFVLNFEEPNKPVLLEGCIDNWGALRNWDRDYLVRLCGDVKFSVGPVEMKLGEYFGYSDQVREERPLYLFDPKFAEKVPKLGDEYEVPVYFREDLFGVLGNERPDYRWVIIGPAGSGSSFHVDPNSTSAWNAVIKGSKKWILFPPDVIPPGVHPSPDGADVASPVSIIEWFMNFYGATKNWNKKPIECVCKAGEVIFVPSGWWHLVINLEESIAITQNYVSRRNLINVLDFLKSPNASTLVSGTRDRLNLYDKFKNAIEAYFPGEIDELTRKEEERKIQQRKLSFWDSVADTNAGAFKFSF

SEQ ID NO: 158533 - protein, 507 aa, Glycine max
  Coding DNA Sequence Number=SeqID_66848
  Gene Ontology: Mol. function=protein binding
  Homolog annotation: Hit_ID=A7Q041; Match level="QueryCoverage=79%, HitCoverage=84%, E-value=1e-92, Identity=47%"; Hit description =Chromosome chr8 scaffold_41, whole genome shotgun sequence
  Pfam annotation: Domain name=DUF593; Domain location=69-162; Score =186.1; E_value=8.9e-53; Accession=PF04576.6; Description=Protein of unknown function, DUF593
MDLESSGDSVKCCKHCECGCSDCSMAAQSSGNWLRSVKRKHKQLEQGGQFSAPGPDCDPVAHVEIGNECDALREAVSSQQKSIKDLYEELEEERNAASSAANETMTMILRLQREKAELQLEARQFKRFVEERTSHDQQELLALDELLYKREQAIHSLTCEVQAYKHRLMSFGITESEAEGDQYKFPPYEYPPLRCNAMHASSDDNDEIDIDKYAFGETPKDRLRNLESRISQMERSPTYSQMDGEFSGKNILEKVIVGQSPRWAKHSRKFSCDSSSLCPEYMIDSPSFRKIDEDLSNLKKVDNASEAGDDMIDKVYTIDSEFKAGASVYDDYATTPRDFVNHADFEDPYVKKLCMRLQELEADRESMRQAIISMRTDKAQLILLKEIAQELCKEMSQQKKMTARSFISSFSFLTVFKCSWVEGCKGLAVAVHVSTSHSQYAKWSQLAGRWWRGRHCKGKRATPKRSGLTLGTCCNSKRDAEPVSTTGDLHFLPAMERIRTQIWLSGL

SEQ ID NO: 158534 - protein, 257 aa, Glycine max
  Coding DNA Sequence Number=SeqID_66849
  Gene Ontology: Mol. function=magnesium protoporphyrin IX methyltransferase activity; Cellular component=chloroplast; Biological process=chlorophyll biosynthetic process
  Homolog annotation: Hit_ID=Q9MUE2; Match level="QueryCoverage=54%, HitCoverage=42%, E-value=2e-40, Identity=63%"; Hit description=S -adenosyl-L-methionine Mg-protoporphyrin IX methyltranserase
  Subcellular localization annotation: CTP_CleavageSite=47; ConfidenceScore=5.62e-01
MAFSSSLCSSLSIANPSRTAISTRFSHKSPKLPLSLAFAILPISTTTAADVSGAIDGTTIVVVSEGFMAALAAMLSLTDPEQRRQLQVEVGDDDKEVVREYFNNSGFQRWKKIYGDTDEVNRVQRDIRLGHAKTVEKTLSMLKDEGSLQGVTICDAGEVFELGHNVADELLVREGKVLEVLPSVVPGRDLAGEKVVAEMKTKKGHHSPLITVGLIVLSAWLGVLMEITINASVAWSFSVLKMLLGRESERVMKLSGY

SEQ ID NO: 158535 - protein, 94 aa, Glycine max
  Coding DNA Sequence Number=SeqID_66850
MISVKGVSADPKKLEVMVAWPIPKEMRTKKVARILRSYIWVVLQGNELFQEEMFKNSWWHMTLAKEISRNLCHQQGYCSPYQFPLGFGTTSHWI

SEQ ID NO: 158536 - protein, 567 aa, Glycine max
  Coding DNA Sequence Number=SeqID_66851
  Homolog annotation: Hit_ID=A7Q055; Match level="QueryCoverage=77%, HitCoverage=66%, E-value=2e-49, Identity=35%"; Hit description =Chromosome chr8 scaffold_41, whole genome shotgun sequence
MVKKGNIVQYRERLDNTLALPDLTNEQILKTLVKSQLQRSSEVEIEGCNEKEVETKTTELCNLLDMLRSASGDNGGGSSSTSHADWKLYAFHGRPPSTRNERMKVPWPLSTREAIVHYYLFEYFQDDLVVILLNTVSESKTDNLNKDAIPEAKDVVRIDLVGGYAMQKVTSERSYFRIIANLDLKLDFLPPTLLNFISRQLIGSGFRLYQKAVTSMMGNDKDKDFSKALEDTLYVRIHEALLSTRESKAMAGEELKQDASIVPTEELVQSEDEAKDVTCEDSSNQCSNNYIGETLDAGSEEVVEADCKEILQIEEDVNKVLSIPIEEGNSLSVLMGKENGEIVETDSEEIVEIEMDVNKMHDLPVEEDGTKSVLKDRMNAYIRSDVRNALETIERVISVVRECGFHSLGSTLNSAGEEFHCMENGGTVDSDSAKVIEVCLKNEVSVKVSSSNMLEENLEEPGTIQSFRHTGTNANKEVNYKKVVPASPEQNLSRPMEANQADSYSLKNGTTLDQTIYDNKQLNSDAVQDMSSDDLKKSTREINIQGVIFNPPFTNSMIPMDVLKSRS

SEQ ID NO: 158537 - protein, 80 aa, Glycine max
  Coding DNA Sequence Number=SeqID_66852
MWFVIHFLMSSPLGFAKYYMRREKDASHVGPWNEGFDSFSFSLTFGNPNRATGGGALENTRNITIDNGERLSDYIELMSQ

SEQ ID NO: 158538 - protein, 152 aa, Glycine max
  Coding DNA Sequence Number=SeqID_66853
MRGGVKETGSNIGLPPHTYTHVGDVDFEGFSQGDVDMVLPPNNFGGLINESSLGLSIVGSDMMLPFNNNSQGNIIGTFMGIGQHDENQGGSVNNINIGLWGHQITLGANNDGAALERSIHPNFVCTTNGENLNLGFPSHANLASTGERSDIE

SEQ ID NO: 158539 - protein, 77 aa, Glycine max
  Coding DNA Sequence Number=SeqID_66854
MASATTVFGSNFVQDKRFLSHGEVVLGNLSKHGDTPEIDLGVVLERYDDVVPLSDEARHDLHVLDQVVAEVAVVLSH

SEQ ID NO: 158540 - protein, 136 aa, Glycine max
  Coding DNA Sequence Number=SeqID_66855
MPKSIRIRTPGSNWLELAPYGKISAWGYFKKHFPEMEPMQIAGGNGAFPVNATAGHGVTINDGVLLEVGLASQTGELMLGHCLPSLRVQQEVAERDRLLQMKAPVPLAIWAAVGSSQWHWRFEVDVAIPNGDFSPL

SEQ ID NO: 158541 - protein, 197 aa, Glycine max
  Coding DNA Sequence Number=SeqID_66856
  Gene Ontology: Mol. function=transcription repressor activity; Cellular component=cytoskeleton
  Homolog annotation: Hit_ID=A7PP66; Match level="QueryCoverage=94%, HitCoverage=72%, E-value=4e-42, Identity=54%"; Hit description =Chromosome chr8 scaffold_23, whole genome shotgun sequence
  Pfam annotation: Domain name=DUF623; Domain location=119-178; Score =86.4; E_value=8.9e-23; Accession=PF04844.4; Description=Protein of unknown function, DUF623
  Subcellular localization annotation: CTP_CleavageSite=88; ConfidenceScore=5.22e-01
MSGSRKKLLLNTVSVKLGCGTCRRPNLCRIFHPKPKPKNLNNTYRKHKHSSSSSSFFSGQWGGEDKCDSTSTTPTPTPTNTTFSPYVDSSHFSDSDSYVKAVGGLGRAGKEGVAVEKDSDDPYLDFRHSMLQMILENEIYSKQDLRELLNCFLQLNSPHHHGVIVRAFTEIWNAVFSVRSSSHINRKPLAALSATMF

SEQ ID NO: 158542 - protein, 227 aa, Glycine max
  Coding DNA Sequence Number=SeqID_66857
  Gene Ontology: Mol. function=protein binding; Cellular component =membrane; Biological process=vesicle-mediated transport
  Homolog annotation: Hit_ID=Q8S8Z8; Match level="QueryCoverage=86%, HitCoverage=97%, E-value=2e-76, Identity=72%"; Hit description =Syringolide-induced protein B13-1-9
  Pfam annotation: Domain name=Hin1; Domain location=60-203; Score =179.2; E_value=1.1e-50; Accession=PF07320.4; Description=Harpin -induced protein 1 (Hin1)
MADKQPHLNGAYYGPAIPPAEQPRYRPHRERSCCCCLFGILWKILVALIVLVGLAVLIFWLVVQPRYFKFYVTEADLTQFDYYSNNNTLHYNMVLNFTARNPNKKLSIYYDKVEALAFYEDVRFANYSVITPMNSFRQYKKSSSTMSAVLSGQQVLPLDNDLVSELNQDKIGGVYEIYVKLYFRIRFRLGDVKTRRFKPKVKCDAKVPLRTMGNVTLFQTTKCDVDY

SEQ ID NO: 158543 - protein, 232 aa, Glycine max
  Coding DNA Sequence Number=SeqID_66858
MFEKVRLHPTELMRLILQQAVLSQAHPLCDHFKLNCDGSKSGSIAAAGGLLRDHMGNSCGYKFLKVESDSLSTIDLLAKDCLVSHPCSSLVHDIKEFGLNKGVYTWSQTLREGNQPADLVTTYGLQLQEQLRVFEFVPSFIFFAVHVLADLNSTVFPRVLVRGSRLLSVVQDRAPDVMVLEGVGRCPRRVRRGAKELKRTVSTTCDATRRMVGFDEVVLEVGCGGGVVVRTR

SEQ ID NO: 158544 - protein, 402 aa, Glycine max
  Coding DNA Sequence Number=SeqID_66859
  Gene Ontology: Mol. function=protein serine/threonine kinase activity; Cellular component=integral to membrane; Biological process=protein amino acid phosphorylation
  Homolog annotation: Hit_ID=Q9FFZ3; Match level="QueryCoverage=36%, HitCoverage=83%, E-value=7e-46, Identity=66%"; Hit description =Genomic DNA, chromosome 5, P1 clone:MBL20
MKVRVVCRKIYDYIRYDLKEIAFPSSLPDPPHIKKRRKLTWDQRIWVLKRAARLYAASWVRDIGPDLRPDDYKKDGDMTDETNGEKKTTIGKEPSTLEDLGTILFSTVAARGGMETLRPALQRVYMTRASAYRDALKSFIEGYQEASPKGGASSPITTTHLRPILLPLGSHPHPCGGTLTGGQRSPLLPHLPLLLHLLWQGKPLPKSTIPLRSAAAASAATWVIGLGGTNLYCVSRLHFVEGLRLSSFHKFQPMMPLITILQSTDNFSEASKLGERGFGPVYKGILPDRRQIAVKRLSKVFGQGSAEFNNEVTFIAKLQHRNLETANHRKSHHKNGETSADCPMPLQPPKPKVKIYKMMARGDVWEGGVKKDASWFGAREGGDGSGWVSEGKRWKGFSKGQN

SEQ ID NO: 158545 - protein, 299 aa, Glycine max
  Coding DNA Sequence Number=SeqID_66860
  Gene Ontology: Mol. function=DNA binding; Cellular component=nucleus; Biological process=regulation of transcription, DNA-dependent
  Homolog annotation: Hit_ID=A7PP88; Match level="QueryCoverage=73%, HitCoverage=82%, E-value=3e-60, Identity=58%"; Hit description =Chromosome chr8 scaffold_23, whole genome shotgun sequence
  Pfam annotation: Domain name=B3; Domain location=76-181; Score=117.0; E_value=5.8e-32; Accession=PF02362.12; Description=B3 DNA binding domain
MSSIHHYSPETTLYWTSDHQQQQQQQQQQQQQAATWLSNSHTPRFNLNEDDDEEDDVVVSDKATNNLAQEQEKEAMFEKPLTPSDVGKLNRLVIPKQHAEKYFPLDSSGGDSAAAKGLLLSFEDESGKCWRFRYSYWNSSQSYVLTKGWSRYVKDKRLHAGDVVLFHRHRAHPQRFFISCTRHQPNPNPPAHVSIRSSSYSALPAYPTHHHHHLPFPYQPHSLHAPGGGSQGQNETTPGGNSSSGRVLRLFGVNMECQPDNDNDSQNSTHECSYTHLYHHQTSSYPSSNPHHHMLPQQP

SEQ ID NO: 158546 - protein, 335 aa, Glycine max
  Coding DNA Sequence Number=SeqID_66861
  Homolog annotation: Hit_ID=A7PP92; Match level="QueryCoverage=88%, HitCoverage=88%, E-value=4e-70, Identity=47%"; Hit description =Chromosome chr8 scaffold_23, whole genome shotgun sequence
MACIDNTATTSTDEAGGATTITAVHPDIIQTHILTCLDGPSLASVASTCSQLHALSAREPLWENICHSTWPSTSSPRVRHVMSTFPRASLSFFSDSFPSFAAAREGSSSRAPELISAVDIFHRRRAVLSRVVETETESDWFRCSPFRIDVLDQKEAVATAMEYPRSEEACEILGEDLRLSWIVVDPNGKRAVNVSSGRVVSVERHWLSGEVKARFATVVGGGERGTAVEVALCSVTVTFGGEMQVREACLQMEDMDGMFLNGRDSLGILQRALEGIRGTLLKDGKEEEGRNRYLEFIKRKMERKDKKERDERRLDMLCVPLALLSFAAFSTLFLF

SEQ ID NO: 158547 - protein, 532 aa, Glycine max
  Coding DNA Sequence Number=SeqID_66862
  Homolog annotation: Hit_ID=A7PP86; Match level="QueryCoverage=96%, HitCoverage=76%, E-value=1e-158, Identity=60%"; Hit description =Chromosome chr8 scaffold_23, whole genome shotgun sequence
  Pfam annotation: Domain name=XkdW; Domain location=92-190; Score= -8.2; E_value=0.0071; Accession=PF09636.1; Description=XkdW protein
MDRSGTGSRQKRTPSISHRARITEHHVGPLDSLSNASLMEIETRSRAQTPASSAVGVKGRLKDVSNALTTSKELLKIINRMWGHEDRPSSSMSLISALHTELERARLQVNQLIQEQRSDQNEINYLMKCFAEEKAAWKNKEQEIVEVAIESIAGELDVERKLRRQLESLNKKLGRELADTKASLLKVVKELESEKRAREIIEQVCDELARDADEDKSEIEKQKRVSTKVCEEVEKEKEIMQLTDRLREERAQKKLSDAKYQLEEKNAAVDKLRNQLEVFLGGKQVREKSRSSTHLNDEEIAAYLSRSRLGSHLVEDKEDDGGEVDNGVECEEESAESDLHSIELNMDNNKSYKWTYPPESRFDTRRYPIEEEVKGSRRSTSGKTSRKSTSLQRSISDGMEWGVQADKLQNSGDGIDWESFYELEKQAQGKGYGDEMQGYKSVKGLRDQILAGSRLASYRGYASPTRQFSQPWSSRDLTNNFQERPATAQGNGLKSRLGEARGEGQNLRKSKRPYPFASATMMAGKNAGQRFS

SEQ ID NO: 158548 - protein, 232 aa, Glycine max
  Coding DNA Sequence Number=SeqID_66863
  Homolog annotation: Hit_ID=A7PPA2; Match level="QueryCoverage=68%, HitCoverage=73%, E-value=1e-21, Identity=42%"; Hit description =Chromosome chr8 scaffold_23, whole genome shotgun sequence
  Pfam annotation: Domain name=DUF584; Domain location=29-201; Score =30.4; E_value=5.6e-10; Accession=PF04520.4; Description=Protein of unknown function, DUF584
MDPTLSFHRRSSSDLLLGPFPFCPSPSSSAEELNEAELFWATDSSESEPQRPAPSPKPHLRNFDRPVDSGILVLLTEPDSRGGLLRGKSPVPTSSRMTIPSLPRPPAPPAADYLAQSAPFRKFQQSAPVKVPILLSAGAARRKNADDFARVVDDDDDEEMLPPHEIVARGSGVSPKTTFSVLEGVGRTLKGRDLRQVGKLNFDSFSASGDSFSLLVTSFSDAVFVLFYFIES

SEQ ID NO: 158549 - protein, 200 aa, Glycine max
  Coding DNA Sequence Number=SeqID_66864
MVRWRVIIFLCNQQEKLGSALVTFVCTANSSNDMRLKDMGGCFGGVGKRGGHGLKFEAHGDNGSEGTGKDPHMLTGQNEPPMLEGDQTMRFNPRSMTHQSATPPASYGADSEMEMQSVGVQKKMRSGGWSREGPTYAKARQALWTYCFELQPTKKLKGRLIAKSRAKRMTALLSPDVLRSACDQPAKSRRGVLNVKSHEF

SEQ ID NO: 158550 - protein, 81 aa, Glycine max
  Coding DNA Sequence Number=SeqID_66865
MGHPSLKIVASRVKILNNTQKWLAGNVLRPSIISDEGSLFCKIMGEGNYAWSSPCRKEAIFGFKSMTNLSPKRNLIVALER

SEQ ID NO: 158551 - protein, 509 aa, Glycine max
  Coding DNA Sequence Number=SeqID_66866
  Gene Ontology: Mol. function=hydrolase activity, hydrolyzing O -glycosyl compounds; Cellular component=extracellular region; Biological process=carbohydrate metabolic process
  Homolog annotation: Hit_ID=Q2HTE2; Match level="QueryCoverage=99%, HitCoverage=88%, E-value=0.0, Identity=82%"; Hit description =Sialidase
  Pfam annotation: Domain name=Glyco_hydro_32C; Domain location=346 -463; Score=164.5; E_value=2.8e-46; Accession=PF08244.3; Description =Glycosyl hydrolases family 32 C termi
  Pfam annotation: Domain name=Glyco_hydro_32N; Domain location=1-305; Score=567.8; E_value=1.1e-167; Accession=PF00251.11; Description =Glycosyl hydrolases family 32 N termi
  Pfam module annotation: Pfam domain module=Glyco_hydro_32C::Glyco _hydro_32N; Domain location=346-463::1-305
MYYNGIYHLFYQYNPKGSVWGNIVWAHSISKDLINWRTLEPALYPSKPFDKFGCWSGSATIVPGKGPVILYTGVVDDKQTQVQCYAVPEDLNDPLLRKWVKPDKFNPILVANKGVNGSAFRDPTTAWWSKDGHWKILVGSRRKRRGIAYLYRSKDFMTWVQAKHPIHSKGETGMWECPDFYPVLVNGNQGLETSEGGNHVKHVFKNSLDMTRFDYYTVGTYFEDKDRYVPDNTSVDGWGGLRYDYGNFYASKSFFDPSKNRRILWGWANESDTKEDDVRKGWAGIQAIPRTVWLDSTGRQLVQWPVEELNNLRGKEVNMNSQKLQKGDYVEVKGITAAQADVEVTFSFASLDKAETYDPKWVNAQDLCAQKGSKLQGGVGPFGLLTLASQNLEEFTPVFFRIFKGPVKHVVLLCSDATSSSLKSNMYKPSFAGFVDVDLATNKKLSLRSLIDHSVVESFGEGGKTNILSRVYPQLAVANQGHLFVFNNGTEPISVENLKAWSMKPADIK

SEQ ID NO: 158552 - protein, 1082 aa, Glycine max
  Coding DNA Sequence Number=SeqID_66867
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=A7PPC4; Match level="QueryCoverage=43%, HitCoverage=100%, E-value=0.0, Identity=83%"; Hit description =Chromosome chr8 scaffold_23, whole genome shotgun sequence
  Pfam annotation: Domain name=AAA; Domain location=712-965; Score= -41.9; E_value=0.098; Accession=PF00004.20; Description=ATPase family associated with various cellular activities (AAA)
  Pfam annotation: Domain name=APS_kinase; Domain location=709-837; Score=-95.9; E_value=0.013; Accession=PF01583.11; Description =Adenylylsulphate kinase
  Pfam annotation: Domain name=CbiA; Domain location=712-893; Score= -6.7; E_value=0.00015; Accession=PF01656.14; Description=Cobyrinic acid a,c-diamide synthase
  Pfam annotation: Domain name=MMR_HSR1; Domain location=711-860; Score= -18.5; E_value=0.053; Accession=PF01926.14; Description=GTPase of unknown function
  Pfam annotation: Domain name=MobB; Domain location=711-844; Score= -31.6; E_value=0.02; Accession=PF03205.5; Description=Molybdopterin guanine dinucleotide synthesis protein B
  Pfam annotation: Domain name=PBD; Domain location=94-140; Score=50.2; E_value=7.2e-12; Accession=PF00786.19; Description=P21-Rho-binding domain
  Pfam annotation: Domain name=RhoGAP; Domain location=157-294; Score =123.7; E_value=5.6e-34; Accession=PF00620.18; Description=RhoGAP domain
  Pfam annotation: Domain name=SRP54; Domain location=709-905; Score =407.5; E_value=2.1e-119; Accession=PF00448.13; Description=SRP54 -type protein, GTPase domain
  Pfam annotation: Domain name=SRP54_N; Domain location=612-697; Score =110.4; E_value=5.4e-30; Accession=PF02881.10; Description=SRP54-type protein, helical bundle domain
  Pfam annotation: Domain name=SRP_SPB; Domain location=936-1024; Score= 127.7; E_value=3.5e-35; Accession=PF02978.10; Description=Signal peptide binding domain
  Pfam annotation: Domain name=cobW; Domain location=711-896; Score= -77.4; E_value=0.065; Accession=PF02492.10; Description=Cobalamin synthesis proteinP47K
  Pfam module annotation: Pfam domain module=AAA::APS_kinase::CbiA::MMR_ HSR1::MobB::PBD::RhoGAP::SRP54::SRP54_N::SRP_SPB::cobW; Domain location=712-965::709-837::712-893::711-860::711-844::94-140::157 -294::709-905::612-697::936-1024::711-896
MTEVLQLPSSSSCSRRPCGSLTPNDGSHPISLINAPPTVEDQRVEIEEEEEKERERERDQLSILTLLIATFRKSLIGCSTTTTSSSSSSSSSMEIGWPSNVRHVAHVTFDRFHGFLGLPVEFEPEVPRRPPSASANVFGVSTESMQLSFDARGNSVPTILLLMQRHLYAQGGLQAEGIFRINAENGQEEFVREQLNRGVVPDGIDVHCLAGLIKAWFRELPTGVLDPLLPEQVMQSQSEEECAQLVRLLPPTEAALLDWAINLMADVAQMENLNKMNARNIAMVFAPNMTQMADPLTALMYAVQVMNFLKTLVVKALREREESIVKSNPVPDLNSFDDDGNHSNSEMLDKEDSENGNDCSDDDEDTVFVTAEPSQQSPSHLTEDGCETETATKSKSLPASTENYISSGNRLLVDSCPCNLVSQICSLAIGLQDCGLATGQTKGDQAKICRSKSLQLSTYDTDKCSRKVIQLPVTGAAEKNLGMAIIEQHPSSMYWEHSHKLLLGREWKGQGVKGRSLFVFPRLEMLATGRGDDMEAVAGSRHFSTLPLSFSQNKTLRSSSAKSIKLSSPWTNASLTSPNCFAKEVWGWVNSNSKGVAVRRDTRGVVVRAEMFGQLTSGLETAWNKLKGEEVLSKENIVEPMRDIRRALLEADVSLPVVRRFVQSVSDQAVGVGVIRGVRPDQQLVKIVHDELVRLMGGEVSELVFAKSGPTVILLAGLQGVGKTTVCAKLANYLKKQGKSCMLVAGDVYRPAAIDQLAILGKQVDVPVYTAGTDVKPSEIAKQGLEEAKKKKIDVVIVDTAGRLQIDKTMMDELKEVKKALNPTEVLLVVDAMTGQEAAALVTTFNLEIGITGAILTKLDGDSRGGAALSVKEVSGKPIKLVGRGERMEDLEPFYPDRMAGRILGMGDVLSFVEKAQQVMRQEDAEELQKKIMSAKFDFNDFLKQTRTVAKMGSVSRVIGMIPGMGKVTPAQIRDAEKNLQNMEAMIEAMTPEEREKPELLAESPVRRKRVAQDSGKTEQQNLMGVMESGSLPTLSNLEEALKAEEKAPPGTARRRKRSESRSVFGDSTPARPSPRGFGSKN

SEQ ID NO: 158553 - protein, 70 aa, Glycine max
  Coding DNA Sequence Number=SeqID_66868
MEVTCKGMDLCKREAKKTCLLGMDICKREAKKSCLLGHFVFADPEIFKFFCPYTAGLMQNIRDYTNKEIY

SEQ ID NO: 158554 - protein, 499 aa, Glycine max
  Coding DNA Sequence Number=SeqID_66869
  Gene Ontology: Mol. function=identical protein binding; Cellular component=protein complex; Biological process=protein polymerization
  Homolog annotation: Hit_ID=O82533; Match level="QueryCoverage=100%, HitCoverage=99%, E-value=1e-134, Identity=54%"; Hit description =Plastid division protein
  Pfam annotation: Domain name=Tubulin; Domain location=119-310; Score =297.1; E_value=3.3e-86; Accession=PF00091.16; Description =TubulinFtsZ family, GTPase domain
  Pfam annotation: Domain name=Tubulin_C; Domain location=371-493; Score=-9.6; E_value=0.013; Accession=PF03953.8; Description =TubulinFtsZ family, C-terminal domain
  Pfam module annotation: Pfam domain module=Tubulin::Tubulin_C; Domain location=119-310::371-493
MATCYTPSNVRNSAGVLAVVGGRTISENHGIRSCFLRIQESKTVFGSNRKCGSFPVKCSANSHSISRKDPFLDLHPEVSMLRGEGGSALNSPRPRKDVSGGNVAESLEATTAPSNYSEAKIKVIGVGGGGSNAVNRMIESSMNGVEFWIVNTDVQAMRMSPVIPPNRLQIGQELTRGLGAGGNPEIGMNAAKESKESIQEAVYGADMAGMGGGTGTGGAPVIAGITKSMGILTVGIVTTPFSFEGRRRAVQAQEGIAALRDNVDTLIVIPNDKLLTAVSQSTPVTEAFNLADDILRQGVRGISDIITIPGLVNVDFADVRAIMANAGSSLMGIGTATARVMHCRPVDHFTQHLSLAASQAINRKWKVSSWGSLCSFALYPQPMAFFLYLCSTSGKTRARDAALNAIQSPLLDIGIERATGIVWNITGGSDLTLFEVSITLIATGFKRQEESEGRPMQASQLTQGDTVGINRRSSTFTDGSFVEIPEFLKKKGRSRYPRV

SEQ ID NO: 158555 - protein, 591 aa, Glycine max
  Coding DNA Sequence Number=SeqID_66870
  Gene Ontology: Mol. function=protein disulfide oxidoreductase activity; Biological process=cell redox homeostasis
  Homolog annotation: Hit_ID=A9NX84; Match level="QueryCoverage=63%, HitCoverage=95%, E-value=2e-47, Identity=35%"; Hit description =Putative uncharacterized protein
  Pfam annotation: Domain name=Glutaredoxin; Domain location=256-322; Score=55.3; E_value=2e-13; Accession=PF00462.15; Description =Glutaredoxin
MGCVSSKHIKKDLKQEEVIATNGGSYVNHVVSLTSSTYGALMLDKEKEQHQLQLPVEESKTSPPRIREEPEVINAWELMEGLEEGVPISNNPMKIPKSTPFLRGFISTDPKPKTKTTPFKFLNQLGSPKSLRKFTGKENKIEVQVHHNAGVRRLDYNFSPKGILKPSNFCSPLNGSPIRARRNSFGSDTKRRSPSPLFDPELLASYEKELSQEEEQIKRMVWATPKTRRVRKSLDSQTFIKTFEEKLPPGGENCVVIYTTTLRGIRKTFEECNKVRSIIESYCVHVLERDVSMDSRFKEELRKLMGTEQVKVPVVFVKGRFVGGAEEVVKLEEEGKLGVLFEGIPPKALGECEGCGGVRFVMCVECNGSCKVLDEDRKKTLSVKESWTKTLQCWSLPWVDTPIGVRLEEGDMHPIGVGKKGNIFFRKNDGELVSFDLSSLKIEELGIKGKLHCCQTAGNSWCRDAGFNKSEKWISLQADGQVVLTPDRGQEASSQILPINFDGLAKSIKKGDTNFIGQYLLTGSETTSVLLEQLPVGDFVLKTSLVALDKVNRAGYKEAQFVIGILDVWNTRGQLEQTYYSNDYRIMYCRR

SEQ ID NO: 158556 - protein, 575 aa, Glycine max
  Coding DNA Sequence Number=SeqID_66871
  Gene Ontology: Mol. function=structural constituent of ribosome; Cellular component=intracellular; Biological process=translation
  Homolog annotation: Hit_ID=A2WX71; Match level="QueryCoverage=13%, HitCoverage=32%, E-value=3e-31, Identity=87%"; Hit description =Putative uncharacterized protein
  Pfam annotation: Domain name=Retrotrans_gag; Domain location=244-322; Score=-1.9; E_value=0.082; Accession=PF03732.8; Description =Retrotransposon gag protein
  Pfam annotation: Domain name=Ribosomal_L1; Domain location=129-267; Score=-94.8; E_value=0.003; Accession=PF00687.12; Description =Ribosomal protein L1pL10e family
  Pfam annotation: Domain name=UCR_UQCRX_QCR9; Domain location=13-63; Score=73.4; E_value=7.2e-19; Accession=PF05365.3; Description =Ubiquinol-cytochrome C reductase, UQCRXQCR9 like
  Pfam module annotation: Pfam domain module=Retrotrans_gag::Ribosomal _L1::UCR_UQCRX_QCR9; Domain location=244-322::129-267::13-63
MEAVSRRRGGGIFESLYKVVMRRNSVYVTFVIAGAFLGERAVDYGVHKLWEANNVGAVVISREEGGDNAVMMMVLFAHHVRIVVVCLALQYVIWWWGSLFGGGSGAWRGYKKEKEELAKMIKLQSDALREAISQVVSNSKEKNRKFTETIELQIGLKNYDPQKDKRFSGSVKLPHIPRPKMKICMLGDAQHVEEGKLVLEMEEAQIWAKKVELPAFIGTYPIGWIARTEKFFEVQEIPSFHKLQYAFMSMKGAATHWFYIWSQNNPDSDWESFSTPLIKRFGDRHGNHIFERLSILKQEKPTETETHIKKWETSTKFLKGRTNISEWKHMLCKILNEEVDSHASQQDKNSMEGSGSEFSEAKASSWARKVELPSFDRSIEGGTDLKGSSFECDNDPLQFLKSENKSKEEEVDPLIKREKHKENGVTNVGCEDDFLDNPITDLIKKEVETGDSTKPHCFQDSDFHKKIVIVKQKSFMKVVGTTMVLESWNVNLLDEPLALNFVASMADSLAMELRQKECTKPVKLIKVIWSPPLFLPPPKPPDLSLHAGAQSNKTLGSFSVQFQFSDSNLEDKVDF

SEQ ID NO: 158557 - protein, 249 aa, Glycine max
  Coding DNA Sequence Number=SeqID_66872
  Gene Ontology: Mol. function=transcription factor activity; Cellular component=nucleus; Biological process=regulation of transcription, DNA-dependent
  Homolog annotation: Hit_ID=A7PPI5; Match level="QueryCoverage=65%, HitCoverage=80%, E-value=3e-34, Identity=50%"; Hit description =Chromosome chr8 scaffold_23, whole genome shotgun sequence
  Pfam annotation: Domain name=AP2; Domain location=64-115; Score=74.6; E_value=3.2e-19; Accession=PF00847.11; Description=AP2 domain
  Subcellular localization annotation: CTP_CleavageSite=72; ConfidenceScore=5.87e-01
MAPFNFQQPSPKLLTFTFTFNCQLQTSNYFQIPRPTFPHITTNMRSSNGTSSSRASNGNTGRHPVYRGVRRRSSGKWVSEIREPKKPNRIWLGTFATPEMAAIAYDVAALALKGKDAELNFPNSASSLPIPASSAAHDIQMAAALAATAVGAANDALEGSQGGNVSVSLAEEFSGGNLNHFVDEDLIFDMPNILVNMAEGMLLSPPRFDNFAATDYEYMDEDPNLWGVQWYLLAIVRFAAVAPQTQICM

SEQ ID NO: 158558 - protein, 160 aa, Glycine max
  Coding DNA Sequence Number=SeqID_66873
  Gene Ontology: Mol. function=fructose-bisphosphate aldolase activity; Cellular component=cytoplasm; Biological process=metabolic process
  Homolog annotation: Hit_ID=A9P9L3; Match level="QueryCoverage=66%, HitCoverage=79%, E-value=8e-27, Identity=79%"; Hit description =Putative uncharacterized protein
  Pfam annotation: Domain name=Glycolytic; Domain location=2-158; Score= -99.2; E_value=5.5e-08; Accession=PF00274.10; Description=Fructose -bisphosphate aldolase class-I
MELERQCWGLGGGVAAQWWHGVWGMGPANRRALRELLFTTPGAFECLNGVILFEETLYQKTASGRPFVELLKEGGVLAGMKVDKGTVEIAGTNGETTTQVQQSTLKAWGGKDENIKKAQGAFIARCKANSRATLGELTRVMLPLLRVPPSLSMSRTTNTN

SEQ ID NO: 158559 - protein, 353 aa, Glycine max
  Coding DNA Sequence Number=SeqID_66874
  Gene Ontology: Mol. function=structural constituent of ribosome; Cellular component=intracellular; Biological process=translational elongation
  Homolog annotation: Hit_ID=A7PPG7; Match level="QueryCoverage=17%, HitCoverage=54%, E-value=3e-18, Identity=79%"; Hit description =Chromosome chr8 scaffold_23, whole genome shotgun sequence
  Pfam annotation: Domain name=Ribosomal_60s; Domain location=17-108; Score=71.3; E_value=3.2e-18; Accession=PF00428.10; Description=60s Acidic ribosomal protein
MKVIAAYLLAVLGGNAAPSADDLRTILGSVGADANDDNISNFLSEVKGKDIAELIAAGREKLASVPSGGGAAVSVAAAPGGGAAAPAAAESKKEEKVEEKEESDDAMLNEYKLQKLNWVEFMLNLPLDFVSDHLSFDGKVASSNITCSMLTHSLNMAVIVLPSMSTATISACRTQLQPCLFVVPVVAGDLKGIEISEVENGFFYKKPEELEKKLKKTSKQKPTRRRAKEEKGGGRRGEEGRKKEEEEGEREENKSRRKKRERKMEVGWELPNCKRHSNIEMSSFLTHVSGQQGSFTLHWHSRCALQPLLLLPRLPGVPILMRKSMVENALAVVDDNDYGEGESEGRRVLQGRS

SEQ ID NO: 158560 - protein, 1178 aa, Glycine max
  Coding DNA Sequence Number=SeqID_66875
  Gene Ontology: Mol. function=hydrolase activity, hydrolyzing O -glycosyl compounds; Cellular component=chloroplast; Biological process=carbohydrate metabolic process
  Homolog annotation: Hit_ID=Q9XIS5; Match level="QueryCoverage=97%, HitCoverage=85%, E-value=0.0, Identity=85%"; Hit description=Starch branching enzyme
  Pfam annotation: Domain name=Alpha-amylase; Domain location=643-931; Score=-93.9; E_value=0.00046; Accession=PF00128.15; Description =Alpha amylase, catalytic domain
  Pfam annotation: Domain name=Alpha-amylase_C; Domain location=1038 -1154; Score=100.2; E_value=6.6e-27; Accession=PF02806.9; Description= Alpha amylase, C-terminal all-beta do
  Pfam annotation: Domain name=Isoamylase_N; Domain location=286-361; Score=49.3; E_value=1.3e-11; Accession=PF02922.9; Description =Isoamylase N-terminal domain
  Pfam module annotation: Pfam domain module=Alpha-amylase::Alpha -amylase_C::Isoamylase_N; Domain location=643-931::1038-1154::286-361
MEDEDKYNISEAASSYRHIEDGQGSVVSSLVDVNIPAKKASVSVGRKSKIVSDEVKPKIIPPPGTGQKIYEIDPSLLAHRDHLDFRQHVVPTSKHTRNTGWKDSNDQHMVVHMWSNSCKLPATGQNEDGEQGGGDQLVRNIHLQDRDCSHERREKVNESVNYTSSVKFLILSNVSTGITYREWAPGAKGEAVSGKEGKDKVVFLGGVEGRCYGVANDHDGRCSQICRKEEDEIVPPGTSNGSFVSLPLLTSIQKVAGLTEGGEDCANDEDCGAAALRCGFLQGGDGEETEVDSGGFGSAALIGDFNNWNPNADVMTRNEFGVWEIFLPNNVDGSPPIPHGSRVKIRMDTPSGIKDSIPAWIKFSVQAPGEIPYSGIYYDPPEEEKYVFKHPQPKRPKSLRIYESHIGMSSPSGWGRMENAALYLKEVTNNYGLQPRSWEFTIPEPKILNWLMEMWVLDCDEKGWRNRDSSEEVRVADGIIELCEAVENNSYFTKPIANVSGQAARTCGGFNVVENMLWSPPMLILATAPPLPNPLNLTIVAMFYKICGNVSHGSSTEIRIIQRLITPLPSPDTSSHTEASGLLPAEPPWVCTREICIAGLEETERRSRMAFCKMGLILDLMGQAQPCLSIWVCEERGSLFGPQADGDTYRPASHLRTGPHLWYHVTNFFAPSSRFGTPEELKSLIDRAHELGLLVLMDIVHSHASNNTLDGLNMFDGTDGHYFHPGSRGYHWMWDSRLFNYGSWEVLRYLLSNARWWLDEYKFDGFRFDGVTSMMYTHHGLEVAFTGNYNEYFGFATDVDAVVYLMLTNDVIHGLFPEAVTIGEDVSGMPTFCLPTQDGGIGFDYRLHMAIADKWIEILKKNDEDWKMGDIIHTLTNRRWLEKCVAYAESHDQALVGDKTIAFWLMDKDMYDFMALDRPSTPIIDRGIALHKMIRLITMGLGGEGYLNFMGNEFGHPVKFSIAHSLLLTSEWIDFPRGDQHLPNGVVVPGNNNSFDKCRRRFDLGDADYLRYQGMQEFDQAMQHLEEKFGFMTAEHQYISRKNEGDKIIVFERGNLIFVFNFHWTNSYSDYRVGCSTPGKYKIVLDSDDALFGGFSRLNHAAEYFTSVWNFSKLVSECAPCSGMDTPSEGWYDDRPRSFLIYAPSRTAVVYALADEAEPALADATEPEPVDLDDKLLG

SEQ ID NO: 158561 - protein, 452 aa, Glycine max
  Coding DNA Sequence Number=SeqID_66876
  Gene Ontology: Mol. function=DNA binding; Biological process =regulation of transcription
  Homolog annotation: Hit_ID=Q94FT0; Match level="QueryCoverage=82%, HitCoverage=89%, E-value=1e-133, Identity=68%"; Hit description =Putative uncharacterized protein SHOOT2
MEPNALGGGIFPNISSGLLGVENPLQPQQQQQQPNLQNQRNPHPLHHPQMVSYATHHDTDTHHQQQPPQQPIKHGYNFSAIKSSKSQSTLSDEDEPVFTAEDNSSGDPKRKVSPWHRMKWTDTMVKLLIMAVYYIGDEAGSECTDPTKKKASGLLQKKGKWKSVSKGMMEKGYYVSPQQCEDKFNDLNKRYKRVNDILGKGTACRVVENQTLLDTMDLSPKMKEEVRKLLNSKHLFFREMCAYHNSCGHNNNCGSTSNVQQSTEAQPPHQHQQQQCLHSSENGVGSLRMLKEDEDEDDDSEEFSDEDEEESGEGGSRGMEEDENDVIRRRARNKGGFGVSSSQMMQQLSGEVSGVLQDGGKSAWEKKQWMKKRVVQLEEQQVSYQIQAFELEKQRLKWARFSSKKEREMEKDKLQNERRRLEIERMVLLLRHRELELVNVQQQQHQQQHSST

SEQ ID NO: 158562 - protein, 348 aa, Glycine max
  Coding DNA Sequence Number=SeqID_66877
  Gene Ontology: Mol. function=transferase activity, transferring glycosyl groups; Cellular component=integral to membrane; Biological process=cell wall organization and biogenesis
  Homolog annotation: Hit_ID=A7PPK8; Match level="QueryCoverage=87%, HitCoverage=57%, E-value=1e-153, Identity=83%"; Hit description =Chromosome chr8 scaffold_23, whole genome shotgun sequence
MAVMCILSLLMNSFIAEKGLVVSLCGRKVRYINTGPLLNAETVNADECLMTRMQEMSLDYHFTVEQEVGSSTYAFFGFNGTAGVWRISALNEAGGWKDRTTVEDMDLAVRASLKGWKFLYLSDLKVKNELPSTFKAYRYQQHRWSCGPANLFRKMVMEIINNKKVSLWKKIHVIYSFFFVRKVVAHINTFVFYCIVLPATVLVPEVVVPKWGAVYIPSIITILNAVGTPRSLHLMVFWILFENVMSLHRTKATIIGLLEASRVNEWVVTEKLGDALKTKAGGKAPKKPRFRIGDRIHLLELGVAFYLFFCGCYDIMFGKNHFFIFLFIQSLAFLIMAFGYVGTIVPNS

SEQ ID NO: 158563 - protein, 577 aa, Glycine max
  Coding DNA Sequence Number=SeqID_66878
  Gene Ontology: Mol. function=receptor activity; Cellular component =mitochondrion
  Homolog annotation: Hit_ID=Q1SN23; Match level="QueryCoverage=94%, HitCoverage=99%, E-value=1e-147, Identity=53%"; Hit description =Putative uncharacterized protein
  Pfam annotation: Domain name=DUF668; Domain location=396-488; Score =144.3; E_value=3.4e-40; Accession=PF05003.3; Description=Protein of unknown function (DUF668)
MGGETVNGSWFSVLWPVSRKSASDNKAVVGVLALEVAGLMLKVVNLWQSLSDAEVLSLREGIVNSVGVKTLVSDDDDYLMELALNEILDNFQSLARSVARLGKKCVDPVYHRFEHFVHNPAQNYFQWSGWEYRWKKMERKVKKMEKFVAAMTQLCQEVEVLAEVEQTFRRMQANPELHKLKLLEFQKKVMLQCQEVRNLRDMSPWNRSYDYVVRLLARSLFTILERIILVFANNHPSTVQEQNDYQHMNANNLLRSHSFSVIHSSVHPSEHDLCGFNSGPVGGRPVSKSGFLVDKGRRKKKLQQARHEPALFRNNLHSESKQLGHIVTFKGCMSAANNSPVIQSCMQTNGGSMRLTDCHLKSIDKMKTVDKLSPSNRIRIYSKLSIKNRLKASSLTLGDAALALHYAKMIVLIERMASSPHLVDLAARDDLYNMLPTTVRTALRAKLKRHVKSKSSSNGHDANLAAEWSPVLAQILDWLAPLAHNMISWHSERNFEKEQSIFNTNVLLVQTLYFANQPKTEAAIIDLLVALNYVCRVDTKVGTRDTLDCANSTRSFNGVRLRKNGMYNEFLYTDVDT

SEQ ID NO: 158564 - protein, 162 aa, Glycine max
  Coding DNA Sequence Number=SeqID_66879
MGATYVIKGWDEGIKTMKKGYFCPAVVKAVKTIKKGEKILLNVSLWSVEVKRRVLGDCCLRLTRPLRMHRPHTSFPGQVNTGSDWECLVGFFKCQMIRCGRMHQDQCASLLLAIDSRLGTCNFRRQPVYIVAFKFAKSLKMVHSYKSAYNMLQKYPVYCLHL

SEQ ID NO: 158565 - protein, 203 aa, Glycine max
  Coding DNA Sequence Number=SeqID_66880
  Gene Ontology: Mol. function=oxidoreductase activity; Cellular component=chloroplast; Biological process=ubiquitin cycle
  Homolog annotation: Hit_ID=A7PPK6; Match level="QueryCoverage=85%, HitCoverage=81%, E-value=6e-78, Identity=81%"; Hit description =Chromosome chr8 scaffold_23, whole genome shotgun sequence
  Pfam annotation: Domain name=AhpC-TSA; Domain location=45-183; Score =65.5; E_value=1.7e-16; Accession=PF00578.12; Description=AhpCTSA family
  Pfam annotation: Domain name=Redoxin; Domain location=44-203; Score =184.8; E_value=2.1e-52; Accession=PF08534.1; Description=Redoxin
  Pfam module annotation: Pfam domain module=AhpC-TSA::Redoxin; Domain location=45-183::44-203
MAPIIPEYSEDNFMGFNVGKYYVILGISDRPLRFSSSTITATISVGDKLPEATFSYLDSSGEVQTTTVSELTKGKKAVLFAVPGAFTPTCSQKHVPGFVEKSGELRAKGIDTIACISVNDAFVMKAWKEDLKVNEEVLLLSDGNGTFTKAIGVELDLSDKPVGLGVRSRRYALLAEDGVVKLFNLEEGGAFTFSGAQDILDVL

SEQ ID NO: 158566 - protein, 30 aa, Glycine max
  Coding DNA Sequence Number=SeqID_66881
MEKRVERLNKAVSASSLRVLQFAKRSTSSI

SEQ ID NO: 158567 - protein, 84 aa, Glycine max
  Coding DNA Sequence Number=SeqID_66882
MPTANNLEKVPMWEQLALICPELLMYASLLLLVARETFTDKEPEHQFKIKIYKQSQGRLYYTHERYSSFGELTIIIGPSNSLIS

SEQ ID NO: 158568 - protein, 367 aa, Glycine max
  Coding DNA Sequence Number=SeqID_66883
  Gene Ontology: Mol. function=oxidoreductase activity; Cellular component=proton-transporting two-sector ATPase complex; Biological process=flavonoid biosynthetic process
  Homolog annotation: Hit_ID=A7QJB7; Match level="QueryCoverage=98%, HitCoverage=98%, E-value=1e-114, Identity=56%"; Hit description =Chromosome chr8 scaffold_106, whole genome shotgun sequence
  Pfam annotation: Domain name=2OG-FeII_Oxy; Domain location=217-316; Score=161.5; E_value=2.3e-45; Accession=PF03171.11; Description=2OG -Fe(II) oxygenase superfamily
MALNEQKGKDDIPESQYQKGVKHLCEKGHLNAVPKKYILPVSERPTKSSVEDSNVVKQNLQLPIIDFSELLGPNRPQVLRSLANACQQYGFFQLVNHCISEDVVRSMIDVSGRFFDLPLEERAKYMTTDMRAPGFLETPVPSLTRFTPPLACFTSGLSVSSGLLVYYYKQVRKVVATYAEETKHLFLVVMEAILESLGIVEANQEEDDNILKEFENGSQMMVANFYPPCPQPDLTLGMPPHSDYGFLTLLLQDEVEGLQIQHQDKWVTVQPIPNAFVVNVGDHLEIYSNGKYKSVLHRVVANEIKSRVSVASLHSLPFNCTVRPSPKLVDEANPKRYMDTDFGTFLAYVSSTEPNKKDFLESRKVLH

SEQ ID NO: 158569 - protein, 275 aa, Glycine max
  Coding DNA Sequence Number=SeqID_66884
  Gene Ontology: Mol. function=metal ion binding
  Homolog annotation: Hit_ID=Q8RWG0; Match level="QueryCoverage=57%, HitCoverage=15%, E-value=4e-38, Identity=53%"; Hit description =Putative PHD-type zinc finger protein
MDAAVKPETEYAAVSTDQPRKVSVVNGYIVYTRAKRSLDSCNGFSEHAELKDNAEVEVKTENGECEKLKNESTEVVARTRKRSRRSALEAKVECCDQMVVSETEQVVANGGSGINGALGAPRNKMELKMSKKIVVNRKPMTVKKLFDTGFLDGVSVVYMGGIKKASGLRGVIRDGGILCSCCLCNGRRVIPPSQFEIHACKQYRRAAQYICLENGKSLLDLLRACRGATLHTLEVTVQNFVCSPHEERYFTCKRCKGESVKQIIFLFAKIKGKCN

SEQ ID NO: 158570 - protein, 492 aa, Glycine max
  Coding DNA Sequence Number=SeqID_66885
  Gene Ontology: Mol. function=transferase activity, transferring glycosyl groups; Cellular component=integral to membrane; Biological process=metabolic process
  Homolog annotation: Hit_ID=Q8S9A0; Match level="QueryCoverage=97%, HitCoverage=95%, E-value=0.0, Identity=74%"; Hit description =Glucosyltransferase-9
  Pfam annotation: Domain name=UDPGT; Domain location=1-473; Score= -77.4; E_value=1.1e-06; Accession=PF00201.9; Description=UDP -glucoronosyl and UDP-glucosyl transferase
  Subcellular localization annotation: CTP_CleavageSite=39; ConfidenceScore=5.22e-01
MAQGHIIPMMDIARLLARRGVIVTIFTTPKNASRFNSVLSRAVSSGLQIRLVQLHFPSKEAGLPEGCENFDMLTSMDMMYKVFHAISMLQKSAEELFEALIPKPSCIISDFCIPWTAQVAEKHHIPRISFHGFSCFCLHCLLMVHTSNICESITSESEYFTIPGIPGQIQATKEQIPMMISNSDEEMKHFGDQMRDAEMKSYGLIINTFEELEKAYVTDYKKVRNDKVWCIGPVSFCNKDDLDKAQRGDQASINEHHCLKWLDLQKSKSVVYVCFGSLCNLIPSQLVELALALEDTKRPFVWVIREGSKYQELEKWISEEGFEERTKGRGLIIRGWAPQVLILSHHAIGGFLTHCGWNSTLEGIGAGLPMITWPLFADQFLNEKLVTKVLKIGVSVGVEVPMKFGEEEKTGVLVKKEDINRAICMVMDDDGEESKERRERATKLSEMAKRAVENGGSSHLDLSLLIQDIMQQSSSKEEIMSTPKESQFSCNV

SEQ ID NO: 158571 - protein, 84 aa, Glycine max
  Coding DNA Sequence Number=SeqID_66886
MASFCDVVLPMLLSIGIKAFDCVSATNDGCAQPACVDAKEAEHGVMLESNCKVWNLSLTLEVWGSSGGFTRHLALQLQWLPFVK

SEQ ID NO: 158572 - protein, 389 aa, Glycine max
  Coding DNA Sequence Number=SeqID_66887
  Gene Ontology: Mol. function=transferase activity, transferring glycosyl groups; Cellular component=integral to membrane; Biological process=metabolic process
  Homolog annotation: Hit_ID=A5BL00; Match level="QueryCoverage=98%, HitCoverage=97%, E-value=1e-132, Identity=52%"; Hit description =Putative uncharacterized protein
  Pfam annotation: Domain name=UDPGT; Domain location=1-388; Score= -159.5; E_value=0.014; Accession=PF00201.9; Description=UDP -glucoronosyl and UDP-glucosyl transferase
MVLPLKQPHFVLVPLLAQGHMIPMVDMARILAERGVIITLVSTLNNASRFEQTVIRAAKSGIPIQLLQIPFPCQKVGLPLGCENLDTLPSRNLLRNFYIALEMTQEPLEKYLQTTLLLQLYNSHLSCSSDSEPLLIPGLPQRAEMSASGVVVNSFEELEHGCAKEYEKALNKRVWCIGPVSLSNKDGLDKFERGNKPSIEEKQCLEWLNSMEPRSVLYVCLGSLCKACYISIDRTWDEKFDERVRGRGLVIKGWAPQTLILSHPSVGGFLTHCGWNSTIEGVCSGLPMITWPLFAEQFLNEKFIVQVLKIGVRIGVEVPVRWGDEEKVGAMVKKSRIMEAIEMCMLGGEEEEKRRNRAIELGKMARNAIVKGGSSHFNISCLIEDIMKH

SEQ ID NO: 158573 - protein, 465 aa, Glycine max
  Coding DNA Sequence Number=SeqID_66888
  Gene Ontology: Mol. function=transferase activity, transferring glycosyl groups; Cellular component=integral to membrane; Biological process=metabolic process
  Homolog annotation: Hit_ID=Q589Y3; Match level="QueryCoverage=97%, HitCoverage=98%, E-value=1e-128, Identity=48%"; Hit description =Glucosyltransferase
  Pfam annotation: Domain name=UDPGT; Domain location=9-457; Score= -81.5; E_value=1.7e-06; Accession=PF00201.9; Description=UDP -glucoronosyl and UDP-glucosyl transferase
  Subcellular localization annotation: CTP_CleavageSite=31; ConfidenceScore=5.19e-01
MAFQAHHQHFLLVPFMSQSHLIPFTHLAKLLASNGVSVTIVLTPLNAAKFNTLIDQAKALKLKIQFHVLPFPSAEAGLPEGCENLDTLPSPQYKHLFFSASNMLKEPLEKWLSELETLPTCMVSDICLPWTTTVASKFKIPRVVFHGISCFALLCSHKIGHSKVHENVTSMSEPFVVPDLPDAIEFTKAQLPGAMSQDSKAWKHAVEQFKAGEHSAAGILVNTFEELEKMAGRDGNETSLDESECLNFLSSNKPCSVIYVCFGSLCRINASQLKEIALGLEASSHPFIWVIGKSDCSQEIEKWLEEENFQERNRRKGVIIRGWAPQVEILSHPSTGGFLSHCGWNSTLEAVSAGIPMITWPMSAEQFINEKLIVQVLKIGVRIGVEAPVDPMETQKALVKKECVKKAVDQLMEQGGDGEQRRNRAREIKEMAQKAVEDGGSSASNCELFIQEIGAVEDGGSSASK

SEQ ID NO: 158574 - protein, 759 aa, Glycine max
  Coding DNA Sequence Number=SeqID_66889
  Gene Ontology: Mol. function=binding
  Homolog annotation: Hit_ID=A7QJC7; Match level="QueryCoverage=92%, HitCoverage=45%, E-value=0.0, Identity=73%"; Hit description =Chromosome chr8 scaffold_106, whole genome shotgun sequence
MGLVAASHLDTVLEKLKDILDNVGQSIFQRILSLFSDSFRTEESDDIHAALALMYGYAAKYAPSTVIEARINALVGTNMLSRLLHVRLPKAKQAVITAIDLLGNAVINAAESGSPFPLKRRDQLLDYILTLMGRDDEDGFADYNDLLRTQALAISACTTLVSVEPKLTVETRSHVMKATLGFFAIPNDPVDVVNPLIDNLITLLCAILLTGGEDGRSRAELLMLILRQIDQFVCSPVEYQRKRGCLAVHEMLLKFRMICVSGYCALGCRGSCAHNKQMDRTLYGNFSKLPSAFVLPSREALCLGDRVIMYLPRCADTNSEVRKISAQILDLLFSISLSLPRPAGSSISAEDIELSYSALSSLEDVIAILRNDTSIDPSEVFNRIVSSLCILLTKEEASVFDSLVATLHGCSVAICDKIKQSAEGAIQAVVEFVTKRGRELTEIDISSTCCYLIRGRALMVKLCLGDRLVMGLNLETASLHMQGQIHPLLVKKISSLAENTSPRTVFDEVLAAAGRDTITKDISRLRGGWPMQDAFYAFSQHMVLSVLFLEHVISVLSQIPILKGDVERLEDSQVDSHTEDGKLQAAIFALTAFFRGGGKVGKRAVEQNYASVLSELTLQLGSCHGLTYSGQHEPLSFQGKLGRYLNLNLLTAFQAFCECVGDLEMGKILARDGELLENERWISLIGDIAGCISIKRPKEVSLSGGSWSTGIPLESPQQLVSEPMVQVGDRLRRVCKYRRWSEWLAAQRAPQVKRGGQNG

SEQ ID NO: 158575 - protein, 185 aa, Glycine max
  Coding DNA Sequence Number=SeqID_66890
  Homolog annotation: Hit_ID=A7QJC8; Match level="QueryCoverage=21%, HitCoverage=19%, E-value=1e-08, Identity=77%"; Hit description =Chromosome chr8 scaffold_106, whole genome shotgun sequence
MAGVFQVMAFGVRALDKKDVDSAFMAKLAKIATAELISSKAYGGLACVFDSVRNQIIAVRTQNLTRKKLKRSCKLYDTFNYESLTNLAGSVRPQKEWQHPVCCSSNGCHAWLEWCFSPPKLKEMATRVAKSHCTSVLIAVPLMAVLASCGSKKRDDLIHKPNGPNPKRQSTLDCVLVARHTVFQL

SEQ ID NO: 158576 - protein, 94 aa, Glycine max
  Coding DNA Sequence Number=SeqID_66891
MVVWLVTMVIRLLGWQRRSGGVSDVGSGDGVWGTQTFGQARSTMDSGQNPTERRRHLHLRVEGHMDRPLDPFEVWDVCMDEQGQQPWDVEQRTW

SEQ ID NO: 158577 - protein, 192 aa, Glycine max
  Coding DNA Sequence Number=SeqID_66892
  Homolog annotation: Hit_ID=A7QJF2; Match level="QueryCoverage=97%, HitCoverage=34%, E-value=3e-49, Identity=55%"; Hit description =Chromosome chr8 scaffold_106, whole genome shotgun sequence
MDEESKRMEEGINSALNGGGNKDDLKRRVTIKTSNGGSVIEHDKGTMAKPYGAESESVQKIAEQEQPVVKQKTKRIATLDAFRGLTIVLMILVDDAGEAYPRIDHSPWNGCTLADFVMPFFLFIVGIAIALALKRIAKIKHAVKKIILRTLKLLFWGIILQGGYSHAPDDLEYGVNMKFIRWCGILQRYQLT

SEQ ID NO: 158578 - protein, 246 aa, Glycine max
  Coding DNA Sequence Number=SeqID_66893
MEPNQFETYVLAVPRTRSNLSSSNNQEVIVIPDVESQNRVQEDGSNKRRRTEEEGEAAAASHSKDINEPLVCPICMDIWTSRRRTSHLVQSQSPLLTLIYILSPCVLIGYVMLFCLPCGHIYDMSSIQKWLQHRRNSNKIIQSLEAKSTALESKVLRTMIGARKKPNGTREKLHCIFKLRSLHRSHDAGIPSLSIDAFNETLGRAEHMSFDQRIAMMKKLSVAFCRVWSGVVSMKLKKMLEQLSLE

SEQ ID NO: 158579 - protein, 138 aa, Glycine max
  Coding DNA Sequence Number=SeqID_66894
  Homolog annotation: Hit_ID=Q6WAY4; Match level="QueryCoverage=96%, HitCoverage=24%, E-value=1e-12, Identity=35%"; Hit description =Putative uncharacterized protein
MGPLQRKVFRKVYGKILDLTTTKVFTEAVVSLAQYYDLPLRCFTFGDFQIVPTVEEFEEILGCPLGGRKPHLFSGFLPSLSKIAAVVRDSARELDRMKQTQNGVVGLPRKYLEGKARDMASQEEWVPFADILALLIFR

SEQ ID NO: 158580 - protein, 86 aa, Glycine max
  Coding DNA Sequence Number=SeqID_66895
TRHPLDPEKSNKALGFPALITGLCQSYGIPVTLSKYCTPSQAQGDAHQAADAPPPPRQADPAGSLGVERYLQYLVRQQAANHRGKV

SEQ ID NO: 158581 - protein, 77 aa, Glycine max
  Coding DNA Sequence Number=SeqID_66896
MSPDLTGQDDRKKSFLRITAWGISVRHQTSRVWMTETICTDNRLGYPRTSPDFTGQDDRKCGRRRKSPRVNGLVGLD

SEQ ID NO: 158582 - protein, 124 aa, Glycine max
  Coding DNA Sequence Number=SeqID_66897
MASRKRKATTSRPQEPFHTTRFTSDGAWERYSQNIHFRNILPERNVNLFVTEYDKFRRELIKWNWYKTLTQFMDGHIDVALVKEFYSNLYDPKDKSPNQVRVRGRVIKFDVGSLNAFLETPPYS

SEQ ID NO: 158583 - protein, 100 aa, Glycine max
  Coding DNA Sequence Number=SeqID_66898
MLSYNLRQGRWGLQFIGSGLKSINQTFSSTWVQGIIYSCPRKINESLANNHPEQQWAHPELVQARHEVKKEYPGLAAICCIVGVLGSWAVEASPPPKGEG

SEQ ID NO: 158584 - protein, 194 aa, Glycine max
  Coding DNA Sequence Number=SeqID_66899
  Subcellular localization annotation: CTP_CleavageSite=28; ConfidenceScore=5.13e-01
LASHARLAIVLFQLSEHAKRVCLAKRPMASRKRKATTSRPQEPFHTTRFTSDGAWERYSQNIHFRNILPERNVNLFVTEYDKFRRELIKWNWYKTLTQFMDGHIDVALVKEFYSNLYDPKDKSPNQVRVRGRLIKFDVASLNAFLETPPYSMFCRSCTDPQELASKLCIPGSALEAPEEGSDNAGPNLERVVIF

SEQ ID NO: 158585 - protein, 150 aa, Glycine max
  Coding DNA Sequence Number=SeqID_66900
MDRGPGTSYKDAGLSLGEVWFDMVGFHKGVVSLDEGGVWGFGVMGEGGRTGKEEKRGRMKGKKMAASKENSIVRELVAMKERGDCNREEDRGDEVHHFKDTEHCDVKSSETKVLLRDGGCLQQSYEVVEAVAEECMTKMRYNLESNNMVS

SEQ ID NO: 158586 - protein, 109 aa, Glycine max
  Coding DNA Sequence Number=SeqID_66901
MAKLNSTKPAFKVMIAPTFIRSGPLEHGQRQRVAVTADHVDEPVIPAPDVQDDLMEAPATVEDIPADILVDAGAKAVEDQPQGFPGGPSDPSVLTAYADHVACSVWTGE

SEQ ID NO: 158587 - protein, 154 aa, Glycine max
  Coding DNA Sequence Number=SeqID_66902
  Gene Ontology: Mol. function=ATP-dependent helicase activity; Cellular component=RNA-induced silencing complex; Biological process= multicellular organismal development
  Homolog annotation: Hit_ID=A7P045; Match level="QueryCoverage=33%, HitCoverage=8%, E-value=9e-20, Identity=92%"; Hit description =Chromosome chr6 scaffold_3, whole genome shotgun sequence
  Pfam annotation: Domain name=DEAD; Domain location=31-154; Score= -38.1; E_value=0.029; Accession=PF00270.20; Description=DEADDEAH box helicase
STKRNTHGLSARKTLEEDELYRLELEAGAGLRAQDEFVSDCEILEASWLWKAKSSVGSSLTISTSISGARYYTGTFNTINRSPDGRYVVVSSRGNFYLTWEPGQMIRYLALDEADRMLDMGFEPQIRKIVEQIDMPPAGARQTMLFNATFPKEI

SEQ ID NO: 158588 - protein, 204 aa, Glycine max
  Coding DNA Sequence Number=SeqID_66903
YIYLGCNTENKRGYICCGSVQVERTSIWLFKENKGGYIPCGSLLVKDFTRLLEISRTGGCLGTGCHLIQHILLSRSSNLAQAFEEDLILMWAFQTGRQIDWAHLVRYQMHKVVRANALLPYPYLVTLFLHHFNIALDDEPFVKVKRSFSIGAGEQFNAMDTRLDAMDARCDGMDMRITHLEDDISFIRHCFDPSTDSWLFIIMF

SEQ ID NO: 158589 - protein, 109 aa, Glycine max
  Coding DNA Sequence Number=SeqID_66904
MLLLFLIFVFPLLLSKPFLFLASHQTCLRKKNSDLELIYRWIVMKFEHHVYNPIPRILTVGNFVPHIFTVGICEIIFTEREKGIAPRQYKWRLQSLLYFSDVWELYRNS

SEQ ID NO: 158590 - protein, 155 aa, Glycine max
  Coding DNA Sequence Number=SeqID_66905
MATKKLTSKRARKTTTGEGSSTAPPVEFEFDGHHFHKIARTHWTQLAEPMPKDDLEVVLEFYANAWPTKEGVMDKRSKVRGQWIPYDTDAINQFLGNPLIVEEGQQCEYTAIRGQTTGFDEKAIDQLLCFPRRNFLWSMERKWFQIMHTNMMTLT

SEQ ID NO: 158591 - protein, 83 aa, Glycine max
  Coding DNA Sequence Number=SeqID_66906
MVASCGVDKIRDKVDQVCPSFLCTGKSLVPHCKSYDNPCYFARWAATRKLLYQFRDVENNTDGDALITKQILSLGAGFDPTYF

SEQ ID NO: 158592 - protein, 332 aa, Glycine max
  Coding DNA Sequence Number=SeqID_66907
MGKRKLEMGIDDQKVKFDLFDTIEHSPDQDDCLKVNKEKNERVLKMASRKRKATASRPREPYDTTKFTSEGAWERYSQNIHSWNILPKRNVNLFVTEYNEFRRELIRRNWHKALTQHMDGHTDVALVKEFYSNLYDPEDKSLRQVQGEVGIWLGNEDEHGRGLTHLRPDFTDGPVQLLSTGFLALITALCISRGVVSDSLTFESLSPAINLSYIKKNCWNLDNPTITILGARKARTRGLDSSAPSSSTPALSLAPSIHNLAQHRPIISMEEFAAQASTAQESQPQPEVVSEVTPESTPQALPVTTPVLKVSDEEDGAADADYEADMIATQST

SEQ ID NO: 158593 - protein, 202 aa, Glycine max
  Coding DNA Sequence Number=SeqID_66908
MKKKKVAAASVSLSEAYVLSEQQLLSEALSSLSELGESGKESTKHARAQCIISSPSESFVFSGAKRAWLTKPKFTNSRLVRKWVKAGPDPSHSGCSTSTTTSHSSTSHLIFHQPALPHVAKPPPWPVSLDAEPSPVISPATSDDTIGIPISGCLARSPASFCKGGDTFGTGNDDATKIGADDDYFGDITAAHVAWDPWPTQE

SEQ ID NO: 158594 - protein, 151 aa, Glycine max
  Coding DNA Sequence Number=SeqID_66909
MTTMMEAMMSMRKMMEDNTATVVAASTATEMDPIHPTDFNQVQSKHSFPPYGLPPNYTSPTVVYTSGENISNFVPVLIENQQPQSDHAHVSQPMGETHEVPQDHTPAGFGVYPGYTTEGIHDVGYNVQDILPENTGVAKSIEVAGSTMSDT

SEQ ID NO: 158595 - protein, 137 aa, Glycine max
  Coding DNA Sequence Number=SeqID_66910
MRLHYYQASWGPSMTTDRPSLPMANIDPVLRTLKPFPCMAIYKKRSFGAGEARPGELELAQASQLLGLEGISSPRRAGCLRLKLSHGPGEPDAGMGEFRSRKFQKMTILTLSLWSAFVFGFDNQTSTLSDPSALHCN

SEQ ID NO: 158596 - protein, 372 aa, Glycine max
  Coding DNA Sequence Number=SeqID_66911
  Gene Ontology: Cellular component=ribosome
  Homolog annotation: Hit_ID=A6BLN7; Match level="QueryCoverage=92%, HitCoverage=71%, E-value=1e-21, Identity=25%"; Hit description =Putative transposase
MDLKENCTYVMHNFKVLKNNGQYRVCDHQFKLVFIGVTVVRECVLGDIPFRKYRFAGFADVVAGQFERGLLVDVIGVVEEVVFRQVSGKGRRVVFKLKDLSQQLLSCTLWDDYCLQFLKFLDDYEGDGPITVLLSHCRIKEAQGSYPASINNSFKASKLIINQPVMEIQEFNERLAELGIEARSGFKSHGEGSTQLSGSIQLSSKESFFGKAEAKTIADINTIPECHKKSDVEIAPFTCACNKYNKEAMLRYRLEVMINQGNESTKLLLWDRECSELIGQSADAVNKLKIEDGDVDLNASPQALDKLLGYELAFKIKVQPKFRNYVVLKCSADSSLINVVMDMLADAEVMFNTSSKMDIPVSDSNHSSQHES

SEQ ID NO: 158597 - protein, 108 aa, Glycine max
  Coding DNA Sequence Number=SeqID_66912
MVLFLTGAGSYPCSVSNSLKASKLTINEPVAPIEEFNKKLSELGIEICSVLTRRSQWSSQPSGSAQLSSRETFISKSEAKTISEINNFCEVIILYMFTCLSLLWLPPA

SEQ ID NO: 158598 - protein, 80 aa, Glycine max
  Coding DNA Sequence Number=SeqID_66913
MEFDLDLRAFAKRDIQWLSARKNPEEDELSSSLSAPLQVIKCTASAYPLSETSALNQNPLMRAKRSRSALSARARTRPPI

SEQ ID NO: 158599 - protein, 26 aa, Glycine max
  Coding DNA Sequence Number=SeqID_66914
MTEDFESYEGEDFETYEGEDFESSEV

SEQ ID NO: 158600 - protein, 123 aa, Glycine max
  Coding DNA Sequence Number=SeqID_66915
MIDLIQHKKLQPRYAHCYINTKAARVLYQRDVVTSCTTSVPSIRISAFFKCIGKGFNSKEGVATYPSAGGRRETRGMRVPRKEYARSRHQRLFEENVGKTGKDAIYELFSERFGSCIYARGRY

SEQ ID NO: 158601 - protein, 54 aa, Glycine max; identical to SEQ ID NO: 97481
  Coding DNA Sequence Number=SeqID_66916

SEQ ID NO: 158602 - protein, 161 aa, Glycine max
  Coding DNA Sequence Number=SeqID_66917
MEILCKGSKRIYLKPGKACKRLSEGVNQVEKDDSQTELGKHMQDLTLKNETLMPRECTIDDELVATMDENNFVVGRNNSYNQLMRMFVSYWGELSSVLLIYLLSMGMLDPLERVLTDEDLDRELKLEVNEILTFLHSQHSLGLPSCERLEWGNVPKLKPPN

SEQ ID NO: 158603 - protein, 746 aa, Glycine max
  Coding DNA Sequence Number=SeqID_66918
  Gene Ontology: Mol. function=identical protein binding; Cellular component=extracellular region; Biological process=negative regulation of catalytic activity
  Homolog annotation: Hit_ID=A7QAJ2; Match level="QueryCoverage=83%, HitCoverage=84%, E-value=0.0, Identity=66%"; Hit description =Chromosome undetermined scaffold_71, whole genome shotgun sequence
  Pfam annotation: Domain name=PA; Domain location=241-334; Score=62.8; E_value=1.1e-15; Accession=PF02225.13; Description=PA domain
  Pfam annotation: Domain name=Peptidase_S8; Domain location=15-464; Score=35.3; E_value=1.2e-08; Accession=PF00082.13; Description =Subtilase family
  Pfam module annotation: Pfam domain module=PA::Peptidase_S8; Domain location=241-334::15-464
MPVLHLGIWPESPSFRDEGIGEIPSRWKGVCMEGSDFKKSNCNRKLIGARYYNILATSGDNQTHIEATKGSPRDSVGHGTHTASIAAGVHVNNASYFGLAQGTARGGSPSTRIAAYKTCSDEGCSGATILKAIDDAVKDGVDIISISIGLSSLFQSDFLSDPIAIGAFHAEQKGVLVVCSAGNDGPDPFTVVNTAPWIFTIAASNIDRNFQSTIVLGNGKYFQGTGINFSNLTHSKMHRLVFGEQVAAKFVPASEARNCFPGSLDFNKTAGSIVVCVNDDPTVSRQIKKLVVQDARAIGIILINEDNKDAPFDAGAFPFTQVGNLEGHQILQYINSTKNPTATILPTTEVSRLKPSPIVASFSSRGPSSLTENVLKPDVMAPGVGILAAVIPKTKEPGSVPIGKKPSLYAIKSGTSMACPHVTGAAAFIKSVHTKWSSSMIKSALMTTATNYNNLRKPLTNSSNSIADPHEMGVGEINPLRALNPGLVFETDVEDYLRFLCYFGYSQKIIRSMSKTNFNCPKNSSEGLISNVNYPSISVSTLKKQQKAKVITRKVTNVGSLNATYTAKVLAPEGLVVKVIPNKLVFSEGVQRMTYKVSFYGKEARSGYNFGSLTWLDGHHYVHTAAIAGLLDAEPHHMSKKNYLRCCRDRYVDVTAAGKGSTFAPGLFAVKVASVASKLGITTAFYSIVTPSLWAFMGETPSSLMGNEWLNPWWVPFPTTVVAFGYFENLKRHGVSSNACRVGLSI

SEQ ID NO: 158604 - protein, 599 aa, Glycine max
  Coding DNA Sequence Number=SeqID_66919
MEYVAGELDMELVLPFLLYKSRANCFAHVVFAELSEDCFQVCHLLGYALRFDDHVVDAKRHDPIAKVGIFSYKCHLLLVCSVHPDLVVSERSINYSVDVGQRVCIFGACPVHISIVGVHSSFAIGLFDHDNIGEPVKYLISPMKLALRRTNGELVADNVGMDFWHVRWLPSEQVHVLICNLSSSSMGFEPLSEVSSRKSLSNSSSRLAWLPNGRIGCYLQALYIALPCLLLILLEDVDVPNGLARLSSIGKFSHNGVVAHTSATGVSVYLDLLLYLFFYVHRNSYVSPLTFLWYLVVSNPSLGGFVGGILMGTSKFKASSRIVVQLAVRVGLGVSFSLVVLLSDLCLLSDFVPKSRHFIHLDVALDSFAQLVHATRVFFCIDCSRTCWAVGQGAWNVMLHTDQGGRGHAMRPVGYVLLTKVFDDDVEAVYGSWWESTVPGIQMLIWIGGPIIPLQERLRSSGVLIVHRGCDSLGCAQAMCEWSTRRLGDLSRLLLMASLSFGVAEEYLYVMAAGGGLKPSKGVSRLKLDQVLTIGEKDRDDKVLRGGLLDFTCQSRVTFVRRTRRETCKTKDSDAQGSMEPGIYKSGMELGGPCLQGLL

SEQ ID NO: 158605 - protein, 248 aa, Glycine max
  Coding DNA Sequence Number=SeqID_66920
MEDRVLEVTKTNVCMILIANIDRVLCPSAITEILHRHTSVSASVFIFLNLSLEVYTWGAIVLDSEKEFQELCDFLNNPNCIVTSSTGRPWVILEKPVGLKNIKASIGRLVHVTKNILQKGKSGTSNNLKVVHSRTQEFKIASDMRDLFLEFFNHQERLHKRLALEERRVSFKLVPIELSRSYVRQEIINFGTYCKRDKLVAVVPYVKMKIISRLLDLVKNHCILITEMVIHTSMPLIKIVALYSTGST

SEQ ID NO: 158606 - protein, 88 aa, Glycine max
  Coding DNA Sequence Number=SeqID_66921
MARRAIKLDPPLPLALQDVTWTVPPFPLARRGDVDGTTIATGDTGHVGEGLAFCSGEICEKKVSPSLVARYMVHHVKKLSPGSQICSV

SEQ ID NO: 158607 - protein, 290 aa, Glycine max
  Coding DNA Sequence Number=SeqID_66922
MDCVIFKVSTSNAETEDTNCSLNFLMKLNPTPAMFLNTIPLYRSKAALRMAEPPPFPATERVNTGSTERVLPPEVNSPEVNSNVPSSASMRVHSPMSDDVLDYSSTSEVGRGGGRGGDFLASAELLQLGSLLLGGLFADLGLRRCCGSGEIVYSRPRHVEIHLFARTAWIVYSRASPFCERKHKRRKGSKEVQETRLKEALASFKVYEPLKKRKLYEPLPVPPPSLPGGTRMKFEACKKATSGLSVACFGKTLTPPCLNSNKVISLSSLLPERIVSVDGHLGMFLWESCA

SEQ ID NO: 158608 - protein, 48 aa, Glycine max
  Coding DNA Sequence Number=SeqID_66923
MAEKEMTPSWMTMTKMESGTTLSSTNMSQPINLNSKIEIEDKTLSFAI

SEQ ID NO: 158609 - protein, 227 aa, Glycine max
  Coding DNA Sequence Number=SeqID_66924
  Subcellular localization annotation: CTP_CleavageSite=40; ConfidenceScore=5.04e-01
MKNTMSSSSNTNHRTCRQRSPTVARNHRGGVGWCFVEECEGAGGGGGVPEVDVGETAEPGGGGGGVGEEEVGDECRVDKAGNYEREVYKGEVFLRWELRGTKLISTEHEFNSYRMEEVVEKFLKKYFLDSKTAEGKLLDTSASGKIKFKTPDEAMELVENMVASDHAILRDQAYTPTKKSLLELKSKDALQAQNKLLANQIETLTKTLNKLQSCKLGDATFVARPMS

SEQ ID NO: 158610 - protein, 59 aa, Glycine max
  Coding DNA Sequence Number=SeqID_66925
MAIYRKRSFGTGKARPGLLELTQASQLLRLEGISSPRSDNQASTLSSPSTLCCNRCQTP

SEQ ID NO: 158611 - protein, 162 aa, Glycine max
  Coding DNA Sequence Number=SeqID_66926
MKADIEAMKEQMTTMMEAMMSMKRMMEVNVAIVVAASTATKVDPTHPLASIKFRTSIPFHHMVCLPTIHHPMLHTLSMRMLKTPHPYPLRANNPNLIMHMSLNHNLADFEPHLEYAAEGRRFAMYPYQTLWGALSIAHNHNPCISRWEESLLLWWKGRNLII

SEQ ID NO: 158612 - protein, 53 aa, Glycine max
  Coding DNA Sequence Number=SeqID_66927
MALHIDYDAIFPRKGPATRAMSKRLQEDWARATEEGPRVLMKLRVCKVPYPTS

SEQ ID NO: 158613 - protein, 35 aa, Glycine max
  Coding DNA Sequence Number=SeqID_66928
MDVKKTILNGDLKEEVYTKEPKSFSSSSGAKKFKD

SEQ ID NO: 158614 - protein, 97 aa, Glycine max
  Coding DNA Sequence Number=SeqID_66929
  Subcellular localization annotation: CTP_CleavageSite=92; ConfidenceScore=5.33e-01
MNSLRSSMIAVIFAMTLILSYGVILSQARTTHPSSPLVSKMSQSSQSHSHSLLHKEEHKSTQEPAVATSLRRIPPSRPNPTQNRFKFLGLLVCESVV

SEQ ID NO: 158615 - protein, 100 aa, Glycine max
  Coding DNA Sequence Number=SeqID_66930
MKGLWKKRERFIWVALGWGGGRKKKGQYEKKKEKGKGHGFGTKMEKEKGKEMLIHEKEGHYQLGLQELVWNHLVGKKFQDSLLEQNVLELVIEVHDIVVE

SEQ ID NO: 158616 - protein, 135 aa, Glycine max
  Coding DNA Sequence Number=SeqID_66931
  Pfam annotation: Domain name=Transposase_23; Domain location=57-127; Score=-2.6; E_value=0.0023; Accession=PF03017.5; Description =TNP1ENSPM transposase
MALSLQNMLALVEYSMPKPIHFVKGLALPPEPQVGPLGPRVSTKGSCVDPSGNDPETGDSDRCGLYIEANPDRLVALGRIYEGSTVVHNTPLLPGQVKLGVEEVKDADAPIPVPTNEVSLVGQAIDTFLAWPTYL

SEQ ID NO: 158617 - protein, 148 aa, Glycine max
  Coding DNA Sequence Number=SeqID_66932
MASINSMEAREVACNKDEKEALVMSQILMIYEKASGQTLNLNRSEIFCHNTAHNHRELLANILGVMECLSIGWYLGKQGFRLITYPNGLISHIFKAKFGQYESSWRLNLAIIQVIPREAYGIPNHWLRKVANGKLGMERLLSCGTTLG

SEQ ID NO: 158618 - protein, 126 aa, Glycine max
  Coding DNA Sequence Number=SeqID_66933
MEDEEAEAVAELKHVRRRIVAAGSPLHAEADNEALLVDEVAVEVERGGDPPLDHGGVGGDDDDDIVFGEIDSVDVVVVTMLYVCDGGYGLENILVSKCYERVIHIEKQIYAMINTLIIRTYVVPMR

SEQ ID NO: 158619 - protein, 121 aa, Glycine max
  Coding DNA Sequence Number=SeqID_66934
MIGHWDMLGAPSIIVGAPSNLLKGQHSLPPQATASPAAASFAWTPLPFENHRVEDESRRCRKKWGKGADGEASGRPVMGSSETSGRTFSGNFPKEVFFRKKPNVFRKNSSSGNFPEEVFFL

SEQ ID NO: 158620 - protein, 75 aa, Glycine max
  Coding DNA Sequence Number=SeqID_66935
MHSEEVVPCFRIICSIPSLTRSLTLLLSPTSPDSIAEGYTRLMVAGVEAKVEEELWRLKAALNCLAMPIAYAVKD

SEQ ID NO: 158621 - protein, 84 aa, Glycine max
  Coding DNA Sequence Number=SeqID_66936
  Gene Ontology: Mol. function=aspartic-type endopeptidase activity; Biological process=RNA-dependent DNA replication
  Homolog annotation: Hit_ID=Q69F85; Match level="QueryCoverage=77%, HitCoverage=3%, E-value=7e-11, Identity=47%"; Hit description=Gag -pol polyprotein
MNYPIKEVLRKLELIGRMVAWPIKLAEFDIHYKPCGLMQTQFMAEFLAEFTGNDTTTLEWWTLYVDKETTVPATSKQRKYKGGT

SEQ ID NO: 158622 - protein, 166 aa, Glycine max
  Coding DNA Sequence Number=SeqID_66937
MASQGVIQVSISLVTLKPMPYLLVNYKKKIEAFIEALFVTLKIEAFNDREEGSGGCGGAQLAGENSTTKDNNDRETDVESDVARREFDLIEETVLVVKKESRPKLLIQVSKNRSEANKAKIPGIPLSERPQAESESTEAEVKGKLIWIDSKQQTTRGKVIKLRLNL

SEQ ID NO: 158623 - protein, 614 aa, Glycine max
  Coding DNA Sequence Number=SeqID_66938
MVLLAWVDSKLAPIVELLYFLNVDGVVHLQYGSSFFWVGFNPLAKWHDLVAKIDFFSDEYHFFLIWRMYSDLVVSEINIVCAYSPFSVGLFDHDNIRELTRKSNLSNEVWPRADGQFVVDYARMDSWHVPTEPRALPWFRFELQLDKLFDGFWASIRGVISQIYVKFIAHARSIDGQGSDLRPFIHCHDLSAFSRCEILVSFDGYNLPDSVGNFIVRWGVETMAPGSLSVFMSIKANHQIHVASGLDSLACEAGEWTNVMVDNVGCYDDGDNHEVVLVDGVDALEVPVCKDKPPMMVLITPLMCWGVPTLVEVVAHATVIGVFVYLGLWLFFYLLPGSCSSPLDVLQVLLLLGGCLVECFLKNRGVIGLYGCVMLVSGPFGERLALVSLIRLVQVSLGVCFTLVTLLSSMLPGGFLHRLSTNLSGCKVRSMECNATSGLRFRIWMVVHPNLSLNFLRDSSSTCSRLAKAVEVMRVSKLSMDLNGSPPYQVNAAPLSDVGKTRWCRGYVCLHNAVDKRMSMDSSCWTPLASHGQLFALSTLPHGVVPSLECSFGVVVEYRVLTMDECERIDDKLQVESRTSHVGMESLVDNSRLVDNSRELIDNARDKHLLIDKR

SEQ ID NO: 158624 - protein, 65 aa, Glycine max
  Coding DNA Sequence Number=SeqID_66939
MEELRLKRMMVSKGCASLYSLPCCSIMYQWVYGFRETLEYESKVGLEELMLKRMMVSDESLELLS

SEQ ID NO: 158625 - protein, 145 aa, Glycine max
  Coding DNA Sequence Number=SeqID_66940
  Homolog annotation: Hit_ID=A5AQM5; Match level="QueryCoverage=93%, HitCoverage=13%, E-value=4e-13, Identity=32%"; Hit description =Putative uncharacterized protein
  Pfam annotation: Domain name=zf-CCHC; Domain location=77-94; Score =25.6; E_value=0.00018; Accession=PF00098.14; Description=Zinc knuckle
MRLNQHEENEKKKKAIALKASPFIQEESDKEDLNEIKEDDDFNFLVKRFNKFLRNKGNQRRTNFNPKKRGEDSSFVPKCYECNQPGHLRVDCLSFKRRMEKSDRKTFKDKKEKKAYITWEDNDMDSSKESENEVVNLSLMAKNYE

SEQ ID NO: 158626 - protein, 283 aa, Glycine max
  Coding DNA Sequence Number=SeqID_66941
  Pfam annotation: Domain name=zf-CCHC; Domain location=97-114; Score =17.9; E_value=0.0029; Accession=PF00098.14; Description=Zinc knuckle
MKKDIGHILDLTPIGDKIKESLKRLTLTSHTSMRRTMVEQQLKRKSTSKSYGSHPYPKEDQGQGILGVTSSKPKDDKGKTIEKQPLKASMQEKTSSMKCFKCLGRGHITSQCSTKKTMIMRGQDIYSSQDEATTSPSSSESEKAKGEESSEEIYPQEEGQPLMVKEECKEVSVSSKRLAKKEIHFEIKTNIKEISPLRQPPHFLFCKKTLVSIATPLRLEFIPQVKELLDEGLVDKSLNPCALLVPKIGVEEKSPEFQEPRDLRTNPFQGGGNDAILPRKGIG

SEQ ID NO: 158627 - protein, 288 aa, Glycine max
  Coding DNA Sequence Number=SeqID_66942
  Gene Ontology: Mol. function=zinc ion binding
  Homolog annotation: Hit_ID=A5B236; Match level="QueryCoverage=91%, HitCoverage=61%, E-value=1e-39, Identity=49%"; Hit description =Putative uncharacterized protein
MEKEKDEWRHHFKEKMSQEEAHHNRRSWIRAWRKKEMNERRGREEHEILCSKRALKSEDTSESDPFVLGIQTEWQLQQMIRYGHRNVVAADSTFGAKRLKYPLFTLLVFDSRQHALPVAWVITRSFAKPDVSKWLKALIDQTRSVEPGWKLNGFLIDDAIAEIDLLSDSFQSVKEKYSASTSWHRALQILDYVVSLDDKDLFAKVVSQKDSSLTHIVWNPGSKFAFCDCSWSIGFDGSMEKANIGTVVNNMPLKWVSKKGRTYIGKPSSLPLPHGSSNTKSVGVHKKN

SEQ ID NO: 158628 - protein, 173 aa, Glycine max
  Coding DNA Sequence Number=SeqID_66943
  Subcellular localization annotation: CTP_CleavageSite=61; ConfidenceScore=5.30e-01
MALTFSGSGASPAAETMYPRTLKTSSKWDRCSVREVLYTRISLKNTATNLRKNGFSNSFMEAWKVAGILLKVWVPIWMDVDWVDLWKEVDMMGNSAWWWVVISGEGRASRGRDEGSLGWAGSDNQARWSMVVILCVCASLLSWWVDAMVGSNDTSTQRCTCWPKYENTIVLVV

SEQ ID NO: 158629 - protein, 266 aa, Glycine max
  Coding DNA Sequence Number=SeqID_66944
MGWEGVMFNSREFLPAPPKVSDDVEEAPQRRRPTTSARRQRTAVVVAEDVDHVDHTADEVHEEPQGPVPDDVRVDTQGFLSKPKDTSVLTDYVYHVGARVWEEELPITGTFHTFNALDVDQVVDLLVELLEMLSAEFLMATTIHLENLSSSYYFLDTSDEENGDRWLQFSEYLTPVGQICSAPRQCAPRHPPMVHDNAFVEPPPAAANVDMSRHAMDACQQITKSLENMINMRMITIGTEAYTLTKHCLRLARGVTEQWNVYVQSR

SEQ ID NO: 158630 - protein, 259 aa, Glycine max
  Coding DNA Sequence Number=SeqID_66945
MAKLAAAQLHFAATVASMESKLDALLLKLPPITSHHYPSSSSIQSPPLPPLLRMTAPPCPVPIQQCQSPMPTLPPMPLSLSMSSLSSMSIAPPCSTPMQPSLVPSPTPLPMPTAPPCPALVQPFLPPLSALLPMPALHLPNLDPVCTAISFNKLINTIFLYDHAVVPHDKPWKYKDMVMFEMGHMSYRTAMAAYKLQLVAFALCTTAKPGAIRRNRPWDLGIAEGGNRPAKVQEENRFVAELAEGRIMILLCSAVRGHA

SEQ ID NO: 158631 - protein, 84 aa, Glycine max
  Coding DNA Sequence Number=SeqID_66946
  Gene Ontology: Mol. function=phospholipase D activity; Cellular component=membrane; Biological process=phosphatidylcholine metabolic process
  Homolog annotation: Hit_ID=Q9C5Y0; Match level="QueryCoverage=55%, HitCoverage=5%, E-value=2e-16, Identity=78%"; Hit description =Phospholipase D delta
MEGTGVGTATGCYKCGKHAETRVLRQPWHDLHCRIDGSAAYDVLINFEQRWRKATKWKEFAILFKNILSMAWRCFNKNRTHLKG

SEQ ID NO: 158632 - protein, 147 aa, Glycine max
  Coding DNA Sequence Number=SeqID_66947
  Homolog annotation: Hit_ID=Q53VE1; Match level="QueryCoverage=24%, HitCoverage=8%, E-value=3e-07, Identity=78%"; Hit description =Ser/Thr protein kinase
MNPYRSTISSNEPTYLIAYNTPLNSFNFNGLAGGSDFEGNRIVGVDAKNAKLDDLANIPKFGALIHVLIEPFVTNGEMEFLDKESQLHVEKDCWEQGMAKKLNFRVTGKEFMVRMQGAMEGRKGKLTMMVEKGKNVMMWYFVYYVIT

SEQ ID NO: 158633 - protein, 198 aa, Glycine max
  Coding DNA Sequence Number=SeqID_66948
MPLKGVGHVKEKTSSSFSLYIAYVAPYISNTSLKVRCGLRTNQMEVGRSVLDPDFIRLQCKAKGSRRVLMVVCQFQKQKPQGNGKMVTCYIFLTLNSPRLASSSPGPRKSFSLKQATHHQRLFKENVRKTKKRTPNLSPYMAIYRKSHLVQRKLAQASWLLKAEGISSLGQVACLGLKKFHGPGEPDASLGEFRSRKF

SEQ ID NO: 158634 - protein, 80 aa, Glycine max
  Coding DNA Sequence Number=SeqID_66949
MERKMITMIVDTLPVFYFEKMPISLILITHHPTSQERLIIHKGHPQIGHKIHPMHIQDQTPPLIPIKTPTREGAFQKTSL

SEQ ID NO: 158635 - protein, 112 aa, Glycine max
  Coding DNA Sequence Number=SeqID_66950
MLEHRYTETLYQKYGKESLNRIKGTKGFQMEEHWNKLNFFNDDKFRAGIDPNRGFSSGNWSQDFAASNTDFNILIRKGTRKEVKEVNVRNWLRFSFMSMLHVVIDEQKECTI

SEQ ID NO: 158636 - protein, 238 aa, Glycine max
  Coding DNA Sequence Number=SeqID_66951
  Pfam annotation: Domain name=GRP; Domain location=71-163; Score= -19.7; E_value=0.0079; Accession=PF07172.2; Description=Glycine rich protein family
MQTKDCARQLRADLHATSLEGKRMCDFLSQIKNIVDELSHVGSLVEHEEYVDAILKILPHDYALVDFVIERKFISLSIVQVKALLLTHESHINRYRKHSFSPSVNYTYGYVNPNSFALIDFDGYCGGHSGGYAHRGRNHGGNGDHGGASGGHHGGGSSRNCGCHFANFQCQICLSMVNSIQSNTKFNNTWVNPNSKAHSQGVAANQAPLSVMLANSSSQRTANSTWIPNSSASFHVTG

SEQ ID NO: 158637 - protein, 78 aa, Glycine max
  Coding DNA Sequence Number=SeqID_66952
DDKKLKSQDHFMITKMITFKNEFKIESRTLQGSRANLISRIKIQDSRIKNNQDQDSRLKIQDSKFKIQDSKFKNQEKT

SEQ ID NO: 158638 - protein, 293 aa, Glycine max
  Coding DNA Sequence Number=SeqID_66953
  Gene Ontology: Mol. function=sugar:hydrogen symporter activity; Cellular component=integral to membrane; Biological process =carbohydrate transport
  Homolog annotation: Hit_ID=Q9C5H6; Match level="QueryCoverage=15%, HitCoverage=11%, E-value=1e-09, Identity=72%"; Hit description =Putative transporter protein
MAKELRKFVQNINMSRKSFNNGEYPLARTLNLPLAATKNGDTKLKFKKKQKIGPHNDFEPLVGIELQKGTFKKRRVVEDSTAGSDKLFKKPLFHNSQEELRIDQTRITSLTESNPKRNNYVTPNNQRIQKCKPTSSRAASKWNDYLTEDNENLELAWKKSFNLEEHSGPRNNILEAITIEICSCFGIPILVYMSKVDGKFNFSPISVNSFTEITNVFFAIVTLLLQAVTHSDKNMIEVLDSFSATLSGLQTQTYDDEASTASSGFGSDEKTINVVFKQMKPQVDPSKLDAPPH

SEQ ID NO: 158639 - protein, 296 aa, Glycine max
  Coding DNA Sequence Number=SeqID_66954
  Homolog annotation: Hit_ID=A5C0V9; Match level="QueryCoverage=79%, HitCoverage=45%, E-value=3e-08, Identity=25%"; Hit description =Putative uncharacterized protein
  Pfam annotation: Domain name=Transposase_23; Domain location=18-83; Score=-16.0; E_value=0.067; Accession=PF03017.5; Description =TNP1ENSPM transposase
MVGPSGPRVSTKECCVDPSRNDLETANPPRLVTLGIVYKGSTIHNIPLLPGQVKVGVEEVKDAQAPVLVPTDEVTLVGQTLNTFLAWPTHLVKPLSEHGNYLTMFDQHAAVSPTKPPQRPDPAVDDPLYLMTLTIPELFLKPFQVNWDATMFGVFNPHFPLYIKHEDLSGIAHSGQCLSTFVIQLWILHLTETSMRAGNSDVYGFLKPQSIQRSGQSQFCSESYIKSWMQSSKRDVYLGAYLNGALKGLDDTPQPKSKAAARWIVVKCNRQKGSTECGYYVMHWMSTIILGSFKNN

SEQ ID NO: 158640 - protein, 116 aa, Glycine max
  Coding DNA Sequence Number=SeqID_66955
MSDVILTRSRSLDTGHKIDEDQWMYESIMSEEVDMDYQNEEECGVNEPHVDCSDAFNTSQVFDGRKDVLRWARSVVHENEFVAVIIRSNTNTSSRGRTSFVLIGCERSGEYRCKKK

SEQ ID NO: 158641 - protein, 150 aa, Glycine max
  Coding DNA Sequence Number=SeqID_66956
MWQFGYIQSIPAPPVDSWVSFDEIDDMWMHYSDHLVPAGETCIVPGHCAPDYIDWFFHISHPFMTATQPSNPLPNAPAMQPRHVPQVPKPAAPSTSARSDVDKLRHTVEACDSISERLERHLNLGVVTLGTSTHEVIEECLGIARSITED

SEQ ID NO: 158642 - protein, 198 aa, Glycine max
  Coding DNA Sequence Number=SeqID_66957
  Gene Ontology: Mol. function=transcription factor activity; Cellular component=nucleus; Biological process=regulation of transcription, DNA-dependent
  Homolog annotation: Hit_ID=Q2EPY6; Match level="QueryCoverage=82%, HitCoverage=40%, E-value=2e-68, Identity=74%"; Hit description =AP2/EREBP transcription factor
  Pfam annotation: Domain name=AP2; Domain location=152-195; Score =19.3; E_value=0.0096; Accession=PF00847.11; Description=AP2 domain
  Pfam annotation: Domain name=AP2; Domain location=53-110; Score=51.3; E_value=3.4e-12; Accession=PF00847.11; Description=AP2 domain
  Pfam module annotation: Pfam domain module=AP2::AP2; Domain location =152-195::53-110
  Subcellular localization annotation: CTP_CleavageSite=31; ConfidenceScore=5.55e-01
MKRSPASSCSSSTSSVGFEAPIEKRRPKHPRRNNLKSQKCKQNQTTTGGRRSSIYRGVTRHRWTGRFEAHLWDKSSWNNIQSKKGRQGAYDTEESAARTYDLAALKYWGKDATLNFPIETYTKELEEMDKVSREEYLASLRRQSSGFSRGLSKYRGVARHHHNGRWEARIGRVCGNKYLYLGTYITQAKNVTWACGNP

SEQ ID NO: 158643 - protein, 81 aa, Glycine max
  Coding DNA Sequence Number=SeqID_66958
  Gene Ontology: Mol. function=protein binding; Cellular component =cytoplasm; Biological process=vesicle docking during exocytosis
  Homolog annotation: Hit_ID=A3A6G7; Match level="QueryCoverage=65%, HitCoverage=6%, E-value=3e-16, Identity=73%"; Hit description =Putative uncharacterized protein
MGKLTVKIMSHSCKMADITDEGVSLVEDIYKQRKPLPTMDVIYFIQPAREKSIAAEWRRRNGDWRRYFKEKIVKNKLTVSR

SEQ ID NO: 158644 - protein, 58 aa, Glycine max
  Coding DNA Sequence Number=SeqID_66959
  Subcellular localization annotation: CTP_CleavageSite=45; ConfidenceScore=5.03e-01
MDQTWQWDGTRMNIVSPIFNLPLSTCLPTRNRKVIKLESLCRLVRVSYTQLVTQLVDL

SEQ ID NO: 158645 - protein, 79 aa, Glycine max
  Coding DNA Sequence Number=SeqID_66960
MKVQVEKDKAPEWRRMKAQVEKDEGPEAETLSRLLIVAEGPSNPCGVYPDLSSFIGSGVIQNLRSLYQTIRPCLSDFVS

SEQ ID NO: 158646 - protein, 175 aa, Glycine max
  Coding DNA Sequence Number=SeqID_66961
  Gene Ontology: Mol. function=hydrolase activity, acting on ester bonds; Cellular component=endoplasmic reticulum; Biological process =protein folding
  Homolog annotation: Hit_ID=A7NYG7; Match level="QueryCoverage=64%, HitCoverage=29%, E-value=6e-43, Identity=64%"; Hit description =Chromosome chr6 scaffold_3, whole genome shotgun sequence
  Pfam annotation: Domain name=Phosphoesterase; Domain location=1-142; Score=-112.1; E_value=0.0027; Accession=PF04185.5; Description =Phosphoesterase family
HDYSLKFKKHTQKGKLLNYMVVKQRYFDMEVFSVNDDHPSHDMAIGQMFVKEEIAVLITYDKHGGFYDHVATSVEGVPNPDRIVGPHPYYFRFDRLRVRVPMFIILPWIDKGTDWKKDENMAGEWNHTSGQWNGDANDKGIQTREDYRFYAILAEYPEFNNKDKILLFQFSVKHE

SEQ ID NO: 158647 - protein, 334 aa, Glycine max
  Coding DNA Sequence Number=SeqID_66962
  Homolog annotation: Hit_ID=A7QAG8; Match level="QueryCoverage=49%, HitCoverage=46%, E-value=4e-14, Identity=33%"; Hit description =Chromosome undetermined scaffold_71, whole genome shotgun sequence
SSIERRRMSKRLAEDAKAYFDECVSLSTFDSSDFSSPEDPPLNFVGPPTPSGSPESGTRGQSMNIHYDISQPPANIDTVGDFHGQVSSITDSTETGSKPCFSFAQKPSETSALQQDIQQYIKKFEKNVLKSSTMRSNYCDPREYSFQSSAESLLIDRVLLKSRIESGSLLLCGGGGEGEGSGVERCGGRWRQTRYTEGGGSIEDVRMTYGSNQVDPYFTYGSTSSIRMDEDEWMYEIMSEQADMDYENEEACGANEPHVDCFDAFNTSQVFECRENVLQWTRSVAHENRFVTVVKGVASIGVGKKNLSEETLRLGNMGVSSSFVASQWLEEKAR

SEQ ID NO: 158648 - protein, 477 aa, Glycine max
  Coding DNA Sequence Number=SeqID_66963
MSSSSFLRNSSPKSLESKDMVKGLPGGVGNETGVVRSLITAKLHDDKNYQVASLQIPRASFNKLDIGYILFIFKEFFFALVAFELLIEYMLLNGKLVSKVAWHENWVPNTKGILLGRKHLNDWFACTIGIKSLLLLFKIKYLTSNINLVSPYFVAGLPFQDSMTPEAWVESDIPIREATFFLLIMGEVGWVQVEVEVRRRVKIDGQRLRLGIFDFYGFPYWWSDDGCFLDFLDRSKGFGLDDRVKSFMRIDTHYEKGTDERGTLRDGPNNSKELGGIWSSDNLTKGIAMECPILAFDMSSQLPSICCVRPQRFGRLSGSVRFKNKDSLQIRMSMKYSLPYHHFQDLMSNTPSNSLLFIDSIETRWEHDDMLHVDHFYRVIELHSSTADDAMPYIGFDSSSEDIEVISPILMSPRLELHESQVPPEVDWVDLMLEDYREDLEKDTPFEEDLSMNKEDSVMKLECMEEDSSQDSSKKSF

SEQ ID NO: 158649 - protein, 261 aa, Glycine max
  Coding DNA Sequence Number=SeqID_66964
MLLRKGFHQVKVKYGSNHLAKVGAVDGSSYIAPLSTANTKECVLQCPYRTRGRARVMSGIEEVQEQMKVDMEAMKDQITAITEAMLTMKKIMESNAAAIATKSVAIEGDSTHPLGLKQSKNYFPPCSLPPNYTPPNIAHTPKNVNNSTPILIESQQPQFDHAHVSQPMGETHEVPHHNLADFEPHLGYATEGQAFCGVPMPNILGGSQYHPQPEPLPFVVGRLPLAIESLTGYQYNSDMAPDRMQLQSMCKKEHEYFKEYA

SEQ ID NO: 158650 - protein, 99 aa, Glycine max
  Coding DNA Sequence Number=SeqID_66965
  Subcellular localization annotation: CTP_CleavageSite=61; ConfidenceScore=5.58e-01
MFATTFNSPPSAYNLAPSSSCYPLKYVTWVTKIRMRITTITMMTMTMMMVMIITREHPRTRGGRGRRPRGQQTQTNPVQQDERSIRISRRTRCGTSSRY

SEQ ID NO: 158651 - protein, 197 aa, Glycine max
  Coding DNA Sequence Number=SeqID_66966
  Gene Ontology: Mol. function=aspartic-type endopeptidase activity; Cellular component=small subunit processome; Biological process=DNA integration
  Homolog annotation: Hit_ID=A5CB76; Match level="QueryCoverage=92%, HitCoverage=71%, E-value=5e-30, Identity=38%"; Hit description =Putative uncharacterized protein
MTSAGLAFSFSGTPTITTAKLNWKNYLSWSASVELWFLGQGHHNHLEKGIDTVPSDRKSEWEKLDYQLCAVLWQSVEADAREIFSNDIQSLFNATMKVTALKQISHGMIAHIGKARVTVEELKKFLVADSLEEVTKKLDKFYMVLILRSLHSDFDHVRDQVLVEDQVPSMDSLITRLFRVPHALKEENPADIINRLI

SEQ ID NO: 158652 - protein, 95 aa, Glycine max
  Coding DNA Sequence Number=SeqID_66967
  Gene Ontology: Mol. function=kinase activity; Cellular component =chloroplast; Biological process=oxidative photosynthetic carbon pathway
  Homolog annotation: Hit_ID=A2ZWL2; Match level="QueryCoverage=63%, HitCoverage=12%, E-value=3e-13, Identity=61%"; Hit description =Putative uncharacterized protein
MSGTYADCFSLMNCSLQSLKSLGFIITMYLSFSGACEQQITEHQSKFKDGEDIPPLVGCYILVALSAIIGFSAPQGCGKTTLVFAVDYLFEVIGR

SEQ ID NO: 158653 - protein, 288 aa, Glycine max
  Coding DNA Sequence Number=SeqID_66968
  Subcellular localization annotation: CTP_CleavageSite=62; ConfidenceScore=5.24e-01
MRSSPPPLCRSVDNDAGGWVTSRKGTVALATATRKCSRFPAVKLDKAGISASGAARTLGVAPAMAKEHLLSAESKVVGASSVRASVCVVPSVRAPTVDIDLYHRKSLCDFPLVLSVLAMIMFRARGLSRTLGKVIGRTLGREVVEHVDHATDEVHEQPKEGTVDDAQGFSSQTGSYAWRAVALVHMYEKLNDASKRRTRQLAEYIITLYSVGSISIFLLLLLLLLLKIIMRGNHVLVVGSLGRHYQCRRITIPPDPATPSLCIEDIDDRWIRFSEYLALMGLICVAPG

SEQ ID NO: 158654 - protein, 56 aa, Glycine max
  Coding DNA Sequence Number=SeqID_66969
MFLHTDHWDLENNNFGLPLSEKGAQSAIPTEGNCAKRPKAALSPIPTERKCVERPE

SEQ ID NO: 158655 - protein, 255 aa, Glycine max
  Coding DNA Sequence Number=SeqID_66970
  Gene Ontology: Mol. function=unfolded protein binding; Cellular component=cytoplasm; Biological process=response to stress
  Homolog annotation: Hit_ID=A7Y7E4; Match level="QueryCoverage=34%, HitCoverage=46%, E-value=2e-31, Identity=76%"; Hit description=Heat shock protein
  Pfam annotation: Domain name=HSP90; Domain location=4-239; Score= -322.7; E_value=0.011; Accession=PF00183.9; Description=Hsp90 protein
MRCVVLKYGVTRQECDNSFPVCYLCLDPVMISDFVFMRADGYILCGTSRGYIYLGLTENKRGYISCGSVLVDGTSTRFKENKGGYIPYGSLLNLKLGIHEDSQNKGKIVELLRYHSTKSGDEMTSLKDYVTRMKEDESKKAVENSPLLEKLKKKGYEVLYMVDAIDEYHYYKSNFLRRGFDDGRNTSSSSSFRYKDGLAPRPVFVLLVVSRGDHRASSPTKSIVSIASSSVCSHRRQRPLVVGGGLHRRKAVSHK

SEQ ID NO: 158656 - protein, 64 aa, Glycine max
  Coding DNA Sequence Number=SeqID_66971
MEPTTKELINKTQLSPKTIPMSSRRLGGSTKESHFTYSTAVILLPRTMVRDHHRYQPYGTKIAR

SEQ ID NO: 158657 - protein, 47 aa, Glycine max
  Coding DNA Sequence Number=SeqID_66972
MEKKMKNKDLKSMAAEWRRGKGDWRHHFKEKMSQEQAHHHRKPWIRA

SEQ ID NO: 158658 - protein, 167 aa, Glycine max
  Coding DNA Sequence Number=SeqID_66973
MNVKNSMNWKVARPSMIMRETTLCLQQCFLLAAVSPAKPPESPDEEVDDPLYLMTLTIPQLFLKPLQVMWDATIFGVFNQNFPLYIKHEDLSEIAHGGQCLSISVIQLWILHLTETSVRAGNSDVYGFLEPQSIQRSGHSQFESESYIKSWIQSSKRDVYLGAYLNR

SEQ ID NO: 158659 - protein, 83 aa, Glycine max
  Coding DNA Sequence Number=SeqID_66974
MVRSLHRFSVNRCRIKPLWALSTSVVGDDRNNDICKYQNMSHVTHHEVANFLFIQLTQPVCVEKLEVMPEGNRITNSVKIELY

SEQ ID NO: 158660 - protein, 240 aa, Glycine max
  Coding DNA Sequence Number=SeqID_66975
MVLHEKAIGVNVEDDDSAVDTCVSPFSTQMPPNINGGEEVNNAHGYTTQLPSSSLSRVINTFMASPSTLKKSRKATRLRSLATKLVGVERPVVFVDPAIGKVDGPYRKKLMTYLVIFVGDKDMKKKRLEEASQSKSTDKIVDPLSSIRRHLKWKMTHTKKSDQTTFEATKEVVYRIEQASQGSFVAHGCQDVLTIAIGRPEHPGRVRVVAADGLTLPPEPKVGASTAHVSTKGSCVNPSE

SEQ ID NO: 158661 - protein, 111 aa, Glycine max
  Coding DNA Sequence Number=SeqID_66976
MTKIVPSYMLAIGRAGMTWVVLSLCWMIVVQVGAHGGVNGAKFDILEGLTAKKKVMFTVGTRWRQFKSSLTTRYVYAENDDEQNKDPSAKYGIDRNTWEEFAKTRQTPTWK

SEQ ID NO: 158662 - protein, 104 aa, Glycine max
  Coding DNA Sequence Number=SeqID_66977
  Gene Ontology: Mol. function=methylmalonate-semialdehyde dehydrogenase (acylating) activity; Cellular component =mitochondrion; Biological process=valine metabolic process
  Homolog annotation: Hit_ID=A3BHC5; Match level="QueryCoverage=39%, HitCoverage=25%, E-value=2e-12, Identity=82%"; Hit description =Putative uncharacterized protein
MGCKQDIVNAICDDDDIKAISFVGSNFAEMHIYSRAAAKGKRVQLLLVLVLLDKGVWLSAQLFLLEAQNHGKAGVNFYTQIKTITQQWKDSIGGSKINLATSQK

SEQ ID NO: 158663 - protein, 166 aa, Glycine max
  Coding DNA Sequence Number=SeqID_66978
  Homolog annotation: Hit_ID=A5AZ88; Match level="QueryCoverage=97%, HitCoverage=13%, E-value=2e-07, Identity=28%"; Hit description =Putative uncharacterized protein
MERNMIDAANGGALGDMTPAEAGNLIEKMASNSQQFSARSDAIVIRGVHEVATNSSSSAETKKLEGKLDALVNLVTQLAVNKKSAVVARLCGLCSSADHHIDLYPSVQQSEAIEQPEAYVANIYNRPPQPQQQNQPQQNNYDLSSNKYNPGWKNHPNLRWSNSSQQ

SEQ ID NO: 158664 - protein, 52 aa, Glycine max
  Coding DNA Sequence Number=SeqID_66979
MSLSGAKRSRRRAHDSTWGHVTQFGTPLKLWLITMGEGKLPMHDKVTSTFAA

SEQ ID NO: 158665 - protein, 86 aa, Glycine max
  Coding DNA Sequence Number=SeqID_66980
  Subcellular localization annotation: CTP_CleavageSite=52; ConfidenceScore=5.22e-01
MTHQTRIPALITTYKNCWNLDDPIVTFRGPKKARGKRSEAPATSASEAPTPSSSTVPPSSSTQIPVIPLVPLKMRLPTPLSVGVMP

SEQ ID NO: 158666 - protein, 130 aa, Glycine max
  Coding DNA Sequence Number=SeqID_66981
MEIIDLCDFCQIGDLEGKIYHSLLGIHEILLHGEQCTNSNSKRTKLYVIGEYSLSSNLETSIGVSKSDTPTQIPCPIGQKAIKRKMKGKRDVASSLIVDLFGMEYVIRKKKYYQQKNSTGKGNREHKGVV

SEQ ID NO: 158667 - protein, 65 aa, Glycine max
  Coding DNA Sequence Number=SeqID_66982
  Subcellular localization annotation: CTP_CleavageSite=48; ConfidenceScore=5.10e-01
MDVEELPSPVNSDVVKRSRIVLGNGQMSGQIQRQRPIKVNSNVATVCRAMSFPAFRYLGMDASRG

SEQ ID NO: 158668 - protein, 281 aa, Glycine max
  Coding DNA Sequence Number=SeqID_66983
MHTRPRVHLNTEVHPWRILRKDLTTLAQVWSFLSYSNLAPTSHTFDLTVDRARLILNIRALISGQMTSIAQSNSSKLGFPALITALCRARGVVSDSLTFERLSPIINLAYIRKNYWNPNDLTVSIRGARRARARPAKLPSTSTAPTPASTSAAPSVPAQIDSQHFDAMLQSIHQGHIILLQKRVAWPGAQPFLHREDEGPTAQVPQHVEDASSEAIILEPFIIEEEAGETRVRQEAAATPERSREVTSNPPTPVVNLSSPQHAVDPSTPILEMPKDPTHQS

SEQ ID NO: 158669 - protein, 94 aa, Glycine max
  Coding DNA Sequence Number=SeqID_66984
MARGDKSRSSAPFPLSRDDQVQWHAKTNHGHPYPFCYQEMIKDNRIRWHAKTVMVTRFRCYESIKVPLSYRDKHVRCYLCYPKTIKSDGIQRQT

SEQ ID NO: 158670 - protein, 61 aa, Glycine max
  Coding DNA Sequence Number=SeqID_66985
MKKIQGLQVPHGATSVKVSDEELDDAILPRKGPVTRAMSKRLQEDWAIAVEEGPRVLMNLK

SEQ ID NO: 158671 - protein, 244 aa, Glycine max
  Coding DNA Sequence Number=SeqID_66986
MVKALQHRHCEVSAGAGTDGGGAKGAGAGEGAGVEEEGAEELAKLMVGLRDSKVRESEMTPLALHNAIMRAGKPSLEEMDWAICEIWLEMIEPASIGEVGVGKDTPCLCKSDEVLPEQLPWCAFCIQNESPPWNAEPGSQLLGVIKICIKLLDQGYIYVPIHLPGQGFMPASPLELPVELVILCDIENNISLLKDVMGVNILGIPLPGSLRDESGGVIRLLGPGYSGLPLPGGHLHKKESHESS

SEQ ID NO: 158672 - protein, 253 aa, Glycine max
  Coding DNA Sequence Number=SeqID_66987
  Gene Ontology: Mol. function=sequence-specific DNA binding; Cellular component=intracellular
  Homolog annotation: Hit_ID=A7QMG3; Match level="QueryCoverage=85%, HitCoverage=75%, E-value=9e-37, Identity=39%"; Hit description =Chromosome undetermined scaffold_125, whole genome shotgun sequence
MEYSQDVNPLSKALYRWKGWGKHCVQSYNVFDFLRDVVSRVPDYGHGHGHAEAGPDDRVITKRRKAIGDDGNDSDEEAKRSKMLELGHTGSTGRGRGRGRGRGRGRGRPPLNRETYHQDAESEPCTSVQPSNPQNTNTSIAMDNGSESKEIPKEENIAAPVVPVVSTDSLRNIDLNAITNENDDKKASAEADASASVPEPDASLPEPPTESKHEEIPGWSLSDVDKMAIDSLQLAQLGRPLEEEEEDYDEEEG

SEQ ID NO: 158673 - protein, 156 aa, Glycine max
  Coding DNA Sequence Number=SeqID_66988
  Gene Ontology: Mol. function=oxidoreductase activity, acting on the aldehyde or oxo group of donors, NAD or NADP as acceptor; Cellular component=mitochondrial matrix; Biological process=metabolic process
  Homolog annotation: Hit_ID=A2X1G3; Match level="QueryCoverage=51%, HitCoverage=16%, E-value=2e-27, Identity=70%"; Hit description =Putative uncharacterized protein
MVFHLPVGKHSVVVEDAKVVGASRIIGVYIDSNREEAFGPVAPREEAIRITNDTNAGLGSYVFTNNIQRSWRVAEALEYGLVGVNETVAPFGGFKQSGLGIEGSKYGMNEYLESLVNEKDEFHEEEESDKSKDKRRILNALLFSNIDNQWCRVCEF

SEQ ID NO: 158674 - protein, 128 aa, Glycine max
  Coding DNA Sequence Number=SeqID_66989
MEFQIRTTIVQNDGEINEDITQEKSWVIKLEEGIGAAFIFCVTCSGHMFAPPDLPTQPANVKGKAKIAEEQNDKMIPTPKENILVKGLPEKKDGYGKKEVSLEEAGEFLRIIQQSEFKVIEQLNKTPT

SEQ ID NO: 158675 - protein, 42 aa, Glycine max
  Coding DNA Sequence Number=SeqID_66990
MASSSGDKRLMGGDDEGFCGGAESDRGWKGRGLGLEENGGGL

SEQ ID NO: 158676 - protein, 69 aa, Glycine max
  Coding DNA Sequence Number=SeqID_66991
MTQRGRRHRNVGPLVSTGGSRGRAMMHKVRPRRKLGIASGIRGIIGSKSAWRELPRGGPSEIWRVWNWP

SEQ ID NO: 158677 - protein, 107 aa, Glycine max
  Coding DNA Sequence Number=SeqID_66992
MKLSTYKEEIRLRQTSLRHLERFFFTSHMNPLIEEEYPGLALEVYDPSLERDYVRRIKKMATSSEPTRSPSSPRSASHPRHLIEVSSDSDSFGDKFTTRKYAFNIGY

SEQ ID NO: 158678 - protein, 60 aa, Glycine max
  Coding DNA Sequence Number=SeqID_66993
MVRSLATRPVVHVDIVTGKADGPHRKKLRIYLGLVTRDKVDVTNDNWEDIQDVRKKAQAI

SEQ ID NO: 158679 - protein, 302 aa, Glycine max
  Coding DNA Sequence Number=SeqID_66994
  Homolog annotation: Hit_ID=Q9LIN9; Match level="QueryCoverage=51%, HitCoverage=25%, E-value=7e-21, Identity=41%"; Hit description =Similarity to the auxin-independent growth promoter
MTYQQGRSTENDVESLDWKFKDGYFENPSLNCYIFFSLLSYLLGYTADPSFSTNPSFSSLIVALHFPFSLSFSLSGRGRHGWMWTTSFTPMTSPPHVPPRASNSLMKRDTGAGGGDSSPLIPDNHLADDDVHDRHSSKDRDRHMCFFFTDDPRVSPHNSRISLVFTLLLLLVGLVSLFTILNNLVSPHLFGCIFRFTTKSLMHCILLRLSNAPYLCKKDGIVLHYPHVKESPSLWENPFSSTTSWKPCAERQDGVLPVSSKFVICKFAAPLRLVKSGFKDGVDITNVLESQASKTALTSRPS

SEQ ID NO: 158680 - protein, 43 aa, Glycine max
  Coding DNA Sequence Number=SeqID_66995
MVIGTRQVSTEEGEAKSRELNVMFIEANAKAGFNIKISPPTPL

SEQ ID NO: 158681 - protein, 156 aa, Glycine max
  Coding DNA Sequence Number=SeqID_66996
MTFLGETSSQTIVNCRFAFIFPNGSIIHNKSSVYFQSSTLIHIRVLDDCGFEILKSRMQNTLQLTNNQYLDEIYYRQPFTDSGKNPKRFDIPSGCSIDGLKDVIKQVAPQGIPPYGIHESQTPREICVMLHSTYGWGGSLLCLIMTMYIPQQRQWW

SEQ ID NO: 158682 - protein, 51 aa, Glycine max
  Coding DNA Sequence Number=SeqID_66997
MKPFLGLEQTPLPLGSDVSGLGSSCSVPLSNEATWNLRKCLHKLLLQLPGH

SEQ ID NO: 158683 - protein, 174 aa, Glycine max
  Coding DNA Sequence Number=SeqID_66998
  Homolog annotation: Hit_ID=A7Q794; Match level="QueryCoverage=77%, HitCoverage=86%, E-value=1e-08, Identity=26%"; Hit description =Chromosome chr18 scaffold_59, whole genome shotgun sequence
MWLIRYCVNSLTRSGSTIWTISWVANQSASRRDGGSDEDPEVAKFKEQGLKFLPEMEFLFKDSRQYEEFNTRTEETNDNIDYNTDMEVNEPEIDTTTQNTSSAKENGQRKRGVSAQDPTSITACVAKLKDLPGLERGSELFYKATKLMKKRANKITFVALEEPELQLGWIKSET

SEQ ID NO: 158684 - protein, 109 aa, Glycine max
  Coding DNA Sequence Number=SeqID_66999
MRQILLQGAEHKRVELQLKVLIAFGLVIFLRVYAEPIGTSHLHVSIGGASKLLFWGNSYPLAILWDRGPRRNHQELPLLQCGRTMEERHRGAVCMRLGFKNNGRTTKVN

SEQ ID NO: 158685 - protein, 150 aa, Glycine max
  Coding DNA Sequence Number=SeqID_67000
MDPRRSGLVATREILSTLQSYQSSSSDAAQIVVVDVVASPHSGVLETITTVAFEGMVGSALVVTIAALLAVVGETYTQCDFDALPMVVELNACVASLPVSYLWTIHRAGSWKSLALEVPGGKCENPMISLKNGPDIDASDAYQAIRYSSF

SEQ ID NO: 158686 - protein, 133 aa, Glycine max
  Coding DNA Sequence Number=SeqID_67001
  Gene Ontology: Mol. function=protein serine/threonine kinase activity; Biological process=protein amino acid phosphorylation
  Homolog annotation: Hit_ID=Q1S5M7; Match level="QueryCoverage=37%, HitCoverage=7%, E-value=2e-13, Identity=74%"; Hit description =Protein tyrosine kinase, putative
MEVDRCIHIGLLCVQEDAKDRLTMSDVVEMLASDTMTLPKPKQLTFSIGRMASAESSISKSSKNVSINDVTVSITLTRAKTLVLRRFGILSMHTIGTSGLSYVERGAQLDYHKSIFYLIRKAFVRLIISPPNL

SEQ ID NO: 158687 - protein, 167 aa, Glycine max
  Coding DNA Sequence Number=SeqID_67002
MDIIEVPTFYHQQWAPEYPEFVNFRYDGTIYQIRLRQHRAKVYFAEGLKEFRKDLSIYESVIIKFLACSSKSLFDLYFVPSLECQTCGMPEVMSRQHIWTLEITQSILGAPGPLKLPNCAITHVNACGQHMTILRRFGPPLQCNVVVVDGGVRRRYLVQPCVSIPCR

SEQ ID NO: 158688 - protein, 114 aa, Glycine max
  Coding DNA Sequence Number=SeqID_67003
MEGVESYTKVLSETSEEEDDLLIRSTRKVKRKDNKEDDLEMVEEFKNNGEVENSPYKQKLLNNGAVVPSSPFEGRYCAMKGLVDGDNVGKKAWFLDVGHQINPGLGNERLYQNY

SEQ ID NO: 158689 - protein, 103 aa, Glycine max
  Coding DNA Sequence Number=SeqID_67004
MSPPPLEPHNHSLTHLMLSGWLLLHAQFYASGLVGACALSATLDRLVRISEFRLSARLLAQWMDSSGALSWMTPRSVNMHNSSFFQILPRAQRRECYAQQMAH

SEQ ID NO: 158690 - protein, 112 aa, Glycine max
  Coding DNA Sequence Number=SeqID_67005
MRIDALEISPSMHRAKAKAEQHVDCSDAFNTSQMMFCSGLDPLLMKMDMWCIGLGKKIVRKDTGSRKCGCPFKLCGKLVVGGQGSDTEMQHLMKLLERDQYIHLHRLKDEDV

SEQ ID NO: 158691 - protein, 160 aa, Glycine max
  Coding DNA Sequence Number=SeqID_67006
MDVELRTGVGSRDSVVFVDEERVVVDPTVEVGVRYGEAPACTSLRIDGLNPEIKQLNTNGAGNPTILFARDSNSERKADHEDNCTLRCIHWNHASAGPSIQLDRSHRIAERPASYGAVDCAMVSVLPTKTMAFAVVADSLRVATFGGGDHRSLSSWRVVK

SEQ ID NO: 158692 - protein, 164 aa, Glycine max
  Coding DNA Sequence Number=SeqID_67007
MLSYPNFIRGLSFIDLLILPSRLTVLKHHVLIKNAKDAKKGGKRVFSLSFLDPSSPRLASGSPRPPNDFRVKELTRLAEPITSGLSLSSPGRAASPLKWPFAYINRRARGAEKGFQGLEGEGIERRQKEEEEERRGNEVEALPNRNHDHSLLHFLFRVLCATVG

SEQ ID NO: 158693 - protein, 248 aa, Glycine max
  Coding DNA Sequence Number=SeqID_67008
MAARKCRAVPTPGEESTWDSSRFTSEIAWHRSSRGTDETRVQGQVVRFDAETINDFLDTPIILADGEEYPAYSQYLHTPPDHEAMLASLCTLGGDLTTLAQTWSVLSYFYLAPTSHTSDINVDRARLIYGLGVVSDTLIFESLSPVINLAYIRKNCWNPTYPSITFPGVRRARTRAPASASKAPLPPQPSSQGPIPPLASTSAPLDMHGQMLRSHGQESIPLLIGGRAIWSRKHSVEAKLNGESKVIQ

SEQ ID NO: 158694 - protein, 142 aa, Glycine max
  Coding DNA Sequence Number=SeqID_67009
MYNHYEKERAPDFESVLADFMTYQASSKDYQWESEWQPCYHNEVEGLSNLDDLLMQFKGTIDSMQQAFKRAETQIGKLVDDMTKVVVRSEEEYAEIEKHQENILQVNTIHHQLITKEVGKEGVDDTICEKYDTSNEKWTQFC

SEQ ID NO: 158695 - protein, 99 aa, Glycine max
  Coding DNA Sequence Number=SeqID_67010
MDTQDTTRSRWTLGIRRRQPLHAPLASLLTEGCHSGYVTHQPHFRESKNKFKMLKIKSGTLQGSRGNLISRIKNQDSRFKLPRIKIKIQDSRFKNQEKN

SEQ ID NO: 158696 - protein, 160 aa, Glycine max
  Coding DNA Sequence Number=SeqID_67011
  Gene Ontology: Mol. function=protein serine/threonine kinase activity; Biological process=protein amino acid phosphorylation
  Homolog annotation: Hit_ID=A7PT10; Match level="QueryCoverage=45%, HitCoverage=10%, E-value=7e-20, Identity=60%"; Hit description =Chromosome chr8 scaffold_29, whole genome shotgun sequence
  Pfam annotation: Domain name=Lectin_legB; Domain location=1-121; Score=-123.3; E_value=0.05; Accession=PF00139.10; Description=Legume lectin domain
CHIEIPNGDNARKWVSHLLFKFHDDPTVNESEIVIFLRQFSDVNGNQVGLDLNRVVSKQVSDLGGIGVDLKSGDSMNTWIEYNGNANGLCISVSYSNVRRKDPILKVDLDVGLPKVARRFTVLSGVWLRRRRGRRRLHGGPMIRAWVKGGGSKRMWWYRG

SEQ ID NO: 158697 - protein, 146 aa, Glycine max
  Coding DNA Sequence Number=SeqID_67012
MAVIGKAAGADRQDRGRPRGCQTGPTVGVGTVHPQRKLGTKCICARDVAMKKEPNKGLVMVIRGKEGPGKVTVVTGGHWRKDAEMACKQQQSHSWRSQDINFQESKGKYKRKWKKVQENVWDFISLTEHLGSFIEVPRLSPQQLLN

SEQ ID NO: 158698 - protein, 314 aa, Glycine max
  Coding DNA Sequence Number=SeqID_67013
  Gene Ontology: Mol. function=aspartic-type endopeptidase activity; Biological process=proteolysis
  Homolog annotation: Hit_ID=A5ARQ3; Match level="QueryCoverage=80%, HitCoverage=27%, E-value=2e-28, Identity=30%"; Hit description =Putative uncharacterized protein
MVVTTYQTSYDCSEKTIIDILVAGFSGQLKGCVVKTDLNGKVFTNDDNEEIPDAINTFIFTIVQHFIGDPSLWKDRSAKLLFNLKCRTLADFRWYRDTFLTRVYMREDSEQPFWKEKFLVSLPRSLGDKINNLLIETSEEETEDVSSEENLNLVQQDDQPWSTNDEDEDIQEINTQTRDQDLLFEAINSIPNLQEKKVFLNKLKKSLETKPKPKDFITNKKFDVSNILKRLENTSVKPTTIQDLQTEINNLKQESISRALQIVCLTILPVNSYREIPMPPRTSGTSLRGRKKYRKRIETGSTRAISQKEFTIII

SEQ ID NO: 158699 - protein, 50 aa, Glycine max
  Coding DNA Sequence Number=SeqID_67014
MATLRIFPPLESTPFLTLMHCRVPNNPQPKIKEVKKKMKGKVNTSSIFGN

SEQ ID NO: 158700 - protein, 58 aa, Glycine max
  Coding DNA Sequence Number=SeqID_67015
LTTVLKVTHFAHAMVATIGLEGGEKGEGWLQNLHYGVFGLGNRQYKHFYKVAKVGVAD

SEQ ID NO: 158701 - protein, 126 aa, Glycine max
  Coding DNA Sequence Number=SeqID_67016
MLLKGSLSEPDWLSKAYPLSKEASSLSEHKILENVKPESSALSARLAHNHLLSLNKTCSLSVPSYAEKPKNLQNTENRGDEGTDYVRQKEDDTKNAFVEESRTKTKGVRLFHVRNHGLSKLTEQEH

SEQ ID NO: 158702 - protein, 39 aa, Glycine max
  Coding DNA Sequence Number=SeqID_67017
MENGQQYLEIESEKAIQAILLKFRGKNKGLTLNYLKEHR

SEQ ID NO: 158703 - protein, 92 aa, Glycine max
  Coding DNA Sequence Number=SeqID_67018
MPDSKSTFHPALAVSNIKNHVSIILEMENVQYATWDELFKIHARSHKKAPPTEEETELWLTLDATVLQWIYAIISHDLLHTILEPDITIMEA

SEQ ID NO: 158704 - protein, 130 aa, Glycine max
  Coding DNA Sequence Number=SeqID_67019
MLIGRASGSGGSLARTSYEIRAPTTLRDTVVKGPWREEKREKGGGARGSKCSEENGRYLSHGITSDIDSQHNQISPTFTLTWKKRKRLRESESTPSVPRPRSQGVEARPMCCPIRERESENNREKRLTAI

SEQ ID NO: 158705 - protein, 151 aa, Glycine max
  Coding DNA Sequence Number=SeqID_67020
  Gene Ontology: Mol. function=transferase activity, transferring glycosyl groups; Cellular component=integral to membrane; Biological process=metabolic process
  Homolog annotation: Hit_ID=Q53UH2; Match level="QueryCoverage=81%, HitCoverage=31%, E-value=3e-32, Identity=48%"; Hit description =Glucosyltransferase
MERPYCDYLERQMRKQVCLARPVLSDTSLSECFLKSDQFKEILLGFELTRIPFLAALKPPIEAEAIESALPEGFNERIKGRRVVHGDWVQQLLILSHPSVGFFVIHCGSGSLTEAKVNECQLIKVQKTVFLSFCAPPKCFAASCRGLEIAG

SEQ ID NO: 158706 - protein, 156 aa, Glycine max
  Coding DNA Sequence Number=SeqID_67021
ETSLSIAIPLELEVIPQVKELLDEGLVRKSLNPCALLVPKISIMRHQIPMIGGMMNVLNGATLFCKITHAPNIFMICVHRDSLGSDQGLPMDPKRIKVIPEWPTPPSVEEKIHEFQEPMDLRSNHFQGRGNEAILLPKGIGLKTPRRLGHRCKRRP

SEQ ID NO: 158707 - protein, 88 aa, Glycine max
  Coding DNA Sequence Number=SeqID_67022
MDKGLKVGEDEGREKERKSMKFCASNELWFSPLIQDQVHDSLLSVLRCHETCSYLVHGPKIYPKAHENPKAFSCIFDPIFLESSIQCP

SEQ ID NO: 158708 - protein, 510 aa, Glycine max
  Coding DNA Sequence Number=SeqID_67023
  Gene Ontology: Mol. function=protein binding; Cellular component =nucleus; Biological process=regulation of transcription
  Homolog annotation: Hit_ID=A7Q1Q9; Match level="QueryCoverage=97%, HitCoverage=95%, E-value=1e-161, Identity=60%"; Hit description =Chromosome chr7 scaffold_44, whole genome shotgun sequence
  Pfam annotation: Domain name=GRAS; Domain location=122-413; Score =365.9; E_value=6.4e-107; Accession=PF03514.5; Description=GRAS family transcription factor
MIHPHMHETWDHYSNTITSLPFSAPTPSNPYPKPATENNHCLNLGQNELCDWMEEHISDITKHFVEDLPETTTSDNLLSNNPTGVVSHHNLGVPSLLSPNFTQRKPSCFRPQFESFTNDPPNFNLHIQTNTSTLDQNKHNVYDQGLNLITLLMECAVAISVDNLGEAHRMLLELTQMASPYKASCAERVVAYFAKAMTSRVMNSWLGVCSPLVDHKSINSAFQVFNNISPFIKFAHFTSNQAILEAVSHCDSIHIIDLDIMQGLQWPAFFHILATRMEGKPKVTMTGLGASMELLVETGKQLTNFARRLGLSLKFHPIATKFGEVIDVSMLHVKPGEAVAVHWLQHSLYDATGPDWKTLRLLEELEPRIITLVEQDVNHGGSFLDRFVASLHYYSTLFDSLGAYLHNDDSNRHRVEHGLLSREINNVLAIGGPKRSGEDNFRQWRSELARHCFVKQVPLSDNSMAQAQLILNMFSPAYGYSLAQVEGTLRLGWKDTSLYTASAWTCCNSS

SEQ ID NO: 158709 - protein, 597 aa, Glycine max
  Coding DNA Sequence Number=SeqID_67024
  Gene Ontology: Mol. function=metal ion binding; Cellular component =Golgi apparatus
  Homolog annotation: Hit_ID=A9PIN1; Match level="QueryCoverage=98%, HitCoverage=100%, E-value=0.0, Identity=68%"; Hit description =Putative uncharacterized protein
  Pfam annotation: Domain name=DUF248; Domain location=80-584; Score =964.8; E_value=3.4e-287; Accession=PF03141.7; Description=Putative methyltransferase
  Pfam annotation: Domain name=Methyltransf_11; Domain location=207 -302; Score=30.1; E_value=8.3e-06; Accession=PF08241.3; Description =Methyltransferase domain
  Pfam annotation: Domain name=Methyltransf_11; Domain location=451 -540; Score=3.3; E_value=0.041; Accession=PF08241.3; Description =Methyltransferase domain
  Pfam module annotation: Pfam domain module=DUF248::Methyltransf _11::Methyltransf_11; Domain location=80-584::207-302::451-540
MVKCDSYAVTRMGRGKADGKPRKRLFTTVLLLAIVGALFFLYSRKSGSSSIEYGSKSLKFGGDDSAIPKTIPVCDDRLSELIPCLDRNFIYQTRLKLDLTLMEHYERHCPMPERRYNCLIPPPPGYKIPIKWPKSIDQVWRANIPHTHLATEKSDQRWMVVKGEKIVFPGGGTHFHYGADKYIASIANMLNFPNNVINNEGRLRNVFDVGCGVASFGGYLLSSDVIAMSLAPNDVHENQIQFALERGIPAYLGVLGTLRLPYPSRSFELAHCSRCRIDWLQRNGILLLELDRILRPGGYFAYSSPEAYAQDEEDRRIWKEMSALVGRMCWKIASKRNQTVIWVKPLTNDCYLKREPDTHPPLCSPSDDPDAVWGVKMKACITRYSDQMHRAKGADLAPWPARLTTPPPRLADFNYSTEMFEKNMEYWQQEVANYWKMLDNKIKPGTIRNVMDMKANLGSFAAALKDKDVWVMNVVPENGPNTLKIIYDRGLLGTVHNCHIVTVEVLPSCDLGLFWHQCDSPEDLLIEMDRILRPKGFIIVYDKRSVVLSIKKFLPALHWVAVATSNLEQDSNQGKDDAVLIIQKKMWLTSESIQVSE

SEQ ID NO: 158710 - protein, 712 aa, Glycine max
  Coding DNA Sequence Number=SeqID_67025
  Gene Ontology: Mol. function=binding; Biological process=cellular iron ion homeostasis
  Homolog annotation: Hit_ID=A7Q1P5; Match level="QueryCoverage=100%, HitCoverage=96%, E-value=0.0, Identity=67%"; Hit description =Chromosome chr7 scaffold_44, whole genome shotgun sequence
  Pfam annotation: Domain name=TPR_1; Domain location=135-168; Score =0.4; E_value=4.8; Accession=PF00515.19; Description=Tetratricopeptide repeat
  Pfam annotation: Domain name=TPR_1; Domain location=439-472; Score =0.5; E_value=4.6; Accession=PF00515.19; Description=Tetratricopeptide repeat
  Pfam annotation: Domain name=TPR_1; Domain location=510-543; Score =2.4; E_value=2.8; Accession=PF00515.19; Description=Tetratricopeptide repeat
  Pfam annotation: Domain name=TPR_1; Domain location=566-599; Score =8.8; E_value=0.46; Accession=PF00515.19; Description=Tetratricopeptid e repeat
  Pfam annotation: Domain name=TPR_1; Domain location=600-633; Score =23.8; E_value=0.00063; Accession=PF00515.19; Description =Tetratricopeptide repeat
  Pfam annotation: Domain name=TPR_1; Domain location=670-706; Score =8.2; E_value=0.55; Accession=PF00515.19; Description=Tetratricopeptid e repeat
  Pfam annotation: Domain name=TPR_2; Domain location=135-168; Score =6.6; E_value=4.5; Accession=PF07719.8; Description=Tetratricopeptide repeat
  Pfam annotation: Domain name=TPR_2; Domain location=320-353; Score =9.3; E_value=2.1; Accession=PF07719.8; Description=Tetratricopeptide repeat
  Pfam annotation: Domain name=TPR_2; Domain location=439-472; Score =7.9; E_value=3.1; Accession=PF07719.8; Description=Tetratricopeptide repeat
  Pfam annotation: Domain name=TPR_2; Domain location=474-507; Score =10.5; E_value=1.5; Accession=PF07719.8; Description=Tetratricopeptide repeat
  Pfam annotation: Domain name=TPR_2; Domain location=510-543; Score =7.2; E_value=3.8; Accession=PF07719.8; Description=Tetratricopeptide repeat
  Pfam annotation: Domain name=TPR_2; Domain location=566-599; Score =9.8; E_value=1.8; Accession=PF07719.8; Description=Tetratricopeptide repeat
  Pfam annotation: Domain name=TPR_2; Domain location=600-633; Score =28.9; E_value=1.9e-05; Accession=PF07719.8; Description =Tetratricopeptide repeat
  Pfam annotation: Domain name=TPR_2; Domain location=670-706; Score =6.7; E_value=4.4; Accession=PF07719.8; Description=Tetratricopeptide repeat
  Pfam module annotation: Pfam domain module=TPR_1::TPR_1::TPR_1::TPR _1::TPR_1::TPR_1::TPR_2::TPR_2::TPR_2::TPR_2::TPR_2::TPR_2::TPR _2::TPR_2; Domain location=135-168::439-472::510-543::566-599::600 -633::670-706::135-168::...
  Pfam module annotation: Domain location=320-353::439-472::474 -507::510-543::566-599::600-633::670-706
MKCLRSVESLGGADEVFPSSSGSLASAIKDFSASENSCLAEQLDKKPDTGNIEEAESSLRESGVLNYEEARALLGRYEYQKGNIVAALHVFEGIDIGVVTPKIKIALSRSRERRKRHSQNHAEPQMSIHSVGLLLEAVFLKAKSLQVLERFKEAAQSCKVILDIVESSLPEGMPDNFGAECKLQETLNKAVELLPELWKLADCPREAILSYRRALLHHWNLDAETIAKIQKEFAVFLLYSGGEATPPNLRSQMDGSFVPRNNIEEAILLLMILLRKVSLNRIEWDPSILDHLSFALSVSGDLTALANQLEELLPGTIHRSERYYALALCYYGTSKDLVALDLLRKLLRSREDQHHVPGLLMASKICCENSTLAEEGVSFAWQVLQNLDGRCNQLENHANFFLGVSLSAHSKLAVSDSDRFKRQSEALQALETAGRTGNPFVLYHLSLEYAEQRKLDAALYYAKCFLKLEGGSNVKGWLLLARILSALKQFLDAESIINTALDQTGKWDQGDLLRTKAKLQIAQGQLRNAIETYTQLLAVLQIQSKGFGSGKKLYKENRDRARNLEVEIWHDIAYVYISLLQWHDAEVCLSKSKAIKPLSASRCHAIGIMYEAKGHYKEALKAFGDALDVDPGHVPSLISTAVVLKRCSNKSNPAVKSFLVDALRHDRFNASAWYNLGLLHKAEGTASSLVEAAECFQAAHFLEESAPVEPFR

SEQ ID NO: 158711 - protein, 225 aa, Glycine max
  Coding DNA Sequence Number=SeqID_67026
  Gene Ontology: Mol. function=protein dimerization activity; Cellular component=nucleus; Biological process=regulation of transcription, DNA-dependent
  Homolog annotation: Hit_ID=A7Q1K7; Match level="QueryCoverage=74%, HitCoverage=54%, E-value=9e-24, Identity=44%"; Hit description =Chromosome chr7 scaffold_44, whole genome shotgun sequence
  Pfam annotation: Domain name=AUX_IAA; Domain location=21-215; Score= -18.2; E_value=4e-08; Accession=PF02309.7; Description=AUXIAA family
MSTVSKDDNLVLSSEDSSCPEESELELGLGLSLSSGPSSKSHHHHVHAPTTLYARIYTAKDFPSSAAAASSSPSSSSSSSPNITAGTKRAAADSLVANNRPSQVVGWPPLRTYRVNSFNSHAKSTEVFNSVAEKSKINNTVVRKTNDNDNDNNINAKEKRHLRSSLFVKVNMDGIPIGRKVDLSAHSSYETLAQTLEDMFNESTTVTTCKENASPSGNSDMFHDH

SEQ ID NO: 158712 - protein, 169 aa, Glycine max
  Coding DNA Sequence Number=SeqID_67027
MEPEGQKGTVNPSAMLASLLSRRAKLHEDLRSIEKQAEDLAAGRDDGRPDYGPGRSKGGGIYANGQGKPKKGRGGARDAKRARASSEQDFDYEDDPDLTLHGTGDLLYYCKAVRRYGKCYFAARHGHLNTVALLFGVAAIVAAIVVPAIISICHATGSQGGDRMYEDEC

SEQ ID NO: 158713 - protein, 150 aa, Glycine max
  Coding DNA Sequence Number=SeqID_67028
  Homolog annotation: Hit_ID=A9PE76; Match level="QueryCoverage=33%, HitCoverage=13%, E-value=6e-11, Identity=62%"; Hit description =Putative uncharacterized protein
MNSYSIRPWTSTTRLTATKDACGVRRRCSRDDEGGAKVPHTTICGDLTRRRLAVTSRDQREGNGHEGGGGAVVQRRWCSGVGEEECGHGKMQTIARRLGQQSLRPSTSLKSIYPISDHHYGMDHERYVSTPRTKGVGHLVLRALVDDPPS

SEQ ID NO: 158714 - protein, 283 aa, Glycine max
  Coding DNA Sequence Number=SeqID_67029
MEEGRTQKSSEVVEVLITFFLLKLLIVPLALVRAGYLFHQCSVPIDKGFVDAVLAGAGAGDGASELDLGGVGEVVDEADESSAAFLLLLAVVEGVDEVLELRATELAGADAEDEADGVHEVGLAGAVGAKDGGEVVEGTDHLEALVGLEILHLEAVDFARGERWMHHIWTCGLGCVRRLVDLVWVVGANLGSWGCGGGWWCAQTMERDCVVGGICVEFGSLRRLMVLVWAECGFGSTEVVVVSGGARWCLFGLCGGWRCRGCGMMLAMSWVAVLVMVVGGFLG

SEQ ID NO: 158715 - protein, 140 aa, Glycine max
  Coding DNA Sequence Number=SeqID_67030
MTHLKMLHIVNCSLLLCLPSLSIENLNHNLVITGPSLLTSNTYPLEKQEKGTTSFSECSRRCVMTEGTTHGTLHPQLLDVTKEIKYLREKVFLWRKYKSSYGEKKSLKNYTYTSLISPLTIPLYQLFQHAKGYTGAGSET

SEQ ID NO: 158716 - protein, 1167 aa, Glycine max
  Coding DNA Sequence Number=SeqID_67031
  Gene Ontology: Mol. function=ATPase activity; Cellular component =chromosome; Biological process=chromosome organization and biogenesis
  Homolog annotation: Hit_ID=A7Q1S8; Match level="QueryCoverage=99%, HitCoverage=99%, E-value=0.0, Identity=63%"; Hit description =Chromosome chr7 scaffold_44, whole genome shotgun sequence
  Pfam annotation: Domain name=ABC_tran; Domain location=1000-1134; Score=-58.9; E_value=0.051; Accession=PF00005.18; Description=ABC transporter
  Pfam annotation: Domain name=SMC_N; Domain location=9-1155; Score =279.0; E_value=9.3e-81; Accession=PF02463.10; Description =RecFRecNSMC N terminal domain
  Pfam annotation: Domain name=SMC_hinge; Domain location=516-584; Score=42.0; E_value=2.1e-09; Accession=PF06470.4; Description=SMC proteins Flexible Hinge Domain
  Pfam annotation: Domain name=Strep_SA_rep; Domain location=294-318; Score=4.2; E_value=22; Accession=PF06696.2; Description =Streptococcal surface antigen repeat
  Pfam annotation: Domain name=Strep_SA_rep; Domain location=336-360; Score=1.0; E_value=74; Accession=PF06696.2; Description =Streptococcal surface antigen repeat
  Pfam annotation: Domain name=Strep_SA_rep; Domain location=788-812; Score=13.0; E_value=0.8; Accession=PF06696.2; Description =Streptococcal surface antigen repeat
  Pfam module annotation: Pfam domain module=ABC_tran::SMC_N::SMC _hinge::Strep_SA_rep::Strep_SA_rep::Strep_SA_rep; Domain location =1000-1134::9-1155::516-584::294-318::336-360::788-812
MPSLLSPGKIHCLEVENFKSYKGFQVIGPFYDFTAILGPNGAGKSNLMDAISFVLGVRTGQLRGAQLKDLIYAFDDREKEQKGRRAFVRLVYHLANSTEIKFTRTITSAGASEYRIDESLVNWDTYNNRLKSLGILVKARNFLVFQGDVESIASKNPKELTALVEQISGSDECKRDYEQFEEEKGAAEEKSALVYQKKKTVVMERKQKKEQKEEAEKHLCLQQELKSMKGEHFLWKLFNIHNDYAETIKDLEDEEKSREGVVKELEYFESEASKKKKEQAKYLKEIALREKRIAEKSNKLDKSQPELLKLKEEMTRITSKIKKGKKELDKKKVERTKHDADIALLQNDIQDLTAKMADLQEKGRDVDDELDLQGNDLEEYFRIKEEAGMKTAKLREEKELLDRKLNADSEAQKNLEENLQQLRNRESELNSQEEQMRARLEKILDNSAKNKVGLENLKKELRVMQDKHRDSKKKYENLKLKIGELENQLRELKADRYENERDVRLSQAVETLKRLFQGVHGRMTDLCRPTQKKYNLAVTVAMGKFMDAVVVDNEKTGKECIKAILFAVGNTLVCDDLEEAKILSWSGERFKVVTVDGILLTKSGTMTGGTSGGMEARSKQWDDKKIEGLNKKKEQYESELEELGSIRDMHLKESEASGKISGLEKKIQYAEIEKRSIEDKLSNLSQEKKTIKERIECISPELQKLNDAVNKSNADVRKLERRINEITDRIYRDFSKSVGVANIREYEENRLKAAQSIAEERLNLSSQLSKLKYQLEYEQNRDMTSRIQELEASLGTLEKDLKRVQDREAAAKLAAENATEEINQLKEEAKEWKSKSEDCEKEIQEWKKKASAATTNISKLNRLIHSKAQIDQLNVQKQEILEKCELEQISLPVILDPMDTDISVPGPSFDFHQLNRALKDRRHSDRDKIEVEFKQKMDALISEIERTAPNLKALDQYEALLEKERVVTEEFEAVRKEEREKTQRFNEVKQRRYHLFMDAFTHISGNIDKIYKQLTKSNTHPLGGTAYLNLENDDDPFLHGIKYTAMPPTKRFRDMEQLSGGEKTVAALALLFSIHSYKPSPFFILDEVDAALDNLNVAKVAGFIRSKSCEGARTSQDADGGNGFQSIVISLKDTFYDKAEALVGVYRDSERGCSRTLTFDLTKYREF

SEQ ID NO: 158717 - protein, 105 aa, Glycine max
  Coding DNA Sequence Number=SeqID_67032
MACGDEVGGGCRACGPGVVESCSGVTIARKEEVKGTMVDGGCGVTQGRVGVGGDLVVVAIAAADVLQSLAFLMMSWWWTIMMVCGNEEQRRRKRKEGERTGRREF

SEQ ID NO: 158718 - protein, 451 aa, Glycine max
  Coding DNA Sequence Number=SeqID_67033
  Gene Ontology: Mol. function=rRNA (adenine-N6,N6-)-dimethyltransferase activity; Cellular component=nucleus; Biological process=rRNA modification
  Homolog annotation: Hit_ID=A5C2S0; Match level="QueryCoverage=70%, HitCoverage=89%, E-value=1e-121, Identity=70%"; Hit description =Putative uncharacterized protein
  Pfam annotation: Domain name=Methyltransf_11; Domain location=59-171; Score=21.4; E_value=0.00082; Accession=PF08241.3; Description =Methyltransferase domain
  Pfam annotation: Domain name=Methyltransf_12; Domain location=59-146; Score=16.7; E_value=0.014; Accession=PF08242.3; Description =Methyltransferase domain
  Pfam annotation: Domain name=RrnaAD; Domain location=25-273; Score =261.9; E_value=1.4e-75; Accession=PF00398.11; Description=Ribosomal RNA adenine dimethylase
  Pfam module annotation: Pfam domain module=Methyltransf _11::Methyltransf_12::RrnaAD; Domain location=59-171::59-146::25-273
MAGGKAKKEKGKPHQQQKHMPYQGGISFHKSKGQHILKNPLLVDSIVEKAGVKSTDVILEIGPGTGNLTKKLLEAGKKVIAVEIDPRMVLELQRRFQGTPHSNRLTVIQGDVLKTELPYFDICVANIPYQISSPLTFKLLKHEPAFRAAIIMFQREFAMRLVAQPGDKLYCRLTVNTQLHARVFHLLKVGRNNFRPPPKVDSSVVRIEPRKPRIEVKQKEWDGFLRICFNRKNKTLGSIFRQKSVISLLEKNYRTVRALELGQEDSLKEVDAKMDFSSFGDDRGMEMDDDGADDDEMEVEDGEADEVQSEFKDKVLGVLKEGDFEEKRRLDEWVKLDQLDLNSVEAVVDEKVEEKGATGLKMTRHQKRKIDETHVERNQDNKTKGNSFFLYSSSTTINDKGKRRTEEDEIYTIGKGIKEVVASASEGATIIVIVALGAYVTYKFTSASSRA

SEQ ID NO: 158719 - protein, 210 aa, Glycine max
  Coding DNA Sequence Number=SeqID_67034
  Gene Ontology: Mol. function=helicase activity; Biological process =protein amino acid phosphorylation
  Homolog annotation: Hit_ID=Q7XD08; Match level="QueryCoverage=99%, HitCoverage=19%, E-value=6e-40, Identity=41%"; Hit description =Putative uncharacterized protein
  Pfam annotation: Domain name=DUF889; Domain location=34-209; Score =196.7; E_value=5.6e-56; Accession=PF05970.5; Description=Eukaryotic protein of unknown function (DUF889)
MAHKFCFVALDHSLRDIIKHNSRDSKIFGGKVMVFGGYFRQILPVIPRGSRSNIVNATINSSYLWDHCQILRLTKNMCLQNNMQATDQEETAAFSQWIIDNGDGEQMEYMSSDLVDKSETIESYHFRSLTTEFLNSLTTSGLPNHCQKLKIGTPIMLLRNLDQTQGLCNDTRLIATRLAKHVIATDIISGTNIGDHVYIPRMSMSPSQSP

SEQ ID NO: 158720 - protein, 96 aa, Glycine max
  Coding DNA Sequence Number=SeqID_67035
MFLFNTCFVKKSVEAKLHDKSRLIQRCFDDNKGDDKKLKGQSKNEFKMFKIESRTLQDSRGKLISRIKNQDSRIKLPRIKIKIKIQDSRFKNQEKT

SEQ ID NO: 158721 - protein, 98 aa, Glycine max
  Coding DNA Sequence Number=SeqID_67036
MKKWDTGHQSVSLENKTRDSTVLKIGDSAKVVIKQDMKGRKHKYGFNNNKREKPEKVRVVDDETSDKHELYEVLRVPSKTKYRCLNQKKNVVITYLLW

SEQ ID NO: 158722 - protein, 88 aa, Glycine max
  Coding DNA Sequence Number=SeqID_67037
MSHLRPPSQSHFDIGEEAEETQRSLEATLEPSPPVVNLPSPQPAADPSTPLLQILEDPTTPVLAVETSPPTTPVLQLTDEEDGKTQDT

SEQ ID NO: 158723 - protein, 24 aa, Glycine max
  Coding DNA Sequence Number=SeqID_67038
MDHRPTSSSGQVMVGCLIYPRGFE

SEQ ID NO: 158724 - protein, 196 aa, Glycine max
  Coding DNA Sequence Number=SeqID_67039
  Homolog annotation: Hit_ID=A5AWL4; Match level="QueryCoverage=55%, HitCoverage=17%, E-value=3e-13, Identity=36%"; Hit description =Putative uncharacterized protein
MNHLLGLGKPFEDDELNIKILNCLTRTWEPKITTIKESKDLGTMTMEALIDKCLAYEHELIQQSHAEETKKKVKGIAFKVNSSKEDGKESSNSGEEAENFNLMVKKFGEDYKESSSSANEAENSNLMVKKFGKFLNKSKDIKFSKSSKKIESNNTFTCFECDNVSTSFDSSSDEEVANVCLMEKSMDDSPTIEETE

SEQ ID NO: 158725 - protein, 212 aa, Glycine max
  Coding DNA Sequence Number=SeqID_67040
MTKRLLAGSLAFECRIMHYMIVCILLPRSSNLAQAHLVRYRMHKALRSNAPLPYPHLITLFLHHFNVPLDFEPFVKVKRSFFIGANVVSSFGYRKKRGGSWVKKDPAQALEDRSPSPPPQRDDSSSLMHNILDAMDARFAGMDTRITKLEEDGEIVEAKLSKFILMMPKSQVKNQESKKFQESKSHSIKNQDSSEDSREDSRYARTSRKTSR

SEQ ID NO: 158726 - protein, 255 aa, Glycine max
  Coding DNA Sequence Number=SeqID_67041
  Homolog annotation: Hit_ID=A7QBW3; Match level="QueryCoverage=100%, HitCoverage=61%, E-value=9e-21, Identity=30%"; Hit description =Chromosome chr1 scaffold_75, whole genome shotgun sequence
  Subcellular localization annotation: CTP_CleavageSite=51; ConfidenceScore=5.21e-01
MQTPPFFMQEPNQTYHDSNKPFQGLIQLSDLNNNNAPSGSNFFNLPFLSNRANKNNNYSEEQQQFNTAEESNFFSESTMNIGTDHQANSTTTAPSLFSTNSLQNTNISHMSATALLQKAAQMGSTSSSNHNIINNNTTNNNPSASSILRSLASKSDQRQLGGGAGNYATIFNNSVQEMMDISGFEAYDHHGGMNKEQKLGVGGSDRLTRDFLGVAQQQQQQQREGFNLVSSLESETNNNNAAPSGQSFGSDGNFQ

SEQ ID NO: 158727 - protein, 236 aa, Glycine max
  Coding DNA Sequence Number=SeqID_67042
  Homolog annotation: Hit_ID=Q6UUU1; Match level="QueryCoverage=25%, HitCoverage=40%, E-value=3e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGIRSSGTSSQVSGPTDEPNPNTSNQDWQKVMDEINSSILDKDWQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEILNREVRGRGK

SEQ ID NO: 158728 - protein, 68 aa, Glycine max
  Coding DNA Sequence Number=SeqID_67043
MRGEEGEFLTIEVALKLKKCIRSFESWKFKVSHSLMIYRGFMNFSPPSLYAPYFTKLTTPFMTQATST

SEQ ID NO: 158729 - protein, 78 aa, Glycine max
  Coding DNA Sequence Number=SeqID_67044
MDLLTNSEVINIVASAPKRSVAAKLLVNHAARAWKYKYGFKIWQEYGRMKRKNGMLLEGSPEPTLNHRLQSPQYLKEG

SEQ ID NO: 158730 - protein, 99 aa, Glycine max
  Coding DNA Sequence Number=SeqID_67045
MTRGNPSDLQPFDPEIDKIFHRLVRHHFIPFEHPEHSFTGESVHSVIGDFEHPDFEHYNFEHFEKMEQPSPRERTLMEMAAPDFTYESLCIQYPDEDVP

SEQ ID NO: 158731 - protein, 199 aa, Glycine max
  Coding DNA Sequence Number=SeqID_67046
  Homolog annotation: Hit_ID=A5BVQ3; Match level="QueryCoverage=78%, HitCoverage=9%, E-value=8e-12, Identity=31%"; Hit description =Putative uncharacterized protein
MDNSFLDNIVSSDHNQLAQSSPQVRLDSSEVSSDPISDNTNVDETDREIVSLDPTLDNTNLDGTNHEIDPCLCEITSNPNNESTIVQYNLPPCSNCGQPPAKYEPDLQAKVKKLWQILDGPKQWLMRWQLQTKNNTWNLVSLPREKKIVGCKWIFTIKRKTDETIERLPRDVRIDSQAQHCETTFVTSNRPRLVSSTIL

SEQ ID NO: 158732 - protein, 161 aa, Glycine max
  Coding DNA Sequence Number=SeqID_67047
  Homolog annotation: Hit_ID=Q2HW90; Match level="QueryCoverage=94%, HitCoverage=38%, E-value=1e-15, Identity=28%"; Hit description =Putative uncharacterized protein
MGQLQLHAFRKTYGKIWDLAMIEMSVESIASLAQYYDQPLRCFMFGDFQLVPTVEEFKGILGCPLGGRKPYLFSGLYPSMARIAKVVKVLIQELDRFGVVLFPNMDGLVDLATINAFLAYHHSKESMVVAILADAYDTFDWRCEKNSARIVCCTPTLYVWL

SEQ ID NO: 158733 - protein, 94 aa, Glycine max
  Coding DNA Sequence Number=SeqID_67048
GEIVEAKLHGESKVIQRCFDDNNEDEKGDDKKLKDQSKNNSSESRTIQEFKKRIKKNSRLKKKAKNQESRSQESRSRFKTQDSRMKRRLNQDKY

SEQ ID NO: 158734 - protein, 96 aa, Glycine max
  Coding DNA Sequence Number=SeqID_67049
MKNDEERLKIFTKSPTERSRKRYGSASAWIFFTQTIFLTNFKGKEGGPSGPDCATMLPFDFRHARNFTDCLTMGVKYLEAVKRRLHPTKQMLPGRN

SEQ ID NO: 158735 - protein, 432 aa, Glycine max
  Coding DNA Sequence Number=SeqID_67050
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=40%, E-value=0.0, Identity=100%"; Hit description=DNA -directed RNA polymerase subunit beta
  Pfam annotation: Domain name=RNA_pol_Rpb2_3; Domain location=42-111; Score=135.4; E_value=1.6e-37; Accession=PF04565.7; Description=RNA polymerase Rpb2, domain 3
  Pfam annotation: Domain name=RNA_pol_Rpb2_6; Domain location=191-423; Score=40.4; E_value=5e-16; Accession=PF00562.19; Description=RNA polymerase Rpb2, domain 6
  Pfam module annotation: Pfam domain module=RNA_pol_Rpb2_3::RNA_pol _Rpb2_6; Domain location=42-111::191-423
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQ

SEQ ID NO: 158736 - protein, 95 aa, Glycine max
  Coding DNA Sequence Number=SeqID_67051
MDEHQEKWKEMTNIMMKINKESDEIFNTIHVIDQSYDEMSRSFAIRWKDKPEPTWHLLHSSGNMHSVTYNQDLVSPVLLAGWMKLREFYGLTGNH

SEQ ID NO: 158737 - protein, 173 aa, Glycine max
  Coding DNA Sequence Number=SeqID_67052
MTKDNAIDTSKPYIEAMRGTVHEPQANLGADQKRSLNESIPCFLIRLDPFIGLYVLAFGGLHVLVFKRLHALASRGLYVLAFRGLHVLASRGLYVLCLQRATRPRLHRAVHPCLQRATRPHLQRAVCPRLQRAACPRLQRVARPHLQRAARPRLQKVVRPLPSEGYTSSPSEG

SEQ ID NO: 158738 - protein, 401 aa, Glycine max
  Coding DNA Sequence Number=SeqID_67053
AWTRYTDNVLGKHILAERKVEIYHTELDEFKGELERRNFHKRLTNLADSSIDLALVKEFYANLYNPKGPSPKQVRIRGHLIRIDADNLNAFLETPVVLAEGESFPVYSRYCRMPTDTREIEAALCIPDRGVLSYCNLASTSHISDLTVDQARLIFGLVTQLDMNVRALISGQITSMAQSNSSRLGFPALSTALCRTRGVASDNLVFERLSPFINLAYIRKNCWNPDDPTIIIRGARRPRARPVETPSTSAAPPPARIAAAPSTPPPLVAPPDSIPIVEQFNEWVAWPWTQPPLHRDDEDPAAQVPHQPSDESSESSTPEPLIRKRREAATTPEKSPEATPKPLGPMVDTTSPQQAVDTSTPEVQTTPVLSPNTSLVATPVLHLTNKEEVQTWDTQDQSQDL

SEQ ID NO: 158739 - protein, 38 aa, Glycine max
  Coding DNA Sequence Number=SeqID_67054
FDDKSCEGTNSEDPDVDFERVANRAEDEEDEDMGFPRS

SEQ ID NO: 158740 - protein, 80 aa, Glycine max
  Coding DNA Sequence Number=SeqID_67055
MGAKYLEEVKRGSHPNNGWSPNEIRTHNDHNLSLCVVGHDRAWAARHRMTIICLCVPPNTIASAWRKGVRNDHNLSLPTS

SEQ ID NO: 158741 - protein, 144 aa, Glycine max
  Coding DNA Sequence Number=SeqID_67056
  Homolog annotation: Hit_ID=Q2N2B2; Match level="QueryCoverage=79%, HitCoverage=31%, E-value=1e-07, Identity=32%"; Hit description=RPGR ORF15 isoform
EDFEYSTGEDFEPSKGEDFESFKGEDFESSNSEDFEPSKGEEFESPKDFESSDGENFESSKGEDFDPSKGEDSKSSKERTFSPLMVQVPNDGEDLEPSKGEDFEPSKGEDSESSKARTFSPLMVRTLSPLKDKDEDFESYEMSQ

SEQ ID NO: 158742 - protein, 180 aa, Glycine max
  Coding DNA Sequence Number=SeqID_67057
  Pfam annotation: Domain name=G-patch; Domain location=1-42; Score =21.7; E_value=0.00045; Accession=PF01585.14; Description=G-patch domain
MVARVMLKNGFEPGMGLGKDGFRNADVVDIKGNPYKYGLGYEPGMPGRRNVPSRLRADRVWPGRISQCFTSAGMVSEEEVAAVGEEFPQDPPNFLQPCHPDSQVGNWHVISQSEVYTADSIYEGRFFDDPNDDGLTINFDRDVSQMMNEEEEEDVLSPELERLIAQEEREMKPRQEETDL

SEQ ID NO: 158743 - protein, 85 aa, Glycine max
  Coding DNA Sequence Number=SeqID_67058
MIDSLLLQPTLLRASEARLTGASSKGGKCAELPPMFIWGKHWKNRRKLVMKNFPDSGVVFTFEEGRQKRGSCSYVPSIEEEIRPT

SEQ ID NO: 158744 - protein, 417 aa, Glycine max
  Coding DNA Sequence Number=SeqID_67059
  Gene Ontology: Mol. function=transporter activity; Cellular component= integral to membrane; Biological process=oligopeptide transport
  Homolog annotation: Hit_ID=A4W728; Match level="QueryCoverage=96%, HitCoverage=87%, E-value=1e-131, Identity=79%"; Hit description =Amino acid/peptide transporter
  Pfam annotation: Domain name=PTR2; Domain location=13-375; Score= -24.0; E_value=5.1e-05; Accession=PF00854.12; Description=POT family
MWERFSFYGIRPLLILFMAATVYDGGMGLARENASAIVGIFAGTMYLAALPGGWLADNWLGQQRAVWRRASRRRFLAVLYGHQHGLVHAPLISGWLIKTHGWHWGFGIGGIGMLVALIIFRVFAVPAMKRYDSEVGLDSTWNSPVVKRNGVGIWLLVLAAGVATLVTLIAQGVIVINPVAVASVLVYVIAASVALYFIYLFVFAGLNRKERARLLVCFILLVSAAFFWSAFEQKPTSFNLFANDYTNRMIGDFEIPAVWFQSINALFIILLAPVFSWAWPKLASMNIRPSSITKFVIGILCAAAGFGLMMLAAQNVLSSGGAGVSPFWLVGSILMLTLGELCLSPIGLATMTLLAPERMRGQMMGLWFCASALGNLAAGLIGGHVKADQLDMLPDLFARCSVALLICAAVLIVLIVP

SEQ ID NO: 158745 - protein, 464 aa, Glycine max
  Coding DNA Sequence Number=SeqID_67060
  Gene Ontology: Mol. function=transferase activity; Biological process= flavonoid biosynthetic process
  Homolog annotation: Hit_ID=A7PIC2; Match level="QueryCoverage=97%, HitCoverage=98%, E-value=1e-142, Identity=58%"; Hit description =Chromosome chr13 scaffold_17, whole genome shotgun sequence
  Pfam annotation: Domain name=Transferase; Domain location=10-458; Score=369.2; E_value=6.7e-108; Accession=PF02458.6; Description =Transferase family
  Subcellular localization annotation: CTP_CleavageSite=2; ConfidenceScore=5.14e-01
MSSSSSSPAVLSKCTVFPHRNSTLGDLKLSISDLNMFLSHYIQKGCLFTTPSLPSHSHTLIPHLKNALSQTLSLFPPLAGRLKTDTDGFVYITCNDAGVDFIHATAADISVADLLSPSSSSDVPPISKQLFPFHHKISYTAHSSPIMAFQVTDLADAVFLGCAVCHSVTDGASFWNFFNTFAGISRGATISPSSLPDFRRESILSSNVVLRLPEDIKVTFNVEEPFRERIFSFSRESIQKLKATVNKSLTLFPPPENGDAVELMAKMSSDTQLRTVTEISSFQSLCALVWRCVTKARNLEGSKTTTFRMAVNVRQRLEPKLGDSYFGNAIQSIATCAEAGDVASKELRWCAEQLNKSVKAFDGATVRRNLENWEREPKCFELGNHDGATVQMGSSPRFPMYDNDFGWGRPLAVRSGGANKFDGKMSAFPGRNGGGAIDLEVVLAPETMARLESDSEFMFYVSGW

SEQ ID NO: 158746 - protein, 545 aa, Glycine max
  Coding DNA Sequence Number=SeqID_67061
  Gene Ontology: Mol. function=oxidoreductase activity; Cellular component=integral to membrane; Biological process=electron transport
  Homolog annotation: Hit_ID=Q9LKH7; Match level="QueryCoverage=62%, HitCoverage=64%, E-value=1e-146, Identity=78%"; Hit description =Cytochrome P450
  Pfam annotation: Domain name=p450; Domain location=88-543; Score =31.8; E_value=4.5e-15; Accession=PF00067.13; Description=Cytochrome P450
NGFFANTSLVRRHLLHRRPLIPPPRVPPPSVPPPAGEPRPAVDRRDAAADIGVQERQSGAFHRRARGAVRFDLHDARVRRADGVLGGPGGEPVHSAERREAVGLQLSRFDIEPARKTLSSVDERCSPQENALSHNELRQLLHHQGSSSSPHRPPHLPQPRCLVRHCLSHGSGKKACDCDVRNGNGGGDSDSMVRYNESNFLAHEPLHLVNLNEKITFELTVKQLMSFDPDEWTENLRKEYVLVIEGFFTLPFPLFSTTYRRAIKARTKVAEALALVVRQRRKEYGENKEKKSDMLGALLASGDHLSDEEIVDFLLALLVAGYETTSTIMTLAIKFLTETPLALAQLKLGFTEPVNRMDVAAWNPTLHPVYVHDHDHHNSTEEHDQIRAKSHPGAPLEWTDYKSMAFTQCVVNETLRVANIIGGIFRRATTDINIKGYTIPKGWKVFASFRAVHLNPEHYKDARSFNPWRWQSNSSETANPGNVYTPFGGGPRLCPGYELARVVLSVFLHRIVTRFSWVPAEEDKLVFFPTTRTQKRYPIIVQRRH

SEQ ID NO: 158747 - protein, 243 aa, Glycine max
  Coding DNA Sequence Number=SeqID_67062
  Gene Ontology: Mol. function=catalytic activity
  Homolog annotation: Hit_ID=A7Q3G0; Match level="QueryCoverage=88%, HitCoverage=94%, E-value=2e-57, Identity=58%"; Hit description =Chromosome chr13 scaffold_48, whole genome shotgun sequence
MGFSSKEEKSKRILRGLKTLFFLITMVISLLLFSAPVLLVIADALVPSALLSSLSQSSFSMETLASHFHNYDFRYSLIDIPLVSIIRSFIIFCVYSLCDGPRLSHGPYLGITTMCSVLSLMFVSFKAVYIFSVSGIDRSGYVRATEIALFVCSCALAVGHVVVAYRTSCRERRKLLVYKIDIEAPKITAFNVVMMPFQLAPCKLKISACKNGYPRATAIHHIMSLRASRDATVYPKDASNLDT

SEQ ID NO: 158748 - protein, 836 aa, Glycine max
  Coding DNA Sequence Number=SeqID_67063
  Gene Ontology: Mol. function=solute:hydrogen antiporter activity; Cellular component=integral to membrane; Biological process =regulation of pH
  Homolog annotation: Hit_ID=A7R3F8; Match level="QueryCoverage=95%, HitCoverage=66%, E-value=1e-152, Identity=37%"; Hit description =Chromosome chr4 scaffold_519, whole genome shotgun sequence
  Pfam annotation: Domain name=Na_H_Exchanger; Domain location=43-431; Score=146.3; E_value=8.4e-41; Accession=PF00999.12; Description =Sodiumhydrogen exchanger family
MEDQYVKRSVTTGCYNVDVSNPNDIWKSENILFFYLPNFAAQVAFMLLSTRLLYYILRPLNQPRLVSEILIGILISPELFGISALSEVLTPIKSILTTETISYVGLVYSVFLAGLDMNFDTILGARKKATSIAIAGIVIPMVLGAGIYALTLSMYKGPAEYWANFNTTNAYMFWALILSVTGFPMVSHILADLKLLYTGLGKVALTTAMVSDFYNWVMFAMLIPFAINGASAIYSVLGTIGFALLCFFVVRPYLVQIIVSKTNKNEWDNYGLFFVIMGSYASALVTDLLGTHPVVGALVYGIMIPRGKFTQMLIEKSEDFAAVYLAPLFFGSIGIRLRIVYVVNTQGLGLVLLILFLSFIPKILSTVIATQFYGMSVLDGVSIGLLMNTKGILPVLMLVNAWDKQILSVESFSILTVAVVMMTMMVPLIINAIYKPRKLYKQSKLKTIQNLKGDIELRILACVHNPRQATGMVNILDACHTTKLSPLRVFALQLIELTGNTISLLASHLNQHNQQQSGRAQALTKAQEDLESITNIFQAYTGTNENTSVETFAAASTYSTIHEDIYNVSQEKQANLILLPFHKQSNIEGILETTNTAFQDINRNVMRDAPCSVGIFVDRGLGSLFKVNLRMLMLFIGGPDDREALAVAWRMSKHQGVQLSVMRILMYGEAAEVDVLSSHLESRGLLAMVLDSERQKELDEEYVSAFRLKAVSNEDSIKYSEKEARCRDDIPRVLKEIEEIGYDLYILGQGTGRNSLILSELMQWADCPELGVIGDIVASNSFGSSSSVLVVQQYGFGGMVFDNSNAATQQQPREVVPADDDDDSGALAIKVEQHHQ

SEQ ID NO: 158749 - protein, 149 aa, Glycine max
  Coding DNA Sequence Number=SeqID_67064
  Gene Ontology: Mol. function=phosphoinositide phospholipase C activity; Cellular component=cellular_component; Biological process =intracellular signaling cascade
  Homolog annotation: Hit_ID=P93620; Match level="QueryCoverage=77%, HitCoverage=20%, E-value=4e-42, Identity=70%"; Hit description =Phosphoinositide-specific phospholipase C
  Pfam annotation: Domain name=PI-PLC-X; Domain location=41-149; Score =68.1; E_value=2.9e-17; Accession=PF00388.10; Description =Phosphatidylinositol-specific phospholipase C, X domain
MLLCITCKLILSGHEISNKCLKHRNLAAPRNKHKFKVHHDMNAPLSHYFMYTGHNSYLTGNQLTSESSDEPIIEALKQGVRVIELDLWPSKSSNNDGIKVVHGRTFTTPVPVSKCLQSIKDYAFHKSDYPVILTLEDHLTPKHQDNFAK

SEQ ID NO: 158750 - protein, 75 aa, Glycine max
  Coding DNA Sequence Number=SeqID_67065
MSELMTRWARACIADSLPYSPNPLSELSVSLNGCYSLSVYISLSETPTATTFFFFILKPETEVENTLIQNVGNIY

SEQ ID NO: 158751 - protein, 388 aa, Glycine max
  Coding DNA Sequence Number=SeqID_67066
MGVPIGADIDRCSLGKKMDTVVCLSLGWKCIGWLEQRLAGRLVSSETMKLGRRDEVQSGLRVPLQFHKTAGDDVSFGNGQYVQVNSEPRILNNHRDVLTDTRALQLLTIANHDAQGSGITSGKAQLRNQLKLDEVVGTPTVHQQDHLSVSDEAHETQRFRRHLSCQRVKTDLGREKCPRGAAMPSVVFLVACEAKPSLPGLGRVGGNNRGGVGMARRGMVELGFWEGGTGVTVVGKGGGYIWGQRLMGLDLAANIRCQPRHEVAEQEWWRETDDAVRQLLKFGEVLGHRTLLGELEQDTYGVLVLRRREPSLNRLKKGRPRCKLTIAVHPLEPSQGAAVHVERGNGEEEEMGVEQVWVAWEGDDAKSHSTGMLPFAKSHPWTIAGLRA

SEQ ID NO: 158752 - protein, 43 aa, Glycine max
  Coding DNA Sequence Number=SeqID_67067
MDDIEVDERSFSCAVDSDIRSEDIKNGGVTSKKARKIEEKKKI

SEQ ID NO: 158753 - protein, 29 aa, Glycine max
  Coding DNA Sequence Number=SeqID_67068
MENVAVIFSASLAELVYVEKCEEEEILGG

SEQ ID NO: 158754 - protein, 137 aa, Glycine max
  Coding DNA Sequence Number=SeqID_67069
MVDLKQAKGGSRRTVNDQELDDRNTTVPKVQTRAGRGGGEMVAGVAEDVDADDGQSKRLRGDDVNDDENNRCKKEPDRDRARDRDCEHSSACLSMRDFITELPWKAAMASDADLGAGLGGMIMRDFITELPWEAAME

SEQ ID NO: 158755 - protein, 184 aa, Glycine max
  Coding DNA Sequence Number=SeqID_67070
MMKRRERDIHIILQGMKEGMELFGVSRLHHETCRTPNQTVGIARRTAPESATLLSEHFVASIALVADHESQPSAQITHLPHLVGTADVHAGDEDARQRHAAADEDPLQFLAEALVDADVALVDRDGEAAEDRSDGAAVVEGAADDAEASVVDDDGGTVGVRRRLDGGGGGAGAAKGADEGGRDD

SEQ ID NO: 158756 - protein, 320 aa, Glycine max
  Coding DNA Sequence Number=SeqID_67071
  Gene Ontology: Mol. function=structural constituent of ribosome; Cellular component=ribonucleoprotein complex; Biological process =ribosome biogenesis and assembly
  Homolog annotation: Hit_ID=A5AXI6; Match level="QueryCoverage=100%, HitCoverage=100%, E-value=1e-122, Identity=72%"; Hit description=60S acidic ribosomal protein P0
  Pfam annotation: Domain name=Ribosomal_60s; Domain location=234-319; Score=73.1; E_value=9.5e-19; Accession=PF00428.10; Description=60s Acidic ribosomal protein
  Pfam annotation: Domain name=Ribosomal_L10; Domain location=6-110; Score=156.7; E_value=6.5e-44; Accession=PF00466.11; Description =Ribosomal protein L10
  Pfam module annotation: Pfam domain module=Ribosomal_60s::Ribosomal _L10; Domain location=234-319::6-110
MARKLTKAQKKIAYDAKLCKLLDNYTQILVVAADNVGSNQLQNIRHGLRGDSVILMGKNTMMKRSIKIHAQNTGDTTILNLIPLLVGNVGLIFTKGDVKEVKEVVSKYKVAAPARVGLVAPIDVIVPPGNTGLDPSQTSFFQVLNIPTKINKGTVEIVTPVELIMKGDKVGSSEAVLLSKLAIRPFSYGLAVVSVYDNGSVFSPEVLDLTEDDLVVKFAEGVCMVSSLSLAISYPSIAAAPHMFVNSYKNILAVAVATEYSFPEADKVKEYLKDPSKFAVAVVAAPATKSGAAPAAASKVEEKKEEADESDDDMGFSLFD

SEQ ID NO: 158757 - protein, 278 aa, Glycine max
  Coding DNA Sequence Number=SeqID_67072
  Gene Ontology: Mol. function=symporter activity; Cellular component =integral to membrane; Biological process=auxin mediated signaling pathway
  Homolog annotation: Hit_ID=Q9FEL8; Match level="QueryCoverage=98%, HitCoverage=57%, E-value=1e-125, Identity=80%"; Hit description =Auxin transporter-like protein 1
  Pfam annotation: Domain name=Aa_trans; Domain location=42-278; Score=- 33.0; E_value=0.00024; Accession=PF01490.9; Description=Transmembrane amino acid transporter protein
MLPQKQAEEAMMSSLTQTMEREEGEEVIGETSNFSFKNALWHGGSAYDAWFSCASNQVAQVLLTLPYSFSQLGMVSGIIFQVFYGLLGSYTAYLISILYIEYRSRKEKENVSFKNHVIQWFEVLEGLLGPYWKAIGLAFNCTFLLFGSVIQLIACASNIYYINDHLDKRTWTYIFGACCATTVFIPSFHNYRIWSFLGLGMTTYTAWYLTIAAIAHGQVENVKHSAPNKMVLYFTGATNILYTFGGHAVTVTGIKDNWRISLHGPFPFFNCSFILHSF

SEQ ID NO: 158758 - protein, 554 aa, Glycine max
  Coding DNA Sequence Number=SeqID_67073
  Gene Ontology: Mol. function=arginyltransferase activity; Cellular component=cytoplasm; Biological process=regulation of protein catabolic process
  Homolog annotation: Hit_ID=Q9ZT48; Match level="QueryCoverage=90%, HitCoverage=81%, E-value=1e-123, Identity=46%"; Hit description =Arginyl-tRNA--protein transferase 1
  Pfam annotation: Domain name=ATE_C; Domain location=249-405; Score =317.6; E_value=2.2e-92; Accession=PF04377.6; Description=Arginine -tRNA-protein transferase, C terminus
MASSSSNTPKESVVDDRGRRRTSCGYCRSSRDNSISHDGTLDVKKVDVTEDPTKSGNFSSPMSEESLAAGSENKDEVEKSLHLSNQIDNVIHILIERGEFASGIQLPKASVKRVSQGKRKLLVNGSEDLLYSSNIAFQIAASIKRAQSCDKVVNDSKPSRVCEKENDSSPKIIAEKLVASLDPTVKNSGLSIRACNGHINFYASSKQVSLNRSVQNAPVPKNSRMKHYSGGNCLIGQVKRRKLEIRLNRSSFDPEEFALYRRYQLKVHNDKPQNVTENSYRSFLVDTPLIQVSPTGGSTVPPCGFGSFHQQYLIDGQLVAVGVIDILPKCLSSKYLFWDPDFAYLSLGKYSAFQEIGWVKENQVYCPSLQYYYLGYYIHSCNKMRYKAAYHPSELLCPLRYQWVPFDIARPLLDRKPYVVLSDSSILQNGESSLPQITDDVMGRDFDDVGQEDANDVPMLDEEEMVDSESECSDDEPDLETTSDDDPEIVDVSKVLLGIKGSHVKYKDLWVVFDPEQRSYLESRLRRYRKVVGPALSERMGALLVLFVALRVAH

SEQ ID NO: 158759 - protein, 106 aa, Glycine max
  Coding DNA Sequence Number=SeqID_67074
PKQVKVRGHLIRIDADSLNSFLETLVVLEEGETLPTYSRFSRMRIDPQEFIAHLCIPGKGFVLNTEGHPWKLLRKDLTTLAQTWSVLSYSNLTPTSHTSNLNMERA

SEQ ID NO: 158760 - protein, 217 aa, Glycine max
  Coding DNA Sequence Number=SeqID_67075
MRERNRVRERVREGERYRDSERQRFREGESERVHDRYRARVWDRDRVRVREGRPRERVYTQRAVDDRNNFHRRGPRSNTGRSWWADEDYSPSRIAYVYQEDQSFDADNHGTWVEVTRKKKTKEVTNRDGPGRSSHQQKWGKVWEVFIPRTKNKLGHRFGFVRFKGVMDEQRLERQLDNNIFIDGVKVFVNRPKFERGKVVNTREKGTSIRGEGDIPQ

SEQ ID NO: 158761 - protein, 106 aa, Glycine max
  Coding DNA Sequence Number=SeqID_67076
MTDPLGLHQVKHLPTDLTSSTSMSANLDSSLYIKHEDLSEIAHGGQCLSISVLQLWILHLTETCMRAGNSDIYGFLEPQSIQSAIKGLDDAPQPKSKAPARWIVVK

SEQ ID NO: 158762 - protein, 76 aa, Glycine max
  Coding DNA Sequence Number=SeqID_67077
MDKTGESVRVTTSSNEESERLATPPTGELGGSATFLAGESGGAVVSSDGESEMIIRGRDGGTISSSGEGGRFTTGD

SEQ ID NO: 158763 - protein, 273 aa, Glycine max
  Coding DNA Sequence Number=SeqID_67078
  Gene Ontology: Mol. function=acetylornithine transaminase activity; Cellular component=cytoplasm; Biological process=arginine metabolic process
  Homolog annotation: Hit_ID=A7MNW0; Match level="QueryCoverage=98%, HitCoverage=66%, E-value=1e-132, Identity=84%"; Hit description =Putative uncharacterized protein
  Pfam annotation: Domain name=Aminotran_3; Domain location=26-273; Score=316.3; E_value=5.6e-92; Accession=PF00202.12; Description =Aminotransferase class-III
MAMSLQVSRHDFDQWMMPVYAPAAFVPVRAEGSTLWDQQGKEYIDFAGGIAVNALGHAHPALQQALTEQAGKLWHTGNGYTNEPILRLAKQLIDATFADRVFFCNSGAEANEAALKLARKVAHDRFGAEKNGIVAFTNAFHGRTLFTVSAGGQPAYSRDFAPLPPAIQHATFNDLASAAALINDQTCAVIVEPIQGEGGVLPADPAFLRGLRELCDRHQALLIFDEVQSGVGRTGSLYAYMHYGVTPDVLSTAKALGGGFPIGAMLTREDLAQ

SEQ ID NO: 158764 - protein, 214 aa, Glycine max
  Coding DNA Sequence Number=SeqID_67079
  Subcellular localization annotation: CTP_CleavageSite=32; ConfidenceScore=5.10e-01
MAHCALGSVGGFALQLNQRINAGQQRSAENFVAVMVEAVTRTLQLTRFLLTADRSQPEPVIDDVNLRHLRPALHHTHRALPRPAYHAQLLQPCQQALLMRRQRRAPVAGALIPAGRDTGAAHRRRLFSFSNAAKRLRNNPYRSGEEEKSRSRAYTTCGAPSPSCSEHSWRDPADASRLAQHAGFICRAKVRHHPAAQVDTLTDVQRQVVVITVE

SEQ ID NO: 158765 - protein, 171 aa, Glycine max
  Coding DNA Sequence Number=SeqID_67080
  Gene Ontology: Mol. function=hydrolase activity; Biological process =metabolic process
  Homolog annotation: Hit_ID=A8AHB8; Match level="QueryCoverage=98%, HitCoverage=93%, E-value=6e-53, Identity=57%"; Hit description =Putative uncharacterized protein
  Pfam annotation: Domain name=Hydrolase; Domain location=1-143; Score =35.9; E_value=1.4e-07; Accession=PF00702.17; Description=haloacid dehalogenase-like hydrolase
MDGLLIHSEPLWDRAELEVFASLNVDISRRHELPDTLGLRIDQTVTHVALQLCQQQGLAIALASASPLAMLERVLEMFNLRHYFSALASAEALPYSKPHPQVYLDAAAKLGVDPLNCVALEDSFNGMIASKAARMRSIVVPAAEHRHDARWALANVQLENLTQLQAEHLFN

SEQ ID NO: 158766 - protein, 49 aa, Glycine max
  Coding DNA Sequence Number=SeqID_67081
MEVNMGTNQTSKRFYQVKIKGLDITSIKELGRLMGPLQMQAFRKRTERS

SEQ ID NO: 158767 - protein, 238 aa, Glycine max
  Coding DNA Sequence Number=SeqID_67082
  Homolog annotation: Hit_ID=UPI00006A2D9E; Match level="QueryCoverage =67%, HitCoverage=98%, E-value=8e-13, Identity=19%"; Hit description =UPI00006A2D9E related cluster
MVAITPAKVHQPPFLRGYDSNAMCAYHGGAPGHSTEHCRALKHKVQDVGNLYTSSPSEGSTPSPSENYTSSPSEDYTTSPSEGCRPSPFRELHVLTFRGLHALAIRGLHVLANSGLHALTFRGLHVLTFRGLHVLAIRGWSALAIRGLHFLSFRGLHTLAFRGLHVLAFRGLHALAFRGTHVLAFRGLHALAFRGLHILTFRGLHVLTFQRTTRPRLQRATRPCLQRDYMSSPLEGLH

SEQ ID NO: 158768 - protein, 61 aa, Glycine max
  Coding DNA Sequence Number=SeqID_67083
YILCGTSRGYIYLGLTESKRGYISCGSVLVEGTSTRFKENKGGGIAQAERHPPIGKSAEGA

SEQ ID NO: 158769 - protein, 37 aa, Glycine max
  Coding DNA Sequence Number=SeqID_67084
MGKWAPRKLSTKRSRKDATVEGTSGRSRVRQPSFQER

SEQ ID NO: 158770 - protein, 173 aa, Glycine max
  Coding DNA Sequence Number=SeqID_67085
MESPTVTTYPFAGERGEAFGCVFQRRKMRGVATNVYLRKTKVLAPLMFVPKGAKYLEAVKQRLHAMKQWSPDEIRVTGCTICGEAHETCQCILTEQNTQEIHYMGNQQQQGYTQGGFLGFQQGPYNQQRQWRTHPSNQFNKDQSGPSNRPIQQGPNIFQRTTKLEDTLTQFMQ

SEQ ID NO: 158771 - protein, 110 aa, Glycine max
  Coding DNA Sequence Number=SeqID_67086
MQSIDSVQEDDLTIIGKESYDEIKYLSFGLGVNDERMAEQALTFYKITVLSTCSRRKTTTYECAGVSNDVEIRYFSTSLLRRETMLKAQVITSVLTRNDVESAGYYIGVD

SEQ ID NO: 158772 - protein, 54 aa, Glycine max
  Coding DNA Sequence Number=SeqID_67087
MGDALHDSENAFLSRFGAEMVTKGWSFVGQQWWVRKEGESYVREGSDRGRTRIK

SEQ ID NO: 158773 - protein, 176 aa, Glycine max
  Coding DNA Sequence Number=SeqID_67088
  Gene Ontology: Mol. function=nucleoside-triphosphatase activity; Cellular component=integral to membrane; Biological process=transport
  Homolog annotation: Hit_ID=A7QBG5; Match level="QueryCoverage=100%, HitCoverage=16%, E-value=5e-47, Identity=59%"; Hit description =Chromosome chr13 scaffold_74, whole genome shotgun sequence
MEEGVEADEVVRSLSSLRMNIGSLSRRSWVSETVPEMWGAGAGHGGDVFERSTRVDDDNDEEELMWAAIERLPTFERLRKSIVKRVLEESGRFNYEEVDISNLGFQGKKKLLHAILRNVEADNERFLRRMRERIDRVAIEIPKVEVRFEHLFVEGDAFNGTRALPTLVNSTMNAIE

SEQ ID NO: 158774 - protein, 67 aa, Glycine max
  Coding DNA Sequence Number=SeqID_67089
  Gene Ontology: Mol. function=DNA topoisomerase (ATP-hydrolyzing) activity; Cellular component=chromosome; Biological process=DNA topological change
  Homolog annotation: Hit_ID=P0AES7; Match level="QueryCoverage=100%, HitCoverage=8%, E-value=1e-30, Identity=98%"; Hit description=DNA gyrase subunit B
  Pfam annotation: Domain name=DNA_gyraseB_C; Domain location=1-56; Score=136.1; E_value=1e-37; Accession=PF00986.12; Description=DNA gyrase B subunit, carboxyl terminus
RYKGLGEMNPDQLWETTMDPESRRMLRVTVKDAIAADQLFTTLMGDAVEPRRAFIEENALKAANIDI

SEQ ID NO: 158775 - protein, 20 aa, Glycine max
  Coding DNA Sequence Number=SeqID_67090
MESGAFWWKQPSSPGRAELS

SEQ ID NO: 158776 - protein, 446 aa, Glycine max
  Coding DNA Sequence Number=SeqID_67091
  Gene Ontology: Mol. function=hydrolase activity; Cellular component =outer membrane-bounded periplasmic space; Biological process=cell adhesion
  Homolog annotation: Hit_ID=Q8A325; Match level="QueryCoverage=99%, HitCoverage=59%, E-value=3e-91, Identity=39%"; Hit description=Alpha- 1,2-mannosidase, putative
  Pfam annotation: Domain name=Glyco_hydro_92; Domain location=25-446; Score=377.3; E_value=2.4e-110; Accession=PF07971.3; Description =Glycosyl hydrolase family 92
MEFSKPFKSYGTYSEGKITENERFALAKDAKAFVRFSTQENESIEVKVSLSPVSTEGAQENFDAEAKNVDFAQAKETAQKTWRDLINRFQITGGTDDQRKIFYTGVYHTFIAPNLYMDTNGDYVAAQENMNTKWFTNYSTYSYWDGFRATHPLLTIMDQKHTKEFANSLISRYTDRKDHMPIWELCGYDNFCILGYHSVSVIWDAISKGVPGIDYEKAFAAMKDASLTDKMSSSDGGGGLNEYIKLGYTPSENGASVSATLEYAYDDWCIQQLAEKLGKKEDAEVYKKRSMNFRNTFNKENNHFWPKQKNGQFLADFPLNDWKKLQPHWVSGNIWAYDFFAPHQIDEMMNLYGGKKGFEEKLDRTFTETLKMEGEQHVDISGFIGSLGFGDEPGHHVPYLYNYAGAPYNTQKMIKFIRDNMYAAKPDGLVNNEDCGQMSAWYISLL

SEQ ID NO: 158777 - protein, 39 aa, Glycine max
  Coding DNA Sequence Number=SeqID_67092
MTLPPRALDKDPRIWAKLLKKASGSHKSDGLHSVATVPE

SEQ ID NO: 158778 - protein, 573 aa, Glycine max
  Coding DNA Sequence Number=SeqID_67093
  Gene Ontology: Mol. function=arginine decarboxylase activity; Biological process=putrescine biosynthetic process
  Homolog annotation: Hit_ID=Q83Q93; Match level="QueryCoverage=58%, HitCoverage=50%, E-value=1e-170, Identity=84%"; Hit description =Biosynthetic arginine decarboxylase
  Pfam annotation: Domain name=EAL; Domain location=341-564; Score= -48.4; E_value=2.2e-07; Accession=PF00563.11; Description=EAL domain
  Pfam annotation: Domain name=Orn_DAP_Arg_deC; Domain location=48-264; Score=149.5; E_value=9.2e-42; Accession=PF00278.13; Description =Pyridoxal-dependent decarboxylase, C-terminal sheet domain
  Pfam module annotation: Pfam domain module=EAL::Orn_DAP_Arg_deC; Domain location=341-564::48-264
SDCSVNYGLNEYANNVIWAIGDACEEHGLEHPTVITESGRAVTAHHTVLVSNIIGVERNEFSTPVAPDADSPRPIQSLWDTWQEMHEPSVRRSLREWLHDSQMDLFDIHTGYSSGTYDLGQRAWAEQLYLSICHYIQQHLDPSNRAHRPIIDELQERMADKIYVNFSLFQSMPDAWGIDQLFPVLPLEGLNKTPQRRAVLLDITCDSDGTIDHYVDGDGIATTMPMPEYDVDNPPMLGFFMVGAYQEILGNMHNLFGDTEAVDVFAFPDGSVEVQLSDEGDTVADMLQYVQLNPNDLMTLFRDQVKQQQDIDEELRAQFLEEFESGLYGYTYLEDDQCKDRKMRCKSDYILMLEPVHAISGEVVAWELLTRFADDADTNNKRNPDRDAGFFSRLSADEKWQLFLHQVEKLIQLYHAGFEQVISVNVDRDIVSGIFKDAEIQRKLAALTRSRLEISAFFTARFNSADLLILKGVAKITPAPLWLDDFGPGYSNLTMLDSGIFDIVKIDKKFFWQFGEDRTFDILLDHLNQLCRGVIIEGVEHQRQVDLLSQKSIYGMQGYHWKSVYLTDLLAQV

SEQ ID NO: 158779 - protein, 306 aa, Glycine max
  Coding DNA Sequence Number=SeqID_67094
  Gene Ontology: Mol. function=methionine adenosyltransferase activity; Cellular component=cytoplasm; Biological process=one-carbon compound metabolic process
  Homolog annotation: Hit_ID=Q57K26; Match level="QueryCoverage=96%, HitCoverage=76%, E-value=1e-155, Identity=91%"; Hit description=S -adenosylmethionine synthetase
  Pfam annotation: Domain name=S-AdoMet_synt_C; Domain location=156 -293; Score=316.2; E_value=6.1e-92; Accession=PF02773.7; Description =S-adenosylmethionine synthetase, C-te
  Pfam annotation: Domain name=S-AdoMet_synt_M; Domain location=36-154; Score=286.7; E_value=4.6e-83; Accession=PF02772.7; Description=S -adenosylmethionine synthetase, cent
  Pfam module annotation: Pfam domain module=S-AdoMet_synt_C::S-AdoMet _synt_M; Domain location=156-293::36-154
MFIPIWALMLTPCAVLSAIGKQSPDINQGVDRTDPLEQGAGDQGLMFGYATNETDVLMPAPVTYAHRLVQRQAEVRKNGTLPWLRPDAKSQITFQYDGGKIVGIDAVVLSTQHSEEISQADLREAVMEEIIKPVLPTEWINASTKYHINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVSTEQLTLLVREFFDLRPYGLIQMMDLLKPIYKETAAYGHFGREHFPWEQTDKAAQLREAAGL

SEQ ID NO: 158780 - protein, 76 aa, Glycine max
  Coding DNA Sequence Number=SeqID_67095
MIVPERFEATITSLENTKDLSKLTLAKLLNCKLTKERKTSGRNTRRKISTPKKQQLTLATIMETTKDFLLANIVAE

SEQ ID NO: 158781 - protein, 90 aa, Glycine max
  Coding DNA Sequence Number=SeqID_67096
MYIKYGPKYIMKHSQQNKLSNETKTPHTYSQNNSKAPKFLKDMDASTRIKPRLLCKQSMGQNTPNDYNDGWLKFSQRSNHHFQIELSKLS

SEQ ID NO: 158782 - protein, 176 aa, Glycine max
  Coding DNA Sequence Number=SeqID_67097
MSSVIVCLQKTTMSSSIFRRRQCLQSLHAFKRRQCLLLLFKDDNVFSHCMLSKGDDDPHLHFKDNNVFNHCMPSKGDNVLIYISKTTMSSVIACLQKATVSSFTFQRQQCLQSLHAFKRRQCPHLHFEDDNVFSRCMPSIGDNVLIYISKTTMSSVITCLQKATMSLFTFRRRRCL

SEQ ID NO: 158783 - protein, 55 aa, Glycine max
  Coding DNA Sequence Number=SeqID_67098
MKQKGKRKKNREGRHVIVKRILIPSPKQRIAESPQGRANRMLKPDFPKKGMGKEK

SEQ ID NO: 158784 - protein, 434 aa, Glycine max
  Coding DNA Sequence Number=SeqID_67099
  Gene Ontology: Mol. function=protein dimerization activity; Cellular component=endoplasmic reticulum lumen; Biological process=proteolysis
  Homolog annotation: Hit_ID=A8GJK4; Match level="QueryCoverage=99%, HitCoverage=98%, E-value=1e-170, Identity=67%"; Hit description =Amidohydrolase
  Pfam annotation: Domain name=M20_dimer; Domain location=226-327; Score=27.9; E_value=3.8e-05; Accession=PF07687.5; Description =Peptidase dimerisation domain
  Pfam annotation: Domain name=Peptidase_M20; Domain location=112-429; Score=152.5; E_value=1.2e-42; Accession=PF01546.19; Description =Peptidase family M20M25M40
  Pfam module annotation: Pfam domain module=M20_dimer::Peptidase_M20; Domain location=226-327::112-429
MNTLSDLVNARIPQMQTWRRDLHQFAESGWLEFRTATLVAEELHRLGYQLQLGREVIDADVRMGLPSAEVLAQQEARALQQGALPQWLPHFSGGFCGVVATLDTGRPGPVMGFRVDMDALDQTESAAADHLPTREGFASCNPGMMHACGHDGHTTIGLALAGVLMAMKHQLSGRIKLIFQPAEEGVRGAKAMVAAGVLDDVDLFTAIHLGTGVPPGEIVCGSDSFLATTKLDVRFTGVGAHAGGKPEEGRNALLAAAQATLALHTLPQHSGGVGRVNVGVLQAGSGRNVVPDVALMKVETRGASNQVNDDIYQQALRVIAGAAAMYGVEHEVTLMGGARSCTPSPAWVSFIHQQAEALGLFSSVIDSKQQAAGSEDATYMMERVQQRGGQASYVIFGCELAAGHHNARFDFDEAVMATAVQMLATLALNQAQFG

SEQ ID NO: 158785 - protein, 83 aa, Glycine max
  Coding DNA Sequence Number=SeqID_67100
MVFRIFLKGTSFVVQVEGTSTWVVVTENKRGYISCGSVQVEGTSTWLFKENKGGYIPCGSLLVKVFTRLKRNLKDRKLLGDWM

SEQ ID NO: 158786 - protein, 97 aa, Glycine max
  Coding DNA Sequence Number=SeqID_67101
YYGKAQKLNIIQNDGQSQAKEKSIESSTEVNQNNNSILEENAQFEGEQHIQEESHVQSHTSLESASESSTKGKKRTRGYTHMLDVWDLPDGEFILLK

SEQ ID NO: 158787 - protein, 59 aa, Glycine max
  Coding DNA Sequence Number=SeqID_67102
MVAHIPDPRVDPSQYRDLVHYWCSEKGQKISNINKRSCSKYEDLHCMGTNNLPRRIHEM

SEQ ID NO: 158788 - protein, 113 aa, Glycine max
  Coding DNA Sequence Number=SeqID_67103
MKAMPSKPTRKGRKWYLNPVMILDIRGKMFSQKEGMMRILKLDKYRLKAQTYQGNPCGVYPDLSSFIGSGVYPDLSSFNGSGPVRFTSKCEESHSFTKKLCVIDYTDLVIDYQ

SEQ ID NO: 158789 - protein, 128 aa, Glycine max
  Coding DNA Sequence Number=SeqID_67104
  Homolog annotation: Hit_ID=A5B7U2; Match level="QueryCoverage=22%, HitCoverage=10%, E-value=2e-07, Identity=90%"; Hit description =Putative uncharacterized protein
ECIGIIMVEENVGECLCNGLKQIEGEKQKKVKLDYMKLSKLGLGQQGHEGEKKCLNSELWHACADFTLEDIYDSQSLKNEGVTMKMDSNTNNLEMIMLLEQKDEVSISIDMETEEEVINQNMVNGPVG

SEQ ID NO: 158790 - protein, 187 aa, Glycine max
  Coding DNA Sequence Number=SeqID_67105
MRSFNSDFPPWRCSGRQRRRGERRRHPLGNKPWKKELHHQDEPWIRSLERMLQSHGLKIYPKAHKNPRAFPWISGPIYLESSIQCPCGVGLHQSVIRLVVERHDNHENRARGEEPPVDDPPLSSGKGHGEGVRYHHRRTVVEEGGGHGEDIEATMESDNGNSGIGSVASGSERRLTKSDVSDSSGTG

SEQ ID NO: 158791 - protein, 266 aa, Glycine max
  Coding DNA Sequence Number=SeqID_67106
  Gene Ontology: Mol. function=protein serine/threonine kinase activity; Biological process=protein amino acid phosphorylation
  Homolog annotation: Hit_ID=A7NWM6; Match level="QueryCoverage=57%, HitCoverage=21%, E-value=3e-28, Identity=49%"; Hit description =Chromosome chr5 scaffold_2, whole genome shotgun sequence
MECSEFKSMGGAMVDVRNKFFITALAGNLLLGQQIEHYEHNRTIEAKLLHIYDPLVGKKPEALYKVDNTEVRQFVEKCLEIVSLKLSARELLDHPFLQIYDYGFDSKVVQYQRHFYEVNPLIRQPLNGIYNINNKLISGDTDNVGGYGPVSELDYHRDDFEASEIGLFGCEEDDNLAEVDTTIKGRREDDGIFLTLRIADKEDFNILIRRGTRKEVKDNISTNVRGPFKGTRHLSYHISLWRDTARDSVKCRQNNSPTHQILDKAS

SEQ ID NO: 158792 - protein, 126 aa, Glycine max
  Coding DNA Sequence Number=SeqID_67107
MYPLLFSVKPKEREKSKEFSNCVVLNSLTREKGDTKEFRRLVLCSFGKGRRETQKEFRRLVLGEFFLAKGEENEKMNSTSFQGLENQKTSESFWYEEEEVQRDSRLVKDCKRLIGKVFKIVVGKID

SEQ ID NO: 158793 - protein, 74 aa, Glycine max
  Coding DNA Sequence Number=SeqID_67108
MWFLRFEVIDLIASTVKLDLSSGDEIMVGKHGYEAEIGAIGALKDNQLQKMHNCTKEFSWIGLPWTCKKLVLMV

SEQ ID NO: 158794 - protein, 83 aa, Glycine max
  Coding DNA Sequence Number=SeqID_67109
MSMGCISHFGCVHPEDIGILNLHATNESIYGSLSSIDWRDDLTLVQPVAFAGSLVHWFRHSRLWDGLRPLVREIQPMQCNMHE

SEQ ID NO: 158795 - protein, 305 aa, Glycine max
  Coding DNA Sequence Number=SeqID_67110
  Gene Ontology: Cellular component=membrane
  Homolog annotation: Hit_ID=A3BIF2; Match level="QueryCoverage=15%, HitCoverage=12%, E-value=3e-12, Identity=71%"; Hit description =Putative uncharacterized protein
  Subcellular localization annotation: CTP_CleavageSite=43; ConfidenceScore=5.23e-01
MNMKNMKVPNVLGGAGISVLLKLGIVGGIAEALSKRFRNVSVKNFAKVSTVLRRSSFVLYRSSIFNGLPSLGTDVWGANTFPVRKYNSRTFHLKVRRSRLFRFFRRFPQINVGGDSARIPFVEHASRESRVALPPKGRLRQVYPEGTHFIISWFKRLVIYDVCARPHLVESTSGSRDMLLGFACSHREMVLCCLKEAIIYQVNLYHSGLLLTMTPKLTVKSKNLKLHHNKSNLHLRKNLKMNVTKHQLYKFPSTILELSEFRFLEKIQSLITYMIKQVNNTRELLTQFGATSPTSGGYQAREEIH

SEQ ID NO: 158796 - protein, 111 aa, Glycine max
  Coding DNA Sequence Number=SeqID_67111
MWVRFKVWFRDMHNVKSLTERMAEEQRKVHNVVRFRVRFRDMHNVKSLTERMAEEQMKVSETMAEGIHSKMVIYNRLRMYDVKAKFSPLISKLPPHLILHRLSSTVVDIAT

SEQ ID NO: 158797 - protein, 81 aa, Glycine max
  Coding DNA Sequence Number=SeqID_67112
MMRIMKLAKYRLKVQVEKDEGPSGEGQSPRVEKDLSFFTRSGVYPDLSSFIGSGVCPDLSSFTGSGVIQTFVACIKRSAPT

SEQ ID NO: 158798 - protein, 146 aa, Glycine max
  Coding DNA Sequence Number=SeqID_67113
MKIVSGTESFGSDESGVDGEEEGVVEICFPDRGGKHNEKGEAEVGGKDAATGGLRRWEATMGRGGNVVSAGGGGFAKEEDGKSWLVTFGSRGSMVPASGGDFGEEEDGESCLGTMFGIHGSLGCDEFGHDGLEAIQAGGGRFDIRH

SEQ ID NO: 158799 - protein, 178 aa, Glycine max
  Coding DNA Sequence Number=SeqID_67114
MAMFDPKPNREGKKKIQMMILATKNFSINISSVESPALKIQGEPSRRVPTNHFSQEILGNEGRSLEDSRRKPKLIPKHNFKYLRSRVSIKRGNHRQHYIQNHPIAPHINLLIVLPLQQNLQRHVVRRPHHAAHAPPVFETLRQTKVDEIKIVRRIKDNIVGLNITVGDIEAVALFDGF

SEQ ID NO: 158800 - protein, 93 aa, Glycine max
  Coding DNA Sequence Number=SeqID_67115
MKLPENAQQLPLADMEKSSEQAAATEPQSRRRRSNSAWEEEEATSSFVNPNFFGEEEEATLREREFIDADLSATLDNLRGTELPPIHLTNAVT

SEQ ID NO: 158801 - protein, 31 aa, Glycine max
  Coding DNA Sequence Number=SeqID_67116
MVLLVKGVTVVEAIVVVVDMRVVEMMVVVEE

SEQ ID NO: 158802 - protein, 127 aa, Glycine max
  Coding DNA Sequence Number=SeqID_67117
PGVEQTHFEISHPQSMYSTPSPVHQTFGHTGESVTASTHEWMTDLFGVDFNTPNLAASYVSTLQQFDAPHSFGEHGHSSSVATTNIANTNIEQQHHHDMGEPVILERRNSRRNRRPPPCGTGHHLGH

SEQ ID NO: 158803 - protein, 52 aa, Glycine max
  Coding DNA Sequence Number=SeqID_67118
MIVSEGRVGVIGATFGEVACLELKAQVEKDEGPSGEGQSPQVEKGEGPSGEG

SEQ ID NO: 158804 - protein, 79 aa, Glycine max
  Coding DNA Sequence Number=SeqID_67119
MASLAKQMDKLQSNVQRRMGDKFDEIQRSTQELSGRMKDIERRRHHRRHMHRRNMDGMDDMKVKIPKFLGTYDPKAYLD

SEQ ID NO: 158805 - protein, 57 aa, Glycine max
  Coding DNA Sequence Number=SeqID_67120
MTDRGLSKEHKDLETLHELKGAMTRSRAKLLQEEMAKKIKDGLLIKDKEGENHKKLN

SEQ ID NO: 158806 - protein, 187 aa, Glycine max
  Coding DNA Sequence Number=SeqID_67121
WATGDGVLMPGLVEVGYLFCAIARSPPSTTYDGRAPGNQPIKEQKSTKQGGLCGGWPAIYLGLLSEKFPLIAMAAQLIHDRVVMECLEGQPAHTLQQPVEWILPTPTPYRLVEPVQVIEVSSSEEDLEEDPEELPPVPAMDAPDLPEDDEDPLPDVDSPEDIILASEADSTEESGPGGTTNSDDSSS

SEQ ID NO: 158807 - protein, 593 aa, Glycine max
  Coding DNA Sequence Number=SeqID_67122
  Gene Ontology: Mol. function=unfolded protein binding; Cellular component=mitochondrion; Biological process=cellular protein metabolic process
  Homolog annotation: Hit_ID=Q1RSH4; Match level="QueryCoverage=98%, HitCoverage=97%, E-value=0.0, Identity=87%"; Hit description=GroEL -like chaperone, ATPase
  Pfam annotation: Domain name=Cpn60_TCP1; Domain location=54-575; Score=595.1; E_value=6.9e-176; Accession=PF00118.15; Description=TCP- 1cpn60 chaperonin family
MYRLASNLASKARIARSSSQQIGSRLSLSRNYAAKDIKFGVEARALMLKGVEELADAVKVTMGPKGRNVVIEQSFGAPKVTKDGVTVAKSIEFKDKVKNVGASLVKQVANATNDVAGDGTTCATVLTRAIFTEGCKSIAAGMNAMDLRRGISMAVDAVVTNLKSRARMISTSEEIAQVGMISANGEREIGELIAKAMEKVGKEGVITISDGKTLYNELEVVEGMKLDRGYISPYFITNDKNQKCELEDPLILIHEKKISSINAIVKVLELALKRQRPLLIIAEDVESDALATLILNKLRAGIKVCAIKAPGFGENRKAGLQDLAVLTGGALITEELGLKLEKVDLDMLGTCKKITVSKDDTVILDGAGDKKALEERCEQIRSAIENSTSDYDKEKLQERLAKLSGGVAVLKIGGASEAEVGEKKDRVTDALNATKAAVEEGIVPGGGVALLYASRELDKLQTANFGQKIGVQIIQNALKTPVLTIASNAGVEGAVVVGKLLEQENHDLGYDAAKEEILILLTFFANFFPASQGEYVDMVKAGIIDPLKVIRTALVDAASVSSLMTTTEAVVSELPNDNKDTPAMAGGMGGMGY

SEQ ID NO: 158808 - protein, 48 aa, Glycine max
  Coding DNA Sequence Number=SeqID_67123
MQFKFFSKFPSSISRGVIRPVIEQVGAWQELSSMDEGKELLELEKGLA

SEQ ID NO: 158809 - protein, 133 aa, Glycine max
  Coding DNA Sequence Number=SeqID_67124
MASNPSRVQKKENPKQPSIAWTLGSLMKEIRGFNFPNLLKVQGLTKQVQMKGTFYLELVKVFYTFTRAGLEGNLFSTVNGVDMEIDVIVWKEVASLVMGEVRKFDETVDGYNKMQTYIRFLLDPTRRLRNHLG

SEQ ID NO: 158810 - protein, 166 aa, Glycine max
  Coding DNA Sequence Number=SeqID_67125
  Homolog annotation: Hit_ID=A5C5L5; Match level="QueryCoverage=99%, HitCoverage=72%, E-value=2e-18, Identity=35%"; Hit description =Putative uncharacterized protein
MEIFIQSIDLGAWNAIVKEPFIPTKEVNHELVPKEWDEMKDDEKIKVQDYQKAKSILTFAFRMKNGETHSELQIRFNHIVNHLLGLGKTFEDDELNIKILNCLIRTWEPKITMIKESKDLASVSMKALFRKLLAYEHELIEESHAKDREKKRKGIALKASSSKEDH

SEQ ID NO: 158811 - protein, 174 aa, Glycine max
  Coding DNA Sequence Number=SeqID_67126
MIVVVVVIMVGLVTGCVGVEGDHEDGKIKGDFMLWWNGENVGLKDLALDSHTIEVLNFGLRNFALKVYVEKLNHGLANVANVVEDEGSIESDSDGDNGSVLFKDSEDERGVAIDDGFDNDEPLVYLILRKKGVDKHLEERDNEMSEGYEIEELLDGGSKSNEEDVGMFVRFRKE

SEQ ID NO: 158812 - protein, 408 aa, Glycine max
  Coding DNA Sequence Number=SeqID_67127
MASFWQIMLGWILSIRIYCPGLGPSCKLFDGFQASIRGIVSWIYVEFISQACLVDDQGSDLRPFVHAHDLSAFSHCGVRLGKLPGGRIWYYLQAFCITLLCFLLVCLDGYNLPCQGKEIGHGNYGSKLVKWSSSPCSLWSLEWTSIGGDLESVESLPIQDISGTALVDKDLGHHEVCNDNRDNHRVVLIDEVDTLEVPIRERKSARNGVDYTSDLLGGFLFLWSSYAAPLGVLQSDLILGGFIRGSLMGTSKLKASSRIVVRLTVRALGTLAQLIHATRWFFAQTICELAEVVYCTLNHSTRVSKLSIDLGRSPPYQVNVVPLRDIHYPIIPLEVEWFPPHGLKSSAMLIVRRGCDSPWVHLGKPSADHAQPLAFSALPHGVTPPLQCGIEVFERGLTSEAKLSANHG

SEQ ID NO: 158813 - protein, 214 aa, Glycine max
  Coding DNA Sequence Number=SeqID_67128
  Gene Ontology: Mol. function=aspartic-type endopeptidase activity; Biological process=RNA-dependent DNA replication
  Homolog annotation: Hit_ID=Q69F85; Match level="QueryCoverage=48%, HitCoverage=5%, E-value=1e-16, Identity=47%"; Hit description=Gag -pol polyprotein
MSRFRNVALQVGKKCDKREGSTKTDLHNLSKSQTISKQEEDLEDTKRSSIGTTKETKEEIKWNTKVDKDTNCSGVSDNLHKNRNPPSKSETRDLPRCWSTLETRGYMDLMTTFGQGKLFRSFTIRYLLVDTDTSYFSLIGKKTLNKLGAIVSMPYFLTLTGEIITVKADQKKAQQCYAESLKVVPYPPTRELAKPYPTVAEGTQVMSMDEGSQI

SEQ ID NO: 158814 - protein, 67 aa, Glycine max
  Coding DNA Sequence Number=SeqID_67129
MPRQTVFAIVIEELPFKQQGRQGIMGDCFMLVHYHKLNMGIFVVGSKMQIDVIFFSGVDEDMGVGAN

SEQ ID NO: 158815 - protein, 60 aa, Glycine max
  Coding DNA Sequence Number=SeqID_67130
MYSASAMDSATKACFLQFQDMSELPKSLHLGKSESEKPIKLKEVPLGYHEPTLVMPLRAP

SEQ ID NO: 158816 - protein, 103 aa, Glycine max
  Coding DNA Sequence Number=SeqID_67131
MTKARQKGVRKGKKGGGCRLAHLGELCCFHQKAPPSVGRSWKAQNFTDCALTHPFNSRHVTKLHGLPNDGCQVPRSGQARVAPQQTDDPRTKLGYEISNKSLL

SEQ ID NO: 158817 - protein, 152 aa, Glycine max
  Coding DNA Sequence Number=SeqID_67132
MRKYRIRVIRHEVVLAEDVVGGIPIMVEFGWVDERGLVTQSKYINPNMVGVLKKVVYSVRGTDLVEVESCSAEERICHFPTVGMGSMISISNVQLHEDYKQKAKFQSKNVTKSSLLFLDGKVSSNLVPASGVLKPTFAPLDPLSENQPLKKS

SEQ ID NO: 158818 - protein, 158 aa, Glycine max
  Coding DNA Sequence Number=SeqID_67133
  Pfam annotation: Domain name=Transposase_23; Domain location=37-107; Score=-7.9; E_value=0.0087; Accession=PF03017.5; Description =TNP1ENSPM transposase
MQSQGLALPPEPLVGPSGPRVSTKGSCVDPLGNDPETGDLDRCGLYIEADPACLVALGRVYEGSTVVHNTPLLPGQVKVGVEEVTDAYAPVPVPTDEVSLVGQAIHTFLAWPTHLVKSLSQQAAVSSAKPPQKPDPKVDDPLYLMTLTIPELFLRLYQ

SEQ ID NO: 158819 - protein, 109 aa, Glycine max
  Coding DNA Sequence Number=SeqID_67134
MEEPSKKRKGTSSRSQRHSGSQETPISSSIPSGSLFSSEEQRIRYTNLFFSCSIIDPKFIDMDFFSNESFECFQAFENSNLIPFMSLKLPVYSDLVKAFYSNIESMKAP

SEQ ID NO: 158820 - protein, 191 aa, Glycine max
  Coding DNA Sequence Number=SeqID_67135
  Homolog annotation: Hit_ID=Q1RU80; Match level="QueryCoverage=59%, HitCoverage=88%, E-value=5e-11, Identity=37%"; Hit description =Putative uncharacterized protein
MAKFRRYALEIEGLVETSSFHLPIEEVTITLDDVTSLLHLLIVGAFHSFEQFYVDDAINMLVELLEVNATEARAETIQYHDSYVRLSWLRDVYQMKIESYAWGAAALVHMYDTLNEASKSTARQLAGYITLLQHFLSVGSVVPANDYDERRPRACGWTSGKALPISTYRRRLDKLTHDVMGSLDGHSSTEE

SEQ ID NO: 158821 - protein, 159 aa, Glycine max
  Coding DNA Sequence Number=SeqID_67136
  Homolog annotation: Hit_ID=A5BEV8; Match level="QueryCoverage=74%, HitCoverage=15%, E-value=1e-17, Identity=39%"; Hit description =Putative uncharacterized protein
  Subcellular localization annotation: CTP_CleavageSite=11; ConfidenceScore=5.01e-01
MCPPPSKVNTKGAPKKPMKRSQTSTKRDPSYWRTITVDIGPLAALLGMGEDSWPLVRNELIKELSRWSHEYMNLFSGTERFEQLKLSLLVDGFSKVSMDKWMDITDIGYVIASRYNVILVSLSREQSMTFFPLRSQPPPDSSGHRMICVDHVFGNHFVQ

SEQ ID NO: 158822 - protein, 197 aa, Glycine max
  Coding DNA Sequence Number=SeqID_67137
  Homolog annotation: Hit_ID=Q6WAY6; Match level="QueryCoverage=39%, HitCoverage=16%, E-value=4e-12, Identity=40%"; Hit description =Putative uncharacterized protein
MLSSYITIARKVQWWLSWQICSTPLTGGGSTINWFPRWKEGKEGVLFSCGDYPNVPLIGTRGCINYNPALAIRQLGYPMRGAPTEESISPFLVRDLGAQGLKKFEAPEEDEEVRALKLELGKARLAKEKSNQLLHNSGRSAPSYKRKTRPLQEPLNKKPKGPARRNTAERNSEEHCGVATMSSSSEERREIGHGCMA

SEQ ID NO: 158823 - protein, 98 aa, Glycine max
  Coding DNA Sequence Number=SeqID_67138
MSGFTHDSPQISASPHQLDLAPYASEPYNAQWNAPGLLRDKHTLRLSRILEKWRLRKPSRVYDYHCIIEWTWEQVNIGHRNLGMAFVDNWAVGKEKEW

SEQ ID NO: 158824 - protein, 232 aa, Glycine max
  Coding DNA Sequence Number=SeqID_67139
  Homolog annotation: Hit_ID=A7PJ21; Match level="QueryCoverage=84%, HitCoverage=34%, E-value=1e-12, Identity=28%"; Hit description =Chromosome chr12 scaffold_18, whole genome shotgun sequence
  Pfam annotation: Domain name=Ank; Domain location=141-171; Score =20.3; E_value=0.0071; Accession=PF00023.21; Description=Ankyrin repeat
  Pfam annotation: Domain name=Ank; Domain location=94-126; Score=9.5; E_value=1.4; Accession=PF00023.21; Description=Ankyrin repeat
  Pfam module annotation: Pfam domain module=Ank::Ank; Domain location =141-171::94-126
MEELKNTQFSGQDAVSDPGLLHKELVGEKTILISELYKAIDEKGNMDNFVDVLEQECRQRKLNLSDIFEQVTETGHTLLMWQQLRGEKRLGNVRGHTPLHVVWSSKNTTMVNLILSQYALVKSTHDDVMKDKKITIEKNELGDTPLHEAVHSGDLNVVEVILQRDKDMVHELNKSRCSPLFLAAASEKVEILNLPLQIPFPADQKLPRFFGNSPLHAAILKRNPGTPSLQIT

SEQ ID NO: 158825 - protein, 44 aa, Glycine max
  Coding DNA Sequence Number=SeqID_67140
MTCLPATGMEASKVGLGLLKFERQSVVPQDDAKSFRWQSWAKNQ

SEQ ID NO: 158826 - protein, 116 aa, Glycine max
  Coding DNA Sequence Number=SeqID_67141
MDSMFLTCQQVTNWQTFSLNHFLPRAITKIVIEAASILRGQVEHMQIAARIGASLGDVTLGTGVASAVDALQELGLASLTGELRVGDFEGAGQQRSFPRRLAVCNAQRRCSRVSPG

SEQ ID NO: 158827 - protein, 123 aa, Glycine max
  Coding DNA Sequence Number=SeqID_67142
  Subcellular localization annotation: CTP_CleavageSite=4; ConfidenceScore=5.38e-01
MRVHCNQASQRPSKTTYSPPLLMFPRTRIDWPNSLKIVPSGVANCRNLPFDGRATRGSWVRLPRKEYARSRHQRLFEENIGKTGKIRGLRTLSERFGSCIYARGRCFPCSYVFLNCGKEIRPA

SEQ ID NO: 158828 - protein, 228 aa, Glycine max
  Coding DNA Sequence Number=SeqID_67143
MNNFGWGWELSPYNQYEEERTPSLESVFEEFMAYHASSKADQTSMKNQELQFGKSYSIEDYQGGPELQPWHQNEAERGSNLDNLLMQFKETTESTQQAFKSAEIQVDKLAEEVTQFVARREEDLVEVEAQEESPVKEHESREKDEEKGEEKVQQWEKYSLVENQQESILQEERQGEQEKTLSVIPTLITDTSPAMNWNVLPKYMKFMEFLAKRKNCQEDVFYVTFMPP

SEQ ID NO: 158829 - protein, 70 aa, Glycine max
  Coding DNA Sequence Number=SeqID_67144
MCLSGKESMLITVNEILDVSISFLKDHLEETLGPTKIGENHSKCINLTQCVARKSLAHSILSVVKGRGPL

SEQ ID NO: 158830 - protein, 43 aa, Glycine max
  Coding DNA Sequence Number=SeqID_67145
MGEPSKKRKGSSSQSQRHSEAQDTPIPSSISSSSLFSSEEQRI

SEQ ID NO: 158831 - protein, 254 aa, Glycine max
  Coding DNA Sequence Number=SeqID_67146
  Gene Ontology: Cellular component=membrane
  Homolog annotation: Hit_ID=Q31FR2; Match level="QueryCoverage=95%, HitCoverage=66%, E-value=3e-37, Identity=37%"; Hit description =Putative uncharacterized protein precursor
MNTKTVTPRLRQVSLFTSLALLSTQAFAEATIQRNENQFINIGIASRVSFSSIKDAAPNGKDRSNDFEVEEARLYTNGKLHENVSFEFNFARNTADDKIELLDGHLGLEFNNYLHIWAGRFLPAASRASAAAPMYSTTFDFPIAEQGSYQFAGRDNGAVLFGTDKSEAFKYYFSATNGRQGGSNQADNLSYATRLQYNFWDSEPGFYNLASYDGKKSILSVGGSYRYQKDGTGTILNKGDSKYWNLDARLEKPL

SEQ ID NO: 158832 - protein, 61 aa, Glycine max
  Coding DNA Sequence Number=SeqID_67147
MQPKVLNLDPSSFNGDFTPWRCSGRQRRRREGRHHPLGNKPRKKELHHQELLWIRSLKRML

SEQ ID NO: 158833 - protein, 258 aa, Glycine max
  Coding DNA Sequence Number=SeqID_67148
MSLPWAFKAPEGTFKTKTLIGWSDAVGMKQNLPGGNSAVVPPDPMPNSEVKRRSADGSVGARYCRHRKMQRKRIGGAVVQLVRIPACHAGGRGGVAQLVEHRSPKPGVASSSLSAPAILRTLCESKGALLTLYADVCPILVASCSSELYPAGLLILISLCIIFSQKAMSAFWLLIAVLQPDGIQWADNRRDLGGGHQLWILFFPLAGQESTSTRGFQQLTRQVSGGGSKHRHVITFQYAAFLLVEVGSPFQLDVGHGG

SEQ ID NO: 158834 - protein, 132 aa, Glycine max
  Coding DNA Sequence Number=SeqID_67149
MSTPVSPLPLAGHALLPKLMAASMQKETPCANTFKIDPVTEALQEGERVLSLPVFKVVSMAFSSSCSSNIQIKSVRMTVMYYGCNLSMFQNMFGMGKKTGNYTLDELSPCIKRKNKYQRKLFLYFGNRVFIG

SEQ ID NO: 158835 - protein, 52 aa, Glycine max
  Coding DNA Sequence Number=SeqID_67150
MAKFDPEIVLEFYANAWPTGEGVRDMRSWVRGQWIPFDGGKLGVYSHPLGTL

SEQ ID NO: 158836 - protein, 167 aa, Glycine max
  Coding DNA Sequence Number=SeqID_67151
MPSTICRDHAHKTPSGPGEVQQSLEFPALVMGLCQSYQVPVPPARSRHHDIKIAPARHLVDLKKSNRVLGFPALITGLCQFYGVLVAPSMAGVGQDTTTAWGWPAAGNRRTAATSRAPQLIYKGRSFAYDPWPTSKRPSPKPKVSKSTRSVTDKSSRVQLQMLKKCY

SEQ ID NO: 158837 - protein, 79 aa, Glycine max
  Coding DNA Sequence Number=SeqID_67152
MDELKDLIKQVVPHGIPPYVEWRRKRERRRHFKEKMSLEEAHHHRRPWIRAWRKKEMNEGRGREDHEILCSKRALKSEV

SEQ ID NO: 158838 - protein, 169 aa, Glycine max
  Coding DNA Sequence Number=SeqID_67153
  Gene Ontology: Mol. function=nucleoside-triphosphatase activity
  Homolog annotation: Hit_ID=UPI0000162C59; Match level="QueryCoverage =79%, HitCoverage=14%, E-value=7e-27, Identity=47%"; Hit description =AAA-type ATPase family protein
MSRNFTDYLTMDVKYLETVKRRLHAAKQWSPYRTMMMEKMDILNTWHHKIPPYIARNLSASSFVETLISPLLHILSPPTIRPVAFQLLSDKEKNDLAQLVSTMVSYTITYKTVKSDILPQTQRCDVVDSLARSLVPPISDFINLKDYTSNHYVLSIAIKQLLVHDVRLH

SEQ ID NO: 158839 - protein, 99 aa, Glycine max
  Coding DNA Sequence Number=SeqID_67154
MVGNAPSSFADLVFDGKRIEAGLKRGKFDHPTLISEKAGANEEDENEGETHVATIIPTRPNFPPAQQCHYSTNISSSHYPPPSYPQRLYLNQPQNPPTT

SEQ ID NO: 158840 - protein, 250 aa, Glycine max
  Coding DNA Sequence Number=SeqID_67155
  Gene Ontology: Mol. function=metal ion binding; Cellular component =nucleus; Biological process=embryonic development ending in seed dormancy
  Homolog annotation: Hit_ID=A7NUQ6; Match level="QueryCoverage=94%, HitCoverage=93%, E-value=1e-42, Identity=43%"; Hit description =Chromosome chr18 scaffold_1, whole genome shotgun sequence
  Pfam annotation: Domain name=ZF-HD_dimer; Domain location=57-116; Score=95.4; E_value=1.8e-25; Accession=PF04770.3; Description=ZF-HD protein dimerisation region
MEFKHHEKTELSMPAATASHNDFGIPPSSQGEEEPVAAAIPVAIPVTPTPPTLAQNNDNEKYHECLKNHTVKTGVHTLDGCIKFLPLGEEGTLDALKCLVCNYHRNFHRKETPNDTYLVPYYHHSPLPLAAYYGEQMGYPRVQGQQCTTLALPSRSRGSGGAQSSREDMEAVSDPTSATPHGGSSKKRFRTRFTLEQKEKMLAFAEKLGWRILKNDESVVQEFCAQTSILPHVLKDVLDTSLKSNLLLQL

SEQ ID NO: 158841 - protein, 426 aa, Glycine max
  Coding DNA Sequence Number=SeqID_67156
  Gene Ontology: Mol. function=protein kinase activity; Cellular component=cytoplasm; Biological process=protein amino acid phosphorylation
  Homolog annotation: Hit_ID=Q6T2Z9; Match level="QueryCoverage=47%, HitCoverage=74%, E-value=1e-92, Identity=74%"; Hit description=CDK -activating kinase
VLDEMKTKSYSFDTDKDTNIYNGNTSYLVTCTTSDIDDDLCKAAELLYGSTYYGLEIDLWSLGCVFAELLTSKPLFPGTSDVDQLSRAVSVLGNINEETWPGCSKLSDYGSISFGNVENPSGLEPCMPNCYPNEVSLVQKRPTTMELLQDKYFREEHLPVPISQLRVPLTRNGQDQDSPGGHNEMGSDYDLEEFSTLNITTTSVKGDKVFAKSDGHSDNHKSDGKNHKSTNMPSDLTSAGDHGLDKKKQEAAIAAGNGSDDFYDGIPWFNDSFPHKSSIKASIFETLGVTSLSGKFSPVPAFQKGSESGYLDKKNLDTCGPESESESHPVSKMKSSKDINPYCEVIRTHERNNFPVSKDNKNSLDQSKQYDDHPIIGYFISSEQVDEGGVGGEEGVDGVLKGATVGEELSCTLLWSCCKAESTARV

SEQ ID NO: 158842 - protein, 96 aa, Glycine max
  Coding DNA Sequence Number=SeqID_67157
MIFYDAKTPKFSSSLSLCSCLYHRGDPHEAGEDVEAQVFIAHEIDLDSSPPKAILFLVRTWHLHPPYQVHSLSEFQTTITPQGMIIWFLLEQNVEG

SEQ ID NO: 158843 - protein, 110 aa, Glycine max
  Coding DNA Sequence Number=SeqID_67158
  Subcellular localization annotation: CTP_CleavageSite=24; ConfidenceScore=5.01e-01
MKNGGKPSRNRPRKCLGSVTEAPRLGYFSRKQFFSLILSDSQIPGGLKKFFCPPPPIYRGKEGGGCRPARLGELSSPRRAGLLPPEGTAFCWNILEGPSGPDCYLHTPVY

SEQ ID NO: 158844 - protein, 41 aa, Glycine max
  Coding DNA Sequence Number=SeqID_67159
MTREIKDQADVLMMPKDHLRLKALFKTKKLKIFKMDDQDSL

SEQ ID NO: 158845 - protein, 42 aa, Glycine max
  Coding DNA Sequence Number=SeqID_67160
MEIPSSTMVAKGRGEGGEGVRSRLVEVRCLNWVMEGVRQRID

SEQ ID NO: 158846 - protein, 108 aa, Glycine max
  Coding DNA Sequence Number=SeqID_67161
MRLVLLAIFGLEYLDNFIQALPISWNFLNEVIHANHSTLMGIDDVIRKQPNNFPMAVSAIDDNNGGRRSNAKEKRTSRKKLSVEDEAETRRRTTPTVLRRNAKKCEEQ

SEQ ID NO: 158847 - protein, 168 aa, Glycine max
  Coding DNA Sequence Number=SeqID_67162
MQPDEQVLVSVVLPALHAQLLPEELQQRKSLFLAHARAAVPAGARAAVPAEVGCILRADCRGCRGWVQLGRGAWEGRAKLLNELPGRVGLASMPKSLSFVNKEDPSISLRSCSSGDDNPLRVVCELASGGSGGGVDAISLHIIPISMAVGFIKKPLSPSTSTTFATQE

SEQ ID NO: 158848 - protein, 171 aa, Glycine max
  Coding DNA Sequence Number=SeqID_67163
VRGCEHATAAGHAAQPRDIGYLGRQRADVGGFFLPFAWRRIPPWNCVVVLVWKRNRSNYRGGLVDKPSRGRHVLQRFGPARPTRLDGINRSPSMIGKRVGFYVGSVLLKGDIIAIWLATRDGKRSSYVIGIAVNLGVGLRGKFLIALEPTPKWALLARRVEVGAGAWGASL

SEQ ID NO: 158849 - protein, 66 aa, Glycine max
  Coding DNA Sequence Number=SeqID_67164
MVVVVVFGYGESWVGRAIMVVCHDAKVYRYWSYGKGVVMLSCFWWCGALKRQINGAYMWVWVMQQC

SEQ ID NO: 158850 - protein, 138 aa, Glycine max
  Coding DNA Sequence Number=SeqID_67165
PPITRAFIENYCTPRQVQGDAHQDADVLPPPRQADPAGSLSVERYLQHFVRQQAANHRGQVQIHECLYRFSLSLQGQGSAPFVCPTPEQFGAEVEWPGDWPDAQAGEELAGSPGEAGESHMDEDMTDLLGFLGGSRAT

SEQ ID NO: 158851 - protein, 53 aa, Glycine max
  Coding DNA Sequence Number=SeqID_67166
MVVELRQQTVELSTLVTRAANDKSFDMLAALTNQRVLPDLLCCVRAATSKLGF

SEQ ID NO: 158852 - protein, 157 aa, Glycine max
  Coding DNA Sequence Number=SeqID_67167
MHDVPRETSSLLFPWRIPSSGPHYWKIIWRWPYPGRSSSHHTPSGTTRMPHVHTIVEPPDTILTLACRSKEGPNVKTNPLARHGGASVNAIEKDRPSGSKRLEEVATSRRFIYQSLQVACMVSRGGGESDECMFHLGESHDMETCPTVEELLQRLMD

SEQ ID NO: 158853 - protein, 119 aa, Glycine max
  Coding DNA Sequence Number=SeqID_67168
  Gene Ontology: Mol. function=transcription regulator activity; Cellular component=nucleus; Biological process=regulation of transcription
  Homolog annotation: Hit_ID=A7PJW3; Match level="QueryCoverage=77%, HitCoverage=18%, E-value=3e-23, Identity=56%"; Hit description =Chromosome chr12 scaffold_18, whole genome shotgun sequence
  Pfam annotation: Domain name=PPR; Domain location=64-98; Score=23.4; E_value=0.00086; Accession=PF01535.11; Description=PPR repeat
MGLAKCGEVDKSRRLCDNMPTRTKGNFELNVVVLTIIIDMYCKCGAIVKGIQVFRASPTTTGLSCWNFIIISLAMNGYERKAIDYFSKLEASDLKPDHLSFIGVLTACKYIAAIENVTS

SEQ ID NO: 158854 - protein, 183 aa, Glycine max
  Coding DNA Sequence Number=SeqID_67169
LPPEKHGDPGIEWAKATRSAKQGGVLRGQVERLKVTNATVAFAEAVKSNHQLSSKVGSVLDKLLCTRLDGEELLEHYKELQRASKERETNKELEEELLMYKKEAVQQHEKGFHKAVWQVGFFAKDLDLGLFDPFKDVKDGVLLDEKDIVAEEKEAAEWRRKRERRRHFKEKMSLEEAHHHRRP

SEQ ID NO: 158855 - protein, 208 aa, Glycine max
  Coding DNA Sequence Number=SeqID_67170
  Homolog annotation: Hit_ID=Q7UE67; Match level="QueryCoverage=81%, HitCoverage=27%, E-value=6e-07, Identity=32%"; Hit description =Putative uncharacterized protein
  Subcellular localization annotation: CTP_CleavageSite=52; ConfidenceScore=5.53e-01
MSILSKSRFSKGSSNPRSILGESCSSKGLSKPMFILGESHSSKGSSNPRSILGESPSSRGLSNPRSVLGESHFSKGSSNSRSFLGESHFSNGSSNQGSSLVSLATLKARQTQGFSLVSLASPKAHQIHGLSLVSLTAPKAGQTQGPSLVSLSSPKTCQTQGLSLVSLNPSSRACQTQGPPLVSLAKTQDERVPGPKFVKPKEYMSVGT

SEQ ID NO: 158856 - protein, 130 aa, Glycine max
  Coding DNA Sequence Number=SeqID_67171
  Homolog annotation: Hit_ID=Q6WAY6; Match level="QueryCoverage=92%, HitCoverage=21%, E-value=1e-07, Identity=30%"; Hit description =Putative uncharacterized protein
MGSNQTPLLKKRFYQVKIKSLEVASLRELWQLMGQLQRQAFRKTNGKIWDLAKIKVSVEAITSLTQYYDQPLRCFTFGDFKLVLTVEEFEEILRCTLGGRKPYLFLGFYPSMAKVAKVVKISIQELDRLK

SEQ ID NO: 158857 - protein, 232 aa, Glycine max
  Coding DNA Sequence Number=SeqID_67172
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=48%, HitCoverage=12%, E-value=3e-10, Identity=34%"; Hit description =Gag/pol polyprotein, 3'-partial, putative
  Pfam annotation: Domain name=G-patch; Domain location=93-137; Score =26.1; E_value=0.00013; Accession=PF01585.14; Description=G-patch domain
  Subcellular localization annotation: CTP_CleavageSite=54; ConfidenceScore=5.34e-01
MAKVLIDNNSSLNVMPKSTLNKLPFNVSHLKPSSMIGRLVIISREKDILVSCPSSMLYVKVAEESLETTFQSFEVVSNAFVESLPMRSRIFDAAIMVAREMLGHGYEPGMGLGKNNDGVASLVEFKENRGRFGLGYRPMHADERTSTQERRSKDMGQQPRLQVKEAPPRHISKSFVSTGWRCEVQVAMIHDDAPQKRSNWDPDVDFEQIASQVEDGEDEDMRFSPELERMVS

SEQ ID NO: 158858 - protein, 250 aa, Glycine max
  Coding DNA Sequence Number=SeqID_67173
  Gene Ontology: Mol. function=metal ion binding; Cellular component =nucleus; Biological process=embryonic development ending in seed dormancy
  Homolog annotation: Hit_ID=A7NUQ6; Match level="QueryCoverage=99%, HitCoverage=99%, E-value=6e-54, Identity=47%"; Hit description =Chromosome chr18 scaffold_1, whole genome shotgun sequence
  Pfam annotation: Domain name=ZF-HD_dimer; Domain location=57-116; Score=99.3; E_value=1.2e-26; Accession=PF04770.3; Description=ZF-HD protein dimerisation region
MEFKHHEETELRMPAATTSYDDFGIPPSSQGEEEPVAAAIPVAIPMTPTPPTLAQNNDNEKYHECLKNHTIKTGVHTLDGCIKFLPLGEEGTLDALKCLMCNCHRNFHRKETPNYTYLVPYYRHSPLPLAAYYGEQVGYPHVQGQQCTTLALPSRSRGSGGAQSSREDIEAVSDPTSGATPHGGSSKKRFRTRFTQEQKEKMLAFAEKLGWRILKHDESAVQEFCAETSIQPHVLKVWVNNNKNTLGKKL

SEQ ID NO: 158859 - protein, 175 aa, Glycine max
  Coding DNA Sequence Number=SeqID_67174
  Homolog annotation: Hit_ID=A7PYF0; Match level="QueryCoverage=42%, HitCoverage=19%, E-value=3e-25, Identity=71%"; Hit description =Chromosome chr15 scaffold_37, whole genome shotgun sequence
MSFSILTSRVPKIRERSLSPHRSAGTMISAQDDYHRHYHFQPQLPNSIDTSRTKYRNASRMLGDQLALASVEMSKPHFDTSKFAKALAFSEDIGGSSILFLPCSMYNWTLPEGAGQFHGMPLDVKIYATHQLEFLEVADLIFESCRKAESTPNNLWEHLLFYLLVAPSSYWEGLF

SEQ ID NO: 158860 - protein, 721 aa, Glycine max
  Coding DNA Sequence Number=SeqID_67175
  Gene Ontology: Cellular component=endoplasmic reticulum
  Homolog annotation: Hit_ID=A7QTH9; Match level="QueryCoverage=92%, HitCoverage=97%, E-value=0.0, Identity=70%"; Hit description =Chromosome undetermined scaffold_168, whole genome shotgun sequence
  Pfam annotation: Domain name=Ank; Domain location=107-139; Score =24.4; E_value=0.00041; Accession=PF00023.21; Description=Ankyrin repeat
GNCEQGPVSFVASNVVVWVLVGGLDWGKWRVEYPIGKIMAGIDATKYGHSPVHKALVLKDHGELRRILAGLPRLRSTAEIRTEAVSILEEEKADAIAAVIDRRDVPNRDTPLHLAVKFGDEVATELLMVAGADWSLQNEQGWSALQEAICSREEGIAKIIIKHYQPLAWAKWCRRLPRLVGTMRRMRDFYMEITFHFESSVIPFISRIAPSDTYKIWKRGANLRADMTLAGFDGFRIQRSDQSILFLGDGSEDGKVPPGSLCMISHKEKEVLNALDDAGFPANDEEVQQEVVAMSKTNIFRPGIDVTQAVLLPQLTWRRQEKTEMVGPWKAKVYDMHNVVVSIKSRGVPGAMTDDELFSSCNENETESEELNDILTEDERRQLEDALRLDSTDLNNESDEVIIGHRHSCYEHREIPIEEGNYNKSGENKLEKKGWFGGWRKKDSKPEAPKKIAPPRSSLCIEEKVSDLLGDSPSRNQSKPGRHSVEIAVKGDESRRRKDAKASSANSDSRSRHKDGNRENEYKKGLRPILWLSPNFPLKTEELLPLLDIVANKVKAIRRLRELLTTKLPMGTFPVKAALAMTSLGAASIAARLNKMRIAQLSIFSWFCELVAIPVVPTIRVLVTFTKFEELEPVDEFATPPSSPSAAEQESPAVPHFSASSWFQWIKAPYRSSTSAPGSSSRIENIEDPFAIPSDYTWVTAEAKKKKMQEKNKSKKGKSHN

SEQ ID NO: 158861 - protein, 187 aa, Glycine max
  Coding DNA Sequence Number=SeqID_67176
MPGQYALDYINWFYLISHSFLSPTYLGDPVRHPPIVQDDTYVEPDMPQYSLATSAMEETPAHAASHVEQPQHAVEACQAIAKRLERLLNLRIVTKGTKTYDVMEDCLRITRVKNLVGRLRVHDDTCLTMGKSSHWGDQSGSLCFMRMLQPCGINTSLKKHSNQVYLPPRPRLRGVHQGLPLLIQKIF

SEQ ID NO: 158862 - protein, 220 aa, Glycine max
  Coding DNA Sequence Number=SeqID_67177
MSAIEDEQLLTSTMLTRMENTTLKMPGLLKTNEHHDHRTQTLGMEEEDDAHGGNTTWRTSTVGQAFLKPATTSCKQNERKKNVAEVRPGVRKETKTTSRQQEEEKMVRGHEEEEGQSGREGGREMNRSFLKKLSQGYKGGRCRGASSSHFCFFFVVHRRGSFVTVHSRGKHREPFLFFTSVADDGVNRYRKVAVHFTNHLIRKHVPDQVDLEDAYGSSDP

SEQ ID NO: 158863 - protein, 548 aa, Glycine max
  Coding DNA Sequence Number=SeqID_67178
  Gene Ontology: Cellular component=endoplasmic reticulum
  Homolog annotation: Hit_ID=A7QTH9; Match level="QueryCoverage=100%, HitCoverage=96%, E-value=1e-141, Identity=45%"; Hit description =Chromosome undetermined scaffold_168, whole genome shotgun sequence
  Pfam annotation: Domain name=Ank; Domain location=69-101; Score=30.1; E_value=8.3e-06; Accession=PF00023.21; Description=Ankyrin repeat
MAGINVSEYAHSSVHKAIILKDHAGLKEILGVLPKLGNPLEIKTEAASIAEDEKAAAISVVVDRRDVPHGDTPLHMAAKLGDIVATEMLMDAGANGRLKNKEGWTAVRQAIINKQDKIAMVMIKYSWNDPDNKYFRRLPRYIGTMRRMKDFYMEISFHFESSVIPFISRIAPSDTYKIWKKGGNMRADMTLAGFDGLKIKRSNQSVLFLGDGTSDDESKFPGSLFKVLHKEKKVYVVSPSLDAPTDRDVKDTLAKKSRSESVRRVGLDVSQALLVPQLTWRRKERKEMVGPWKAKVYDMQNVVFSVKSRRIPGAPPPEAKPAPKKTKKKDNGKIEDILTDEERKQFEAAMNSSDDNGHSHNRAKKEKKGRSGGHRDHKERKTNSAQPAEHFVNQKGESQFKRGMMPALWLSQNFPLKIDELLPMLDILAEKLKAVRRLRELLTTKLPKESFPVKVAIPVVSTVRVLVTFTKFEEIQHENADEFESAPSSPTSGDQENPEEERSSSSSWFGWIKTPSRSSTTCAESSSKIFDAEDLFAIPSGFKWITIE

SEQ ID NO: 158864 - protein, 177 aa, Glycine max
  Coding DNA Sequence Number=SeqID_67179
  Homolog annotation: Hit_ID=A2Q1D6; Match level="QueryCoverage=93%, HitCoverage=31%, E-value=1e-17, Identity=33%"; Hit description =Ovarian tumour, otubain, related
MNKNVVFGTLDDVLQWARSVAHGNKFVEVIMRSDTNTGSKERTSFVLIGCERSDQYRSRKKDFVRRDTESRKCGCPFKLPGKPVDEKTIIVDMTKAMVKPRNILLMLKEHNVNSCTTMKQIYNARSAYRSSIRGSDTEMQHLMKLLERDQYIYWHRLKDEDVGEHVNNVVWALEWFQ

SEQ ID NO: 158865 - protein, 83 aa, Glycine max
  Coding DNA Sequence Number=SeqID_67180
  Homolog annotation: Hit_ID=A5BBD8; Match level="QueryCoverage=86%, HitCoverage=8%, E-value=3e-08, Identity=44%"; Hit description =Putative uncharacterized protein
MAPLRGLAPEGAEIRAFEKHLEGWKGKNVSIGCKIVIIKSVLSSLPLYFRSFYLAPKIVLDTLVGNQQRFLWGGANAGNRSAG

SEQ ID NO: 158866 - protein, 117 aa, Glycine max
  Coding DNA Sequence Number=SeqID_67181
  Homolog annotation: Hit_ID=A5BP71; Match level="QueryCoverage=64%, HitCoverage=19%, E-value=5e-12, Identity=47%"; Hit description =Putative uncharacterized protein
  Pfam annotation: Domain name=zf-CCHC; Domain location=90-107; Score =18.9; E_value=0.0021; Accession=PF00098.14; Description=Zinc knuckle
MKDKYIVQSLLKNLEKIKNKLVRTSFACMISTPQAYSTQWWPLGNEAAIPPSNDAWTLIHDPTTIRAKGRPKSTRIRNEMDWVEPSEHRQKCSRCGAEGHNRRRCPMQSEHGSCSNH

SEQ ID NO: 158867 - protein, 66 aa, Glycine max
  Coding DNA Sequence Number=SeqID_67182
MQGHRFKEWGFDKGWGNIAGRVKETMKLLYEVVYILDQVRALEEELLHKIELQVLDVKPQILVVSY

SEQ ID NO: 158868 - protein, 214 aa, Glycine max
  Coding DNA Sequence Number=SeqID_67183
  Gene Ontology: Mol. function=metal ion binding; Cellular component =nucleus; Biological process=embryonic development ending in seed dormancy
  Homolog annotation: Hit_ID=A7NUQ6; Match level="QueryCoverage=98%, HitCoverage=82%, E-value=2e-33, Identity=42%"; Hit description =Chromosome chr18 scaffold_1, whole genome shotgun sequence
  Pfam annotation: Domain name=ZF-HD_dimer; Domain location=57-116; Score=102.2; E_value=1.6e-27; Accession=PF04770.3; Description=ZF-HD protein dimerisation region
MEFKQHEETELRMPTPTASHDDFGIPPSSQGEEELVAAVIPVVIPVTPTPPTLAQNNDNEKYHECLKNHTIKTGVHTLDGCIKFLPLGEEGTLDALKCLVCNCHRNFHRKETPNDTYLVPYYYHHSSLPLAAYYGEQVGYPRVQGQQCTTLALPSRSRGSGGAQSSREDMEAVSDPTSGATPHGGSNKKRFRTRFTQEQKEKMLAFVESLAGGF

SEQ ID NO: 158869 - protein, 58 aa, Glycine max
  Coding DNA Sequence Number=SeqID_67184
MDDVATLQHSSQRPQYRSPLRKDHARKTPSGLEEVQQGPRVSSSDYGPLSVQWSARRP

SEQ ID NO: 158870 - protein, 140 aa, Glycine max
  Coding DNA Sequence Number=SeqID_67185
VHKAWRSPLRKDKELRGIRNGAIGGYHGWLRIHTRGLDWLSRLKVIDEENFEAPEEDEEVQALKLELGKARLTKEKFKVIDALHQEATMWMDRFALTLNGSQDLPRLLAKARAIAEVRTAPEEVHGLINYYQHMIDGPHN

SEQ ID NO: 158871 - protein, 86 aa, Glycine max
  Coding DNA Sequence Number=SeqID_67186
  Subcellular localization annotation: CTP_CleavageSite=65; ConfidenceScore=5.56e-01
MSAIVFSIQSLNNIWMMPIRKCSIGVIRRCFFFKPRSVIFPGRSRLAFFSISAGESLFFCRGNVRSASPGDFSLGLHLLTFLADVV

SEQ ID NO: 158872 - protein, 92 aa, Glycine max
  Coding DNA Sequence Number=SeqID_67187
  Subcellular localization annotation: CTP_CleavageSite=83; ConfidenceScore=5.01e-01
MGVQIAPRPIWALQKIPPEGGCFWRKQPCSPGRAGAATTSPYFAINRGGRQEGRAEALPKRFRNVFREESRKAFNRSSTFFIRSSSFFDLQR

SEQ ID NO: 158873 - protein, 29 aa, Glycine max
  Coding DNA Sequence Number=SeqID_67188
  Homolog annotation: Hit_ID=Q8HVY4; Match level="QueryCoverage=93%, HitCoverage=3%, E-value=5e-07, Identity=100%"; Hit description=DNA -directed RNA polymerase subunit beta'
GAIREQLADLDLRILMDSSLIEWKELGIL

SEQ ID NO: 158874 - protein, 129 aa, Glycine max
  Coding DNA Sequence Number=SeqID_67189
AETSSLDWLPKLRAAREEEAEAPEKRTSIWPPPKPWNEKPKLNLVATHEQRLEDDYTKISAEREARERVIDSLHREAMMWMDRFTFTFNGSQELPRMLAKAKAIVDIYGNSRILKLCMGDVEDPTLESG

SEQ ID NO: 158875 - protein, 938 aa, Glycine max
  Coding DNA Sequence Number=SeqID_67190
  Gene Ontology: Mol. function=oxidoreductase activity; Cellular component=cytoplasm; Biological process=thiamin biosynthetic process
  Homolog annotation: Hit_ID=Q9F811; Match level="QueryCoverage=30%, HitCoverage=83%, E-value=1e-112, Identity=68%"; Hit description =Putative amino acid oxidase flavoprotein ThiO
  Pfam annotation: Domain name=Cupin_2; Domain location=44-120; Score =19.5; E_value=0.0035; Accession=PF07883.2; Description=Cupin domain
  Pfam annotation: Domain name=DAO; Domain location=385-677; Score =96.5; E_value=8.6e-26; Accession=PF01266.15; Description=FAD dependent oxidoreductase
  Pfam annotation: Domain name=Pirin; Domain location=3-119; Score =196.7; E_value=5.7e-56; Accession=PF02678.7; Description=Pirin
  Pfam annotation: Domain name=Rick_17kDa_Anti; Domain location=266 -307; Score=11.7; E_value=0.013; Accession=PF05433.6; Description =Rickettsia 17 kDa surface antigen
  Pfam annotation: Domain name=ThiG; Domain location=695-930; Score =489.1; E_value=5.6e-144; Accession=PF05690.5; Description=Thiazole biosynthesis protein ThiG
  Pfam module annotation: Pfam domain module=Cupin_2::DAO::Pirin::Rick _17kDa_Anti::ThiG; Domain location=44-120::385-677::3-119::266 -307::695-930
MIEQRLSEQRGLGDHGWLHSRHTFSFASYWDPQQTGFSDLLVINDDQVAPGRGFGAHPHNNMEIISYVLEGALEHKDSMGTGSVIVPGDVQLMSAGSGVTHSEFNHSKQDNVHFLQIWIVPAERGTEPGYQQVSVAEADKRGQLRLIVSPQGDNGSLRVRQDMRIYAGLFDGAEQQTLELANDRYAYIHVARGSIEVNGVSFKAGDGARVRNETALQFANGNNAEVLVFDLRPVEVNHPQRTNNNQRLTVVLVLAFSVTACGMSHRGRNTAIGAGVGAVGGAVLTGGSTFGTLGGAAIGGLIGHEAIDNGLRDKVMAIDATVDHQRGADNRIKFAGFGQAFGQQRHFKRAGLTASCAKPSGAKASPIAGVDSLHLYLRVSVITERPIVLGSGVSGLCVATLLAERGETVEVIDDEARQPASWFAGGMLAPWCEAESAPAEVITLGQHAAAWWQTRVSSVVHQGTLVLAPPRDNPELNRFARMTTAHQWVDPASLEPALENRFARGLFFPREAHLDPRRALSELRDKLLQRGVRFDARQPSGRIIDCRGIHARAQLSGLRAVRGEMLILQSHEVSFSRPIRLLHPRFPCYLVPRRDGHFMLGATMIESDDASAISARAMMELLSAAYTLHPALAEARVIESGSGLRPAWPANLPEIHYHNAMNIQLNGRTISTEATSLSELLIEQQIDAACVATACNGDFVPKSYPSPAILQQAIAASGSEIITVSLRREGTAGAAFRELLTGMNVRVLPNTAGCHTVKEAVTTAHMARELFNTPWIKLEVIGHADTLQPDPFALVEAARILCADGFQVFPYTTEDLIVGEKLLAAGCELLMPWGAPIGSGQGLRNIDGLRAMRAWFSDIPLIIDAGIGAPSQAAQAMEMGFDAILLNTAVAKAGDPVAMARAFSHAIAAGQGAREAGLMEKRDMAVASTPIFGLANLN

SEQ ID NO: 158876 - protein, 528 aa, Glycine max
  Coding DNA Sequence Number=SeqID_67191
  Gene Ontology: Mol. function=transporter activity; Cellular component= integral to membrane; Biological process=transport
  Homolog annotation: Hit_ID=Q2L1N2; Match level="QueryCoverage=69%, HitCoverage=91%, E-value=1e-137, Identity=66%"; Hit description =Probable transporter
  Pfam annotation: Domain name=MFS_1; Domain location=46-377; Score =155.8; E_value=1.2e-43; Accession=PF07690.7; Description=Major Facilitator Superfamily
  Pfam annotation: Domain name=Sugar_tr; Domain location=41-429; Score=- 95.6; E_value=3e-05; Accession=PF00083.15; Description=Sugar (and other) transporter
  Pfam annotation: Domain name=Voltage_CLC; Domain location=149-439; Score=-183.7; E_value=0.082; Accession=PF00654.11; Description =Voltage gated chloride channel
  Pfam module annotation: Pfam domain module=MFS_1::Sugar_tr::Voltage _CLC; Domain location=46-377::41-429::149-439
  Subcellular localization annotation: CTP_CleavageSite=36; ConfidenceScore=5.01e-01
TVASLFAVFFTCGTDKNMSSVQPQLSQLPDEASLPRHSVPKALFALGTGGFAIGTGEFVIMGLLPDAANGLNVTIPEAGHLISIYALGVVIGAPLLAILGARASRRNFLMTLMGLFALGNLLSAVVPGYPAMLVARFLAGFPHGTFFGVAALVAAGLVERARRAQAVSMVLLGLTIANLIGVPAVTAIGQWFGWRDAFAIVGGLALLTLLLVWLWVPNVAGDKQASPLRELSALTRKQVLLTLAIGAIGSGGMFSVFSYVKPTMMELAHLPENLVPAILALFGLGMIIGNLVGGRLADRGLEKTIRIVLVWSLLVLSAFVFAAHYALAGALNVMLVGTMVALGSVLQIRLMDVAGDAQTLAAALNHSAFNIANALGAWLGGITISAGLGWQSTGWVGAILSVLGLLIHAVATSAVVTAGRHYSRITAGAVSCCRRLADAAAPQCAKSGAVAAAKQRCASGIPAQSCQGRVRYRVFQPGTVPVIGRFAIAGGNPHAPDYGVPVRSLALEFQLAHGEQWRTGMNALPFFP

SEQ ID NO: 158877 - protein, 175 aa, Glycine max
  Coding DNA Sequence Number=SeqID_67192
EAIKSSSTDIVIDPPSLIRRHVKWKMVCTKKIGQMTSEAAKEIADKIGSFVAHGHHDVMIAAIGRLEHLGHVHAAGADMQSQGLTLPLEPEVGPSATRVSTKDCCVDPSGNDLGMGGLEKCGLYVKENPSRQVALGRIYEGLTTIHNISLRNDQVKVGVEEVRDADAPIHVPTQE

SEQ ID NO: 158878 - protein, 126 aa, Glycine max
  Coding DNA Sequence Number=SeqID_67193
MHIRPQTHRHHLDRPVSRPCDLSQQGQGSAPFACPTPEQFACPTPEFGPGDWQCLYQFSLSQQGQGSIPFACPTPEQFGAEVTWPGDWPDAQAGEEPAGSPGEPDESHMDEDMTDLLGFLGGSGAT

SEQ ID NO: 158879 - protein, 44 aa, Glycine max
  Coding DNA Sequence Number=SeqID_67194
MDTCLRVIGDLMNGVQRGHKPLFEDSPSECGGGAAIVRYGLISK

SEQ ID NO: 158880 - protein, 159 aa, Glycine max
  Coding DNA Sequence Number=SeqID_67195
MDLGISQSCGSAPSQEIKQIGHLLVLAGLICLTGSLCGCLPCLGLRPISGPCDLYPELIRSRAWKRSKTLALQAEAKLVERVMSLHVRPVAHGCAFQRRKDVRSRHQRKTSEKLKETGQNENSVRELYLRLRKVNKSGALAPTYPPSKRKSDLRSSLLR

SEQ ID NO: 158881 - protein, 67 aa, Glycine max
  Coding DNA Sequence Number=SeqID_67196
MPVCGRARRGSRVDKSGALAPTYPPSKRKSDLRSSFLRVNQAILFTWKVIILRRWTLQMIHLLGKKN

SEQ ID NO: 158882 - protein, 185 aa, Glycine max
  Coding DNA Sequence Number=SeqID_67197
MAASDHIILHDRVHIPIKKSLLELSSQDALLAQNKLLSKQLEALTETLSKLPTQLHANQTLPSSVLHVAGCTLYGGAHESGCCIPTEDSTHEVNYMGNTLDKILVQGGPPNKPQQQGPSLYERTTKLEETLLAKQLAEKSSSTFGANTEQNPKEECKAVMTQGRKVTMEEEKKKGKMVEDDKQQL

SEQ ID NO: 158883 - protein, 30 aa, Glycine max
  Coding DNA Sequence Number=SeqID_67198
MASSEASSNCFDCGRNPSMKMFSCIGSEKP

SEQ ID NO: 158884 - protein, 66 aa, Glycine max
  Coding DNA Sequence Number=SeqID_67199
MICPLRCHEEMHDAIEEHARIRLHCYQASRRPNMITDRPPLLMAHTDPDIGPNISMCVRGVGVMCA

SEQ ID NO: 158885 - protein, 49 aa, Glycine max
  Coding DNA Sequence Number=SeqID_67200
MGVLIGYDLLMQSYPARALDRKLQVDWAKDAREGPRVLMSLRVDFEPMD

SEQ ID NO: 158886 - protein, 339 aa, Glycine max
  Coding DNA Sequence Number=SeqID_67201
  Gene Ontology: Mol. function=RNA-directed DNA polymerase activity; Biological process=RNA-dependent DNA replication
  Homolog annotation: Hit_ID=A5AXB3; Match level="QueryCoverage=58%, HitCoverage=67%, E-value=7e-15, Identity=28%"; Hit description =Putative uncharacterized protein
SARAQGRHSGWWRDLRKLYHYDGQSIFQHCMRWKAMGPLSVSPVDHFLQFCDGFGAERNHSTYCGWWVALTSTIWKHRNFLIFQNKPFEPQKGSTNGALYFLYPVPLEPTNILQYADDTAFEGEALWENVLVLKALLRGFELASGLKINYAKSQFGIIGGMEFQLRRDKRGFSNWWKDLRKIYHQSQHNIFHQNMVWKIGCGDRIDFWHDRWVGECTLKQQYNQLFMISSQQHNLISMMGNFSQDNWRWDLQWRRNLFDHEHDLAVSFMEDIPSICIQRNVKDIMMWKAEPNGVYSTKSAYSLMLKLNDSGSQDKLPTKGNMLRRHVDIQDAGCPLCGQ

SEQ ID NO: 158887 - protein, 201 aa, Glycine max
  Coding DNA Sequence Number=SeqID_67202
MHEMGLLCLTGGSCRLLPCLGLGPVFGPCNVSLKLLWIRACKRSETLPLLTEAEPVETLMYLHLPLVVGRLLGLMRWWRSVCGLMRITLRLARCAVLLDEGPGDRRSDHLTTGDGNPEQLAEARDQCQKPRAQLDLSGSRGCLVGRTLLSSSAMHVWVKVVMLVRMIRTRLPAAVRAKSCPGVYNNWAMASSSNPSALVLL

SEQ ID NO: 158888 - protein, 125 aa, Glycine max
  Coding DNA Sequence Number=SeqID_67203
MSNHKSTESALKNLEIQVGQLVKQLAEKSSNCFGENTEKNPKEECKVVATRSRKLVAAQDEDVVALKEQVALKDTTVKKKNEMKKRVGVKKKEKRGNKKLQIRVRKCHIPWYLPRKIRTAIWRDS

SEQ ID NO: 158889 - protein, 310 aa, Glycine max
  Coding DNA Sequence Number=SeqID_67204
MASRKRKSIASRPQAHLNTFLETPVVLEKEGHPWKLLRKDLTTLAQTWNVLSYNNLTPTSHTSDLNIDRARLVYGLVTGMDMNIGALILGQISTIAQSNSSRLGFPALITTLCRAGGVTSDSLTYESLSPAINLAYIKKNCWNMDDLTVNFRGARKVRARPADIPSSSAPPAPSTSATPTPAPPISATPTPAAQDSQCFEAMLHKVVAPLGSILSVEQFIEKRQEAATLERTPQTLEDPLSPGMDSSFAQQVEDPPTAVHERQADPPTPIMEMPEDPTTPVLRLPPTPPATPVLHLTDEEDMQDQDTQGT

SEQ ID NO: 158890 - protein, 168 aa, Glycine max
  Coding DNA Sequence Number=SeqID_67205
  Subcellular localization annotation: CTP_CleavageSite=51; ConfidenceScore=5.03e-01
MSGPGASGVLKATSADPWSASFMVETRTLFVFHKSKNFTSDYEIRMPPTVPVNHYSDPEGQHNRIRILTGARPGQLRTGAHRRQKDEPTGAHRSGPIDPTQVHYELFNCNNLNYTAIGAGITAAAAPDLPPMDLVKGFRLYSSQLPDSMSPAPSPESNPNSPSPVTTM

SEQ ID NO: 158891 - protein, 332 aa, Glycine max
  Coding DNA Sequence Number=SeqID_67206
  Homolog annotation: Hit_ID=Q6WAY6; Match level="QueryCoverage=68%, HitCoverage=40%, E-value=1e-14, Identity=27%"; Hit description =Putative uncharacterized protein
MGWSEYRGSTWRRRRRLWRIKQRKPGRCTPALYVWLVLHFFGHESRPVCPLQGHRTCTKKVKANWEQLLASMVRTSVNWFPRWKKGRAGVLSSCEGFSNIPLMGTRGSINYNVVLAIRQLGYPMRGAPSEESTTPFIARGFSDPNAMIFQSVQKAWSVVQRKDNELRGSSNGIISGYHKWLKARTQELDWLSKLKAGSSESRKRLKPWRRVMRTERRQCGHSRSVGTGNKEVPKGRMGLKQVLRGIVGSKRSLSEQLSKMEENMWAIIDQYKEKLSLATTHEQRLEDEYAKVSVLFAFTLNGSQELPRLLTKAKAMADVYSAPEEVHGLLDY

SEQ ID NO: 158892 - protein, 45 aa, Glycine max
  Coding DNA Sequence Number=SeqID_67207
MKGKHRLKGINSRKHQEESSQGYCASNQWGKTHQTIMMMTQILTK

SEQ ID NO: 158893 - protein, 199 aa, Glycine max
  Coding DNA Sequence Number=SeqID_67208
MEVIYLCLMKKGSRKLGKAWKKSGNGVSFRLDQLMKKRKNERECGYRKAQDYGKGCWHDFDSITITNNDVIVARVAKGNSYGGCGQKDCVLEMMTDLGMENLVLGGVVVLVMENLVYGKWLGEMLVPTIEEFEEILGCPLGGRNPYLVSGFYPSMEAKALAYQGEWASFIDVLALLVFGVILFPNVDGLVDLAAIDAFL

SEQ ID NO: 158894 - protein, 139 aa, Glycine max
  Coding DNA Sequence Number=SeqID_67209
MVTFGTFSAPGSIRKLRDELTNSPRRVFVAGKCTGSHKTLESDQFPLLNDPNKACIYVIKDLTITHKLISSSQNGFRFELLSLQIFTQQNLSELSGTWSFLSLELPKHAKASSQGQTLMHAEASQGKMLKLQQKIGFQA

SEQ ID NO: 158895 - protein, 50 aa, Glycine max
  Coding DNA Sequence Number=SeqID_67210
MAYKNIQISTSTVDPTGYDTSSTLEVWDSSVGSKREILPTGSEKVVSVFP

SEQ ID NO: 158896 - protein, 51 aa, Glycine max
  Coding DNA Sequence Number=SeqID_67211
MWVSTERFPADFRWEEKEKTDFKKEEKEKREGKVFERAVNIGFEKTNVNIN

SEQ ID NO: 158897 - protein, 362 aa, Glycine max
  Coding DNA Sequence Number=SeqID_67212
MAYRKRKAPSTPTQAKFGRSRFTFQDTWERYTDIVVPRKLLPKRNVVRVRGHLIKFDEDTLNTFLKTPVVVEEGETPCAYSRFALLTGFELNADGQPLKILRKNKTTLAQTWSILSFSNLIPTAHTSDVTLDRAKLIYGIIVKMDMNVGYLISHQISPIAQHDTSRLGFLALIIALCKARGVQSDSRSLESLSPAINLAYIKKNYWNLDDPTITFRGPRKARGKRPEAPSTSALEAPTPPSSIVPPSSSTQILVIPPVPLQMPLPAPLSVEPSGLRLPSIMSMEEFDVQVAWPRDQPSSFGGGGASAAQEPMTEEPPAATEEETTPEETQPSTPVMEPEIQDSSATPALDLNEDQPQEEQDV

SEQ ID NO: 158898 - protein, 117 aa, Glycine max
  Coding DNA Sequence Number=SeqID_67213
YILCGTSRAYIYLGCNTENKRGYIFSGSVQVERTSTWLFKENKGGYIPCGSLLVKDFTRLLEISRTGGCLGTRQAIPLRNIDQSRFLEKSFTTSRFMASSNSLFLKGNSIHRPPIFN

SEQ ID NO: 158899 - protein, 238 aa, Glycine max
  Coding DNA Sequence Number=SeqID_67214
MITNSFESSFKNSFEALCYAEDYQNKNIFSDYAREDYFDDPSLSSKVVWVTQVSYFTPHQNVVVLYPPIDDMRCHMKPLHLTAMVEDQIINKILVDGRVAFIILPRSMLQRFGSIVEDLIPYNIVVSNLCGEPSDFGKEWIHREGAVPLIVHQKIFFWNEDEKVEMVEVDKSSYGIYANFASEGGQAMARATPFEVEDSFYVNNKPSDKKYKFFCWDATRGFLLINKVIEKMVKVEES

SEQ ID NO: 158900 - protein, 172 aa, Glycine max
  Coding DNA Sequence Number=SeqID_67215
MQIIMMGASTGMPRVNTPLSEEEVNQALKEFEKEEELVVRPVGKTLVEFLLKKQKLAAKAFEALEIRMNFQKIQEVNVKGKEKQNINITISQVQSPYSFSQRKSYVPHANALPKKWFQSRNERSISRIKEFKVNNLTLRRGGTTKGSRKGYYEYQNHPRMNRNMSKTQWREH

SEQ ID NO: 158901 - protein, 64 aa, Glycine max
  Coding DNA Sequence Number=SeqID_67216
MGEEEKKPEDNKVEEKKAKDEEKKEEEKKPEESKDDKESKEESAPPKIVQGTTFAMHGHFKHDF

SEQ ID NO: 158902 - protein, 51 aa, Glycine max
  Coding DNA Sequence Number=SeqID_67217
MDAKHLTRTKERSHVIKQRSPDEIRGLCVCFMTNFSYWQFSGSVLLRLPSK

SEQ ID NO: 158903 - protein, 83 aa, Glycine max
  Coding DNA Sequence Number=SeqID_67218
LFMSRVSRERKVQVPESFERFCCVKIYRDQSLKQEPASWYGKLNPLLDLPYRSFNSGNWSDSKVLDSTGLSCRTITRNRGAIT

SEQ ID NO: 158904 - protein, 198 aa, Glycine max
  Coding DNA Sequence Number=SeqID_67219
  Homolog annotation: Hit_ID=Q96467; Match level="QueryCoverage=47%, HitCoverage=28%, E-value=4e-10, Identity=38%"; Hit description =Putative uncharacterized protein
MLINKAQNITTTLSPFSNKVMELKLALLSLIGSHPFAGMDHKDPYIHLYTFMELCSTMGAFDEDAKVVYLIAFPFSLAGKAKSWFQSHPNKSLMAGDHTIMHILVQITLLLQVLLTTNMEVLQIGVHNINKLSQIECQRCKILKHSLCRYPSQNRRTLDAILPRKGPITRAMSKRLQQDWARAAAEGPRVLMNLSLDF

SEQ ID NO: 158905 - protein, 158 aa, Glycine max
  Coding DNA Sequence Number=SeqID_67220
SQRQALLGEGPVDPFDENAINQFLGHPLVLEEGQHCEFSQETGADHAHQDDHPHLVYAIMTQASAGSAIDVPPPPLEEVPSLRSIFDHLWRIELQMHRYMQHDPNPFPWPTPEQFGAMVTWPGDETDFETRPGPVGALGDDGGVQEDEGMADMLDFFT

SEQ ID NO: 158906 - protein, 27 aa, Glycine max
  Coding DNA Sequence Number=SeqID_67221
MVLSEPSFFHDWARAAEEGPRVLMNLR

SEQ ID NO: 158907 - protein, 66 aa, Glycine max
  Coding DNA Sequence Number=SeqID_67222
MEAIEIGPYIPTMVAGNATIEKPREQWDEEERKMVQYNLKAKNIITSTLGIDEYFRVSNYKNAKEM

SEQ ID NO: 158908 - protein, 76 aa, Glycine max
  Coding DNA Sequence Number=SeqID_67223
MAAEWRRKRERRHHFKEKMSLEEAHHHRRPWIIAWRKKEINEGRGREEHEILCSKRALKSKPTNPRSIPRFSTKCA

SEQ ID NO: 158909 - protein, 121 aa, Glycine max
  Coding DNA Sequence Number=SeqID_67224
MECLEGVWETLEGNERCRFRSTIRLTATSLVHPEEPARTLQQPVEWILPTPTPYRLVEPVQVIEVSSSEEDPAVDALDLPEDDEDPLLDVDFSEYIMSASEADSTEESVPGGTTNSEDSSS

SEQ ID NO: 158910 - protein, 61 aa, Glycine max
  Coding DNA Sequence Number=SeqID_67225
MGGFYLLLKLISVKFSRENRLKKNEENKPWKEKLHHQDSALDKKLREEASMEEENERERPH

SEQ ID NO: 158911 - protein, 131 aa, Glycine max
  Coding DNA Sequence Number=SeqID_67226
MTTRRGDKPNRNAHRILRVGFTMTKFTKHGINQQFQLKHETTNERKKKKHKIGTELDRGRGTNLDRRRGAKMVVNHAREPQRCWKAFTTIDYDEEGERVVQNENNTIEVLESLWRQSTKTKREKGSNSDEG

SEQ ID NO: 158912 - protein, 737 aa, Glycine max
  Coding DNA Sequence Number=SeqID_67227
  Gene Ontology: Mol. function=glutamate-ammonia ligase activity; Cellular component=chloroplast; Biological process=nitrogen compound metabolic process
  Homolog annotation: Hit_ID=Q69B32; Match level="QueryCoverage=7%, HitCoverage=13%, E-value=8e-21, Identity=84%"; Hit description =Glutamine synthetase
  Pfam annotation: Domain name=Gln-synt_C; Domain location=39-265; Score=-134.1; E_value=0.025; Accession=PF00120.15; Description =Glutamine synthetase, catalytic domain
MSSRPEIGNKSNTQNNAENKGFAESHDNEFIPASFPVGPWDDFAIMSDNITGLKRFRDEDVKPFSGLNSPKSQNETGGQKPSSSTLIVIFVSTSLQEVGPSVGIEASDHIWASRYFLERITEQAGVVLSLDPKPIEGDWNRAGCHTNYRFLPMFLPDEYCAVYYIGVDVGTDVKNTVYYIGADVGTDVENAGYYIGPTSAPIPAAKGVAVSVLTRRANVHILALRQFCGPWTVHKTPKLRVQLISERGYSMLRVASSTCSRVAGLSSPSTWTTIVQVALFEILMLVVLQEKSVSVCCTCALLFYMCYFVSGHILEMRYVGWLNHIMAQILSASFQLLAIAGGLHSYLNEVDFGGSIQQPLVDREASDGESSSSKRLVDPPMLARDKVFGCYRDMLRERNDLADKVESIVAEKKELIATVAKFAKLEEELLAFKKEVMEQHKKGFYKVIRQAMFFTKGLDLGIFDPFKDVKDERVLNGFESLMDLYEIENSMVGNHLEFDFNLVEGLANKSSGSREDETWQQRGSLRTDLGFNEPWTKDEFILGFGEAHQGGPWVYRAFGGLTRDASVFGFGETHQGENLGFDKPLEMRNSPRADLRFNEPLKMRDSPGMDLGFDESLENRPKTADLGFDEPLENRDSPRADVGFDEPLEKRDSPMWQLDLYDTIDKGVSTHGPRVSLSIMVVGKGLELSRGGSRIRANERQGGRSLDGLHNLHVGLLVPSIRRIGGGTYKTKDPKTQ

SEQ ID NO: 158913 - protein, 158 aa, Glycine max
  Coding DNA Sequence Number=SeqID_67228
MRACHSVWNSLETQADHLGGELPVHDRVTSTLTAYNDFQDYFDDAKKSRIEQIPKIQESSFKNQDSRIIKIKIQESREDSIKIRYILCGTSRGYIYLGCCTENKRGYISCGSVQVEGTSTWLFKENKGGYIPCGSLACKGFYKVERNLKNYWLLGDWM

SEQ ID NO: 158914 - protein, 85 aa, Glycine max
  Coding DNA Sequence Number=SeqID_67229
MFVGMKVLMTNMSTTYHRGCMMNASGHSLPWCPMHAIKKSLPATTYHQKTKTLDEASLLSSESETQHDYRSTSTSYVSHRLGYRA

SEQ ID NO: 158915 - protein, 133 aa, Glycine max
  Coding DNA Sequence Number=SeqID_67230
MNNENEDEVGVNEEEHVDYSDAFNTSQIIVQLMWLALLVFATQDDVLEWARSVAYEIEFFAAIMRSRKKDFVRRDTDNRKCGCPFKLHGKPVVRGQSWMAVSIDVSHGSLGKSWASSRASSACWNSSLAASST

SEQ ID NO: 158916 - protein, 121 aa, Glycine max
  Coding DNA Sequence Number=SeqID_67231
MKRCPFEALGSIAPITSIPYMENGQGAAKMFKGTGGALTLSTNVWHLWHFLTWIQQSFSMGQLKHGCQSGKRIGHLILFLRSVVEGYVIKELCQPLDVGLIGYQLMIPSLPFYSQLVNHQG

SEQ ID NO: 158917 - protein, 61 aa, Glycine max
  Coding DNA Sequence Number=SeqID_67232
MLMIKPSMWNKSECTPHESREPSGHDQETNDKADTKKQFSELLMKAASDCGALTASVANFQ

SEQ ID NO: 158918 - protein, 319 aa, Glycine max
  Coding DNA Sequence Number=SeqID_67233
  Homolog annotation: Hit_ID=Q6WAY6; Match level="QueryCoverage=76%, HitCoverage=47%, E-value=6e-21, Identity=29%"; Hit description =Putative uncharacterized protein
MARVAKVVKISAKELDRVKQNKNGVVGVPRKCLEEKAKALASQCEWAPFIDILALLIFGVVLFPNTDGLVDLAVIDAFLAFYHSKESPVVAILADIYDTFDRRCEKSEANRDQLLASIEGVSINCLPHWKEGRTEIVFSFGGFPNVPLIGTRGCINYNPILAIRQFGYPMRGALSEKGLTPFIARGFSDPNAKVLREVHEAWGMVQRKDKELRGSSNGSIGSYPPEESEEVQALKVELEKAQAVKEKFKSTAVRVRKVYDELKDINAATAKALERETKRARKEEHGRNKFLGALWGSNSELKLQRDKGTVASQRHGFER

SEQ ID NO: 158919 - protein, 79 aa, Glycine max
  Coding DNA Sequence Number=SeqID_67234
MTQMEEAEEEAQQEPTHQWNPFESLVIQKMDAILHLHQEHQVDVHSSLENITTSDATLPLKGIGYKTLSRLGQRCKRRS

SEQ ID NO: 158920 - protein, 157 aa, Glycine max
  Coding DNA Sequence Number=SeqID_67235
  Homolog annotation: Hit_ID=Q8LAQ8; Match level="QueryCoverage=61%, HitCoverage=34%, E-value=3e-09, Identity=32%"; Hit description =Putative uncharacterized protein
MEEAQIWVKKVELPTFMGTDPIGWIARAKKFFEVQEIPSFHKLQHAFMSMEGAATHWFYIWSQNNPDSDWESFSTTLIKRFVDRHEKKHMLCKILNEEVDSHASQQDKNNMEGTRSEFSEAKASSWARKVELASFDRNIEGGTDLKGRSFECDSDPL

SEQ ID NO: 158921 - protein, 130 aa, Glycine max
  Coding DNA Sequence Number=SeqID_67236
  Pfam annotation: Domain name=G-patch; Domain location=67-111; Score =8.0; E_value=0.02; Accession=PF01585.14; Description=G-patch domain
MVVRAFDSSRQDLIIVSGEEDILVSCPSSTPYVEAAEESLETSFQALEVVSNTYVESPPVQPRSSSVALMVARVMLGHRYEPERGLGHNGDDVESLVEFKENHRRLGLGYKPTRADVRRSALERRGRSMG

SEQ ID NO: 158922 - protein, 91 aa, Glycine max
  Coding DNA Sequence Number=SeqID_67237
METYRGMLLDPVRILRNQLGVGGLAAEDKMPNKPTDSIFPRRGPITRAMARRLKEDCDEAPYGACRPWIFFINGVLCFLNINGSGMEKEER

SEQ ID NO: 158923 - protein, 239 aa, Glycine max
  Coding DNA Sequence Number=SeqID_67238
  Gene Ontology: Mol. function=motor activity; Cellular component=cell projection
  Homolog annotation: Hit_ID=UPI00016621D1; Match level="QueryCoverage =87%, HitCoverage=40%, E-value=4e-22, Identity=36%"; Hit description =UPI00016621D1 related cluster
GGPLGTSTLTLRGLRALAIRGLRALTFRGIHILTFRGLHVLTFRGLHVLPFRGLHALTFRGLHVLAIRGLHALTFRGLHVLAFRGLHTLTFRGLHVLATRGMHALTFKGLHVLAFRGLHDLTFRGLLALTLRGLHVLAFKGLYVLTFRGLHALTFKGLHVLAIRGLHTLTFRGLHVLAFRGLHVLTFRGLYVLAFIGLHALTFKGLHVLAIRGLHALTFRGLHVLAFKGLHALTFRGLH

SEQ ID NO: 158924 - protein, 64 aa, Glycine max
  Coding DNA Sequence Number=SeqID_67239
MEMIQKSTSSDNSQGWFHGLPATMIHQKRKTLGEVSLSSSKSKTQHDHKSTSTPYGSYRPGYRA

SEQ ID NO: 158925 - protein, 73 aa, Glycine max
  Coding DNA Sequence Number=SeqID_67240
MENCTKQSVRMGSKLVGEGCMNENVIHGAPKKGREWRIALSNHCRQRIKMNVLMMPKFHMRLKVSKLYSRQRN

SEQ ID NO: 158926 - protein, 247 aa, Glycine max
  Coding DNA Sequence Number=SeqID_67241
  Pfam annotation: Domain name=Retrotrans_gag; Domain location=54-132; Score=27.7; E_value=4.2e-05; Accession=PF03732.8; Description =Retrotransposon gag protein
PIKDHIMAEEPRRLTMEDYSSSNVPQFFTSIAQPEVQAQTTTYPPSLIQLIHNNLFHGEANRWLHSFKGNSLKTWDEVVEKFLKKYFPESKATEGKAAISSFHQFPDESLSEALERFCDRSPSSYWTLLHDVPSVGELMNLDVVSLLKNNPLMKSITWEISPETILMQEDFLDSNMASNTINSGDNGGTTLEINSIEIKVSMSNQKRTEFAIKNLEVQVGQLAKQLADRSSSSFIAIQRKIPRECKA

SEQ ID NO: 158927 - protein, 305 aa, Glycine max
  Coding DNA Sequence Number=SeqID_67242
  Homolog annotation: Hit_ID=Q652R5; Match level="QueryCoverage=29%, HitCoverage=36%, E-value=1e-16, Identity=53%"; Hit description =Putative uncharacterized protein P0603C10.50
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGLGPGPPLRTLLQTTIRTPRATDFMVGFSGRRALGLMASGATCVQRLDGSRDSAIHTKYRISLRSSSMQEPRYPLPRVIVCKCCVVTTPAGHRLRAPGSRT

SEQ ID NO: 158928 - protein, 201 aa, Glycine max
  Coding DNA Sequence Number=SeqID_67243
  Subcellular localization annotation: CTP_CleavageSite=33; ConfidenceScore=5.38e-01
MPSPLEGCTPSPSEGYASSLSKGSTSTPSENLRSSALKFLTETCAPGYRANSFLLSVPGPPPDIGGRPIVRAQPEREAITQLLCIPGHDFTYATTKRRVRVMRTNMTTLTQIWMTLLLSNIPPDDHNADLPPKEGSAHKTPSGPGGYLGYAYKRALEIGYGAVVMVVELLRSFTRTGKGKDREREREMKERGCEFVLRRRQ

SEQ ID NO: 158929 - protein, 124 aa, Glycine max
  Coding DNA Sequence Number=SeqID_67244
MGVKRSIRGYSSALGPSRPIKKLQHEATSSPGALEAKGKRFSTLGIQISLKISEENKKEGENEGRGASVTNSMNILRRSSFVLYCSSIFNQLVFDFEALNSFYAPLGVHSCFRVSIDYLSRNLT

SEQ ID NO: 158930 - protein, 287 aa, Glycine max
  Coding DNA Sequence Number=SeqID_67245
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=A1G060; Match level="QueryCoverage=100%, HitCoverage=100%, E-value=1e-153, Identity=97%"; Hit description=ATP synthase gamma chain
  Pfam annotation: Domain name=ATP-synt; Domain location=2-287; Score =501.0; E_value=1.4e-147; Accession=PF00231.10; Description=ATP synthase
MASGREIKTKIKSVQNTRKVTRALEMVSASKIRKAQDRMKTSRPYAQAMKQVIGHLAQASTDYQHPFLVEREQVKRVGFIVISSDRGLAGGLNNNLFRKMLGEAKAWQDKGAEVDLVTIGQKASTFFRRVKVNMVGSVTHIGDVPKLESLIGVIKVMLDAFTEGKVDRVYLVYNRFVNTMVQKASFDQLLPLPPAEKQVAHHDWDYLYEPDAATVLEHVMTRYIESLVYQALLENVASEHAARMVAMKAASDNANKLIGTLQLVYNKARQAAITQEISEIVGGAAAV

SEQ ID NO: 158931 - protein, 296 aa, Glycine max
  Coding DNA Sequence Number=SeqID_67246
  Homolog annotation: Hit_ID=UPI0000F2465A; Match level="QueryCoverage =99%, HitCoverage=62%, E-value=7e-28, Identity=34%"; Hit description =conserved hypothetical protein
RVDDADCQDRAQVFGGPVFVGGRLGVRQQRQRAGAAAQFDTVFGQRRGQARQDRDGRHGVHQQGFHGAADAVAIGLGIEGDGVGLVRVGGRVDVDVAVAVQVLDQRHARLLRQSGDQALAAARHDDVDVLGHGDELADRGAVGRGHHLHRVLRQAGGGQAHLDDATQRHVGVQGFAAAAQDGGVAGLQAQRRRVDGDVGPGFVNDADHAQRHAHLRHAHAVGAHGGGGDAADRVGQGGDLAQPFGHMGQCFLGQRQAVEQGRLQAIGARRGDVLGVGGQQFGLVGCQRFGHGQQGL

SEQ ID NO: 158932 - protein, 88 aa, Glycine max
  Coding DNA Sequence Number=SeqID_67247
  Homolog annotation: Hit_ID=A7QR85; Match level="QueryCoverage=51%, HitCoverage=30%, E-value=1e-11, Identity=62%"; Hit description =Chromosome chr13 scaffold_149, whole genome shotgun sequence
MKTNKKCVCLILKDRDDPDLGLKINMTIAVGLPSLCKTPDNLSQCSVFKIQLNKVLDSNNNIMEEPEVAANSRPARNHNRPTHLRDYV

SEQ ID NO: 158933 - protein, 51 aa, Glycine max
  Coding DNA Sequence Number=SeqID_67248
HPSSRFFLALNRKSGALSRWLAKPADWLSEKLKMSTSQTSLINLKLKGNDY

SEQ ID NO: 158934 - protein, 136 aa, Glycine max
  Coding DNA Sequence Number=SeqID_67249
MTRDNPGDLQPFDPEIDRTFHRLVRHSVHLDFPKHFVPFEHPKHSVTSEYEHSVVGNFEHPDFEHYNFEHSDFEYSTTNFHTENMAQPPPRERTLRKMVAPDFTYESLCIQYPNEDVPYVLKTGLIHLLPKFHGLA

SEQ ID NO: 158935 - protein, 115 aa, Glycine max
  Coding DNA Sequence Number=SeqID_67250
  Homolog annotation: Hit_ID=A0PAV3; Match level="QueryCoverage=42%, HitCoverage=22%, E-value=2e-07, Identity=61%"; Hit description =Restriction endonuclease
MVKVGTSYVPINVSFSPKVGPGLPGINRDTRIYLFCEVLQWLSVFYQLSLPVQLLTGVVRNGKKPPPGHQRWQAAQLLGRAIGAGLFAITPAGERGMCCKAIKLGNARVFPVTTL

SEQ ID NO: 158936 - protein, 163 aa, Glycine max
  Coding DNA Sequence Number=SeqID_67251
MKNGGKSSRNRPRKRLGSLTEAPRLGFSSRKQFFSLILSESQITGGGKEGGGCHPARPGELGCFHQKAPPSVGTSWVAICTPLFTKYTPCLKEGRLLSLAHQWAKRTSIAKRSFSVLSVTEESGRASISRSRAKCEISVLSAAVVFSQAQCMVGAKLKSTYSC

SEQ ID NO: 158937 - protein, 118 aa, Glycine max
  Coding DNA Sequence Number=SeqID_67252
  Gene Ontology: Mol. function=chitin binding; Cellular component =extracellular region; Biological process=chitin metabolic process
  Homolog annotation: Hit_ID=UPI00006A17C9; Match level="QueryCoverage =57%, HitCoverage=95%, E-value=9e-09, Identity=36%"; Hit description =UPI00006A17C9 related cluster
  Subcellular localization annotation: CTP_CleavageSite=61; ConfidenceScore=5.75e-01
ARACSPLKVRTCSPLKVRTCSPLKAMTCSPLKARACSPLKVRTCSPLRARTCNPLKARACSPMMARTCSPMKGTYWVRTSNLPLGLLEGTYWVRTSNLPLGLLEVYAWCPSLPQCRAL

SEQ ID NO: 158938 - protein, 220 aa, Glycine max
  Coding DNA Sequence Number=SeqID_67253
MVIRTFFQPEASELVDTQRLTSSSAPLLARDGESDDMRGYLMVIRTFCQPEASELVDTQRLTSSSVPLSSRDGESDDMRGYLMVIRTFFQPEASEPIDTQRLTSSSAPLSSRDGESNDMRGYLMVIRTCCQPKASEPIDMSRLTSSSAPLSFRDGESDGMWGYLMVIRTFCQPEASEPVDAQRLTLSSAPLSSRDGESDDTWDYLMVTRTFCQLGGKRAH

SEQ ID NO: 158939 - protein, 57 aa, Glycine max
  Coding DNA Sequence Number=SeqID_67254
MEEAEKEILETFRKVKVNLFPHIPEKCKGPSESRKQPEEREETPLQGEDESRRSSPP

SEQ ID NO: 158940 - protein, 79 aa, Glycine max
  Coding DNA Sequence Number=SeqID_67255
MAQEEGTSTDQIPEPSSAPVPEETQPSTPVTELEHPIQDSSAAPGLEWSDNCFDQACSHQKRMSILIVKECINRIPVRV

SEQ ID NO: 158941 - protein, 273 aa, Glycine max
  Coding DNA Sequence Number=SeqID_67256
  Gene Ontology: Mol. function=dihydrodipicolinate reductase activity; Cellular component=cytoplasm; Biological process=lysine biosynthetic process via diaminopimelate
  Homolog annotation: Hit_ID=A1A780; Match level="QueryCoverage=100%, HitCoverage=100%, E-value=1e-140, Identity=91%"; Hit description =Dihydrodipicolinate reductase
  Pfam annotation: Domain name=DapB_C; Domain location=132-268; Score =281.3; E_value=2e-81; Accession=PF05173.5; Description =Dihydrodipicolinate reductase, C-terminus
  Pfam annotation: Domain name=DapB_N; Domain location=6-129; Score =223.9; E_value=3.7e-64; Accession=PF01113.11; Description =Dihydrodipicolinate reductase, N-terminus
  Pfam module annotation: Pfam domain module=DapB_C::DapB_N; Domain location=132-268::6-129
MHDAQIRVAIAGAGGRMGRQLIQAALQMEGVALGAALERDGSSLLGTDAGELASAGRTGVTVQSSLDAVKEDFDVFIDFTRPEGTLTHLAFCRQHGKGMVIGTTGFDDAGKQAIQDASKEIAIVFAANFSVGVNVMLKLLEKAAKVMGDYTDIEIVEAHHRYKVDAPSGTALAMGEAIAHALDKDLKDCAVYTREGHTGERVPGTIGFATVRAGDIVGEHTAMFADIGERVEITHKASSRMTFANGAVRSALWLKNKEKGLFDMRDVLDLNNL

SEQ ID NO: 158942 - protein, 90 aa, Glycine max
  Coding DNA Sequence Number=SeqID_67257
MTKARQKGVRKENEGGACHPAHPGELGCFLQKAPPSRELPGRTSRIVQQCFLSTSGMSQNFMDCLTMGAKYLEVVKRGSHPNKRMVPQRN

SEQ ID NO: 158943 - protein, 107 aa, Glycine max
  Coding DNA Sequence Number=SeqID_67258
MFRHENQGNGGNVACPITPEYKLGLRPSPTTPQFNENKQQSKDKSITFLSNYMQLRAPKYINGKLEIPRMRILGFLAVALSVCPELGKGRRSIGRDPSLYLRLSLST

SEQ ID NO: 158944 - protein, 63 aa, Glycine max
  Coding DNA Sequence Number=SeqID_67259
MSRNFTDCATMLSFDFRHVMELHELPNDGCQLYKTLLHDLTVGIFEKMSGVCAKLPFPRAFLI

SEQ ID NO: 158945 - protein, 196 aa, Glycine max
  Coding DNA Sequence Number=SeqID_67260
MWTETYLTLELLSLCALRHQLHLNAPQITTVILSQRGLRLWIDEKTREVGYVVVFFIFRDWSNLCRACERRRKRLVVIVRGDRIETVMMMMMNQLILFLGVVLQKWHVVPCGVAYGTDVGACMGKGSDAGEVKRVITLYSEDSEYEKVELLILNLKLFLKREMLSLGERGEFGWRCSDDVERRPGLTQLLGEGVGL

SEQ ID NO: 158946 - protein, 150 aa, Glycine max
  Coding DNA Sequence Number=SeqID_67261
  Homolog annotation: Hit_ID=Q5XM22; Match level="QueryCoverage=75%, HitCoverage=64%, E-value=3e-24, Identity=51%"; Hit description =Resistance-like protein HAAS-2
MLVELLEVSIEEAKAKTFQCHGSYVRLSWLQDVYQMKIDACHWIVAARAYLLHLLGCTLFTNKSATHEHVVFLDALRNLMQSGTYAWGTTALVHMYDNLNEASKSTARQLAGYITLLQLPRIMMRGDRTHANEPLASNCPCRHIASVWTD

SEQ ID NO: 158947 - protein, 137 aa, Glycine max
  Coding DNA Sequence Number=SeqID_67262
  Homolog annotation: Hit_ID=A2Q5Z6; Match level="QueryCoverage=45%, HitCoverage=33%, E-value=3e-08, Identity=36%"; Hit description =Phosphoglycerate/bisphosphoglycerate mutase
MVGVLPKRRTLMRHRKSQGNRDTTFYVSPYAHTRSMLHELKWYFLKKKIIGVREESRVQERDFRNHLGGKEDEGEALNQKNGEGVDDGVVCVGEGGGEGGTVAKVQQAYLVSSGVRVSLGVYGEVGLLFVAGEEEEE

SEQ ID NO: 158948 - protein, 62 aa, Glycine max
  Coding DNA Sequence Number=SeqID_67263
  Subcellular localization annotation: CTP_CleavageSite=52; ConfidenceScore=5.13e-01
MGLFHSYLPWGAVLRVAGGGDRGWKCPATRRVRSRPARRRVDWWPARGALVRALAPGTSKRP

SEQ ID NO: 158949 - protein, 95 aa, Glycine max
  Coding DNA Sequence Number=SeqID_67264
  Gene Ontology: Mol. function=structural constituent of ribosome; Cellular component=ribonucleoprotein complex; Biological process =translation
  Homolog annotation: Hit_ID=Q3HRZ6; Match level="QueryCoverage=63%, HitCoverage=26%, E-value=1e-25, Identity=90%"; Hit description =Ribosomal protein S8
  Pfam annotation: Domain name=Ribosomal_S8e; Domain location=1-74; Score=-43.3; E_value=0.011; Accession=PF01201.13; Description =Ribosomal protein S8e
MAEWATPIVVYEGGDAAAAAEEAKKSNHVQRKLEKRQKDRKLDAHIEEQFGGGRLLACISSRPGQCGRADGYILEGKELEFYMKKLQKKKGKGAA

SEQ ID NO: 158950 - protein, 151 aa, Glycine max
  Coding DNA Sequence Number=SeqID_67265
MVSRVGTTSNNMLSKRKTLDEGSLLSNKSETQHDHRFTSTPYVPMDPASKSYIQERKGNKRKPTKEEVMILHEITRPNSLTTVPVESPTVVTYPSARGRREGSQVRLPWEENARSRHKHLFEENVEKTGKVWSTNFKCERFGSCFYAQGRY

SEQ ID NO: 158951 - protein, 49 aa, Glycine max
  Coding DNA Sequence Number=SeqID_67266
WTEASDYVGPLGLRWIVTSGRQHMVKETMLEVGRLVLQLWLGYGGALGR

SEQ ID NO: 158952 - protein, 137 aa, Glycine max
  Coding DNA Sequence Number=SeqID_67267
MVERPTSNFGANTEKNPKEECNVVLTRSQKRAYREEESKGDQSEEGRVDKEGEKEEKEKKEKEEKGLEITMPFGEALHVEAMPSKIILMMPKNQELSKFQRFKNQDSRFKNQVSRIKNQEQDSRLKIQESREDSIKI

SEQ ID NO: 158953 - protein, 83 aa, Glycine max
  Coding DNA Sequence Number=SeqID_67268
  Homolog annotation: Hit_ID=A7Q3P1; Match level="QueryCoverage=50%, HitCoverage=5%, E-value=9e-09, Identity=69%"; Hit description =Chromosome chr13 scaffold_48, whole genome shotgun sequence
MRAFITKGDEGKVVCDEMLSTKESAQMYAKHLVELAVNLGFDGRLEDYPRRSVVVVAGDRKSDMYMGIDVFGKNTYGCRMRNF

SEQ ID NO: 158954 - protein, 130 aa, Glycine max
  Coding DNA Sequence Number=SeqID_67269
MIITRPAPHATLIEWIKKQKVDLRSQGFGGSSNHADQATPVDSDESTCSKAGVAAHDVQRYVKESDRAAQCTRQDKMSNEELKLQDPRCRIQCPGHPARKYWTHKSVNRVCRIHDVGHDVLTSGPKILDT

SEQ ID NO: 158955 - protein, 140 aa, Glycine max
  Coding DNA Sequence Number=SeqID_67270
MWDTLALMYEGLLQVKCNKLNLLTSINTDTSYDDEFDDESSGEDDQLAFISRKIGTHGRKGVDQTGKDSRNHIEKERAKIKVPPYAMSVRNQDTSSQNTQTLISQITRKDTSNKKNKKVLMSTWEELDDTFFDEETKEEE

SEQ ID NO: 158956 - protein, 140 aa, Glycine max
  Coding DNA Sequence Number=SeqID_67271
MELHHFSTTSSHARRLFPLNEGSHLFASLAKEKENRLRRMVSSGTPTIFSVLQISMYVAKCVYRSLFGRPWNRFHWISWMRECGISGYDDDHALSAATFRLSEYGSDHAPLSFFMGLLHAKLGPAAKRDDVLGLSCALSE

SEQ ID NO: 158957 - protein, 117 aa, Glycine max
  Coding DNA Sequence Number=SeqID_67272
MTSSSRSEETLDLGESAMFSQREHQIDSNSRLRGLESSEEFKERGKQLREKHNPNRKESKALMADKAKEMTSSAHHTKSFRYAVPFGPVYCMHLLLAISLLLAITYPIGWIAMAEKL

SEQ ID NO: 158958 - protein, 48 aa, Glycine max
  Coding DNA Sequence Number=SeqID_67273
MRMHNTTDAILPRRGPVTRAMSKRFQEDWARVAEEGPRVLMNLRGSII

SEQ ID NO: 158959 - protein, 64 aa, Glycine max
  Coding DNA Sequence Number=SeqID_67274
MAPFDKNQLVYAIVCAEANHQEAMLDSYPDWHPKGKTTPNTKVDATSKSHISTAAAFVTKSMSG

SEQ ID NO: 158960 - protein, 208 aa, Glycine max
  Coding DNA Sequence Number=SeqID_67275
  Gene Ontology: Mol. function=cyclin-dependent protein kinase activity; Cellular component=cytoplasm; Biological process=protein amino acid phosphorylation
  Homolog annotation: Hit_ID=A7R6V8; Match level="QueryCoverage=90%, HitCoverage=58%, E-value=1e-50, Identity=53%"; Hit description =Chromosome undetermined scaffold_1440, whole genome shotgun sequence
MWAVGAILAELFTLTPIFPGESEIDQLYKIYGILGMPDSTAFTIGASNSQLLDIVAHEVVPPVKLSNIIPNASLEAIDLITVDAWVPCPPSDPLELKLSSKRAKPNLELKLQDFGPDPDDCFLGLTLGVKPSVSNSDVVQNVSQGVRENVLFCSDFNDHSDQSVFWTLLSPDQNGIHNSAETSLSLSFRCFFEHHAWSVALVLSAAKI

SEQ ID NO: 158961 - protein, 339 aa, Glycine max
  Coding DNA Sequence Number=SeqID_67276
  Homolog annotation: Hit_ID=A5BSR3; Match level="QueryCoverage=25%, HitCoverage=31%, E-value=9e-10, Identity=36%"; Hit description =Putative uncharacterized protein
MQEIKKNNDCPHFLSRGGYDLLEKKLLDEKIKKRQHDALMTENPALIEDPPSPIKRHVKWKMARTNRYGKMTSEAARQIADKIDSLEEQVTQGEFVPQGRQDIFNMAIGRPNHGGRVRVAGNEIEEEKKRSLEAWKNELKDAIITDIFNREKVSAPANFHLNVLGARVSTKESNVEIVVNPSGEEHVGRVTPPMGLYVQSQDCTKLVALGKIQDGPSTIHCIAYADDVIKVSIKKVIDGEAEVPFVTSEIKYVREAVNTFIAWSLPLHSGITPNKVVNATELNNDVPKQDPLCELIKTLVEIYDKPVEFVWDLTEFGIPNRNNIKQQMLEHSHTSVVDH

SEQ ID NO: 158962 - protein, 150 aa, Glycine max
  Coding DNA Sequence Number=SeqID_67277
METKPHNLTTKATTILGKRELCSEKRETKNGRRENGGFGRKERSEILLSNKRKYSENPLIEGVGLVEDVFGAFDGEARGEGDYATWTRRMRDGRVLEPEKLALLEEELVVVPYLDVLALLGDPADPLGVQPELDTIIVGGVVHHVDFCVP

SEQ ID NO: 158963 - protein, 21 aa, Glycine max
  Coding DNA Sequence Number=SeqID_67278
MAVFIGIRGKGDAILLRKGIG

SEQ ID NO: 158964 - protein, 200 aa, Glycine max
  Coding DNA Sequence Number=SeqID_67279
MLKVAKRRVKGKQNDVNFWQKQANKIIQEDTKSKVTYFFGRCPNCKWQYGRGKELTCKTKEIKRLIMENDNNYITGLLGMESTGKTTLVKEVGKELKKSKKFDQVIDTSVSYTPDRKKIQDDIAGPLGLTSLKDCTESERPTRLWRRLTNDYQPMIPYYSQNIEPRPHTRTQNTEEDGKLTRGTHTRKNSPKGLSVINFL

SEQ ID NO: 158965 - protein, 232 aa, Glycine max
  Coding DNA Sequence Number=SeqID_67280
  Pfam annotation: Domain name=Transposase_23; Domain location=54-113; Score=-14.2; E_value=0.042; Accession=PF03017.5; Description =TNP1ENSPM transposase
MSQGGSQFSPLIEPDIHVLGARVSIKGSNAETAVNPSEEENVAHVPTMGLYVQRQHSTHLVALGKICEGGSTIHSIAYANDVVRVSVEKVIDGDVDVPLPTSEIQYVKQALLIFIAWSTPLVKLISDEDSAITQNKVTKAVQRLNDVAIDDPLCELIKSLYDIYEKPVQLLWDVTKFGIPNVDASLFLTYADCMESLSLSRYTMQRIEVVNVKITLKDGLRNPNERSTQELI

SEQ ID NO: 158966 - protein, 186 aa, Glycine max
  Coding DNA Sequence Number=SeqID_67281
  Gene Ontology: Mol. function=metal ion binding
  Homolog annotation: Hit_ID=A5BA51; Match level="QueryCoverage=52%, HitCoverage=15%, E-value=1e-14, Identity=36%"; Hit description =Putative uncharacterized protein
MTNANCLEESLHSVSNGNLRVIQSKTDGKLVELNTQCAHADNGCGSCSSEDNAMNEAILNSKLEAVICSEGYILKHQKIQSKIDRCKKDKKFLDDLNKNLVKNKDIWKTKILRIEERYAFFRHEARQKSSMNPASSYRYKQWTKSINSGLNMDNMQQVNSEQRDIPIEDFNGRQELAGSSETSQEI

SEQ ID NO: 158967 - protein, 79 aa, Glycine max
  Coding DNA Sequence Number=SeqID_67282
MSLFHMIVSPSSGSHFHPRVFHDEWQRNGERKRERRRHFKEKMSLEEAHHHRRPWIRAWRKKEMNEGRGREEHEILCSK

SEQ ID NO: 158968 - protein, 88 aa, Glycine max
  Coding DNA Sequence Number=SeqID_67283
  Subcellular localization annotation: CTP_CleavageSite=69; ConfidenceScore=5.06e-01
MTSPPNKHPLTNQRSRKNVFRICPLDLMMKYVQFQLSLAHQWAKHASTAKCSFSVLSVTEESGRASISRSRAKREISPLSVGVVFSQA

SEQ ID NO: 158969 - protein, 265 aa, Glycine max
  Coding DNA Sequence Number=SeqID_67284
MDMNLGYIISAQISMITQHDSSRLGFPALIAAFCKARGVISNSLTLESLSPTINVAYVKKNYWNLDDLSITFKGSCKARGERFEAPPSSEFPPSSPPTPIPTVPSASTDRGPLDFIFTPQLLHSMLQSLHRGQPIIMQSLQGLGLPSIMSMDDFDVQVAWPGAQPSPSGGGGTSAAQEPVPAAAEGEDELTPLEPFYFDTYAHMAQEEGTSIYQIPEPSPAPIPDDAIPSAPASELEQPIPQDSPGAQVLDLNEHAQEQPQEKDI

SEQ ID NO: 158970 - protein, 86 aa, Glycine max
  Coding DNA Sequence Number=SeqID_67285
  Homolog annotation: Hit_ID=Q2HW78; Match level="QueryCoverage=100%, HitCoverage=14%, E-value=1e-07, Identity=39%"; Hit description=RNA -directed DNA polymerase
MAGRGRDQNRDVLDRITAVLETLVQECDVESAEYRGLMAFHKNHPSKFSRDYDPEGARLWLAEIEKIFEAMGCLEEHKVPYATFLL

SEQ ID NO: 158971 - protein, 80 aa, Glycine max
  Coding DNA Sequence Number=SeqID_67286
MGDNIKGKGTNQGTSFVVQVEGTSTWVVVIENKRGYISCGSVQVEGTSTWLFKENKGGYIPCGSLLVKVFTRLKEISRIA

SEQ ID NO: 158972 - protein, 28 aa, Glycine max
  Coding DNA Sequence Number=SeqID_67287
MEEIHVEKLRNNYGGEAMELQRKIKEKR

SEQ ID NO: 158973 - protein, 373 aa, Glycine max
  Coding DNA Sequence Number=SeqID_67288
  Homolog annotation: Hit_ID=A5BSR3; Match level="QueryCoverage=50%, HitCoverage=56%, E-value=2e-09, Identity=27%"; Hit description =Putative uncharacterized protein
  Pfam annotation: Domain name=Transposase_23; Domain location=260-330; Score=-11.5; E_value=0.021; Accession=PF03017.5; Description =TNP1ENSPM transposase
MATPPDSAPPPPLPVVASQSQPPGAARPVVHVDPATGKVDGPHKKKLRTYLGIVARDKVDVTYKTWKQVPAAQEDIQVEFDILEASDADNDIVDDTVCEKYDISKEKWAHFCQTHRDPSWEAIHKQNTALHVLSREGYEYLEQKLMVEKTKKKMEEAAQSESTEAVIDPPSPIRRHVKWKMARTKKTGQMTFETAKEITEKIDVLTAAIGRPEHPGRVRAVGVDVTIKLALPPEPEVGPSAACVNTKGSCVDPSAVDPDTGDSDKYGLYIKENPPHLVALGRVYEGSTIVQTIPLLHDQVKVGVEEVKDADALVPVPTDEAILVGQALNTFLAWPTHLIKRLSEHGVVSPAKPADRPDPEVDDPLYLMTLTIA

SEQ ID NO: 158974 - protein, 170 aa, Glycine max
  Coding DNA Sequence Number=SeqID_67289
  Homolog annotation: Hit_ID=A5BXY0; Match level="QueryCoverage=78%, HitCoverage=10%, E-value=4e-12, Identity=34%"; Hit description =Putative uncharacterized protein
MTRGNLGDLQPFDPEIDRTFHRLLRHSVHPDHFVHFEHFEYSVAGDSEHSDFEHSTTNFHTENMDQPPPRERTLREMVAPDFTYESLCIQYPDEDVPYVLKIGLIHLLPTFHALAGEDPYKHLKEFHIVCSTMKPADVLEDHIFLKVFPHSREGVAKDWLYYHAPRSITS

SEQ ID NO: 158975 - protein, 189 aa, Glycine max
  Coding DNA Sequence Number=SeqID_67290
  Homolog annotation: Hit_ID=A8NQF8; Match level="QueryCoverage=16%, HitCoverage=42%, E-value=2e-08, Identity=87%"; Hit description =Putative uncharacterized protein
MSGPGSTPGGALPSIPLSFSLATILPPEPKDFDSHKLFVFHKSKNFTSDYEIRMPPTVPVNHYSDPEGQHNRIRILWCYPMLITGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 158976 - protein, 134 aa, Glycine max
  Coding DNA Sequence Number=SeqID_67291
  Subcellular localization annotation: CTP_CleavageSite=21; ConfidenceScore=5.09e-01
MAPRKLSLKRSRRDTAAKGTRAPSTSSVLRPSKDGRSNERRVQLRDDEYTDFQDEIARRCWTSLVTPKANFDPDIVLEFYANAWPTEEGVWDMRSWVRGFCPDRCREAGADHAHQYNHLDSDVDDVAAQQCPTQ

SEQ ID NO: 158977 - protein, 294 aa, Glycine max
  Coding DNA Sequence Number=SeqID_67292
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q6D736; Match level="QueryCoverage=97%, HitCoverage=27%, E-value=1e-113, Identity=66%"; Hit description=Beta- galactosidase
  Pfam annotation: Domain name=Glyco_hydro_2; Domain location=221-291; Score=-20.8; E_value=0.091; Accession=PF00703.12; Description =Glycosyl hydrolases family 2, immunoglobulin-like beta-sandwich domain
  Pfam annotation: Domain name=Glyco_hydro_2_N; Domain location=49-219; Score=292.6; E_value=7.5e-85; Accession=PF02837.9; Description =Glycosyl hydrolases family 2, sugar binding domain
  Pfam module annotation: Pfam domain module=Glyco_hydro_2::Glyco_hydro_ 2_N; Domain location=221-291::49-219
MTLAAVSLSEVLARRDWENPVITNLHRLDAHPPFASWRDEVSARDGHPSPAQQRLNGQWAFSYFTAPEAVPHSWLLQDLPDAATLPVPANWQLHGYDAPIYTNVQYPIPVNPPLVPRENPTGCYSLTFKVDEGWLSQGQTRIIFDGVSSAFYLWCNGQWMGYSQDSRLPAEFDLSHALQPGNNRLAVMVLRWSDGSYLEDQDMWRMSGIFRDVTLLHKPDTRLSDVQIETALSPEYLRGDLRVSVKIHAGTRPLSQCRVRVTLWRNGDCIAQHEQPPGSAIIDERGHYPERTLL

SEQ ID NO: 158978 - protein, 160 aa, Glycine max
  Coding DNA Sequence Number=SeqID_67293
MMITMIVDTLPVFYYEKMVGYTPSSFADLVFTDERIKVEDEKEGETYAVTAIPIRPSFPPTQQCHYSANNNPSPYPPPNYPQRPSLNQPQSLSTTLPIMNTTFSTTQNTNEGRNFAAKKPIESTLILVSYDGWLPYPLDNSMIAITPTKVPQLPFLRKND

SEQ ID NO: 158979 - protein, 83 aa, Glycine max
  Coding DNA Sequence Number=SeqID_67294
MGTNQTGKRFYRVKVKGLYATSIKELGRLMEPLQMQAFRKIYGKILDRIATVVKDSARGLDRIKQSRNGIAGLPRKYLEDKAR

SEQ ID NO: 158980 - protein, 184 aa, Glycine max
  Coding DNA Sequence Number=SeqID_67295
MPLIQGPTLIDAGCLTFQEDRPNVKTNPLANHGGGAVNAVGLGKSRRSKPLKDVTTPRRFIYEVLQKGGVIPHSGHEEDSCLLHHKKVKAILEMPEPRTKRQVRDSYHSSSLFVSHYSNSCGSNAFKGYFDDAKEFKNQEKDSREVSSFKFSRSQESRSRFKTQDSRIKRRLNQDKYQKVFSKL

SEQ ID NO: 158981 - protein, 58 aa, Glycine max
  Coding DNA Sequence Number=SeqID_67296
  Homolog annotation: Hit_ID=A7R463; Match level="QueryCoverage=100%, HitCoverage=33%, E-value=8e-08, Identity=49%"; Hit description =Chromosome undetermined scaffold_621, whole genome shotgun sequence
MEEPHKILAEAKKKHVKLRHVIFHTLIHGYCKLEQFHEALKLSAGARLWCRPSVDEYD

SEQ ID NO: 158982 - protein, 287 aa, Glycine max
  Coding DNA Sequence Number=SeqID_67297
YPLDPDKSNRTLGFPALITGLCRSFGVPVTPSKVIRPPITRAFIEKYCTPRQAQGNAPQAADAPPPPHQADPAGSLGTERYLRHLVRQQAANHQGQVQIHDCLYQLSLSRQGQGFAPFACPTPDQFRAEVAWPRDWPEAQAGEVPAGALNDAEEARMEEEMTYLLGFLSKSLAFVDRPIISVILTLGSGDMRRYPSGGGPDDMWRYPNGSGPDDMRRYPSGSGPDDMRRYPSGGGPDDMRRYPSGGGPDDMQRYPSEAAGPMTCGDTQVVIRTFAISKTQSMIACRD

SEQ ID NO: 158983 - protein, 46 aa, Glycine max
  Coding DNA Sequence Number=SeqID_67298
MKSDKASQGKVKEASTRIKPRLLCKQSMGKNTPIDYDDGWLKFSQR

SEQ ID NO: 158984 - protein, 171 aa, Glycine max
  Coding DNA Sequence Number=SeqID_67299
VVPEDMSRGSGDLGDVRRAPGSQPIKEQKSTKQGGLCGGWPAIYLGLLSEKFPLIAMAAQLIHDRVVMECLEGQPARTLQQPVEWILPTPTPYRLVEPVQLIEVSSSEEDLKEDPEELPPEPAVDASDLPEDDEDPLLDVDSPEDIMSASEADSTEESGPGGTSNSDDSSS

SEQ ID NO: 158985 - protein, 253 aa, Glycine max
  Coding DNA Sequence Number=SeqID_67300
MAPKKLSMKRSRKEAAGEGSSTTLEFDGHRFRSAEHQQRFEAIKGWSFHRERRIQLREDEYTNFQEEIAHRHWTTLVTPMAKFDPEIVLEFYANAWPTEEGVRDMRSWVRGMPPTRHPLDPDKSNRALGFSALITGLCQSFGVQVTPSKVIRPPITRAFIEKYCTPRQAQGDAPQGTGALPPPRQADPAEPLGRERYLQHLVRQQAAKHRGQVQIHECLYRFSRSQQGQSSNHHGHVCSTSKQFAAEVAWPDA

SEQ ID NO: 158986 - protein, 422 aa, Glycine max
  Coding DNA Sequence Number=SeqID_67301
  Gene Ontology: Mol. function=endonuclease activity; Cellular component=cytoplasm; Biological process=response to DNA damage stimulus
  Homolog annotation: Hit_ID=A8GII1; Match level="QueryCoverage=48%, HitCoverage=89%, E-value=7e-79, Identity=71%"; Hit description=DNA mismatch repair protein mutH
  Pfam annotation: Domain name=MutH; Domain location=58-157; Score =188.7; E_value=1.5e-53; Accession=PF02976.6; Description=DNA mismatch repair enzyme MutH
  Pfam annotation: Domain name=TerC; Domain location=241-349; Score =151.0; E_value=3.3e-42; Accession=PF03741.7; Description=Integral membrane protein TerC family
  Pfam module annotation: Pfam domain module=MutH::TerC; Domain location=58-157::241-349
MNCPAALPAAPRNEAELLQRAQQLAGQSFAALAAQLGLPMPADLRRDKGWVGMLLELLLGASAGSKAEQDFAHLGIELKTIPVDALGKPLETTFVCVAPLTGNSGVTWQTSHVRHKLARVLWIPVEGDRAIPLAERRVGSPLLWQPNAQEEQQLREDWEELMDMIVLGQVERITARHGAWLQIRPKAANSKALTEAIGEHGEPIMTLPRAPPAPCIIPVYFSFRNEGFMFDWIADPNAWLALGTLTILEVVLGIDNIIFLSLVVAKLPQHQQNRARRLGLMGAMLMRLGLLASIAWVVRLTQPLFSIMDHAFSARDLILLFGGLFLLWKSSMEIHETIEGGEEEHKTNVHSFFGAIVQIMLLDIIFSLDSVITAVGLSDHLFIMMAAVVIAVLMMMVAARAIGEFVERHPSVKMLALAFLIL

SEQ ID NO: 158987 - protein, 177 aa, Glycine max
  Coding DNA Sequence Number=SeqID_67302
IAPTRHIVDPEKPNRALGFPLWLWASVSPTGCTSPPARSRHRDIGIAPARHSVDPEKSNRVMGFPALIMGLCQFYRVPVAPSKVIRPPTNLAFNKKYCAPCRRRARHHNSLGMAGSGQQTHRRHLQSPSAHLQKLERCLRPVVDQQAIKSKAKGKQSTRSVTDKSSRVQLATLKKRY

SEQ ID NO: 158988 - protein, 49 aa, Glycine max
  Coding DNA Sequence Number=SeqID_67303
MATIALLSRYGWWCLASDVQQAGFVADLGAAFVDDWVFLASRVVGNEKD

SEQ ID NO: 158989 - protein, 146 aa, Glycine max
  Coding DNA Sequence Number=SeqID_67304
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MVFFVEIAFLLISMILKLYRAPPRGRRPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 158990 - protein, 190 aa, Glycine max
  Coding DNA Sequence Number=SeqID_67305
MDEIEKVQEQMKADPEALKEKMATMVEAMMSIKEMVEVSAAYQTRARAKIMGEVEKVQEQMKADMEAMKEQMAHEIPYHNLADFEPCLGYAAEGQAVGGVPLQNTLEGPQYHPQPQPSRSTTSKNPRAMAEMEKLDHLKERLRAIEGGEDYAFANLEELFLVPNIITSPKFKGLDFDKYKGTTCPKNHLK

SEQ ID NO: 158991 - protein, 72 aa, Glycine max
  Coding DNA Sequence Number=SeqID_67306
VIWHRAVFTALGSPAGGQPQGADRFRAEVAWPRDWPEAQAGEAPTEAPGDAEEARMDEEMTNLLGFLGGSGA

SEQ ID NO: 158992 - protein, 56 aa, Glycine max
  Coding DNA Sequence Number=SeqID_67307
ALAEEIKARYDKAAVKVVDLLKMDSARCCCLCQDTYICSTNKVVILVEAILLSPNH

SEQ ID NO: 158993 - protein, 37 aa, Glycine max
  Coding DNA Sequence Number=SeqID_67308
MGDPISRLSFPEKHRDFFKSHKYPELRRSEFLTWRDD

SEQ ID NO: 158994 - protein, 156 aa, Glycine max
  Coding DNA Sequence Number=SeqID_67309
MPQGTLGSKNASKRDAPGEGSSAIIEFDSRRFWSAEHQQRFEAIKGWSFHRERHVQLREDEYPDFQEEIARRRWEPLVTHMAKFDPKIVIEFYANAWPNEEGVRDMRSWVSGHWIPFDADALSQFLGNPLILEKDQQCEFSQRRNQVDDFDEEVIA

SEQ ID NO: 158995 - protein, 72 aa, Glycine max
  Coding DNA Sequence Number=SeqID_67310
  Subcellular localization annotation: CTP_CleavageSite=56; ConfidenceScore=5.40e-01
MRLADRRNLEGNLSRRHTLSTSSARSASRLSPSRLSASLALSGNSLTHAERENGAKCDVEVSKPFLSLTCRE

SEQ ID NO: 158996 - protein, 67 aa, Glycine max
  Coding DNA Sequence Number=SeqID_67311
MCLSGKESMLMKFRGSTGFNKNRRKSLKVYQSHTVRGEKVASAKDFGWQSKGEGHFRSWFPFFLFIW

SEQ ID NO: 158997 - protein, 88 aa, Glycine max
  Coding DNA Sequence Number=SeqID_67312
MGSSQAPLLKKRFYQVKIKSLGVTSLKELGQLMGQLQRQAFCKAYEFKEILGCPLGGRKPYLFSGFYPSLARISKVVKISAQELDRGK

SEQ ID NO: 158998 - protein, 328 aa, Glycine max
  Coding DNA Sequence Number=SeqID_67313
  Gene Ontology: Mol. function=kinase activity; Cellular component =integral to membrane
  Homolog annotation: Hit_ID=A7NSJ2; Match level="QueryCoverage=72%, HitCoverage=44%, E-value=3e-96, Identity=71%"; Hit description =Chromosome chr18 scaffold_1, whole genome shotgun sequence
  Pfam annotation: Domain name=DUF300; Domain location=42-314; Score =203.4; E_value=5.4e-58; Accession=PF03619.7; Description=Domain of unknown function
MDEHSLLQHPNSLQAGSKIVWPFTIAFIQELKNDLSQRDATHFHSSTPCGCWGTWLFLGSSDVCMVQFLSVLNSDAAFNSEIIRECYEAFALYCFERYLIACLGGEEKTIQFMENMSLTESSIPLLKEAYAYGVVEHPFPLNIFLEDWNLGPEFYQSVKIGIVQYMILKMICALLAIILESFGVYGEGKFEWKYGDMKIILASPPICLRFMENWLLTWYPYLALVLNFSQTWALYCLVQFYAVIKDKLKPIKPLAKFLTFKSIVFLTWWQSVAVAFLFYMGAFRGSLAQELKTRIQDYIICIECDIRWLHGPVHCTCHTGNPDIGTLY

SEQ ID NO: 158999 - protein, 83 aa, Glycine max
  Coding DNA Sequence Number=SeqID_67314
MKDADNHTVPPHVIGLVVSGRQKVQKTTRGWAFSPWVKVYGELGFWLNAYRTAGHDICQSVGLASDSGIKGMSHIISMTHMQQ

SEQ ID NO: 159000 - protein, 76 aa, Glycine max
  Coding DNA Sequence Number=SeqID_67315
MRITIRYPRMSSDLLSQDDKRRGWAFSPWVKVYGELGFWLKACRTAGHDICQSVGLASDSGIKGMSHIISMTHMQQ

SEQ ID NO: 159001 - protein, 71 aa, Glycine max
  Coding DNA Sequence Number=SeqID_67316
MCVATYPSAGGRREAHGCVFQEGKMRRVATNVYLRKTSENPKRCGLRTLSVKGCFPRSYVFLNCNEKIRPT

SEQ ID NO: 159002 - protein, 127 aa, Glycine max
  Coding DNA Sequence Number=SeqID_67317
MSSKVILMMPKNQELSKVSRFKKNQDQDSRIKRRFNQDKFQRTNCLRYLLFPLTKIQRTNRLRILCLNTLEGTSFVVQVEDTSTWVVELRIREENKGRYIPCGSLACKGFYKVERNLKNHRLLGDWM

SEQ ID NO: 159003 - protein, 241 aa, Glycine max
  Coding DNA Sequence Number=SeqID_67318
MAPKKNLVVMILGINDGQNAKKVFLEDSFILDDGLDKLPRKVQFLPLCPYMHCSRTARQDKVIIRGIVQGKEVTISPITNVVASRCLEERFVFDKEWEKEITWEIVDIMLYGGPQPVTNDKVVLRRFLRPTNLSHMCRLIHIFYMCKVLVDVSADVSGMTLSGGATQLKCMTFVKMGITDNFPKYAQKYIKKNNKKEPKEESQSIVDQAKKTKKQPLFDPKPSDPKPTQKRKAQDSTKSKP

SEQ ID NO: 159004 - protein, 52 aa, Glycine max
  Coding DNA Sequence Number=SeqID_67319
MMLSSTGAQAQWELLLCVAVLKCMMNGSGMKKEEREEMPLQGEDESRRSSPP

SEQ ID NO: 159005 - protein, 146 aa, Glycine max
  Coding DNA Sequence Number=SeqID_67320
MAESMKKRKGSSSTTVVVGHRRHRPSEAPIALVPPSVIILDPKYLDLEFFDGETFDCYQFFYSNLKIHDGILYSEVQNIPIVINQSLFFSLTKLPSQGVPFEGTIVDDWKFDYSSHDARRMVYDDQANMTGRFLAESLTFDCRIMH

SEQ ID NO: 159006 - protein, 90 aa, Glycine max
  Coding DNA Sequence Number=SeqID_67321
MGLFLNNFRDGSIFDVNFQRKRQQQWRFEHAATRGGKIASTNDDFVPAGLASLTSKLHPVSPDAVATCTGACWSRHEKALLLLVLPLARA

SEQ ID NO: 159007 - protein, 127 aa, Glycine max
  Coding DNA Sequence Number=SeqID_67322
MNDLLYVMYNLKLKSKQTRKIVVLPFKDMKSDDEWIIEEGDDIFYEDNLQVEQEEPLGESGSGSNIDLVGGSLTDPTLDAFDIDNLVLNDNVEDHFSTEEELEDDGDEDDGGGGDILDDFIRGLMDI

SEQ ID NO: 159008 - protein, 81 aa, Glycine max
  Coding DNA Sequence Number=SeqID_67323
MVKLKEGNIGAASEIFQFLLLLDEGMIENGGRIVEDFKVVEDLKGWVHLRLDPSGIMIQYVHDYQRVQLEHQSATRLRSHA

SEQ ID NO: 159009 - protein, 154 aa, Glycine max
  Coding DNA Sequence Number=SeqID_67324
  Gene Ontology: Mol. function=protein dimerization activity
  Homolog annotation: Hit_ID=A5AWE7; Match level="QueryCoverage=55%, HitCoverage=8%, E-value=2e-10, Identity=30%"; Hit description =Putative uncharacterized protein
MVPDEIKLLMMKIVAESKATKEKKRRLNSIDEDEERAEGVEATNLQGQRGFGSKGKKGSASSGSGNVRATLNQLMKKKEKPLVDAQVAEFFYTSVIPFNAIKNPAFLKMCQMIGKYGPGYRPPSYHDVREKLLKQAVQKTDDSLQEFRDEWKRT

SEQ ID NO: 159010 - protein, 61 aa, Glycine max
  Coding DNA Sequence Number=SeqID_67325
MVINLGLAHHGAKLGAAIQHDASSSGENEGFRQVRAFDECSAMMRTSSLARHQSDRVASEG

SEQ ID NO: 159011 - protein, 70 aa, Glycine max
  Coding DNA Sequence Number=SeqID_67326
MSSWLQTLNTRDDQRSLGSLQEAGFASWLITGHKKPTSFRFIARSGYNFLVVIRGHKGPTFLGVHCKKWE

SEQ ID NO: 159012 - protein, 390 aa, Glycine max
  Coding DNA Sequence Number=SeqID_67327
  Gene Ontology: Cellular component=integral to membrane
  Homolog annotation: Hit_ID=A9NQ39; Match level="QueryCoverage=46%, HitCoverage=73%, E-value=3e-54, Identity=59%"; Hit description =Putative uncharacterized protein
  Pfam annotation: Domain name=MtN3_slv; Domain location=128-202; Score= 14.0; E_value=0.00035; Accession=PF03083.7; Description=MtN3saliva family
  Pfam annotation: Domain name=MtN3_slv; Domain location=6-95; Score =70.7; E_value=4.9e-18; Accession=PF03083.7; Description=MtN3saliva family
  Pfam module annotation: Pfam domain module=MtN3_slv::MtN3_slv; Domain location=128-202::6-95
  Subcellular localization annotation: CTP_CleavageSite=35; ConfidenceScore=5.04e-01
MDVAHFIFGIFGNASGLFLFLAPIVTFWRIVSNKSTEKFSGVPYPMTLLNCLLSAWYGLPFVSPNNLLVTIINGTGAGIEIIYVFIFIYFAPKKEKTKIIGLFSFVVAVFSVVVLVSLFALQGNARKLFCGFAAAIFSIVMLVIKTKSVEFMPFFLSLFVFLCGTSWFIYGLLGRDPFVAPLLPRWVPTPQLAFARAIQEERVASSRKGSLIMMGPDDYLGCGVFVPNPSKVDDGGLSWLRMVRVILRLAQVVRFLVIRRGGGTVLGLASVVLMMVGGGMQKTIMDANLLLPHRHPHPSTSSTTPMTFSKQTMTLMTLTRLTGPFLDLVKCHGGSILRFHLKGFRCCTNGSFKGGWVVIGGVIGNCINDVKVHKEKSWRRKEWCGKFKIS

SEQ ID NO: 159013 - protein, 188 aa, Glycine max
  Coding DNA Sequence Number=SeqID_67328
  Gene Ontology: Mol. function=transferase activity
  Homolog annotation: Hit_ID=A5B4U2; Match level="QueryCoverage=22%, HitCoverage=11%, E-value=1e-14, Identity=83%"; Hit description =Putative uncharacterized protein
MVGGAISWRSIKKTLTATSTMEVEFVSCFEAISHGVWLKSFISRLKCSCLDLLGLSLSSGLHHASIYTAKDVTFKRVMSAVPAFVYVTVVWQISSVAAALEDYHGFITPEEMVVQGWSVSPLEGAAFGVLCFLLLSCSFPFWFVVQTAFYFVCKSYHNENIDKSALADRLEGYANNGSPDVQLKQNQV

SEQ ID NO: 159014 - protein, 577 aa, Glycine max
  Coding DNA Sequence Number=SeqID_67329
  Gene Ontology: Mol. function=protein disulfide oxidoreductase activity; Cellular component=chloroplast; Biological process =glycerol ether metabolic process
  Homolog annotation: Hit_ID=Q2HTA0; Match level="QueryCoverage=68%, HitCoverage=72%, E-value=6e-31, Identity=27%"; Hit description=IMP dehydrogenase/GMP reductase, related
  Pfam annotation: Domain name=DUF1723; Domain location=176-218; Score =13.8; E_value=0.012; Accession=PF08330.1; Description=Protein of unknown function (DUF1723)
  Pfam annotation: Domain name=Thioredoxin; Domain location=481-574; Score=33.3; E_value=4.1e-07; Accession=PF00085.11; Description =Thioredoxin
  Pfam module annotation: Pfam domain module=DUF1723::Thioredoxin; Domain location=176-218::481-574
MSDGFCGTHLQIMVRTRGLGRALGQVTRKGVGRGDHDDSDDSPQRRRLAAFTRRQRVAVTADHIDEPVIPDPDVQDDPMEAPTAVEEIPADIPADAGAEEAEDQPQGFPGGPSDPSVLTMYADHVACSVWTGEERPELKLSSHGRKVHSLGRPVPAIEGLIAGTGLSPLIACSVDTDDRGLLSAFVERWHRETSSFHLPVGDFHAFEPLHVDDAVQMLVDLLMVSPESARAETVQCREPYVRLQWVRDIYQRRCQAGHWTAVARAYLLHLLGCTLFANKSATNVHVVYLEVLRDLSMTERYAWGVATLVHMYDQLNDASMSHSRQLDGYITLLQVDCDKEDREENSHAVVQGAPGLTPDFGCLLDPVWGASGERVVRQFGYTQTIPAPPVDSWVLYDDIHDRWMHYEDHIVPAGACSSDYIDWFFRIFHPFMTPGHAAPQTDIPRVPEPGASSTSVEEPRHAVEVCDDIAERLERHLNLGVVTPGSSTHEVIEECLRLARSVTQDHLPVIDELAKEYSGKIACFKLNTDDYPNIATEYGIRSISTVLFFKNGEKKESVVGAVPKSTLSATVEKYVDV

SEQ ID NO: 159015 - protein, 114 aa, Glycine max
  Coding DNA Sequence Number=SeqID_67330
MDPSARQNANGIGDLACKPPMGLAIWPAPCTAMSVPCTAIRRASLHPQALELASLIGGSLRNPHIAIEAGGFSPQCTTKFRALLFLSLHSSPSSSKLLSMASYGGELLLNSSSP

SEQ ID NO: 159016 - protein, 323 aa, Glycine max
  Coding DNA Sequence Number=SeqID_67331
  Gene Ontology: Mol. function=exonuclease activity; Cellular component= intracellular; Biological process=generation of mature 3'-end of 5S rRNA generated by RNA polymerase III
  Homolog annotation: Hit_ID=A5BZ26; Match level="QueryCoverage=93%, HitCoverage=32%, E-value=1e-97, Identity=57%"; Hit description =Putative uncharacterized protein
  Pfam annotation: Domain name=Exonuc_X-T; Domain location=37-167; Score=4.5; E_value=0.00013; Accession=PF00929.15; Description =Exonuclease
MAWWQPTKVCSDDGDQCDTRWRCITHRAHELNVLGKGLVISSVLSWLRMWMVWRSLAMGDSGQRFSGITSEMLDGVTTSLRDIQEEFIKLVYKETILVGHSLENDLLALNISHDSVIDTAVLYKHPRGSSHKNALRFLTKRFLSREIQQSGNGHDSIEDARATMELALLKIRNGKKKLLSILSESGKISSLIDDISVVKRYASESSHAIPVTSDDVALAKANKEVKNEKVHFIWTQFSELHSYLKKQAEDSESLNKRLAEMIAIKTCQNNFAKGKGFKLNASAELKEILARMDARIHNLYLSLPTNAMMIICTGHGDTAIVRR

SEQ ID NO: 159017 - protein, 313 aa, Glycine max
  Coding DNA Sequence Number=SeqID_67332
MELYGLRNDALLDFQNVAGLYELCNDALLEGPEGNKQDNHEVSPHATRPLSLTVETRFFRGLGRKTLTSLGKVQMTMLVSACYQTLESDGRNETFSRSRLEDTNISGKDADISRKGVDDYKMLTSLGKVQMTTLVSACYRTLDSDGRNETFSRSRPEDADISGKGPDDYMLTSPGKVQMTTLVSVGYQTLESDGRNETFSRSQPEDADISKKDLGSSNDDVRITVRCLPMLLDSWVMIGKVRGEEVASEQDFGWQSKGDDHFKARMEILISGQGLWWFEVLAQMACRMAGHDICQGVGLANGSGIKECPILFP

SEQ ID NO: 159018 - protein, 99 aa, Glycine max
  Coding DNA Sequence Number=SeqID_67333
MQGITRMDAALDAMRPLGFRTQLILRTVNELLDVAQGGGKKTGQYSRHVTGCRYGINLAKGILEHHSKGILDSDKPRKLLANFQIGKLIIGYVFDQMSR

SEQ ID NO: 159019 - protein, 82 aa, Glycine max
  Coding DNA Sequence Number=SeqID_67334
MDYQDRMGVQQHHLPRDGMYSRIRVWGKVMKSSKLPQQEFHSSIQLNVIQPSAILAISLSLGQDNPIQAASIGMVHYYKKQF

SEQ ID NO: 159020 - protein, 65 aa, Glycine max
  Coding DNA Sequence Number=SeqID_67335
MFLNHKDDSLDIFFKFYKRVQNENDAILPRKGPITRTMSKRLQEDWARAAEEGPRVLMNLRGSIL

SEQ ID NO: 159021 - protein, 193 aa, Glycine max
  Coding DNA Sequence Number=SeqID_67336
MASMMDAILGMKQLMESNAATAAAVISAAEADPTLPTVAHHPFPNLVGRERSTSGHISNPHLGYNRGAYPYGLPPNYTPPVIRDDEGHVPPLILEGEPPRHPDEVHEDHREHAQGDVDSYSPFPAEGSAPNSLPQPNITGEPRNHPTQPMFLSMGGPPREVEGKGKLDLIEERLRAVEGFDDYPFADMTDLCL

SEQ ID NO: 159022 - protein, 66 aa, Glycine max
  Coding DNA Sequence Number=SeqID_67337
MWVSSERFPVDFRREEKEKNECRGFNGISNHLSSISNSTAIDLQEAKDSIGEEDPRPTSSTWSYIT

SEQ ID NO: 159023 - protein, 323 aa, Glycine max
  Coding DNA Sequence Number=SeqID_67338
  Gene Ontology: Mol. function=motor activity; Cellular component=cell projection
  Homolog annotation: Hit_ID=UPI00016621D1; Match level="QueryCoverage =60%, HitCoverage=40%, E-value=2e-18, Identity=33%"; Hit description =UPI00016621D1 related cluster
GLHVLAFRGFHVLAIRGLHALAFRGLHALAFRGLQVLAFRGLHILAFRGLRTLTFKGLHVLSFRGLHVHAFKGLHVLAFSGPHALDFRGLHVLAFRELHALTFRGLHALTFRGLRALTFRGLHVLTFRGGLHALVFRGLHVLTFIGLHVLAFRELHALAFRGLHILTFRGLHALAFKGLHILAFKGLHVLAFRGIHICAFRGLKECQLCEHNQREAIVEPLCILGQDFTRAATKRRVRIMRTNMATLTQIWMTDCTHKTPSGPGGAEQGPGVSSSGYGPLSVLQGIAPARYPVDTEKSNRILGFPALITGLCQFYRVPVAPNK

SEQ ID NO: 159024 - protein, 225 aa, Glycine max
  Coding DNA Sequence Number=SeqID_67339
  Homolog annotation: Hit_ID=Q6WAY4; Match level="QueryCoverage=68%, HitCoverage=27%, E-value=1e-16, Identity=34%"; Hit description =Putative uncharacterized protein
VGAVDGTSPNASLPQGVRKDFRFDHSRDIHGGRCITHQYYDQPLRCFTFGDFQLVPTVEEFEKILGCPLGGRKPYLFSEFIPSLSKIAVVVRDSARELDRVKQTRNSVVGLPRKYLEGKVRDMANQEEWVPFVDVLALQIFGVVLFPNVDGLVDLAAIDAFLAYHYSKESRVVAILADLFDTFDRRCEKSSARDHLLLTRSLCMVGFAPIPTRHKTPMSAPKPLL

SEQ ID NO: 159025 - protein, 88 aa, Glycine max
  Coding DNA Sequence Number=SeqID_67340
  Subcellular localization annotation: CTP_CleavageSite=17; ConfidenceScore=5.18e-01
MQNTEHSKTMMTKVMTKSSKINQRITQVNQRSIKNNSRVQDKNQEEFKTQEESLETRIKIQGSRSQESRSRFKTQDSRMKRRLYQDKY

SEQ ID NO: 159026 - protein, 133 aa, Glycine max
  Coding DNA Sequence Number=SeqID_67341
MEKSFVGHPFVSRLSNEKIIVADMTKSMVKPKNILLTLKEHNDNSYTTIKKIYNANRNDITYKTNRYQLSLLDIIGVTPTGMTFSATFAYLGGERLNLSLMNALKNVFPDATNLLCQFHIDKNVKVLDQVASE

SEQ ID NO: 159027 - protein, 391 aa, Glycine max
  Coding DNA Sequence Number=SeqID_67342
  Homolog annotation: Hit_ID=Q2HVW1; Match level="QueryCoverage=31%, HitCoverage=51%, E-value=8e-07, Identity=26%"; Hit description =Putative uncharacterized protein
MGGLKLYVNIPKFERGRGRVQPQSTGGREHTRLVEQGRRETYQAQKHTATPGLVRGSFADVVARREPRIQQRRTSAVQNAKTNTSRSEVHLDRPMTAPKWLQDAWVGRLKNLALLDRVEENMLWDWGLDVVPKYIGDDMVLLPGLTEDKAKQMMEEGNAGREVMFYSVERWNKKMRAGSRLTWVQCWGVPLVAWDPTHLREIVTAIGEVVEVDEEMEDLRKMDRARLLVRTPWKPLIQHTVSVHIETEVFQVHIIEESGSSPNWCHCRRSTMLSSSEDICSEESEMVSLSELMTAKPQSGSQKVEMVEERRVTSEADTAPEEDNGMQGPTASTSIQLLSNGRITTSEPLDNNLDWGIEEESRCRVGGESNGATKSQMGTYGEARAAVGAVT

SEQ ID NO: 159028 - protein, 70 aa, Glycine max
  Coding DNA Sequence Number=SeqID_67343
MESPTVASYPSAGGRRGARGCVFQERKMRGVATNVYARKMSEKLEKVWSTNFKCERYILTEQMSFKALDH

SEQ ID NO: 159029 - protein, 80 aa, Glycine max
  Coding DNA Sequence Number=SeqID_67344
MRETQCGPLRAHRMNRKACKIGEVVAAQLAQASSARPGEQGCFLQKQPPSGGIFQRAQANFVVDLGMAFVVDWVVGNEKG

SEQ ID NO: 159030 - protein, 36 aa, Glycine max
  Coding DNA Sequence Number=SeqID_67345
MVVPRASHVNLIIAFCRAYTCFYGKVHQVKVKNGSN

SEQ ID NO: 159031 - protein, 57 aa, Glycine max
  Coding DNA Sequence Number=SeqID_67346
MAPRKLASKRSRKDKVVEGTSSALEYDSHRFRSAEHQQRFEAIKGWSFLRERRVQLK

SEQ ID NO: 159032 - protein, 62 aa, Glycine max
  Coding DNA Sequence Number=SeqID_67347
MGILDEVSLTDLCLGTTLVLMDSPKTSITGLSLLSLNFGSWYWVVGGILDVVSKPWRFTVGN

SEQ ID NO: 159033 - protein, 90 aa, Glycine max
  Coding DNA Sequence Number=SeqID_67348
MKAQVEKDKAPEWRRMKAQTYQGNPCGVYPDLSSFTGSSVYPDLSSFTGSGVYPDLSSFTGSGVIQTFVACIKRSAPTQVHIIWYQSFGS

SEQ ID NO: 159034 - protein, 93 aa, Glycine max
  Coding DNA Sequence Number=SeqID_67349
MPTSPERVQMTTLASACQSNLGSLNDEVRITVRCLRMLPDSWVMIAKGGVVDKSRMTTLASACQSNLGSLNDEVWITVRCLRMLPDSWVMIAK

SEQ ID NO: 159035 - protein, 428 aa, Glycine max
  Coding DNA Sequence Number=SeqID_67350
  Gene Ontology: Mol. function=two-component response regulator activity; Cellular component=intracellular; Biological process=two -component signal transduction system (phosphorelay)
  Homolog annotation: Hit_ID=A8G802; Match level="QueryCoverage=42%, HitCoverage=92%, E-value=2e-89, Identity=93%"; Hit description=Two component transcriptional regulator, LuxR family
  Pfam annotation: Domain name=GerE; Domain location=136-191; Score =70.1; E_value=7.4e-18; Accession=PF00196.10; Description=Bacterial regulatory proteins, luxR family
  Pfam annotation: Domain name=LexA_DNA_bind; Domain location=136-191; Score=-6.4; E_value=0.085; Accession=PF01726.7; Description=LexA DNA binding domain
  Pfam annotation: Domain name=MASE1; Domain location=37-367; Score= -7.5; E_value=0.0036; Accession=PF05231.5; Description=MASE1 domain
  Pfam annotation: Domain name=Response_reg; Domain location=3-114; Score=119.2; E_value=1.2e-32; Accession=PF00072.15; Description =Response regulator receiver domain
  Pfam annotation: Domain name=Sigma70_r4_2; Domain location=129-181; Score=17.5; E_value=0.012; Accession=PF08281.3; Description=Sigma-70, region 4
  Pfam module annotation: Pfam domain module=GerE::LexA_DNA _bind::MASE1::Response_reg::Sigma70_r4_2; Domain location=136 -191::136-191::37-367::3-114::129-181
MTLRVAFIDDHDIVRSGLVQLLSLEADIQVVGEFSGAAQARAGLPGLEVDVCICDISMPDGSGLDLLADIPSGIRVVMLSMHDNPALVEMALDRGAGGFLSKRCKPEDLITAVRTVAGGGVYLMPEIAQQLARVRVDPLTRREREIALLLAQGQEVREIAAALGLSPKTVHVHRANLFAKLGAAAVPVRPAHGHFAAEPIPFLAGDPAGRSAADGAAGGSVRLRPGAVGVGGGAGVDGAAQPAGLAVAVAPSAERQRMALATVAGRGGGRRRLAAGASVAAGERIWLQQQVNAAELRRFAPFCLAIPIVFMSYRYGWQGALLATLLNGVALMVNEPPQPESHRDLLLSLLAQSLTGLLLGVGIQRQRELNQQLRLRLAENRQLARALVTAEEQTRREVARELHDEVGQTITVIRTQASIVKRLAPEPA

SEQ ID NO: 159036 - protein, 439 aa, Glycine max
  Coding DNA Sequence Number=SeqID_67351
  Gene Ontology: Mol. function=nucleic acid binding
  Homolog annotation: Hit_ID=A1G086; Match level="QueryCoverage=98%, HitCoverage=63%, E-value=1e-132, Identity=62%"; Hit description=ATP -dependent helicase HrpB
  Pfam annotation: Domain name=HrpB_C; Domain location=287-425; Score =287.4; E_value=2.8e-83; Accession=PF08482.1; Description=ATP -dependent helicase C-terminal
  Subcellular localization annotation: CTP_CleavageSite=41; ConfidenceScore=5.12e-01
MTRWNWSGLVMSAHWRRSDLHASSTAPDGRRTAQRLGAAVPAVAITALSGAPRIGWRRCCAAPDRAQAWPHPVTAGVPARPARIASACRPGCRTLDGNVRTGARAAGGQRWRRRVVLATNRAPNLGDLPGVRVVIDSGQAREPRYDPNSGFTRLDVVASAGSFEARDALLLRAAPVDVRPAAARRGRSGFVTEDVELGQRAPRPGTGPAQTRFDRIVLDSRSAGRVDPQHAAQALTDAVAELGLQALPWTEGLRQWQARVESLRRWMPELDLPDCSDAALLANRAQWLQPAFAGKSRLDALDESSFGEALKSPLEWSQRQLVERHAPTRITVPSGLERPITYELDSESGEPLPPVLAVKLQELFGLADTPRIADGRVPLTLHLLSPGGRPLQVTQDLRNFWENTYAEVKKEMKGRYPRHPWPDDPWTATATHRAKPRGT

SEQ ID NO: 159037 - protein, 483 aa, Glycine max
  Coding DNA Sequence Number=SeqID_67352
  Gene Ontology: Mol. function=cation transmembrane transporter activity; Cellular component=integral to membrane; Biological process=cation transport
  Homolog annotation: Hit_ID=P0AFZ8; Match level="QueryCoverage=100%, HitCoverage=100%, E-value=0.0, Identity=83%"; Hit description=Trk system potassium uptake protein trkH
  Pfam annotation: Domain name=TrkH; Domain location=152-481; Score =409.9; E_value=3.7e-120; Accession=PF02386.7; Description=Cation transport protein
MHFRAITRIVGLLVILFSVTMILPGLVALIYRDGAGRAFSQTFMMAIVIGSLLWWPNRKQKSELKPREGFLIVVLFWTVLGSVGAMPFIFAEQPHLSVTDAFFESFSGLTTTGATTLVGLDSLPKAILFYRQMLQWLGGMGIIVLAVAILPILGVGGMQLYRAEMPGPLKDNKMRPRIAETAKTLWLIYVLLTVACALALWLAGMPMFDAIGHSFSTIAIGGFSTHDASIGYFNSPTINTIVAIFLLISGCNYGLHFSLLSGRNLKVYWRDPEFRMFIGVQLTLVLICTLVLWFHNVYSSGWQTLNQAFFQVVSMATTAGFTTDSIARWPLFLPVLLLCSAFIGGMAGSTGGGLKVIRILLLCKQGSRELKRLVHPNAVYTIKLGNRALPERILEAVWGFFSAYALVFLVSMLAIIATGVDDFSAFAAVAATLNNLGPGLGVVADNFTSMNDVAKWILISTMLFGRLEVFTLLVLFTPTFWRE

SEQ ID NO: 159038 - protein, 48 aa, Glycine max
  Coding DNA Sequence Number=SeqID_67353
MHWHRLIAHGAAGYAKPPSLPSAMYSSGSQRRAISARLLKSAGYYCGD

SEQ ID NO: 159039 - protein, 506 aa, Glycine max
  Coding DNA Sequence Number=SeqID_67354
  Gene Ontology: Mol. function=nucleoside-triphosphatase activity; Cellular component=intracellular; Biological process=chlorophyll biosynthetic process
  Homolog annotation: Hit_ID=A8GL65; Match level="QueryCoverage=100%, HitCoverage=100%, E-value=0.0, Identity=64%"; Hit description=Mg chelatase, subunit ChlI
  Pfam annotation: Domain name=AAA; Domain location=212-448; Score= -25.1; E_value=0.0031; Accession=PF00004.20; Description=ATPase family associated with various cellular activities (AAA)
  Pfam annotation: Domain name=AAA_5; Domain location=212-387; Score =18.2; E_value=0.00012; Accession=PF07728.5; Description=ATPase family associated with various
  Pfam annotation: Domain name=MCM; Domain location=186-499; Score= -239.2; E_value=0.044; Accession=PF00493.14; Description=MCM235 family
  Pfam annotation: Domain name=Mg_chelatase; Domain location=189-393; Score=480.6; E_value=2e-141; Accession=PF01078.12; Description =Magnesium chelatase, subunit ChlI
  Pfam annotation: Domain name=Sigma54_activat; Domain location=193 -341; Score=-178.7; E_value=0.02; Accession=PF00158.17; Description =Sigma-54 interaction domain
  Pfam module annotation: Pfam domain module=AAA::AAA_5::MCM::Mg _chelatase::Sigma54_activat; Domain location=212-448::212-387::186 -499::189-393::193-341
MSLSKVLTRAALGVQAPLVTIEVHISNGLPALTLVGLPETTVKEARERVRSAIINSGFTFPAKRVTINLAPADLPKEGGRYDLPIAIAILAASEQLPGDKLAHYEFLGELALNGALCGVQAAIPAAMAALQAGRQMILAEQNQQDVGLIQQGETLVGKHLVEICAFLHSQTALTVAHYQPETVPHEQQDLSDIIGQQQGRRALEITAAGGHNLLLLGPPGTGKTMLATRLPGIMPPLDDQEALECAAIASLVSSGTLHHQWRKRPFRAPHHSASLYALVGGGSLPRPGEISLAHNGVLFLDELPEFERKALDALREPIESGEIAISRSRAKVTFPARFQLIGAMNPSPTGHYQGNHNRCTPQQVLRYLSRLSGPFLDRFDLSLEIPLLPGGSLSQKQQHSETSAQVRARVLAARAIQMARAGKVNAQLSNPEIARDCVLQQQDAEWLEEILNALGLSVRAWQRILKVARTIADLAGERQITRQHLQEAVGYRSIDRLLIYLHKSLE

SEQ ID NO: 159040 - protein, 181 aa, Glycine max
  Coding DNA Sequence Number=SeqID_67355
  Gene Ontology: Mol. function=transferase activity, transferring glycosyl groups; Biological process=metabolic process
  Homolog annotation: Hit_ID=A5AZZ3; Match level="QueryCoverage=96%, HitCoverage=73%, E-value=1e-24, Identity=52%"; Hit description =Putative uncharacterized protein
MAEHHKKLHIVVFPWLAFGHMGLYFELAKVISQKELPLPHVDQLPENVEATVDIPQHIVPYLKKAYDGLQEPLTKFLERCKPDWIIFDFAPYDTLKGSLVFALRSCMEIEAFGSEVTLSDEEFTKAAMGLELSGFPFFWALRKQNTSAIESQDWVLSEFKRGMVWRTWAPQLRILVHMPVR

SEQ ID NO: 159041 - protein, 106 aa, Glycine max
  Coding DNA Sequence Number=SeqID_67356
MFCPPPPIYRGKQGGGCRSARPGELGCFHQKAPPSVRRSWKAQNFTDCALTHPFNSRHAAKFHGLPNDGCQVPRSCQARVAPQQTDDPWTKLGYDSCPSLLVFYWR

SEQ ID NO: 159042 - protein, 70 aa, Glycine max
  Coding DNA Sequence Number=SeqID_67357
MAMVCGDKSLETMEEPPKGRKTPLELVGLGSSSSMDSFASWKINGSGMEKEEREETPLQGEDESRRSSPP

SEQ ID NO: 159043 - protein, 172 aa, Glycine max
  Coding DNA Sequence Number=SeqID_67358
MLVNAYDTLTEDARRVEQGLSVAHPLCMYGWFLTFFAMKVDMHVPYKVTACVPRKGKQIGSSSWLNASKHSKAWNATQRKYKELRGSSNGIIGGYHKWLKARTQEITWLPKLGVSSEDEAEVPEESEEVQALKMELERTQVVKQKFKMTAIRVRKECDELRDVNTATAATLE

SEQ ID NO: 159044 - protein, 91 aa, Glycine max
  Coding DNA Sequence Number=SeqID_67359
MDSMMEAMLSMKRMMKSNVAAIAATSAAAKVDPTHPSAINQANQPILNMANQGGEVLGITSGPHMGHNRNAYPPNYTPPNDMTSNPDLDYG

SEQ ID NO: 159045 - protein, 61 aa, Glycine max
  Coding DNA Sequence Number=SeqID_67360
MNELLMQSYSVRALGRRLQVDWARDPREGPRVLMSLRLLKEVFSKKLLKEVFSRKLLKEAT

SEQ ID NO: 159046 - protein, 53 aa, Glycine max
  Coding DNA Sequence Number=SeqID_67361
  Subcellular localization annotation: CTP_CleavageSite=39; ConfidenceScore=5.05e-01
MFPWVISQRFSTVLRRSSFVLRRSSVFKSEYVGARETPSSTAKRQKYKKNKKK

SEQ ID NO: 159047 - protein, 578 aa, Glycine max
  Coding DNA Sequence Number=SeqID_67362
  Homolog annotation: Hit_ID=A7Q9Y9; Match level="QueryCoverage=86%, HitCoverage=81%, E-value=1e-119, Identity=47%"; Hit description =Chromosome chr8 scaffold_68, whole genome shotgun sequence
  Pfam annotation: Domain name=DUF618; Domain location=53-118; Score =126.1; E_value=1.1e-34; Accession=PF04818.4; Description=Protein of unknown function, DUF618
MICLVPLQIPKRPPLPPTKRHNHSALSHWCISHRKRAKEIVETWDKLFNASQKEQRVSFLYLANDILQNSRRKGSEFVNEFWKVLPAALRHVYESGDEDGRKAVTRLVDIWEERKVFGSRGQGLKDDVMGKNPLPSASNGKSSNSIKIVKRDAHSVRIKLAVGGLPEKILTAFQPILDQHLNEEASLNNCSAAVREVGKVVEDVENTLAQGVTSSGLIVDGFGRMVGGYSSNADGGWLGCVLVTVEVGMGNQLGSTLVNDLQEQEEKLKQYMEQLENAEAARDSLLSQLKHALQEQESRQELVHTQLLVARSQIKKVVGIRKQLNQAAEATNPSQPTSVSYAPFQTTEDDSKKAAAAAVAAKLAASASSAQMLTSVLSSLVAEEAASLNGSLNSTGFSSGLPIFNPEKRPKLEKPTPAHDASNYDMANSPFYATMQQPSLANVPLAPSVGMQAVSQASQLQPAFASPPPPPLHSLANQPSNQYVQSTGLMAGGIPYGYRSNSLPPPPPPPLPPHMAIGLSMPGTQPAQQQQQSPPGFYRPPGIGFYGKSHPSTPPPVPRHMFLWEIAVKVEDFPAGAV

SEQ ID NO: 159048 - protein, 87 aa, Glycine max
  Coding DNA Sequence Number=SeqID_67363
MKKSAMFPKPMKEDDLFRNHVIFDDGNNINGGDYKQFAIARANALGSWLGENNSIAHWVGWGNLSDVDMWQSTSEVNGQCPIEASGD

SEQ ID NO: 159049 - protein, 447 aa, Glycine max
  Coding DNA Sequence Number=SeqID_67364
  Gene Ontology: Mol. function=drug transporter activity; Cellular component=membrane; Biological process=multidrug transport
  Homolog annotation: Hit_ID=A7Q9Z0; Match level="QueryCoverage=95%, HitCoverage=97%, E-value=1e-153, Identity=58%"; Hit description =Chromosome chr8 scaffold_68, whole genome shotgun sequence
  Pfam annotation: Domain name=MatE; Domain location=261-383; Score =30.6; E_value=5.9e-06; Accession=PF01554.9; Description=MatE
  Pfam annotation: Domain name=MatE; Domain location=41-201; Score =131.2; E_value=3e-36; Accession=PF01554.9; Description=MatE
  Pfam module annotation: Pfam domain module=MatE::MatE; Domain location=261-383::41-201
MEGNLKQKLLSREKISEEEENLSLVKRVWEESKVMWIVAAPAIFTRFTTFGLSVISQAFIGHIGSKELAAYALVFTVIIRFANGILLGMSSALSTLCGQAYGAKEYDMMGVYLQRSSIVLFLTALCLLPLFIFTSPILTLLGQDESIARVARNVSLWSIPILFAYIVSFNCQTFLQSQSKNVIIAFLATLSIIIHVSLSWLFTIQFKYGIPGAMISTILAYWIPNVGQLIFITCGWCPETWKGFSSLAFKDLWPVVKLSLSAGAMLCLELWYNTILILLTGNMKNAEVQIDALSICININGWEMMIAFGFMAAAREKVAYLFTSNEDVATAVGDLSPLLAVSLLLNSIQPVLSGVAVGAGWQSIVAYVNIGCYYLIGIPVGIVLGNIIHLQVKGIWIGMLFGTLIQTIVLTIITYKTNWDEQVIIARNRISKWSKVDLDRETVTSDN

SEQ ID NO: 159050 - protein, 109 aa, Glycine max
  Coding DNA Sequence Number=SeqID_67365
MLGCVVATVNHLEDAENLNLNIFHKHTLANNFVGLYDSQSLQDAQMLEPVASLKRLHIAANNFHFVLRSLECQIALLLLCDQISQRLKPDGIDAKVNGKWHLFTVARQE

SEQ ID NO: 159051 - protein, 339 aa, Glycine max
  Coding DNA Sequence Number=SeqID_67366
  Gene Ontology: Mol. function=RNA binding; Cellular component =cytoplasm; Biological process=nicotianamine biosynthetic process
  Homolog annotation: Hit_ID=A7Q9W1; Match level="QueryCoverage=100%, HitCoverage=100%, E-value=1e-122, Identity=68%"; Hit description =Chromosome chr8 scaffold_68, whole genome shotgun sequence
MSGLYNSNFSPVRAASPQIRTNPEVDSQYLTELLAEHQKLGPFMQALPICSRLLNQEILRVSGMLSNQGFGDFDRLRHRSPSPMASSNLMSSVTGTGLGGWNSLQQENAKKVNPVRGKSKTCWLYVSQAKPPPLRLQLRQPLKRPQPQLRGWLGVIAIKVAFQQNRLRGTPGMAMDWQVAPASPSSYTVKRILRLEIPVDAYPNFNFVGRLLGPRGNSLKRVEASTGCRVYIRGKGSIKDPDKEEKLRGRPGYEHLNEQLHILIEADLPANIVDIRLRQAQEIIEELLKPVEESEDYIKRQQLRELAMLNSNFREESPGPSGSVSPFNSSGMKRAKTGR

SEQ ID NO: 159052 - protein, 108 aa, Glycine max
  Coding DNA Sequence Number=SeqID_67367
MGRINCVGDGIDVGKAIEAVTSAVMMLIHIHIPAVHDANNNSTLLFAFIPSRPTHITDTPVPCRVQCPTRVRVSPTPTRHPYYVLYFGYYKCSRVCVVSGVRVGVGAS

SEQ ID NO: 159053 - protein, 225 aa, Glycine max
  Coding DNA Sequence Number=SeqID_67368
  Gene Ontology: Cellular component=integral to membrane; Biological process=transport
  Homolog annotation: Hit_ID=A7Q9T2; Match level="QueryCoverage=28%, HitCoverage=15%, E-value=2e-24, Identity=89%"; Hit description =Chromosome chr8 scaffold_68, whole genome shotgun sequence
MADHRGQYTAHTAYNLMRGTEVDGIQDEAFEELWKLKVPAKYAVFAWRLLRNRKIIPIWWESLSWVNISTAFSNDPKQHFLQHGLIMAGGIRTTRWKCWWLAVTWSIWQKRNKIIFSNDSFDANKVIDDAAFLLWTWLSNLEKDFSLHFNQWSSNIREGQQRERSERNKQAEVDTLVNSGGSIHDRYALLWKQQMDRQLAQLGSATGVYKTLVKYLVGVPQVWLS

SEQ ID NO: 159054 - protein, 124 aa, Glycine max
  Coding DNA Sequence Number=SeqID_67369
  Gene Ontology: Cellular component=integral to membrane; Biological process=transport
  Homolog annotation: Hit_ID=A7Q9T2; Match level="QueryCoverage=75%, HitCoverage=21%, E-value=6e-29, Identity=67%"; Hit description =Chromosome chr8 scaffold_68, whole genome shotgun sequence
MASTEGLVPITRAFLASYYDKHPFTPLSAHVSTLSSQIRSMANDFLTQHPPIQGERILINEADQQPPHKMDENMWKNREYIEETIFLLQSSNWPEAVPPNLLLKCLGGNHKANPKSIKCVLETT

SEQ ID NO: 159055 - protein, 46 aa, Glycine max
  Coding DNA Sequence Number=SeqID_67370
MAMEKEDEDGNNNVLVTEEGEFQQLPIGIGATKLGPLKCDQAAYGC

SEQ ID NO: 159056 - protein, 266 aa, Glycine max
  Coding DNA Sequence Number=SeqID_67371
  Gene Ontology: Mol. function=metal ion binding; Cellular component =integral to membrane; Biological process=regulation of transcription, DNA-dependent
  Homolog annotation: Hit_ID=A7P1V4; Match level="QueryCoverage=91%, HitCoverage=42%, E-value=6e-47, Identity=43%"; Hit description =Chromosome chr19 scaffold_4, whole genome shotgun sequence
  Pfam annotation: Domain name=zf-C3HC4; Domain location=215-255; Score= 32.0; E_value=2.2e-06; Accession=PF00097.16; Description=Zinc finger, C3HC4 type (RING finger)
MVNRFGISDCCHYSPAFSANGSSSENARIGPQRYHDTTGSRSGHRFPHHPPQYHSFHHQVQPAQLIRGHSFNIHPPLTAPSYRVPTNPSHGFSILMHDAFEMGARRPGFAPFAGARIHLSHRGNLHEMITLIHQNLPPAVFFPGDDVALLVDHHTDMHLDTEDMSYEASEQIGNAKSGLSEKTITSQMKTKTYILPTNATNLEEAAYKEQETDLCIICLEEYKNKENIGILRCEHEYHADCFRRWLLEKNVCPMCKSVALTPGEKQ

SEQ ID NO: 159057 - protein, 68 aa, Glycine max
  Coding DNA Sequence Number=SeqID_67372
  Homolog annotation: Hit_ID=Q9FT95; Match level="QueryCoverage=61%, HitCoverage=14%, E-value=2e-16, Identity=85%"; Hit description =Putative uncharacterized protein F8L15_130
MGEIVNVRLLGINALYDSSPMSNEQELANSSVEYDPLYDADKGFKVMPSSFHDISDIEFQENWGRVWY

SEQ ID NO: 159058 - protein, 117 aa, Glycine max
  Coding DNA Sequence Number=SeqID_67373
  Gene Ontology: Mol. function=small conjugating protein ligase activity; Biological process=ubiquitin-dependent protein catabolic process
  Homolog annotation: Hit_ID=A5B472; Match level="QueryCoverage=34%, HitCoverage=16%, E-value=6e-10, Identity=78%"; Hit description =Ubiquitin carrier protein
  Subcellular localization annotation: CTP_CleavageSite=77; ConfidenceScore=5.22e-01
LYTGIHAKPKPKFKSGAISESTTALNVDQTNTSVISADIKTTPASAALPAATATRGNNQEQAAAAVNGSNAAATVISAAASAPQKKEGGQAKAQFYNLIEKEEGVEIWSPGFNICFI

SEQ ID NO: 159059 - protein, 227 aa, Glycine max
  Coding DNA Sequence Number=SeqID_67374
  Homolog annotation: Hit_ID=Q9M197; Match level="QueryCoverage=20%, HitCoverage=3%, E-value=1e-07, Identity=58%"; Hit description=Copia -type reverse transcriptase-like protein
MKALLGAHNVWEMVEKGYKEPQDETSLSQAQNKILKDSRKLSSSSIKHLMMMRSRRFLLQHPLKRYGISFKPLTKEKTKRRKKVKEMREVNETEVEVIVTAEGKLDVATMDVATMDGVQISSTTVTRKEKVQQENVEEAMQAQDMINLKPDGIIVKRLVTMLQNVDSPRIKLRRRLTMWSKKDEKFETVLLTSGDNEGSQENTWFLDMVQATMCAEKEACSWILITR

SEQ ID NO: 159060 - protein, 568 aa, Glycine max
  Coding DNA Sequence Number=SeqID_67375
  Gene Ontology: Mol. function=peptidase activity; Cellular component =chloroplast outer membrane; Biological process=regulation of transcription
  Homolog annotation: Hit_ID=Q2HUG9; Match level="QueryCoverage=46%, HitCoverage=100%, E-value=1e-109, Identity=78%"; Hit description =Peptidase M22, glycoprotease; Homeodomain-related
  Pfam annotation: Domain name=AIG1; Domain location=1-153; Score=77.4; E_value=4.6e-20; Accession=PF04548.7; Description=AIG1 family
  Pfam annotation: Domain name=Myb_DNA-binding; Domain location=339 -390; Score=37.8; E_value=3.8e-08; Accession=PF00249.22; Description =Myb-like DNA-binding domain
  Pfam module annotation: Pfam domain module=AIG1::Myb_DNA-binding; Domain location=1-153::339-390
AGFTLNIIDTPGLIEGGYINDMALDIIKRFLLNKTIDVLLYVDRLDVYRVDNLDKVVAKAITDSFGKGIWSKTILALTHAQFSPPDGLPYDEFFSQRSESLLKVLRSGARIKKEAFQAASIPVVLVENSGRCNKNDSDEKVLPNGTAWIPNLVQTITDIALNQSESIHVDKNLIEGPNPNQRGKLWTPLVFAIQHIRLLLSVLRMNLDGFSYTVIAGSLRHRNLFVTERIALYAGSKETVLERDFGRNIKVLALVLLWNYQIGWIKFDDFALLFLQNSAGIDFYQQVSITTYQAKKFSPASMVPHKSQGGVEQLANAGVLGGSAVKIAAAPAGGSGKQRLRWTSDLHDRFVDAITQLGGPDRATPKGVLRVMGVPGLTIYHVKSHLQKYRLAKYLPESPADGKDSKVEKRNSGDSISGADSSPGMPINDALRMQMEVQKRLHEQLEVQKQLQMRIEAQGKYLQKIIEEQQKLGSNLTTSEALPLSHDEQNHPQSEASGSSEALASTVSPLKKQRIDDGSKDGFTASQVRNAAQKNDCNVGQLDPNLYDDAGFEFDLETKKDEDNESGQ

SEQ ID NO: 159061 - protein, 316 aa, Glycine max
  Coding DNA Sequence Number=SeqID_67376
  Gene Ontology: Mol. function=protein dimerization activity; Cellular component=nucleus; Biological process=regulation of transcription, DNA-dependent
  Homolog annotation: Hit_ID=Q2HUH2; Match level="QueryCoverage=100%, HitCoverage=100%, E-value=2e-97, Identity=62%"; Hit description=CAMP response element binding (CREB) protein
  Pfam annotation: Domain name=bZIP_1; Domain location=241-304; Score =52.2; E_value=1.8e-12; Accession=PF00170.12; Description=bZIP transcription factor
  Pfam annotation: Domain name=bZIP_2; Domain location=242-296; Score =47.9; E_value=3.5e-11; Accession=PF07716.6; Description=Basic region leucine zipper
  Pfam module annotation: Pfam domain module=bZIP_1::bZIP_2; Domain location=241-304::242-296
MGSQSGATQDQEPKTGSLTRQGSLYNLTLDEVQNQLGNLGKPVGSMNLDELLKSVWTVESGTDAYMHHGGGQVVSAGSSLNPEQGSLTLSGDLSKKTIDEVWRDMQQNKSVGKERQPTLGEMTLEDFLVKAGVSTEPFPNEDGAMAMSGVDSQHNTLQHAHWMQYQLTSVQQQQQPQQQNSVMPGFSGFMAGHVVQQPIPVVLNTVRDAGYSEALPSSLMAALSDSQTAGRKRVASGNVVEKTVERRQKRMIKNRESAARSRARKQAYTQELEIKVSQLEEENERLRRQNEIERALPSAPSPDPKHQLRRTSSAPL

SEQ ID NO: 159062 - protein, 506 aa, Glycine max
  Coding DNA Sequence Number=SeqID_67377
  Gene Ontology: Mol. function=catalytic activity; Cellular component =integral to membrane; Biological process=recognition or rejection of self pollen
  Homolog annotation: Hit_ID=A7PZU2; Match level="QueryCoverage=77%, HitCoverage=30%, E-value=1e-151, Identity=67%"; Hit description =Chromosome chr15 scaffold_40, whole genome shotgun sequence
  Pfam annotation: Domain name=Peptidase_C12; Domain location=82-405; Score=192.2; E_value=1.3e-54; Accession=PF01088.12; Description =Ubiquitin carboxyl-terminal hydrolase, family 1
  Subcellular localization annotation: CTP_CleavageSite=72; ConfidenceScore=5.74e-01
MEPSLLLSSPSSSTPLPFFLSNTLPFHSKPKLSTKFNCTLQKSHFWGSNLSWVPSQSHHGRPKLDAVRPIITAAVKRRKELPFDNVIQRDKKLKFVLKVRNILVTQPDRVMSLKTLGKFKRDLGLDKKRRLIAVLKKFPAVFQIMEEGVFSLKFKMTPEAERLYFEETRVRNEMEELVVVKLRKLLMMSLEKRILLEKIAHLKTDLGLPQEFRDTVCHRYPQYFKVVATQRGPALELTHWDPELAVSAAELAAEENRIREMEEQNLIIDRPPKFNRVKLPKGLNLSKGEMRKIMQFRDLPYFSPYSDFSGLRPGSREKEKHACGVVHEILSLTLEKRTLVDHFTHFREEFRFSQQLRGMLIRHPDMFYVSLKGDRDSVFLREGYRDSQLVEKDRLLLIKEKLRTLVNVPRFPKGPARRIVEDSMRESDGREDESGQEEEEWSEDVDNLLSDDDWSDEDDDDLPPDFDEDGELLEIGQGKTIKQDSRQNDEMVLLPVFADGRPREQW

SEQ ID NO: 159063 - protein, 353 aa, Glycine max
  Coding DNA Sequence Number=SeqID_67378
  Gene Ontology: Mol. function=transcription regulator activity; Cellular component=cytoplasm; Biological process=regulation of transcription, DNA-dependent
  Homolog annotation: Hit_ID=A7ZTJ2; Match level="QueryCoverage=55%, HitCoverage=99%, E-value=1e-93, Identity=88%"; Hit description=HTH -type protein slmA
  Pfam annotation: Domain name=TetR_N; Domain location=170-217; Score =39.4; E_value=1.3e-08; Accession=PF00440.14; Description=Bacterial regulatory proteins, tetR f
  Pfam annotation: Domain name=dUTPase; Domain location=16-150; Score =191.5; E_value=2.1e-54; Accession=PF00692.10; Description=dUTPase
  Pfam module annotation: Pfam domain module=TetR_N::dUTPase; Domain location=170-217::16-150
MMKKIDVKILDARVGKEFPLPTYATSGSAGLDLRACLDDALEIAPGMTTLVPTGLAIHIADPSLAAVILPRSGLGHKHGIVLGNLVGLIDSDYQGQLMVSVWNRGQDSFTLQPGDRLAQLVFVPVVQAEFNLVEDFDASDRGAGGFGHSGRVLKVMAEKKVAKRNRREEILQALAQMLESGDGSQRITTAKLAANVGVSEAALYRHFPSKTRMFDSLIEFIEDSLITRINLILKDEKETMARLRLIVQLLLGFGERNPGLTRILTGHALMFEQDRLQGRINQLFERIEVQLRQVMKEKKMRDGEGFQTDETLLASQLLAFCEGLLSRYVRSEFRYRPTADFDSRWPLIAAQLV

SEQ ID NO: 159064 - protein, 45 aa, Glycine max
  Coding DNA Sequence Number=SeqID_67379
MSRNFTDCLTMGVKFLDAVKRRLHAIKQWSPDEIRAILCPSWGFN

SEQ ID NO: 159065 - protein, 118 aa, Glycine max
  Coding DNA Sequence Number=SeqID_67380
MLTTSKDWKAVSNDSSADSTYGIEEEQLTRTSSSPDTMTKCPSTTNFSFWWSVEGTTPTEWIHGCPKRQLPYLYWEVNLSPHLSTTAIEGTDHHGTRPQVGGVKWQLLQCALGHHIQA

SEQ ID NO: 159066 - protein, 87 aa, Glycine max
  Coding DNA Sequence Number=SeqID_67381
MGKDWGPGAADAWYTDKSSHSTALGPYDWPPTGHPNAACRVPSSACEQRWTLEMVATIEVAVVHLWLAATAGPAPAAVPALACSTFL

SEQ ID NO: 159067 - protein, 91 aa, Glycine max
  Coding DNA Sequence Number=SeqID_67382
MKQFLNKETEEDLVTTPKNVLTQWLRVEAMSSKVILMMPKNQELSKVSSKDSRIRFQVSRFKKNQDQDSRLKIQESREDSIKFYSLVIEYW

SEQ ID NO: 159068 - protein, 233 aa, Glycine max
  Coding DNA Sequence Number=SeqID_67383
  Pfam annotation: Domain name=Retrotrans_gag; Domain location=1-81; Score=5.3; E_value=0.016; Accession=PF03732.8; Description =Retrotransposon gag protein
EAKRWLHSFKGNNLKTREEVVEKFLKKYFPKSKIAEGKAAISSYHQFPDESLSEALERFRGGKIKLKTPEEATELIENMSASDHAILHNRVVPSVVRLMKQANVFPVKNTLKKLTIWEINKDKDILKDDFQASSRVLITNKDNGDHTLAINSTKTRVTMSNHKSTESALKNLEVQVEQLAKQIADKSSNNFVANTEKNPKEECKAVMIRSKRFVEAEDEDSVVPKKKAVEGIL

SEQ ID NO: 159069 - protein, 70 aa, Glycine max
  Coding DNA Sequence Number=SeqID_67384
GPAVIAGKSIVLKPRTQLSCCYPPYFPSSIGNLQGCYGRVLEEIIHGPTMKNSVLPNPGVEFPPQRHNFW

SEQ ID NO: 159070 - protein, 52 aa, Glycine max
  Coding DNA Sequence Number=SeqID_67385
MIDVDGLKHNLLSITQLCDEGFKIEFNKNCCLISETMFGEFVHIGKSIGLRI

SEQ ID NO: 159071 - protein, 89 aa, Glycine max
  Coding DNA Sequence Number=SeqID_67386
  Subcellular localization annotation: CTP_CleavageSite=50; ConfidenceScore=5.18e-01
TYQGNPCGVYPDLSSFTGSGVYPDLSSFTGSGIYPDLSSFTGSGVYPDLSSFTGSGVIQIFVTCIKRSAPTQVHIQPVSSDPPRKVHII

SEQ ID NO: 159072 - protein, 47 aa, Glycine max
  Coding DNA Sequence Number=SeqID_67387
  Gene Ontology: Mol. function=translation elongation factor activity; Cellular component=cytoplasm; Biological process=translational elongation
  Homolog annotation: Hit_ID=A8GGU5; Match level="QueryCoverage=95%, HitCoverage=23%, E-value=5e-15, Identity=86%"; Hit description =Elongation factor P-like protein
  Pfam annotation: Domain name=EFP_N; Domain location=1-46; Score=24.6; E_value=6.1e-05; Accession=PF08207.3; Description=Elongation factor P (EF-P) KOW-like do
MAVTWNGKLLLVKDIDVQSPSARGAATLYKMRFTDVRTGLKVEERSR

SEQ ID NO: 159073 - protein, 308 aa, Glycine max
  Coding DNA Sequence Number=SeqID_67388
MARPFNQADIDAKIGHRIDGVLAVADAQLQRQRGKITAIRGDHPRQQIVADGAAGKQANRSVVFFKQLFDLNRLLQQPDRTRIEQPAVLVEHQPFADAVKQLHAELTFQIGQGRADRRLRQRQHLRGLSGGAAFQHLGKHFNLTQRNVHACSLHGVPFHQIDHHRQPDQQHQNQAAPADDLFAARPLHLGAFGAADAHVARQQTQQDHHAKRDDNRVIQQANNRDEVRNQIDGAERISDDAKRQQLKPPRRTRIATGKPQRQHVPFDELRPAAQAHEHCCPSLSLIPVDYKYIINFTFKPARRTLKPH

SEQ ID NO: 159074 - protein, 607 aa, Glycine max
  Coding DNA Sequence Number=SeqID_67389
  Gene Ontology: Mol. function=oxidoreductase activity; Cellular component=cytoplasm; Biological process=metabolic process
  Homolog annotation: Hit_ID=A9ZDI2; Match level="QueryCoverage=57%, HitCoverage=93%, E-value=1e-161, Identity=80%"; Hit description=S -(Hydroxymethyl)glutathione dehydrogenase/class III alcohol dehydrogenase
  Pfam annotation: Domain name=ADH_N; Domain location=7-135; Score =140.7; E_value=4e-39; Accession=PF08240.3; Description=Alcohol dehydrogenase GroES-like domai
  Pfam annotation: Domain name=ADH_zinc_N; Domain location=166-308; Score=130.0; E_value=6.9e-36; Accession=PF00107.17; Description=Zinc- binding dehydrogenase
  Pfam annotation: Domain name=Abhydrolase_3; Domain location=430-589; Score=-89.7; E_value=0.072; Accession=PF07859.4; Description =alphabeta hydrolase fold
  Pfam annotation: Domain name=Esterase; Domain location=344-600; Score= 344.1; E_value=2.4e-100; Accession=PF00756.11; Description=Putative esterase
  Pfam annotation: Domain name=Peptidase_S9; Domain location=390-607; Score=-78.8; E_value=0.07; Accession=PF00326.12; Description=Prolyl oligopeptidase family
  Pfam module annotation: Pfam domain module=ADH_N::ADH_zinc _N::Abhydrolase_3::Esterase::Peptidase_S9; Domain location=7-135::166- 308::430-589::344-600::390-607
DLMPPQKGEVLVRIVATGVCHTDAYTLSGKDPEGVFPAILGHEGGGVVEAVGEGVTSVAVGDHVIPLYTPECGKCKFCLSGKTNLCQAIRTTQGKGLMPDGTTRFFKDGKPIFHYMGTSTFSEYTVVPEISLAKISKEAPLEEVCLLGCGVTTGMGAVMNTAKVKEGDTVAIFGLGGIGLSAIIGAKMAKAGRIIGIDINTSKFDLARKLGATDLVNPKDFAKPIQEVIVEMTDGGVDFSFECIGNVNVMRSALECCHKGWGESVIIGVAGAGEEISTRPFQLVTGRVWRGSAFGGVKGRTQLPGIVQDYLDGKFALNDFITHTMPLEEINEAFELMHEGKSIRSVRWRHQSAVLNCPMTFSIFLPPPRDDAPPPVVWFLAGLTCNDENFTTKAGAQRVAAELGLVLIMPDTSPRGDAVANDSGYDLGQGAGFYLNATQQPWAAHYRMFDYLSEELPALVADNFKLSNRQSVMGHSMGGHGALVLALRLGGRFASASAFAPIVNPTEVPWGQKAFAAYLGDDRQTWREWDSCLLMQNAEHRLPVLIDQGDSDQFLADQLRPERLEAVAREQNFPLELRIQPGYDHSYFFIASFVEDHLRFHAQHLLA

SEQ ID NO: 159075 - protein, 371 aa, Glycine max
  Coding DNA Sequence Number=SeqID_67390
MARIAGVVKISKRELDRVKQNRNRIVGITRKCLKEKAEALASQGKWASFIDVLALLVFGTILFPNVDRLVDLVVIDAFLAYHHSKDSPIIAILAYAYDTFDLRCEKSIERVVCCTPALYGRPLVGSHNGKKDGQECYAHVKGAPSEETIAPFIARGFNEANAKTLQRVCKAWNEVERKDNELRGSGNGVIGGYHKWLKSRMQGITWLPKLKSLSREEAKVPDEITRVWKECDELKDINMTTVEALEREMKKARKEEWSRNKFRGALWGSKKFERTQLSKIEGSMLIIIDQYKEKVNLAASHGQMLEDEMAKVSALQVEMEAREGVIELLHKKTMKWIDRFALTLNESQELPRLLARAKAVADTYSTPDEVH

SEQ ID NO: 159076 - protein, 233 aa, Glycine max
  Coding DNA Sequence Number=SeqID_67391
  Gene Ontology: Mol. function=helicase activity; Biological process =viral genome replication
  Homolog annotation: Hit_ID=A2Q378; Match level="QueryCoverage=96%, HitCoverage=14%, E-value=1e-55, Identity=48%"; Hit description =Putative uncharacterized protein
  Pfam annotation: Domain name=DUF889; Domain location=1-209; Score =242.5; E_value=9.4e-70; Accession=PF05970.5; Description=Eukaryotic protein of unknown function (DUF889)
MCLQNNEQSPDEQETDAFAKWILDIGDGIIGHESDGYLIIEIPEDQLITQYDDPIHAIVNSTFPDLTQHHNDAQYFNSRVILASTNEIVEHVNDYILSLIPGEHMEYLSSDSIDKSKTIESCHFQTITTEFLNSLMTSSLPNHCIKLKIGTPIMLLRNLDQTQGLCNDTRLIITRLEKHVIAAEIISGKNSGHMVYIPRMSMSPSQSPWPFKLLRRQFPIMLSYAMTINKSQE

SEQ ID NO: 159077 - protein, 54 aa, Glycine max
  Coding DNA Sequence Number=SeqID_67392
MDKSLKVGEDEWREKERRSSKFYASNKLSFIPLIQDQVQDSPLSVLRCYEACKA

SEQ ID NO: 159078 - protein, 42 aa, Glycine max
  Coding DNA Sequence Number=SeqID_67393
MAREKENEEAEAWGQKRRSRGMGEPTTTKALIEAIKQQIDVY

SEQ ID NO: 159079 - protein, 491 aa, Glycine max
  Coding DNA Sequence Number=SeqID_67394
  Gene Ontology: Mol. function=ketol-acid reductoisomerase activity; Cellular component=mitochondrial nucleoid; Biological process =branched chain family amino acid biosynthetic process
  Homolog annotation: Hit_ID=A8A6N0; Match level="QueryCoverage=100%, HitCoverage=100%, E-value=0.0, Identity=84%"; Hit description=Ketol -acid reductoisomerase
  Pfam annotation: Domain name=2-Hacid_dh_C; Domain location=4-140; Score=-104.7; E_value=0.092; Accession=PF02826.10; Description=D -isomer specific 2-hydroxyacid dehydr
  Pfam annotation: Domain name=ApbA; Domain location=40-180; Score= -31.7; E_value=0.087; Accession=PF02558.7; Description=Ketopantoate reductase PanEApbA
  Pfam annotation: Domain name=IlvC; Domain location=210-485; Score =449.4; E_value=4.7e-132; Accession=PF01450.10; Description =Acetohydroxy acid isomeroreductase, catalytic domain
  Pfam annotation: Domain name=IlvN; Domain location=34-204; Score =292.2; E_value=1e-84; Accession=PF07991.3; Description=Acetohydroxy acid isomeroreductase, catalyti
  Pfam module annotation: Pfam domain module=2-Hacid_dh_C::ApbA::IlvC::I lvN; Domain location=4-140::40-180::210-485::34-204
MANYFNTLNLRNQLAQLGKCRFMSRDEFADGASFLKGKKVVIVGCGAQGLNQGLNMRDSGLDVSYALRAEAIAEKRASFRKATENGFKVGTYEELIPQADLVVNLTPDKQHSAVVQAVQPLMKDGAALGYSHGFNIVEVGETIRKDITVVMVAPKCPGTEVREEYKRGFGVPTLIAVHPENDPKGEGMAIAKAWAAATGGDRAGVLESSFVAEVKSDLMGEQTILCGMLQAGSLLCFDKLVAEGHDAAYTEKLIQFGWETITESLKFGGITLMMDRLSNPAKIRAYALSEQLKTIMAPLFQKHMDDIISGEFSSGMMADWANDDKNLLTWREETGKTAFENAPQFEGKIDEQEYYDKGVVMVAMVKAGVELAFETMVDAGIIEESAYYESLHELPLIANTIARKRLYEMNVVISDTAEYGNYLFSFAAVPLLKEFMTTLQPGDLGKAVEGTQVDNAQLRDVNEAIRQHPIEAVGRKLRGYMTDMKRIAVAG

SEQ ID NO: 159080 - protein, 68 aa, Glycine max
  Coding DNA Sequence Number=SeqID_67395
  Subcellular localization annotation: CTP_CleavageSite=53; ConfidenceScore=5.23e-01
CGGHAARKHHTAALNAPLQGASPLHSGCAPVGRASGARLFAISPARERGMCCKAIKLGNARVFPVTPL

SEQ ID NO: 159081 - protein, 232 aa, Glycine max
  Coding DNA Sequence Number=SeqID_67396
  Homolog annotation: Hit_ID=Q9AVH2; Match level="QueryCoverage=19%, HitCoverage=16%, E-value=5e-22, Identity=100%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRGGDESKRQGLNLSGIVAARPLCHLQYPVAYLSRLQRILPAARWELRFKASRRANPPHEGHQRHVPLGGPRPPTAAHVPYWWVNNPTLGEFCFTMIGRADIEGSKSNVAMNAWLPQASYPC

SEQ ID NO: 159082 - protein, 161 aa, Glycine max
  Coding DNA Sequence Number=SeqID_67397
  Subcellular localization annotation: CTP_CleavageSite=35; ConfidenceScore=5.72e-01
ANGTPPSSPPPPPPPPPPPPTGAASHSPSTLKQTRKATRLGSLTTRPVGEEKPLVHVDPAIGKADGPYRKKLTCLGIATRDKAEFDISEEFNLRTKKKILQIVGERWRQFKFDLKSKWALAADKDSVDDTVCEKYGISKEKWAQFCQSRRDPWWEDVRKKA

SEQ ID NO: 159083 - protein, 48 aa, Glycine max
  Coding DNA Sequence Number=SeqID_67398
MTLDQVRVLFLGYGSNYIIVLGRKHKNKCGGLREAVLVVCGGLAIPAL

SEQ ID NO: 159084 - protein, 189 aa, Glycine max
  Coding DNA Sequence Number=SeqID_67399
  Gene Ontology: Mol. function=RNA binding; Cellular component=nucleus; Biological process=mRNA processing
  Homolog annotation: Hit_ID=A5ADM7; Match level="QueryCoverage=93%, HitCoverage=56%, E-value=7e-99, Identity=96%"; Hit description =Putative uncharacterized protein
  Pfam annotation: Domain name=WD40; Domain location=11-50; Score=42.5; E_value=1.5e-09; Accession=PF00400.23; Description=WD domain, G-beta repeat
  Pfam annotation: Domain name=WD40; Domain location=136-174; Score =42.9; E_value=1.2e-09; Accession=PF00400.23; Description=WD domain, G-beta repeat
  Pfam module annotation: Pfam domain module=WD40::WD40; Domain location=11-50::136-174
MGGGGTIEKGKVKDIELKGHTDSVDQLCWDPKHADLIATASGDKTVRLWDARSGKCSQQAELSGENINITYKPDGTHVAVGNRDDELTILDVRKFKPIHRRKFNYEVNEISWNMTGEMFFLTTGNGTVEVLSYPSLRPLDTLMAHTAGCYCIAIDPVGRYFAVGSADSLVSLWDISEMLCVRTFTKGIL

SEQ ID NO: 159085 - protein, 101 aa, Glycine max
  Coding DNA Sequence Number=SeqID_67400
MVLEKIDHIGSWTFSIVVGRRSFWCECGITSFLIEESLMAHSTSLIFMGRSFSPLPKTKVSVSGRLVSRSSAGLRIQAVQENGGPRRLVDIIRLVPELSRN

SEQ ID NO: 159086 - protein, 475 aa, Glycine max
  Coding DNA Sequence Number=SeqID_67401
  Gene Ontology: Mol. function=nucleic acid binding; Cellular component= ribonucleoprotein complex; Biological process=regulation of RNA splicing
  Homolog annotation: Hit_ID=A7NZQ5; Match level="QueryCoverage=51%, HitCoverage=100%, E-value=2e-89, Identity=69%"; Hit description =Chromosome chr6 scaffold_3, whole genome shotgun sequence
  Pfam annotation: Domain name=RRM_1; Domain location=275-342; Score =16.0; E_value=0.0049; Accession=PF00076.13; Description=RNA recognition motif. (a.k.a. RRM, RB
  Pfam annotation: Domain name=RRM_1; Domain location=389-459; Score =44.4; E_value=4.1e-10; Accession=PF00076.13; Description=RNA recognition motif. (a.k.a. RRM, RB
  Pfam module annotation: Pfam domain module=RRM_1::RRM_1; Domain location=275-342::389-459
MSHNEFFWICVLLDYCVYCPLGLLLLPPLVLGVELCVVVEEHYHNTIVVIVITTVIVHHYDDDNCGDHVPQQHAQLHVSIRGRGCSQEDNKRRVCPTTSSSGYASLLDYCCLCLLSSWSTAPTSPPLVLGVELCVVVEEHYHHTTVVIVITTVIVHHYDDDNCGDHVPQQHAQLHVSIRDLAPIFCRVPSSDLGHSGDFHHLPCFPSAKNDLLSADIVFHKFADGGDGREMAAKRQRTVDPGSSFYGASTGSNFMYNPSPYGYVSQPPPPPFPVVRLRGLPFDCTETDVAEFFHGLDIVDVLFVHKGGKFTGEGFCVLGYPLQVDFALQRNRQNMGRRYVEVFRSKRQEYYKAIANEVSDARGGSPRRSASRAKSYDEGKDSAEHTGVLRLRGLPFSASKDDIMEFFKDFGLPEDSIHIIMNSEGRPSGEAYAEFASAEDSKAAMVKDRMTLGSRYIELFPSSPGEMEEAISRGR

SEQ ID NO: 159087 - protein, 362 aa, Glycine max
  Coding DNA Sequence Number=SeqID_67402
  Gene Ontology: Mol. function=protein disulfide oxidoreductase activity; Cellular component=cytoplasm; Biological process=cell redox homeostasis
  Homolog annotation: Hit_ID=A7R2K3; Match level="QueryCoverage=43%, HitCoverage=76%, E-value=1e-40, Identity=45%"; Hit description =Chromosome chr10 scaffold_433, whole genome shotgun sequence
  Pfam annotation: Domain name=DUF260; Domain location=177-277; Score =164.0; E_value=4e-46; Accession=PF03195.5; Description=Protein of unknown function DUF260
  Pfam annotation: Domain name=Glutaredoxin; Domain location=125-184; Score=22.5; E_value=0.0016; Accession=PF00462.15; Description =Glutaredoxin
  Pfam annotation: Domain name=Glutaredoxin; Domain location=39-94; Score=36.8; E_value=7.5e-08; Accession=PF00462.15; Description =Glutaredoxin
  Pfam module annotation: Pfam domain module=DUF260::Glutaredoxin::Gluta redoxin; Domain location=177-277::125-184::39-94
MYAPKHLKTSYGKTFDTLEGADPSSLANKVAKLVDSNPVMLFMKGTPEEPKCGFSRKAVDVLKEERVKFGSFDALSDSEHESGELKEVFKDHGIDTINEAKEKGDGKGGISKSTDLSTTLSSRLMKGKPDEPKCGFSRKVVEILQQENVPFESFDILTDEEVRQGLKDSMSRSSTQACAACKYQRRKCGSNCILAPYFPHDRQKQFLNAHRLFGVGKITNMIKPLDQHHRDLAMSTLIYESDMRARDPIGGCYSLVLQLQSQIFYATQQLHLLLQHLAYFKSHQPSSNSSDIVNNVTPQPPDPLEQTPQEQQQQQQCFNYNLLQEDDINMWAIQNSLSLLSPLSLENNINQDPVVDHGSHSL

SEQ ID NO: 159088 - protein, 391 aa, Glycine max
  Coding DNA Sequence Number=SeqID_67403
  Gene Ontology: Mol. function=DNA binding; Cellular component=nucleus; Biological process=regulation of transcription
  Homolog annotation: Hit_ID=A2WX32; Match level="QueryCoverage=36%, HitCoverage=43%, E-value=4e-15, Identity=38%"; Hit description =Putative uncharacterized protein
  Pfam annotation: Domain name=Extensin_2; Domain location=14-354; Score=-141.8; E_value=0.097; Accession=PF04554.4; Description =Extensin-like region
  Pfam annotation: Domain name=Myb_DNA-binding; Domain location=111 -158; Score=20.6; E_value=0.0058; Accession=PF00249.22; Description =Myb-like DNA-binding domain
  Pfam module annotation: Pfam domain module=Extensin_2::Myb_DNA -binding; Domain location=14-354::111-158
MSDYYFDEEEMQELLKENDAPVSDDFFNDFAAQDSSPPADEILPADEVLDPLLVPTSHMVHTSSATAPDPAPHLIPSEETLPSSHPHHLLRQNMESNHVMLSGDSSHHKKYEHWTIEEHKSFLFGLEIMKEKGWKQISEKYVPSKTLKQVASHAQKYFKRKNTPMKERKRRSIHDITLEDIHMTDTSHIDKHNWVPLPTNFAVQPHTPHIDQPNWVPPTPNFIVQPHTPSIHQHNWVPPTPNFIAQSHTPRIDQHTWVPPAPPNFAGQPRSAHIDQLNWVSPPPNFAPHTPLVDQDNWVPTPPDFAVQSHTPHIDQHNLVPPPPNFAVQPHQMQRAQHMQQFNLHDSSPQMDEYRNFNSFHPQNELDLIAQQILEYKKNKFNHKNNEGSSR

SEQ ID NO: 159089 - protein, 328 aa, Glycine max
  Coding DNA Sequence Number=SeqID_67404
  Gene Ontology: Mol. function=nucleic acid binding; Cellular component= ribonucleoprotein complex; Biological process=regulation of transcription, DNA-dependent
  Homolog annotation: Hit_ID=A7NYL6; Match level="QueryCoverage=25%, HitCoverage=25%, E-value=8e-34, Identity=82%"; Hit description =Chromosome chr6 scaffold_3, whole genome shotgun sequence
  Pfam annotation: Domain name=RRM_1; Domain location=58-129; Score =81.5; E_value=2.7e-21; Accession=PF00076.13; Description=RNA recognition motif. (a.k.a. RRM, RB
  Subcellular localization annotation: CTP_CleavageSite=49; ConfidenceScore=5.75e-01
MSYSRRSRCFHFPFHRYSRSPSPYKRYSRSVSRSLSRTSSRSRSRSLSRDAENPGNNLYVTGLSPRITKRELEKHFSAEGKVIDVHLVVDPWTRESRGFGFVTMETLEEADRCVKYLNRSVLEGRVITVEKLNGVLQVTLLVAPLAILLIEEAIAGLPILQTEVGVVLTLLTIGGGSQTIHITLGEGHTLHTTAGTGLILDMIDTGHILALALLIAGHLSASATDHTLLMTHDMTHRMITPTEGTITDLFHEVPRLMIAIIEGTITGLFLEVPHPGQGEGQGGATLGVPLLFQRGATREVCPPGQGRVIQEAPRGVANMRNTTQEARV

SEQ ID NO: 159090 - protein, 234 aa, Glycine max
  Coding DNA Sequence Number=SeqID_67405
  Gene Ontology: Mol. function=ceramidase activity; Cellular component =extracellular region; Biological process=sphingolipid metabolic process
  Homolog annotation: Hit_ID=A9PHI9; Match level="QueryCoverage=99%, HitCoverage=87%, E-value=1e-104, Identity=77%"; Hit description =Putative uncharacterized protein
  Pfam annotation: Domain name=Ceramidase_alk; Domain location=1-234; Score=-162.3; E_value=2.3e-13; Accession=PF04734.4; Description =Neutralalkaline non-lysosomal ceramidase
MAGRRLRDAVKMVLTSEEDFEFDDIHIVIAGLTNTYSQYITTYEEYQVQRYEGASTLYGPHTLSAYIQEFKKLAEALIYGEPVEPGPLPPDLLEKQISLLPPVVLDATPLGVNFGDVCADVPRNSTFKSGDMVTASFWSACPRNDLMTEGTFALVEFLQEKDAWIPAYDDDDFCLRYKWSRPSKLSSRSKGTLEWMIPQGVTPGVYRLSHFGAAKGLFGSIHHFTGSSTAFVVA

SEQ ID NO: 159091 - protein, 499 aa, Glycine max
  Coding DNA Sequence Number=SeqID_67406
  Gene Ontology: Mol. function=nucleoside-triphosphatase activity; Cellular component=nucleus; Biological process=cell division
  Homolog annotation: Hit_ID=A7NYI8; Match level="QueryCoverage=84%, HitCoverage=82%, E-value=1e-151, Identity=65%"; Hit description =Chromosome chr6 scaffold_3, whole genome shotgun sequence
  Pfam annotation: Domain name=AAA; Domain location=104-313; Score= -14.7; E_value=0.00037; Accession=PF00004.20; Description=ATPase family associated with various cellular activities (AAA)
  Pfam annotation: Domain name=Cdc6_C; Domain location=383-462; Score =55.9; E_value=1.4e-13; Accession=PF09079.2; Description=CDC6, C terminal
  Pfam module annotation: Pfam domain module=AAA::Cdc6_C; Domain location=104-313::383-462
  Subcellular localization annotation: CTP_CleavageSite=26; ConfidenceScore=5.35e-01
MPVIAAKRTLRSHPSSPPRKSPRRCTAATPNSTPTMNRFGADENRADPEAVKPKWNPKDGEQLKRVKLALHLSTAPSSVVCREEEQNVVLEFCKGCVEHQKAGSLYICGCPGTGKSLSMEKVKDKLLNWAKEAGLPQPDVLSVNCTTFTNTSDIFTKILGLNQTQGKKVSATPLQQLQNMYSQKSSNKNMTLIVADELDYLITKDRGVLHDLFMLTTFPFSRCILIGVANAIDLADRFLPRLTSLNCKPIVVNFRAYSKDQILKILEERLNELPYTVFQQQAMELCARKVAAASGDMRNALCICGRAIEMLEAEIRESACNLNTSLEEISSSRQNLATAPDFMKKREFETVRTDHMARALSKTYRSPVVDTIQSLPHHQQIVLCSSMKHFRGAKKDTILGELYKSYVGVCKSCIIPPAGILEFSNMCRVLNDQGLIKLGQSREDKLRRVSPKVDEGDITFALQISLFGSNRCLHYMKWYTRSVELKSLVQNFHPRSKSC

SEQ ID NO: 159092 - protein, 253 aa, Glycine max
  Coding DNA Sequence Number=SeqID_67407
  Gene Ontology: Mol. function=sugar:hydrogen symporter activity; Cellular component=membrane; Biological process=carbohydrate transport
  Homolog annotation: Hit_ID=Q59IV5; Match level="QueryCoverage=62%, HitCoverage=51%, E-value=4e-71, Identity=85%"; Hit description =Plastidic phosphate translocator-like protein2
  Pfam annotation: Domain name=DUF6; Domain location=85-225; Score=8.0; E_value=0.024; Accession=PF00892.11; Description=Integral membrane protein DUF6
  Pfam annotation: Domain name=TPT; Domain location=81-225; Score =171.0; E_value=3.1e-48; Accession=PF03151.7; Description=Triose -phosphate Transporter family
  Pfam annotation: Domain name=UAA; Domain location=14-231; Score= -140.0; E_value=0.0021; Accession=PF08449.2; Description=UAA transporter family
  Pfam module annotation: Pfam domain module=DUF6::TPT::UAA; Domain location=85-225::81-225::14-231
MAQDGAHANGAFEGAICEDIVAGTHILLVRGGGQHLPPLPSGVVQPGHRRHHAVLHGGVRLFDDPPEGGLAHGEPSFHLFGFIMCIAATAARALKTVLQGVLLSSEGEKLNSMNLLMYMAPVAVAFLLPASIIMEEDVIGITISLAREDSSILWLLMFNSALAYFVNLTNFLVTKHTSALTLQVLGNAKGAVAVVISILIFRNPVSVTGMFGYSLTVIGVILYSEAKKRGSIISSEENQRMGDVSARLDISRN

SEQ ID NO: 159093 - protein, 102 aa, Glycine max
  Coding DNA Sequence Number=SeqID_67408
  Homolog annotation: Hit_ID=A7NVD8; Match level="QueryCoverage=39%, HitCoverage=6%, E-value=4e-08, Identity=66%"; Hit description =Chromosome chr18 scaffold_1, whole genome shotgun sequence
MMVRGAIMFTQQSDIGGSTGDDKGLEKEDSGVGWKNGKDKCGEEGSEGSEESGGGGAEKDLCELSCYDSWASALITELDQFKNEKYKQMPSGSVNIDLMDES

SEQ ID NO: 159094 - protein, 82 aa, Glycine max
  Coding DNA Sequence Number=SeqID_67409
MVQMKIDNFNYTHGGTAEPAVEAAVEESDVGGGDVVGGAAEEVDGGVEDNVGGVNGGGRGVRRGLLGFVRCEAFEEKKSRVS

SEQ ID NO: 159095 - protein, 411 aa, Glycine max
  Coding DNA Sequence Number=SeqID_67410
  Gene Ontology: Mol. function=RNA binding; Cellular component =nucleolus; Biological process=biological_process
  Homolog annotation: Hit_ID=A7PGM2; Match level="QueryCoverage=53%, HitCoverage=100%, E-value=4e-96, Identity=80%"; Hit description =Chromosome chr17 scaffold_16, whole genome shotgun sequence
  Pfam annotation: Domain name=KH_1; Domain location=332-384; Score =25.3; E_value=0.00023; Accession=PF00013.20; Description=KH domain
  Pfam annotation: Domain name=Subtilisin_N; Domain location=1-86; Score=51.5; E_value=2.9e-12; Accession=PF05922.7; Description =Subtilisin N-terminal Region
  Pfam module annotation: Pfam domain module=KH_1::Subtilisin_N; Domain location=332-384::1-86
SYIVYLGWHSHGPNPSASDLEFATNPHYKLLGSHLGSHEKAKEAIFYSYNKHSNGFAVVLEEEHAQDIAKNPNVVSVFLNKGHELQTTRSWEFLGLESDGVVPKDSIWEKARYGEGVIIANIDTESETASNLRPPLLTVIAAALGNISFSVSDSTWYAITSALTYLRGMAAVSSAIVNRGKTPPLPVFVLRMESNQAASSMDVDTVPSEVKLLPPKPKFEPLKPHEMSDGQVQFRKVNVPPHRYTPLKKAWMDIYTPIYEQMKIDVRMNLKGRRIELKTRPDTPDISNLQKCADFAHAFMLGFDVIDAIALLRLDELYIESFEIKDVKTLRGDHLSRAIGRLSGKGGKTKFAIENASKTRIVIADTKIHILGSFSNIKIARDSLCSLILGSPAGKVYSKLRAVTARLAERF

SEQ ID NO: 159096 - protein, 219 aa, Glycine max
  Coding DNA Sequence Number=SeqID_67411
  Gene Ontology: Mol. function=RNA binding; Cellular component =nucleolus; Biological process=biological_process
  Homolog annotation: Hit_ID=A7PGM2; Match level="QueryCoverage=59%, HitCoverage=74%, E-value=5e-45, Identity=59%"; Hit description =Chromosome chr17 scaffold_16, whole genome shotgun sequence
  Pfam annotation: Domain name=KH_1; Domain location=136-191; Score =11.9; E_value=0.038; Accession=PF00013.20; Description=KH domain
MYWIAYKCFLYQEIDFFRHLLIVELSLPLYQKAVLSVLAAEWSQIWQLHPWKLRLSHLRPKFEPLKPHEMSDGQVQFRKVNVPTHLKKAWMDIYTPIYGQMKIDVRMNLKARRIELKTRPDTPDISNLQKCADFVHCSSALSSLRSRMLSGKGGKTKFAIENASKTRIAIADTKIHILGSFANIKIARLCLPRMRICDDDVVEAKGKREKDKGLANFRW

SEQ ID NO: 159097 - protein, 207 aa, Glycine max
  Coding DNA Sequence Number=SeqID_67412
  Homolog annotation: Hit_ID=A7QPD7; Match level="QueryCoverage=69%, HitCoverage=72%, E-value=1e-47, Identity=65%"; Hit description =Chromosome chr18 scaffold_137, whole genome shotgun sequence
  Subcellular localization annotation: CTP_CleavageSite=37; ConfidenceScore=5.28e-01
MSSMMEYSKNQNSRQPLLQQRRRRRGLVSLLPHLKPYLDAPSRLVSLSPRLIAGSSLVSSGLTMEAIVKKFQSKFRKVREEMSRWDELQSCLISQFRNASHIVDRLQVLQNSNNYGVLNCASGLKDALLVKQIESLRNILVSMRKTLEEFHCIVLSLDKIHRDSRQQVKGGSCHLNMKQLQQQIGIKPSLIYCLDSLMFIHEIYNSE

SEQ ID NO: 159098 - protein, 83 aa, Glycine max
  Coding DNA Sequence Number=SeqID_67413
MITGKDEEKEKENKGKEAIYDSDLGALQQLLVDQPNLQTEEVPAYFRKTGPDITLIQSRLCLNNIVPWSSALFYSFLSGVTII

SEQ ID NO: 159099 - protein, 71 aa, Glycine max
  Coding DNA Sequence Number=SeqID_67414
MLPQLQLEQLELSGDNFDSASELSSDGDDPLADDFLQGSNDDEGAVANTTTMLSRPWYWQNAALSLMIVAK

SEQ ID NO: 159100 - protein, 1450 aa, Glycine max
  Coding DNA Sequence Number=SeqID_67415
  Gene Ontology: Mol. function=binding; Cellular component=protein complex; Biological process=multicellular organismal development
  Homolog annotation: Hit_ID=A7Q9F7; Match level="QueryCoverage=90%, HitCoverage=75%, E-value=0.0, Identity=68%"; Hit description =Chromosome chr19 scaffold_66, whole genome shotgun sequence
  Pfam annotation: Domain name=HEAT; Domain location=1129-1165; Score =13.4; E_value=0.27; Accession=PF02985.13; Description=HEAT repeat
  Pfam annotation: Domain name=HEAT; Domain location=1290-1326; Score =18.4; E_value=0.027; Accession=PF02985.13; Description=HEAT repeat
  Pfam annotation: Domain name=HEAT; Domain location=611-647; Score =10.0; E_value=0.87; Accession=PF02985.13; Description=HEAT repeat
  Pfam annotation: Domain name=HEAT; Domain location=841-877; Score =10.1; E_value=0.84; Accession=PF02985.13; Description=HEAT repeat
  Pfam module annotation: Pfam domain module=HEAT::HEAT::HEAT::HEAT; Domain location=1129-1165::1290-1326::611-647::841-877
MGVGGPMHWSVLKLIDRGQYSKNEHLSETVAAATSILSYVEPSLVLPFVASRFRMALETMTATHQLKIAVMSVAFVGRSLFYTSVSASSMKPIDLGGGDETFIDLVGVSLSNALLGMDANDPPKTLATMQLIGSIFSNLALLDDKIDDLSFMPMIRFSEWLDEFLCRLFSLLLHLEPGSVINEGLQSSAATGTFLVDDGPYYFCVLEILFGRLSKSLYNQALKKISKFVRTNILPGAVAEVGLLCCACVHSNPEEAVSQLVEPILLSVISSLKGTPRTGFGGGGTFDASASSKVRSSISPALEASIDYQLKILSVGITYGGPAILRYKDQFKEAIFLAFDSPSWKVNGAADHLLRSLLGSQIHYYPIDQYKCVLSHPDAVALEEWISTKGFSTDEKLIPKWHIPCDEEVHFANELLDIHFKSALDDLLKICQTKIHADQGDEKEHLKVTLLRIESSLQGLFSCLPDFVPDSRNGMVEDSNHMFLIAGATGCTVGSTALREKATEVVHAACKYVLEKKSDDSILLILIIRIIDALGNYGSLEYDEWSSHRQAWKLESAAIIEPPINFIVSSHSKAKKRPRWALIDKAFMHNTWRSSQASYHLYRTSGNFCPSDHVTMLMDDLLSLSLHSYETVRLLAGKSLVKLIKRWPSMISKCVITLTHNLQDTNAKEYAVLGSCSVLASQTVLKHLTTDPKSFSSFILAILSSSHHESLKAQKAINELFVKYNIQFSGVSRSFFRISDKENHTGGLGFSDLVSQIGSMSFDSTGLHWRDKAKIEYIIEVQPSSHELAFGVELGPNSHSKMISELILDPLNETPAMYNLMANRVLLLLALASRNHPNSSSKILSETAGHFLKNLKSQLPQTRILAISALNTLLKESPYKLSHGEKSAVLEDLQDHVKSSLEGTLTQTFQEEGFFNETLTSLSHVHIITDTETASRGGQGDSSFQSLADKSITRFYFEFSASWPRTPSWISFLGSDDTFYSSFARIFKRLVQECGMPVVLALKGAVDEFIIAKERSKQCVAAEALAGVLHSDIDGLSGTWESWLMPQLKNIILAQSVESVSEWASCIRYAVTGKGKYGTRVPLLRQKILDSLMTPLPPTVATTVTAKRYTFLAAALIEISPQKMPVAEIQLHNTLLKEVLGNMCHSSAQVREALGVTLSILCSNIRLYHSSRHDNAQDERNDNVDSLMKDESWVQFLTERAAEAVVNIQIATQSDKVVNPVDSSSQNGHLDGDSQDDIKWMETSGRSSYLLDVLVGLLYPVICLQETSNKDLSTLAKVAFELLKWMIVWEPHLQKAVSVILTAANDSNWRTRSATLTYLRTFMYREHAAAVLAGLMKGGDEDLARDFHDRAYKEANIVQKRRKSRNASSGLSIASVHGAVLALVASVLSAPYDMPSWLPDHVTLLARFSGEPSPVKSTVTKAVAEFRRTHADTWNVQKELFTEEQLEVVI

SEQ ID NO: 159101 - protein, 43 aa, Glycine max
  Coding DNA Sequence Number=SeqID_67416
MKRKSLKSPVLQNTSTWPLVAKLKEKIKIWVMPVSKKKRWGIL

SEQ ID NO: 159102 - protein, 89 aa, Glycine max
  Coding DNA Sequence Number=SeqID_67417
  Subcellular localization annotation: CTP_CleavageSite=76; ConfidenceScore=5.30e-01
MDHLRFNALKGPPFKLLSFGTNVRGANTFLKGKYNSRIWNILHDRFPSVFPTFSTNKCWWRLRAFSSFGRCTREPRLAHPQKGDLVIPK

SEQ ID NO: 159103 - protein, 114 aa, Glycine max
  Coding DNA Sequence Number=SeqID_67418
EGQLRQNDAGNSDAQRANGAGNTGEWREPGIQRDGKADECRQQQQKSLRMKARKTACTDESMRLLFAGDDDIQAARRMRAEQESDKNGEFVMTGGTARMLITDAQAAGYLNPAD

SEQ ID NO: 159104 - protein, 85 aa, Glycine max
  Coding DNA Sequence Number=SeqID_67419
MNPGIGPLFYSNPRARRGSRVRFSKEEKSAELPPTFIGGKRQKNRRKPVIKIIPSSRVVFTFEEGQQKRGSCSYVPSIEEEIIPT

SEQ ID NO: 159105 - protein, 129 aa, Glycine max
  Coding DNA Sequence Number=SeqID_67420
MDYQEYQRSSHLSCADAQTRSSPTRQTRHSTDHPTNCQNLTISIKTLIAEIKMFMNYTPSYKKTWTHPISFACVTLHKTFFTVMHTRRRCTGDILGIFVRISQVQLNGLINYPNKNGYNALMRGNIGDI

SEQ ID NO: 159106 - protein, 594 aa, Glycine max
  Coding DNA Sequence Number=SeqID_67421
  Gene Ontology: Mol. function=electron carrier activity; Cellular component=integral to thylakoid membrane; Biological process =electron transport
  Homolog annotation: Hit_ID=Q1KVS1; Match level="QueryCoverage=45%, HitCoverage=83%, E-value=1e-109, Identity=72%"; Hit description =Apocytochrome f precursor
  Pfam annotation: Domain name=Apocytochr_F_C; Domain location=513-594; Score=108.1; E_value=2.7e-29; Accession=PF01333.10; Description =Apocytochrome F, C-terminal
  Pfam annotation: Domain name=Ribosomal_S2; Domain location=1-152; Score=143.1; E_value=7.7e-40; Accession=PF00318.11; Description =Ribosomal protein S2
  Pfam module annotation: Pfam domain module=Apocytochr_F_C::Ribosomal _S2; Domain location=513-594::1-152
KQAGGLIAKTASDSNSFYVNQRWLGGMLTNWSTMKLSIAKLKELEARETDGGLDRLPKKEAALCKKQKERLEKYLGGVKDMMRLPDVVVIVGQPEEMNAVRECRKLGIRSITVLDTNCDPTVADLFIPANDDSVTSLRFLLQIFSDAILKGQNLACPFNETPLGVGVHCEAMQPRPTERLWAWAPASVRRVRPVRQGRFAERFRRPVHPIGMQGRREKPEERATDKTKHHNVSARRWGTGEPILVLPGNKLLFNETGGEAVSSRPHRPHRPHRGRPHRPHRPHRFRHGFRRFEQASQAQGRSVGRARCFAEPLELLLPVESRIRSTLLALGMVVLIGLSANQPAQSYPVFAQQNYANPREANGRIVCANCHLAQKSVEIEVPQSVLPDTVFEAVVKIPYDQQVTQVLGNGKKGGLNVGAVLILPEGFSAAPADRIPEEMKAKAGKLYFQPYASDKKNILVVGPVPGKKYSEMVFPLLSPDPSKDKNVSFLKYPIYLGANRGRGQVYPDGSKSNNTVFNASTGGTISQIQPVEKKGGFEITIETGNGEPIVDKVPAGPDLIVKVGQTIQADQPLTNNPNVGGFGQKDTEIVLQNP

SEQ ID NO: 159107 - protein, 148 aa, Glycine max
  Coding DNA Sequence Number=SeqID_67422
MNGGRMLNPDTSVKVFFEHEIDMVAAFMDEIDGVQIHLSSLDYLTWRADPTGSYSTKSAYNLLMGDGSSDNEDKNNCWKRRAKPNGYTTRSAYLLMQGEATEENSDGVFTELCKLQIPPKAAIFAWRLVKDRLPTKLNLRRRQIQLKG

SEQ ID NO: 159108 - protein, 95 aa, Glycine max
  Coding DNA Sequence Number=SeqID_67423
  Homolog annotation: Hit_ID=A4EB57; Match level="QueryCoverage=53%, HitCoverage=31%, E-value=1e-09, Identity=58%"; Hit description =Putative uncharacterized protein
MIARGANGIRYPSNPSGKQWILGVVRIDPCIAVANTLSIPPGEYTVGDKPEEGEDDVKSSCPFFPGQHKCYNGRDKGSRSHEGELTPKTYPQFRL

SEQ ID NO: 159109 - protein, 163 aa, Glycine max
  Coding DNA Sequence Number=SeqID_67424
MPIGTSSQRLNLIRKHEVDSLKGSLIPNSKDRTLDLGNWHIKRNLRGRDNSCNLTPSFANLFGDSLRLLPLDSKGILRSLHERLTSDVPYYHNCLWPSPTSSWSNEFSYQMCKCKPQESKLKRKISHSLIYMDFIGLVTMSGGKRAMKERIKEAQRVFKGYIE

SEQ ID NO: 159110 - protein, 98 aa, Glycine max
  Coding DNA Sequence Number=SeqID_67425
MGSKIYHEVHENTKAFFSSSSSILLDPLAHGSGNWSLPREDCINSIVTGSILTVSQARSHVSNDNSLWHMCLSQMSEMDETFKGSAYQKGRLDCVHSD

SEQ ID NO: 159111 - protein, 118 aa, Glycine max
  Coding DNA Sequence Number=SeqID_67426
MQTKIRPMKKMINAEHQEKHNQLGEQAVTTTNKHPKWPSSKQKEGRRRRITYLEGEEEGRSSNNRKKREENEEGTVMVTATTTEVTTRSRRKARHDQQQQNTEPKRKEKGEQRKINSD

SEQ ID NO: 159112 - protein, 67 aa, Glycine max
  Coding DNA Sequence Number=SeqID_67427
MAQPPPRERTLMEMVAPDFTYESLCIQYPDEGEDPHKHLKEFHIVCSTMKPPDVQEDHIFLKAFLNL

SEQ ID NO: 159113 - protein, 128 aa, Glycine max
  Coding DNA Sequence Number=SeqID_67428
MKADMEAMKEQMTTMMEAMMSMRKMMEVNTTTVVVASTATEVDLTHPSGLNQVNRPASNMVGQGGEALGSAGGPHFMQVQSKHSFPRYGCRQRIKLNVLMMPKFHMRLKALFKTKKLKIFKTDDQDSL

SEQ ID NO: 159114 - protein, 145 aa, Glycine max
  Coding DNA Sequence Number=SeqID_67429
MSKNKVLKEHNKTFVNWFKDIIFGDDNAFEMLRKLANGPKRNVITWQGYGINNFQSQMQLQMQSQGLTLPLEVEVGPSSARVSIKESCVDPLGQDPKIKDSDKCGLYVDESLPRLVVVGRVYEGSTIVRNIPLGNDQVKVGVEDV

SEQ ID NO: 159115 - protein, 91 aa, Glycine max
  Coding DNA Sequence Number=SeqID_67430
  Subcellular localization annotation: CTP_CleavageSite=60; ConfidenceScore=5.18e-01
TYQGNPCGVYPDLSSFTGSGVYRDLSSFTGSFLHRKWCHPNSITCIKRFAPTQRAFLNKNCAMSDEKYQSGLFHDRCRLLSFLFNPWMKYA

SEQ ID NO: 159116 - protein, 137 aa, Glycine max
  Coding DNA Sequence Number=SeqID_67431
MAKYDPEIVMEFYANAWPTEEGEESGLGLPRGGHQPAVVHSGTGLCSEHSGEMGFPMPKCQLVYAILTQVRVHVAQLISDAMYQFAGITPPRHPVDPEKSNMALGFPTLITGLCQFNGVSVNPTKLLDKCGLNYLKK

SEQ ID NO: 159117 - protein, 67 aa, Glycine max
  Coding DNA Sequence Number=SeqID_67432
MANNVFASCPYFRDLYGRELKGFFVIIPKVVISLLMVSRGIIPFEEHIAAVGTTSNNMLSKRKTLDE

SEQ ID NO: 159118 - protein, 205 aa, Glycine max
  Coding DNA Sequence Number=SeqID_67433
  Gene Ontology: Mol. function=zinc ion binding
  Homolog annotation: Hit_ID=Q1SKU8; Match level="QueryCoverage=39%, HitCoverage=11%, E-value=4e-12, Identity=45%"; Hit description=FAR1; Zinc finger, SWIM-type
MTTTGRSESINAFIKRFINSHTSLSDFTKQVDVAIDDIKQKEDHDIMLEKCKRINLKLMSPLQEQAHGVLTRFAFQKFQEEFESIFLHKDCHEIPSNYLPSRWRLQTSHDDDEVDPQQVNVVFEEQVDVVHCPPPSKTKGRPKRRRLKGGKELSHNMNTCGLCKDVGHNIVTCPLKENTQFSGHTNKKKKICKDANLNPILLPKV

SEQ ID NO: 159119 - protein, 48 aa, Glycine max
  Coding DNA Sequence Number=SeqID_67434
MKKQKWKRSGRQRRRGKRRRHPLGNKPWKKELHHQDEPWIRSLERMLQ

SEQ ID NO: 159120 - protein, 45 aa, Glycine max
  Coding DNA Sequence Number=SeqID_67435
MFLMRGNTCTWGDVTQFGTSFETQADHHGGAELFVHDRVTSTLVA

SEQ ID NO: 159121 - protein, 94 aa, Glycine max
  Coding DNA Sequence Number=SeqID_67436
  Subcellular localization annotation: CTP_CleavageSite=56; ConfidenceScore=5.57e-01
MWKPSTKENKRGWPSPLLMKTLVWTTLAFQGKSRRSRLNNRRRRKRRNSPKGLGSSSSMDSFASWKMNGNKMEKEEREETPLQGEDESRRSSPP

SEQ ID NO: 159122 - protein, 166 aa, Glycine max
  Coding DNA Sequence Number=SeqID_67437
MHPTDIQSLTDDLSSVSKLHEQMYLHDQALAYPSSLHISRAIDIKMVVDRVYPRLPVWDVSKKKGFEMYYKEQMPSWQMKLIRTPDAHDARTFWSKIELMVFKNPQPLAMMKVILLCTATLFKCYDLLGSITLIMLASGSPKMMTVTPSSKVFSSFPPFNMKEPIT

SEQ ID NO: 159123 - protein, 289 aa, Glycine max
  Coding DNA Sequence Number=SeqID_67438
  Gene Ontology: Cellular component=nucleus; Biological process =regulation of transcription, DNA-dependent
  Homolog annotation: Hit_ID=A7P3T6; Match level="QueryCoverage=84%, HitCoverage=64%, E-value=2e-55, Identity=51%"; Hit description =Chromosome chr1 scaffold_5, whole genome shotgun sequence
  Pfam annotation: Domain name=CCT_2; Domain location=237-263; Score =52.3; E_value=1.7e-12; Accession=PF09425.1; Description=Divergent CCT motif
  Pfam annotation: Domain name=tify; Domain location=107-142; Score =67.2; E_value=5.7e-17; Accession=PF06200.5; Description=tify domain
  Pfam module annotation: Pfam domain module=CCT_2::tify; Domain location=237-263::107-142
MERDFLGLSSKEPLAMMKEEMNIDIGSKDTGMNENEVYDGSFVVPNQAISVSMGHPSLKNHFATVGQNMNVATVKQPLLGGIPVTVPHSVHPIVGAVAGMTETRVKPSVPAPKLTIFYAGTVNVFEDISPEKAQAIMLLAGNGLSAGSNEASPNVQAPCLKLAVGDGVPVSQPIPPCSGLSSPSSVSSHTGSPSGSGSSSNDEFLAAKTSGGTTSSVNKVETPKVVNTTTMLTSAVPQARKASLARFLEKRKERVMNAAPYNLNKKSENVPQQNTMVSNITASAGDYFR

SEQ ID NO: 159124 - protein, 145 aa, Glycine max
  Coding DNA Sequence Number=SeqID_67439
MTDVESNRAVVQEKEGEASREKNVKVRRTSPPANEPSPQPRPVSEAPSWGHHTERTQNRPPRLKGTLTKKPDVHCGSFTETKTMQGRPCRRTQWSSGHASCDEGYWKGNRCEEFNEFYYIKFWVVVVGENWLENQKEGEILEFED

SEQ ID NO: 159125 - protein, 113 aa, Glycine max
  Coding DNA Sequence Number=SeqID_67440
MVTGGHMGIMKTLVRVCKNFTWTGLRKDVQTFLAASRTIPIKWNKATHEFCIPPDVAPCEACRPWIFFINGVLCFLKIMAAEWRRRKGDWRLHFKEKMSQKQAHHYRKPWIRA

SEQ ID NO: 159126 - protein, 30 aa, Glycine max
  Coding DNA Sequence Number=SeqID_67441
MKAVVSRLRNNEGYGLGFQAWSEAPKDQEL

SEQ ID NO: 159127 - protein, 215 aa, Glycine max
  Coding DNA Sequence Number=SeqID_67442
MGQEGITVDKDMIKEDGCEFPQQFWQCPHQPLISGGIPAEYARSRHQRLFEENVGKTGKDVIYELLSESTGEDKGLWLTRMRPESRRKEVDVVGDLAWRGKGGWFEEDGGGSGCGLECTERWNKVEVELVWIIHRSCLGDEERLYLGQGKVEELCNTWLDEAMCATIIDKDSDSSVIDEVVHSKVARSGGFEGGESGGGARGMVAVQDFIFLEFG

SEQ ID NO: 159128 - protein, 265 aa, Glycine max
  Coding DNA Sequence Number=SeqID_67443
MAPKKLPAKRSRKDATGEGSSAAPQADVDFDRHRFRSVEHQQRFEAIKGCSFLRERRWIPFDEHAINQFLGHPPVLEEGQHCEFSQRRSQASGFDEEAINRLLCVPRQDFAQSVVGRRVSVHVAQLISDVIYQFARITPRRHPVDPEKSNRALGFPTMITGLCQFCGVAGQASQQPNEDQQQPATDAPPPPLQEAANHRGQVQLNDTFYWYNMHQQSQDPHPFPWPTLDQFGATVASPGDWVNFETRLGPVGAPGGCWIKWPRNN

SEQ ID NO: 159129 - protein, 82 aa, Glycine max
  Coding DNA Sequence Number=SeqID_67444
  Subcellular localization annotation: CTP_CleavageSite=17; ConfidenceScore=5.06e-01
SSPSFLSKAHLGGEAPSSMAYSLVDGASSHLFSFVFRYISMVDEERKGEEEVALSSRISRALSEILRELNKKVPGALIKTRL

SEQ ID NO: 159130 - protein, 93 aa, Glycine max
  Coding DNA Sequence Number=SeqID_67445
MANNPSSAQKKEKTSKRKQAQGLLKLVQMKETFYQELVKVFYTYAHADLEGNLFSTIIGVDMVIDTTVWKEVVGLDMGGARKFDETPNEYNKM

SEQ ID NO: 159131 - protein, 212 aa, Glycine max
  Coding DNA Sequence Number=SeqID_67446
MAPPKEISIIVHHNGQIVDNSVHKSMYSCANPIFLYLIPQPQPQLPSPQPLLYNNLEIQNAFDIYTSYSQLLSQNDSFLCPTNLISPTKLSFITIFYNITPSQQPQTQISNPNEYSITNEDPIIRFHEENMIDFSEHEDQELFHHNNDQSDDEGVVIPTSPPLQYHQPKCPVELNIDHLPRYIDHHHFVQQQDRVQPPTSALRVGMTFNEKA

SEQ ID NO: 159132 - protein, 76 aa, Glycine max
  Coding DNA Sequence Number=SeqID_67447
  Gene Ontology: Mol. function=phosphoric ester hydrolase activity; Cellular component=cytoplasm; Biological process=carbohydrate metabolic process
  Homolog annotation: Hit_ID=Q9XF47; Match level="QueryCoverage=76%, HitCoverage=17%, E-value=2e-21, Identity=84%"; Hit description =Fructose-1,6-bisphosphatase, cytosolic
MENVQERYVENFKYPKDGSSPKSLRYIGSMVADVHRTLLYGGIFLYPADKKSPNGKLRMLSHQFNLMEMVILGKEL

SEQ ID NO: 159133 - protein, 116 aa, Glycine max
  Coding DNA Sequence Number=SeqID_67448
MKVDMEAMKEQMTMMMEAMMSMRKMMEVNIATTIAASTAIEKDSIHPPDFNQKGRPVLNVAGQGGKAMMNAYGPHYVQERLRAIEGGGNYGFVEISELCLVPDVVIPPKFKVSDFW

SEQ ID NO: 159134 - protein, 59 aa, Glycine max
  Coding DNA Sequence Number=SeqID_67449
MSDIEQVMQSYTARALDRRLQEDWARDAREGPRVLMSLRGEVGVGIGQAGSQGPTTWPT

SEQ ID NO: 159135 - protein, 60 aa, Glycine max
  Coding DNA Sequence Number=SeqID_67450
MAVEWRRRKGDWRHHFKEKMSQEQAHHHRKPWIRAWTQLIQDQVQDSSLSVLRCHEACKA

SEQ ID NO: 159136 - protein, 48 aa, Glycine max
  Coding DNA Sequence Number=SeqID_67451
MAKRFQEDWTKDAGEGPRVLMSLRGSIVQGGYPSNVGFFIPCILGHLD

SEQ ID NO: 159137 - protein, 127 aa, Glycine max
  Coding DNA Sequence Number=SeqID_67452
  Gene Ontology: Mol. function=calcium ion binding; Biological process =response to abscisic acid stimulus
  Homolog annotation: Hit_ID=A7P3U1; Match level="QueryCoverage=89%, HitCoverage=62%, E-value=1e-40, Identity=65%"; Hit description =Chromosome chr1 scaffold_5, whole genome shotgun sequence
  Pfam annotation: Domain name=Caleosin; Domain location=2-119; Score =142.2; E_value=1.5e-39; Accession=PF05042.4; Description=Caleosin related protein
MRKSPNQHLFQNGTYEGKFPSILLPIEVQNIHRSKHGSDSGVYDSEGSKHARTHPNSLTSDELMGMLVANRVPKDYAGWLASYTEWKILYVLGKDKDGLLHKETIRAVYDGSLFEKMEKEHSDKKAK

SEQ ID NO: 159138 - protein, 78 aa, Glycine max
  Coding DNA Sequence Number=SeqID_67453
MLIDVGSALACACCVCSWGAKCTDLPGSLALALGHIHTLDVVYVRGGQSALTFQGFWHLLWATFICRIECMSWGGGIL

SEQ ID NO: 159139 - protein, 50 aa, Glycine max
  Coding DNA Sequence Number=SeqID_67454
MDHLALLWPQGNELSSDVSRLTIEYDGEQLSLGQLSGPNQPEMQGLSAKR

SEQ ID NO: 159140 - protein, 366 aa, Glycine max
  Coding DNA Sequence Number=SeqID_67455
  Pfam annotation: Domain name=Transposase_23; Domain location=74-144; Score=-11.3; E_value=0.021; Accession=PF03017.5; Description =TNP1ENSPM transposase
MTTDKLVEIIGSIKQELRKEVEDENKWIIDIMQKQLDAIKSEPSIPDVLDARVSTKESCAEAAANVVAKERSTLDASIVRLYIVCGNSTQVVALGKMYRVGGIIHNVAYADDVVRVCVETIYDGDASVPFPTAEIQYVRDTSSTFIAWPKHLVKPIADDSNHNVHLPLRRLGEAEVAAEADPLGELMKTLFCVYKNPVEVSWEATQFGLPNVGAKFFITHADLAEIISGDKCLNISILQLWTMAHWQLFVLCPRENMIVWFCSLRKKPDINIKAAINSTMKTITSSSEGMSNQAAPRWVEPKSHVQTGGYECGYYVMHWMWCIVTGGLKDDWNKWFSDGSPLDVEAITTLRQKWATFFLSIRKSRC

SEQ ID NO: 159141 - protein, 136 aa, Glycine max
  Coding DNA Sequence Number=SeqID_67456
  Gene Ontology: Mol. function=transferase activity; Cellular component= plastoglobule
  Homolog annotation: Hit_ID=Q9ASX5; Match level="QueryCoverage=80%, HitCoverage=26%, E-value=1e-25, Identity=48%"; Hit description =Uncharacterized aarF domain-containing protein kinase At5g05200, chloroplast precursor
MGLIGNATAPKVYQYCSTKKVLTMQRLYGVPLTHLHSISSLVSNPETSRITALNVWNCWSYIPYNLGCYGSLLRTTAIEDYASMTSSLIEMGATNQDVHAKAFVKDLEKSECVLLLIFLHYLCVLCNSRNWTLKYL

SEQ ID NO: 159142 - protein, 201 aa, Glycine max
  Coding DNA Sequence Number=SeqID_67457
MALGSDQTPGEADRCHSEGRTLKYCRVRGQVIRFDVETINDFLDTPVILVDREGYPAYSQYLSIYPDHQAIAATLCTTGGKFVLNVDGAQEVVSNTLIFESLSHVINLAYIKKNCVHFSTTRRAQPDAPVLILGIADHHPGPASAVSSPVDGPAAHDSRGLHSGGEPSGAEDDASIDEDVIADLAATNWGPWSDFGGDTSP

SEQ ID NO: 159143 - protein, 58 aa, Glycine max
  Coding DNA Sequence Number=SeqID_67458
MSFEEAKLHSESKVIQRCFDDNNDDEKGDDKEQLKDQSRTIQEFKIRIKKNSRFKKKV

SEQ ID NO: 159144 - protein, 83 aa, Glycine max
  Coding DNA Sequence Number=SeqID_67459
  Gene Ontology: Mol. function=small conjugating protein ligase activity; Cellular component=nucleus; Biological process=regulation of protein metabolic process
  Homolog annotation: Hit_ID=Q45W76; Match level="QueryCoverage=59%, HitCoverage=30%, E-value=8e-21, Identity=93%"; Hit description =Ubiquitin-conjugating enzyme 2
MNFFQTSILGRKALYGRGRGNCRTLRGVKIPRNFRLLQELERGEKGIGDGTVSYGMDDADDIYMQSWTGTIIGPPGVSCSLLF

SEQ ID NO: 159145 - protein, 200 aa, Glycine max
  Coding DNA Sequence Number=SeqID_67460
MVDHCSLGDDLGSLPRYCIFNVYLIRVRPRSNLAPLLGSSRPKCMTRGNLGDLQPFDPEIDRTFHRLVRHSVYPDHSVHFEHCEHLEHSEYSIASDSEYSNFEHSTTNFCTENMAQLPPRERALRMMAAPDFTYESLCIQYPDEGVPYVLKTGLIHLLPKFHGLAGEDPHKHLKEFHIVCSTMKPPDVQEDHIFMKKRMR

SEQ ID NO: 159146 - protein, 205 aa, Glycine max
  Coding DNA Sequence Number=SeqID_67461
MYLPIPQAFKIVETDAFDIGYGGILKQRVLNQEHNTSRAPQILYLTISPVNFYRKTVMPPKATGTSLRGDRSSGKSFKLALPESPIKKSSSTSSGSPTQTGSFTQKSKIEGSSIQIVTIKPNSSTQESPKPATGKQIAVDYAWSIQTLQALQEMGLAKLPQLTKKTWADMASESDDDSETSLQNIIQDSKNSKTIVDSKGKQTLS

SEQ ID NO: 159147 - protein, 177 aa, Glycine max
  Coding DNA Sequence Number=SeqID_67462
MAHENPRAFSCIFGPIFLESSIQCPWGARLPLVDKGADDDVSHCMLPDPLIRQALENVVFHLLAKPICWLNERPLSATLLGYARGRIQKTMSYTGSLSAPLQVIKRTASAHPLSERSALSQNPVMCTKRTSTNKATYLSLKLDFVNRVWTGIQSFACLGFLERERSKFQRVLRDFAV

SEQ ID NO: 159148 - protein, 37 aa, Glycine max
  Coding DNA Sequence Number=SeqID_67463
MGAKHLTRTKEWSHVIEQRSPDEIRVIDYQRVITLVT

SEQ ID NO: 159149 - protein, 79 aa, Glycine max
  Coding DNA Sequence Number=SeqID_67464
MPHLEPHYDLEFRLTPIGYDNQGNVLSYRMELVRIVEVIKDRGDHSDMKTKEIEEYKELLCQLEPSSENEYDDLPKVMS

SEQ ID NO: 159150 - protein, 29 aa, Glycine max
  Coding DNA Sequence Number=SeqID_67465
MSGKIPIDVRSCKPNKVHAPCGIVVVIIE

SEQ ID NO: 159151 - protein, 136 aa, Glycine max
  Coding DNA Sequence Number=SeqID_67466
MELGLRWEALNGNFSNMLLGITFRLEPLSMSTLAITCFMHLTDICKALLCPLGGDFLFSEGEVVVSCDVIDNSPKAFYGDVLGYVSFIQDLYQQSSMRLRAHEQCRNLPFGGRATRDSRDACSTKGIRAESPPTFI

SEQ ID NO: 159152 - protein, 162 aa, Glycine max
  Coding DNA Sequence Number=SeqID_67467
MVTTRGLVRALGRVIGRALGREVSGDADEAPQRRRPTTSAHRQWEAAPIDEDVERLDYAVDEIQEQPEGATTDDAVTHAEGFLGRPHDTSFFMDYVHHVAVTVWNEEEHSELKLSSHGRKVEKFGRPAPKIEDLVATIGLSPLIACSLDTNDRRLISAFAER

SEQ ID NO: 159153 - protein, 143 aa, Glycine max
  Coding DNA Sequence Number=SeqID_67468
ALAQSSWSLLLMVLVIGPFLGRIASGCDSSHLNLNFNVQRHCKLHDESRLIQRCFDDNKDDDKGDDKKLKGQSKNEFKMFKIESRTLQDSRGKLKKIESRTLQDSRGKLKNTSRFKRKVDFKNQESRFKIQESREGLIKISMK

SEQ ID NO: 159154 - protein, 153 aa, Glycine max
  Coding DNA Sequence Number=SeqID_67469
MDASVIGYGDILKQRVNSQEHVIAYTSKHWNPAQLNYSNSISRAPQTLYRTTLPMNSYRKVAMPPKATGTSLRGGWNPSRSLKLALTEPNTKTNSSDSPIQLRSSTQKIKKEGSSTQIISVKPESFAQEPPKSETAKQTSTDYAWSIKTLQAL

SEQ ID NO: 159155 - protein, 453 aa, Glycine max
  Coding DNA Sequence Number=SeqID_67470
  Gene Ontology: Mol. function=1-deoxy-D-xylulose-5-phosphate synthase activity; Cellular component=cytoplasm; Biological process =isoprenoid biosynthetic process
  Homolog annotation: Hit_ID=Q6D844; Match level="QueryCoverage=57%, HitCoverage=42%, E-value=1e-133, Identity=90%"; Hit description=1 -deoxy-D-xylulose-5-phosphate synthase
  Pfam annotation: Domain name=TPP_enzyme_C; Domain location=292-410; Score=-46.7; E_value=0.044; Accession=PF02775.12; Description =Thiamine pyrophosphate enzyme, C-termina
  Pfam annotation: Domain name=polyprenyl_synt; Domain location=1-206; Score=195.5; E_value=1.3e-55; Accession=PF00348.8; Description =Polyprenyl synthetase
  Pfam module annotation: Pfam domain module=TPP_enzyme_C::polyprenyl _synt; Domain location=292-410::1-206
MDDDALRRGQPTCHIKYGEDTAILAGDALQTLAFTILADQPMPGVSPQDRIAMISELAQASGVAGMCGGQALDLAAEGQSVDLNQLEQIHRHKTGALIRAAVRLGALTAGAAGREALPQLDIYANAIGLAFQVQDDILDVVGDTAVLGKTQGADQALGKSTYPALLGLDNARAKAQDLYREALGALEVLAAQSFDIAKYPTLALAGTVQELRLLPKEKLPDLCDELRQYLLDSVSRSSGHFASGLGVVELTVALHYVYNTPFDHLVWDVGHQAYPHKILTGRRDRIGTIRQKNGLHPFPWRGESEYDVLSVGHSSTSISAGLGMAVAAEREGKGRRTACIIGDGAITAGMAFEAMNHAGDIKPDMLVILNDNEMSISENVGALNNRLAQILSGKTYSRLREGGKRVLGGLPPIKELVKRTEEHLKGMVVPGTLFEELGFNYIGPVDGHDVLTL

SEQ ID NO: 159156 - protein, 17 aa, Glycine max
  Coding DNA Sequence Number=SeqID_67471
MDFTKIVEISSGLLEYW

SEQ ID NO: 159157 - protein, 92 aa, Glycine max
  Coding DNA Sequence Number=SeqID_67472
MQTRQLFCTLVGISSSLSFLITMRPVFLGTTWTRLTHWLLEMGVATYPFVGERGEAHRSTKAGLLLLRTLHRRGDQTYVVLSKGANQAILFT

SEQ ID NO: 159158 - protein, 102 aa, Glycine max
  Coding DNA Sequence Number=SeqID_67473
MAGSDIAIIRDRAHIPTNKSLLELTSQDALLAQNKLQGVPSVVELTILAVVSPMKNQLMKLIRQVCEVLILICSLSQSADSASHPLSATLLWLSKRKNLEEG

SEQ ID NO: 159159 - protein, 281 aa, Glycine max
  Coding DNA Sequence Number=SeqID_67474
  Gene Ontology: Mol. function=motor activity; Cellular component=cell projection
  Homolog annotation: Hit_ID=UPI00016621D1; Match level="QueryCoverage =97%, HitCoverage=40%, E-value=2e-17, Identity=31%"; Hit description =UPI00016621D1 related cluster
RATRLAFVGLHVLGFRGLHVLTFRGLHALTFRGLHVLAFRGLHVLTLGGLHVLPFRGLYALAFEALHALTFRGLHVLAFRGLHTLPFRGLYALTLVGLHALTFRGLHILAFRRLHVLTFRGVHVLPFRGLHALAFIGLHALTFRGLHVLAFRGLHALTFRGLHVLTFRGLHALTFRGLHALAFVEDYTSSASEGYTSSPSEDYTYASPSEGYMSSPSEDYQSSPSRLHVLAFRGYVLTFRGLHALAFRGLHALTFRELHVLAFRGLHVLAFRGLHVLSCED

SEQ ID NO: 159160 - protein, 53 aa, Glycine max
  Coding DNA Sequence Number=SeqID_67475
MAFFLSYTKAKTTFREDPMVNEGWAAFLPRQLHVVFSKSFIKRLSPEASSWLL

SEQ ID NO: 159161 - protein, 86 aa, Glycine max
  Coding DNA Sequence Number=SeqID_67476
KELRRSDFLIPIEEYVGAKSLMTGVWGANTFPVRKYNSRAFHLKVRRLRLFRLFRHFPQINVCGDSARIPFMEHASRESRVALPPK

SEQ ID NO: 159162 - protein, 112 aa, Glycine max
  Coding DNA Sequence Number=SeqID_67477
MTRGNPGDLQPFDPEIDRTFHRLVRHSMHPGHFVHCEHSEHFVEGDSDFEHSTTNFYTENMAQPPPRERTLREMTASDFTYESLCIQYPDEGVPYVLKTGIIHLLPKFMVLQ

SEQ ID NO: 159163 - protein, 474 aa, Glycine max
  Coding DNA Sequence Number=SeqID_67478
  Gene Ontology: Mol. function=nucleobase transmembrane transporter activity; Cellular component=membrane; Biological process=nucleobase, nucleoside, nucleotide and nucleic acid transport
  Homolog annotation: Hit_ID=A0QXR9; Match level="QueryCoverage=64%, HitCoverage=67%, E-value=2e-92, Identity=54%"; Hit description =Cytosine permease, putative
  Pfam annotation: Domain name=NnrS; Domain location=111-412; Score= -244.5; E_value=0.042; Accession=PF05940.3; Description=NnrS protein
  Pfam annotation: Domain name=Transp_cyt_pur; Domain location=149-474; Score=-104.7; E_value=7.3e-05; Accession=PF02133.6; Description =Permease for cytosinepurines, uracil, thiamine, allantoin
  Pfam module annotation: Pfam domain module=NnrS::Transp_cyt_pur; Domain location=111-412::149-474
MRQMQSELGAAMSPHLSAMLQRDWRAEHFTDANTTRKKLCNQLWRFMQRYDLLLSPTLAVPPFALHMQGPEVIDGRMVRSDHWLSFCFPFNFTGQPAASVPAGFTASGLPIVPLLSASNHGIITILLLLEFSMSNKSSPALEQEFEHEPVPLSHRHSTGSVSAVWFGFPMILTNALFGGIITWHLGFWPALLAILLGNLVLFAYVGALSWFAGHTGMNFALQAKRTFGTKGYILVSGFLSTVVIGWYAFQTGLTGTVINQTFGWNALAVTAFAMVLYTGVTFLGVRALSVLGMIAAPLFVVLGLVALWLVSKDHDFTTLTQWQGSPAAAGAMSMGTAVTMVIAGFADSGTMTADFTRWSKDGKSAVIAAFSAFPLANVISYLFGVVIVAVGAAVDPLSNGGNFLPLLMGHGMLLSVIAFLFVFINLGSVCTHCLYNGAVGFSHLFSSKNAPVDADPSGPSVACWRWPACGLWIL

SEQ ID NO: 159164 - protein, 368 aa, Glycine max
  Coding DNA Sequence Number=SeqID_67479
  Gene Ontology: Mol. function=binding; Cellular component=mitochondrion
  Homolog annotation: Hit_ID=A9PHB6; Match level="QueryCoverage=70%, HitCoverage=53%, E-value=7e-91, Identity=67%"; Hit description =Putative uncharacterized protein
  Pfam annotation: Domain name=PPR; Domain location=178-212; Score=8.2; E_value=0.82; Accession=PF01535.11; Description=PPR repeat
  Pfam annotation: Domain name=PPR; Domain location=213-247; Score =26.6; E_value=9.2e-05; Accession=PF01535.11; Description=PPR repeat
  Pfam annotation: Domain name=PPR; Domain location=289-323; Score=4.6; E_value=2.2; Accession=PF01535.11; Description=PPR repeat
  Pfam annotation: Domain name=PPR; Domain location=324-358; Score=2.8; E_value=3.6; Accession=PF01535.11; Description=PPR repeat
  Pfam module annotation: Pfam domain module=PPR::PPR::PPR::PPR; Domain location=178-212::213-247::289-323::324-358
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPVALKELEKRNAFKDLTAYQFLITLYGRTGNLYEVYRVWRSLRLAFPKTANISYLNMIQVLVNLKDLPGAEKCFREWECGCPTYDIRVANVLIRAYVKLDMLEKAEELKERARRRGAKPNAKTLEIFMDYYLLKGDFKLAVDYLNEAISMGRGNGEKWVPSSRIISIMMRHFEQEKDVDGAEEFLEILKKSVESPGVEVFESLIRTYAAAGRISSAMQRRLKMENVEVSEGTQKLLEAISVE

SEQ ID NO: 159165 - protein, 120 aa, Glycine max
  Coding DNA Sequence Number=SeqID_67480
MVRTRASAPRQREVAPVSEDAADISEDVPAPGAEAVDGVEGFVVDDVEGFPGGSHDPLVLTEYGDHVAFSIWNGEERPELKLSSHGRKVEKLGRPAPEIEGLVTATRLTPLCWNKWPRNN

SEQ ID NO: 159166 - protein, 207 aa, Glycine max
  Coding DNA Sequence Number=SeqID_67481
  Gene Ontology: Mol. function=metal ion binding
  Homolog annotation: Hit_ID=A7PNQ2; Match level="QueryCoverage=40%, HitCoverage=22%, E-value=2e-18, Identity=54%"; Hit description =Chromosome chr8 scaffold_23, whole genome shotgun sequence
MVWWQRWGLARRCLEVESMLAESLVSMGASNSTTIFGGYWTNITILKQGGCAKRYLINIRGSKANLACYTCFVLIHEQNNIVCWRCHDDFVEHVTSPNASTSDEENNFELNYDDFNSKGLCPLPSTMSKFLLGLVFDWLLEQVLQIEINGLGRAENPSTSKAVIESMPTVEITESHVVLHPPRLDLNSTTPLAQQRATQINNNLDLK

SEQ ID NO: 159167 - protein, 126 aa, Glycine max
  Coding DNA Sequence Number=SeqID_67482
  Gene Ontology: Cellular component=microtubule
  Homolog annotation: Hit_ID=A7Q2I5; Match level="QueryCoverage=72%, HitCoverage=61%, E-value=5e-31, Identity=72%"; Hit description =Chromosome chr1 scaffold_46, whole genome shotgun sequence
MGNCQAVDAAALVIQHPSGKIERLYWPVSASEVMRTNPGHYVSLIIPLAVPDDQGQINQEQQKAVLFTRVKLLRPNETLTLGHAYRLVTTQGCEGSESKETCKDEEATGEGNGGYANSAAGKASFR

SEQ ID NO: 159168 - protein, 136 aa, Glycine max
  Coding DNA Sequence Number=SeqID_67483
MVCQKGLLIGICNLENTKHILRSTPKRRVGRRPMKNNKNVMVDAPGNDDFLRDTMIGGFTIFNFFLQELIDKQGKVSKVKVLEYNKDSILIYKGWPKFKRLNEIYNEREIMFVYVGDHKFHGRFFKQDPELARVNQ

SEQ ID NO: 159169 - protein, 179 aa, Glycine max
  Coding DNA Sequence Number=SeqID_67484
MPTSTPTSSPHFVVRVEGDGGVPNDDISVRRWDLEEELVGEGEGEAGAVESEEGRGDEGVTKEGGLGGMGVERGGEEGEVEGGAGLEGEGEEESMEASRARRREELHQKGGGGVEENGGDWTKNIVKDLDELDLKEEGEELNEEEMVEGGRSKLKMFPLLGEIEAKKEYYAKGDKHRRK

SEQ ID NO: 159170 - protein, 101 aa, Glycine max
  Coding DNA Sequence Number=SeqID_67485
MVTHSRNSTFNFLAFWLNMYVDVRCRSGDLVCGEEDDERDPRSCAVTGECDGGSGRGCGRCGVEEKKKKVKILLGCLTRFETDENDALKMRLIGCQLQPPI

SEQ ID NO: 159171 - protein, 133 aa, Glycine max
  Coding DNA Sequence Number=SeqID_67486
  Gene Ontology: Mol. function=dimethylallyltranstransferase activity; Cellular component=chloroplast; Biological process=carotenoid biosynthetic process
  Homolog annotation: Hit_ID=P34802; Match level="QueryCoverage=75%, HitCoverage=26%, E-value=1e-21, Identity=51%"; Hit description =Geranylgeranyl pyrophosphate synthetase 1, chloroplast precursor (GGPP synthetase 1) ...
  Homolog annotation: Hit description=(GGPS1) [Includes: Dimethylallyltr anstransferase (EC 2.5.1.1); Geranyltranstransferase (EC 2.5.1.10); Farnesyltranstransferase (EC 2.5.1.29)]
MDASIVLREPKKCHKDMCYSLFIDSKRVNPILFITVYKLIGRTEATVLPTRYVVEINHTMWHIHDNLPCMDNDNLCREKPNNHRVFSEDNHVLVGNNIQSLLIVREYYIKGSAELFNKRFSLPLQVSNFQHKG

SEQ ID NO: 159172 - protein, 873 aa, Glycine max
  Coding DNA Sequence Number=SeqID_67487
  Gene Ontology: Mol. function=hydrolase activity; Cellular component =nucleus; Biological process=protein amino acid phosphorylation
  Homolog annotation: Hit_ID=A7QK10; Match level="QueryCoverage=78%, HitCoverage=92%, E-value=0.0, Identity=43%"; Hit description =Chromosome undetermined scaffold_109, whole genome shotgun sequence
  Pfam annotation: Domain name=PPR; Domain location=174-208; Score =18.8; E_value=0.02; Accession=PF01535.11; Description=PPR repeat
  Pfam annotation: Domain name=PPR; Domain location=275-308; Score =14.1; E_value=0.17; Accession=PF01535.11; Description=PPR repeat
  Pfam annotation: Domain name=PPR; Domain location=311-345; Score =12.1; E_value=0.28; Accession=PF01535.11; Description=PPR repeat
  Pfam annotation: Domain name=PPR; Domain location=377-411; Score =40.0; E_value=8.3e-09; Accession=PF01535.11; Description=PPR repeat
  Pfam annotation: Domain name=PPR; Domain location=453-487; Score =45.1; E_value=2.4e-10; Accession=PF01535.11; Description=PPR repeat
  Pfam annotation: Domain name=PPR; Domain location=488-522; Score=3.1; E_value=3.3; Accession=PF01535.11; Description=PPR repeat
  Pfam annotation: Domain name=PPR; Domain location=524-558; Score=5.2; E_value=1.9; Accession=PF01535.11; Description=PPR repeat
  Pfam annotation: Domain name=PPR; Domain location=73-107; Score=25.1; E_value=0.00027; Accession=PF01535.11; Description=PPR repeat
  Pfam module annotation: Pfam domain module=PPR::PPR::PPR::PPR::PPR::PP R::PPR::PPR; Domain location=174-208::275-308::311-345::377-411::453 -487::488-522::524-558::73-107
MRRCLKPKEALFRNSKNQRPSSHSQIQRNTINQHISNDNNTHILDNLTRFHVARNQVEHARHVFEKIPKPSVVLWNMMIRAYAWNDPFLQSIHLYHRMLQLGVTPTNFTFPFVLKACSALQAIQVGRQIHGHALTLGLQTDVYVSTALLDMYAKCGDLFEAQTMFDIMTHRDLVAWNAIIAGFSLHVLHNQTIHLVVQMQQAGITPNSSTVVSVLPTVGQANALHQGKAIHAYSVRKIFSHDVVVATGLLDMYAKCHHLSYARKIFDTVNQKNEICWSAMIGGYVICDSMRDALALYDDMVYMHGLSPMPATLASILRACAKLTDLNKGKNLHCYMIKSGISSDTTVGNSLISMYAKCGIIDDSLGFLDEMITKDIVSYSAIISGCVQNGYAEKAILIFRQMQLSGTDPDSATMIGFTANTSICNAIIDMYAKCGKIHISRQVFDRMKKRDIVSWNTMIIGYAIHGLYIEAFSLFHELQESGLKLDDVTLVAVLSACSHSGLVVEGKYWFNTMSQDLNILPRMAHYICMVDLLARAGNLEEAYSFIQNMPFQPDVRVWNALLAACRTHKNIEMGEQVSKKIQMLGPEGTGNFVLMSNIYSSVGRWDDAAQIRSIQRHQGYKKSPGCSWIEISGAIHGFIGGDRSHPQSVSINNKLQELLVQMKKLGYHADSGFVLHDVEEEEKEQILLYHSEKIAIAFGILNTSPSNPILYEMQVDFIILRMKSAIVRITAMAKACKSHEEILSGATKHGLKALQKCHLLEEAAHAPAILALSRPIGSEWKEKVENLQVELQQCYKAQSWLSEQLVVEVAESRASKALVQEKEDAAAYLQKELTELREGCSQLKVDLGEKIKSLEVVVSEKSELKSTTGADDY

SEQ ID NO: 159173 - protein, 42 aa, Glycine max
  Coding DNA Sequence Number=SeqID_67488
MWCFGRLWREVQGEVQFALKAKDLHESLRDMLYEVQLCIAVT

SEQ ID NO: 159174 - protein, 160 aa, Glycine max
  Coding DNA Sequence Number=SeqID_67489
  Gene Ontology: Mol. function=protein dimerization activity; Cellular component=endoplasmic reticulum lumen; Biological process=proteolysis
  Homolog annotation: Hit_ID=A5B212; Match level="QueryCoverage=53%, HitCoverage=64%, E-value=2e-31, Identity=79%"; Hit description =Putative uncharacterized protein
  Subcellular localization annotation: CTP_CleavageSite=30; ConfidenceScore=5.37e-01
MEHHHLRLILLLLFLFLPNTCFSFSFQTPSSNEFSNQSSSSLKQQILELANSPSTVKWMKRIRREIHEHPELAYEEFRTSAVIRRELDLLGVEYKWPVAGTGVVAKIGYGSPPFVALRADMDALPIQLVSPLMPQGHMCWTSLVCLHGPVCGYEALAGFG

SEQ ID NO: 159175 - protein, 108 aa, Glycine max
  Coding DNA Sequence Number=SeqID_67490
MGFRKQKCFQNSHSEEGGERKEKKKRRVKEPLTFTEGGRTMRECENEGAWGKEESPREGGNGCRHGGVLLRVERKEKGGLLLAPAIVALGTHPHILAALTSCPSHSFP

SEQ ID NO: 159176 - protein, 528 aa, Glycine max
  Coding DNA Sequence Number=SeqID_67491
  Homolog annotation: Hit_ID=A7Q2K5; Match level="QueryCoverage=89%, HitCoverage=98%, E-value=2e-94, Identity=44%"; Hit description =Chromosome chr1 scaffold_46, whole genome shotgun sequence
MGKTAASNPALQVSVSFGRFENDSLSWEKWSAFSPNKYLEEVEKCATPGSVAQKKAYFEAHYKNIAARKAELLAQAKQMEKDSPRSQRQNGEDLSCNTCGTDAECDMSSTQGSSEGVKQETNSIGEIVRTDVSNLMEDVAVSIDYQGSSVEGEKENEELESRLGSSQIDKHEEVVCVEQGGSKEESPNTEAEDVKEISHNVNNEPAKTSENEAKYVTLDHPKVSKKVTPVNRESNATKAKKKSMLSTSKPKASQFSTPRSSKPTSTPTKTLASASSTKRGISPSISGRKINSTSENRKVPNKSLHMSLSLAPSQPDPASHTTMRKSLIMEKMGDKDIVKRAFKTFQNNFNQPKTSGENKSLVKEKVPSKVTESRNPTSITLRKEDGQSPKVDSMDRRSVNAVRTAFGLKGDVKAEKGKEFPRKIDEKFNSKEVERTHLQLKSKGEKIKHISKATHLPAFHWGQKASKSHPEKSTCVLQLNSLVIVGKGMLRLRNGGSLKSRDGIEYISGRLRSICSEEMLMATTQVTL

SEQ ID NO: 159177 - protein, 1517 aa, Glycine max
  Coding DNA Sequence Number=SeqID_67492
  Gene Ontology: Mol. function=transcription corepressor activity; Cellular component=nucleus; Biological process=regulation of transcription, DNA-dependent
  Homolog annotation: Hit_ID=A7Q2L0; Match level="QueryCoverage=86%, HitCoverage=95%, E-value=0.0, Identity=63%"; Hit description =Chromosome chr1 scaffold_46, whole genome shotgun sequence
  Pfam annotation: Domain name=HDAC_interact; Domain location=479-579; Score=231.2; E_value=2.3e-66; Accession=PF08295.3; Description =Histone deacetylase (HDAC) interactin
  Pfam annotation: Domain name=PAH; Domain location=102-148; Score =78.6; E_value=2e-20; Accession=PF02671.12; Description=Paired amphipathic helix repeat
  Pfam annotation: Domain name=PAH; Domain location=188-234; Score =63.5; E_value=7.3e-16; Accession=PF02671.12; Description=Paired amphipathic helix repeat
  Pfam annotation: Domain name=PAH; Domain location=379-450; Score =11.5; E_value=0.3; Accession=PF02671.12; Description=Paired amphipathic helix repeat
  Pfam module annotation: Pfam domain module=HDAC_interact::PAH::PAH::PA H; Domain location=479-579::102-148::188-234::379-450
FGSYEGDLCAILGLEILLAFHAFVNFPAVRSASCLLLLFECERMKRSRDDVYMSSQLKRPMVSSRGEPSGQPQMTSGGAQKLTTDDALAYLKAVKDMFQDKREKYDDFLEVMKDFKAQRIDTSGVIARVKELFKGHKDLILGFNTFLPKGYEITLPLEDEQPPQKKPVEFAEAINFVGKIKARFHDNDRVYKSFLDILNMYRREAKSIAEVYKEVAALFQDHVDLLREFTHFLPDTSGTASNHCGLARNSLLPDRSSAMPIIRQMHVEKRERNIASHGDRDLSADHPDPELDRCLIRADKDQRRHDEKEKGSRDYDHDGISRKRKSGIRAEDSGAEPLHDTDENFGMHPISYACEDKSSLKSAPVLGYLDKVKEKLRNPEDYQEFLKCLNIYSKEIIARHELQSLSFWHEGHGPKPVKVEDRDRDRDRDDGMKERDRECRERDKSNAIANKDVLVPKTSLYAGKDKYAAKPISELDLSNCEQCTPSYCLLPKNYPIPPASQRTELGAEVLNDHWVSVTSGSEDYSFKHMRKNQYEESLFRCEDDRFELDMLLESVNVATKRVEELLEKVNANIIKGDSPIRIEEHLTALNLRCIERLYGDHGLDVMDVLKKNASLALPVILTRLKQKQDEWARCRSDFNKVWAEIYAKNYHKSLDHRSFYFKQQDTKSLSTKVLLAEIKEISEKKRKEDDVLLAIAAGNRQPIIPHLEFVYPDSEIHEDLYQLIKYSCGEMCTTEQLDKAMKIWTTFLEPMLGVPSRPQGPVDTEDVVKANKNNSAKTGTGIDDGDSSPATNPKNLNTNRNGDENFPSEQSNSCKQWQTSGDNKVKEDNHLDLERSAHKNETLGSSTQHGKVHINASTTDEVSRANKQDHSIERLVNANVSLTLGMELISRRTNVDNASGLTATPSRPGNISGEGGLGLPSLEGADSTRPVTSTNGAINEDTKVHRYHEEVGHFKSEREEGELSPNGGDFEEDNCEVYGHAGLEAVHKGKDGTICRQYQNRHGEEVRGEAGGENDADDEGEESPHRSMEDSENASENGDVSGTESADGEECSREHEENGDHEHDNKAESEGEAEGMTDANDVEGDGASLPYSERFLVTVKPLAKHVPPVLHDKQRTVRVFYGNDSFYVLFRLHQTLYERIQSAKVNSSSAEKKWRASNDTGSSDQYGRFMDALYNLLDGSSDSTKFEDECRAIIGTQSYVLFTLDKLIYKLVKQLQVVATEEMDNKLLQLYTYENSRKPGRFVDLVYHENARVLLHDENIYRIECSPAPTQLSSIQLMDYGYDKPEMTAVSMDPNFSAYLHNDFLSVVPDKKEKSGIYLKRNKRKYAISDEYSSQTLDGLQIINGLECKIACSSSKILKIFYIKQEEKGEPCIRAVHAMDRKSPQSFVQAEHNGPANYFQFEDGIHFEPEMFASGSHHHSLSSRFEDYREIFAWIFRHSTPPVRFSLTPEMLPVTTPKSSTTSTASTFDSLTMTCFAAAFPKKTMMKKKKKPNMNECSRGLNVCTFLPFGYEYLITA

SEQ ID NO: 159178 - protein, 153 aa, Glycine max
  Coding DNA Sequence Number=SeqID_67493
  Gene Ontology: Mol. function=aspartic-type endopeptidase activity; Biological process=DNA integration
  Homolog annotation: Hit_ID=Q69FA4; Match level="QueryCoverage=100%, HitCoverage=19%, E-value=4e-34, Identity=39%"; Hit description=Gag -pol polyprotein
MSLPDLITHIIIEDKNRKKSATTRTKAMSAKANTPGHFAPQCMYKVVRNDNPPKPRANLVEGDDIIVAVISQVNVVTNVNKWLNYSGSRKGESFLKLAFGKTLALNDVLHVPSIRFNIVSVALLGKGLFILNVPEVINKNVSSSAYLIDSYDI

SEQ ID NO: 159179 - protein, 897 aa, Glycine max
  Coding DNA Sequence Number=SeqID_67494
  Gene Ontology: Mol. function=transcription repressor activity; Cellular component=nucleus; Biological process=regulation of transcription, DNA-dependent
  Homolog annotation: Hit_ID=A7Q2L0; Match level="QueryCoverage=87%, HitCoverage=66%, E-value=0.0, Identity=53%"; Hit description =Chromosome chr1 scaffold_46, whole genome shotgun sequence
  Pfam annotation: Domain name=HDAC_interact; Domain location=471-561; Score=138.9; E_value=1.5e-38; Accession=PF08295.3; Description =Histone deacetylase (HDAC) interactin
  Pfam annotation: Domain name=PAH; Domain location=147-192; Score =38.6; E_value=2.2e-08; Accession=PF02671.12; Description=Paired amphipathic helix repeat
  Pfam annotation: Domain name=PAH; Domain location=347-393; Score =38.6; E_value=2.2e-08; Accession=PF02671.12; Description=Paired amphipathic helix repeat
  Pfam annotation: Domain name=PAH; Domain location=60-106; Score=59.4; E_value=1.2e-14; Accession=PF02671.12; Description=Paired amphipathic helix repeat
  Pfam module annotation: Pfam domain module=HDAC_interact::PAH::PAH::PA H; Domain location=471-561::147-192::347-393::60-106
MKRSRDDSYTSSQPKRPKGSSREEEPSGQSQMTTGDGQIPTTKDALAFLKAVEDAFQDKREKYDYFMVIMKDFKAQRIDTIGVMERVEELFKGHKDLILGFNTFLPKGYKIILPLEDEQPPQKKLIELKEEAINFVGKIKARFHDNDRVYKSFQNICMCRKETKSITEIYQEVSALFQGHADLLEEFNHFLPDIPGTTSTQYASVQNSLLHDRSSAMPTIRQMHVEKRERNIASHGDHDLSADHPDPELDSCLMMADKDQRRRGAKENDCRKGRDRREQERDDGDYDHDGSREHLSHKRKSGCRAEDSGAESMHPISYACEDISSLKSMCSPVFGYLEKVKEKLQNPEVFQEFLKYLYIYSMEIITRQELQSLVGNILGKYADLIEGFDEFLDQCEKNEIFWHEGHGPKPMKVEDRDQDRDDKMEKRDRKCLERVKSNATANKDVSVPKMSLYASKDKYAMKPINELDLSNCEQCTPSYRLLPKQYPILPASDRTELDAEVLNDNWVSVTSGSEDYSFKHRYKNQYEDSMFRCEDDRYSAFQLMKEIYFVVQALNLRCIEQIYGDHGLDVVDALKKNALLALPVILTRLKQKQDEWARSRADFNKVWSETYAKYHHKSLDQCNGTAIAKGHGGHHVGFTIMNPKNFNNNTNGNESVLLEESNSCKQRQTIGDNKVEEDNSLDSDCSAHKTETETFGSSTQHGQMHLIATNLDEISRAKKQDHSIDRLVNANVSMSSGMEQSNRRTNVGNASGLTATPPSRPGNVSNEGGLDLPSLEETLSQSVSQEEVADHDHNDILGRTLNVPKHLGRDRGLGFEVTQKINVSLQQMPLSITNGHVQQIQKGLVDLKKGTNKLEMEVQMQMNKEPQEEGLGGLSGINSCTPTATHIPEVIIKPYNY

SEQ ID NO: 159180 - protein, 110 aa, Glycine max
  Coding DNA Sequence Number=SeqID_67495
  Gene Ontology: Mol. function=protein serine/threonine kinase activity; Cellular component=nucleus; Biological process=regulation of transcription, DNA-dependent
  Homolog annotation: Hit_ID=Q1EP20; Match level="QueryCoverage=84%, HitCoverage=6%, E-value=5e-21, Identity=52%"; Hit description =Transcriptional repressor protein-related
  Pfam annotation: Domain name=PAH; Domain location=21-67; Score=53.2; E_value=9.1e-13; Accession=PF02671.12; Description=Paired amphipathic helix repeat
MTKMDAIQYIKEVQYTFRDKREKFDKFMDVMKDYKLHRIRVGVVVTKMEEILKDHEDLILGFNKFLPKGYEMLLLPKGEIQFEDAVKYVNKIKVTKLLNFWHLIQYGTLD

SEQ ID NO: 159181 - protein, 540 aa, Glycine max
  Coding DNA Sequence Number=SeqID_67496
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=A7QX90; Match level="QueryCoverage=99%, HitCoverage=39%, E-value=0.0, Identity=79%"; Hit description =Chromosome undetermined scaffold_215, whole genome shotgun sequence
MIQVAELIENDLILIGSTAIEDKLQEGVPACIETLQRAGIKIWVLTGDKIETAINIAYACNLINNEMKQFVISSETDEIREVEDRGDQVEIARFIKEVVKRELKKCLEEAQSSFQSLRGPKLALVIDGKCLMYALDPSLRVMLLNLSLNCHAVVCCRVSPLQKAQVTSMVKKGAQKITLSIGDGANDVSMIQAAHVGVGISGMEGMQAVMASDFAIAQFRYLADLLLVHGRWSYLRICKVVIYFFYKNLTFTLTQFWFTFQTGFSGQRFYDDWFQSLYNVIFTALPVIIVGLFDKDVSSSLSKKYPQLYMEGIRNVFFKWKVVAIWAFFSVYQSLIFFYFVSSTNLSAKNSAGKIFGLWDVSTMAFTCVVITVNLRLLMICNSITRWHYISVGGRISTPYDRQENIYFVIYVLMSTFYFYVMLFLVPVAALFCDFVYQGVQRWFFPYDYQIIQEMHRDEVDSTGRAQLLEIGNQLTPDEARSYAISQLPRELSKHTGFAFDSPGYESFFAAQLGVYAPPKAWDVARRASMRSRSKTGQQK

SEQ ID NO: 159182 - protein, 263 aa, Glycine max
  Coding DNA Sequence Number=SeqID_67497
  Gene Ontology: Mol. function=phosphoprotein phosphatase activity; Cellular component=cytoplasm; Biological process=protein amino acid dephosphorylation
  Homolog annotation: Hit_ID=Q6VUQ5; Match level="QueryCoverage=73%, HitCoverage=96%, E-value=7e-69, Identity=96%"; Hit description =Serine/threonine protein phosphatase
  Pfam annotation: Domain name=Metallophos; Domain location=106-199; Score=7.2; E_value=0.068; Accession=PF00149.19; Description =Calcineurin-like phosphoesterase
MSGMARLTNWYKLQNAAFHSPVLALLRNPNPIHGIPPLAVDAVTVAPTAANRINRIDLREEEEEDAISEIEQLMECKPLSESEVKALCDQARAILVEEWNVQPVKCPVTVCGDIHGQFYDLIELFRIGGNAPDTNYLFMGDYVPHEGPMCDLLWSDPDDRCGWGISPRGAGYTFGQDIAAQFNHTNGLSLISRAHQLVMEGFNWCQDKNVVTVFSAPNYCYRCGNMAAILEIGENMDQNFLQFDPAPRQIEPDTTRKTPDYFL

SEQ ID NO: 159183 - protein, 307 aa, Glycine max
  Coding DNA Sequence Number=SeqID_67498
  Gene Ontology: Mol. function=transcription regulator activity; Cellular component=nucleus; Biological process=regulation of transcription
  Homolog annotation: Hit_ID=A5AIN2; Match level="QueryCoverage=85%, HitCoverage=89%, E-value=8e-71, Identity=57%"; Hit description =Putative uncharacterized protein
  Pfam annotation: Domain name=HLH; Domain location=153-203; Score =39.3; E_value=1.4e-08; Accession=PF00010.17; Description=Helix-loop -helix DNA-binding domain
MDPGAMMNEGSFANNASGNTAPFSLAEIWQQFPPAISGGGGLGLRSPQFGHGPGGQFGDFTTGPSHGLGPSNSRKRRDSEEDDSAKGVSTSNAVNEGDGKRVKGNRNEGGGDGGNNKGEGEVSSGKPAEQSAKPASEPPKQDYIHVRARRGQATDSHSLAERARREKISERMKILQDLVPGCNKVIGKALVLDEIINYIQSLQRQVEFLSMKLEAVNSRLNSGIEAFPPKDFGQQAFDPAGIPFGSQAPREYSRGSSPDWLHMQIGVAPRKHQWYTQGSKYNGHLIPIFYTRHGAVTVFHRTASVSI

SEQ ID NO: 159184 - protein, 160 aa, Glycine max
  Coding DNA Sequence Number=SeqID_67499
  Gene Ontology: Mol. function=protein dimerization activity
  Homolog annotation: Hit_ID=A7PEU5; Match level="QueryCoverage=42%, HitCoverage=29%, E-value=2e-24, Identity=72%"; Hit description =Chromosome chr11 scaffold_13, whole genome shotgun sequence
ASGCERNWSVFEQIHSKKRNRLEHKRLHDLVFVKYNQQLKQRYNARDEIDPISLNDIDVCNEWLVGEMDQDDDNDARNDLASGVGECRMYTRRKKQKTRSKKEVQDNDEDLDVEENIDVEFEEEEIMVNFEASDGEEGEGDAPLPYDNNEDDYVGIGEDD

SEQ ID NO: 159185 - protein, 93 aa, Glycine max
  Coding DNA Sequence Number=SeqID_67500
  Gene Ontology: Mol. function=glutathione transferase activity
  Homolog annotation: Hit_ID=Q9FQF3; Match level="QueryCoverage=100%, HitCoverage=95%, E-value=2e-10, Identity=61%"; Hit description =Glutathione S-transferase GST 5
MAKSDELKLMGKWSSPYAMRVKIALNIKSLEHEHFEETMISVIEQRYERKLLVEAKAPALVKWAERFVVDPTVKGLIPETDKLVEISKSLQIK

SEQ ID NO: 159186 - protein, 227 aa, Glycine max
  Coding DNA Sequence Number=SeqID_67501
  Gene Ontology: Mol. function=transmembrane receptor activity; Cellular component=intrinsic to membrane; Biological process=innate immune response
  Homolog annotation: Hit_ID=Q2HS00; Match level="QueryCoverage=75%, HitCoverage=13%, E-value=7e-45, Identity=48%"; Hit description=TIR
  Pfam annotation: Domain name=TIR; Domain location=16-148; Score =164.9; E_value=2.1e-46; Accession=PF01582.11; Description=TIR domain
MASSSSSSNLEERHEVFLSFRGEDTRKTFTSHLHAAFKRMEINTYIDYNLERGDEISGTLLRAIEDAKLSVIVFSKNFGTSKWCLDEVKKIMECKKTRRQMVVPVFYDIEPTHVRNQTGSFASAFARHEERFMDRPNKVQKWKDALREATNLSGWDCSVDRWHCGLEVVDIWATKVGGGDVCSVVWMMPGVVNAMMIGCKVVDGGDGDNDTGKTRGEEEKEEEACIL

SEQ ID NO: 159187 - protein, 81 aa, Glycine max
  Coding DNA Sequence Number=SeqID_67502
MSEEVDMDFQNEEEDCGVNEAHVDCSDAFNTSQVFETREDVLKWARTVAHENGFVAVIMRSDTYTGSRGRTSFVLIGCERS

SEQ ID NO: 159188 - protein, 347 aa, Glycine max
  Coding DNA Sequence Number=SeqID_67503
  Gene Ontology: Mol. function=AMP deaminase activity; Cellular component=integral to membrane; Biological process=purine ribonucleoside monophosphate biosynthetic process
  Homolog annotation: Hit_ID=Q0TVC7; Match level="QueryCoverage=96%, HitCoverage=38%, E-value=1e-100, Identity=48%"; Hit description =Putative uncharacterized protein
  Pfam annotation: Domain name=A_deaminase; Domain location=69-347; Score=342.5; E_value=7.3e-100; Accession=PF00962.13; Description =AdenosineAMP deaminase
TEELFPVASSTRFFTDMHYILKVMSIGNVRTSCYHRLRFLEEKFRLHLLLNADREFLAQKGAPHRDFYNIRKVDTHIHHSACMNQKHLVRFIKSKLRKESDEVVIFRDGKYMTLKEVFESLDLTGHNSLKPPKFTGRFLAEVTKEVLTDLEASKYQVVGFDLVDDESKPERRPTKHMPTPAEWTNEFNPAYSYYLYYCYANLYTLNKLRESKGMTTIKLRPHCGEAGDSDHLAAAFLLCHNISHGINLRKTPVLQYLYYLAQVGLAMSPLSNNSLFLDYKRNPLPMFFQRGLNVSLSTDDPLQIHLTKEPLLEEYSVAAKVWKLSACDLCEIARNSVYQSGFSHQAK

SEQ ID NO: 159189 - protein, 126 aa, Glycine max
  Coding DNA Sequence Number=SeqID_67504
MTREAQLVNLLEQPMQVEHVKHVDQVQDENVNPVQVTPTISSKERVFQNGLLASEKGLWKTHSKRNKCTLEQAFRNDLLAYGKGGLERPFQKQQERHFCARSFGIESWKNTLVGEEEKNSKVDALQ

SEQ ID NO: 159190 - protein, 320 aa, Glycine max
  Coding DNA Sequence Number=SeqID_67505
  Gene Ontology: Mol. function=sequence-specific DNA binding; Cellular component=nucleus; Biological process=regulation of transcription, DNA-dependent
  Homolog annotation: Hit_ID=Q93XA4; Match level="QueryCoverage=100%, HitCoverage=100%, E-value=1e-125, Identity=70%"; Hit description =Homeodomain leucine zipper protein HDZ2
  Pfam annotation: Domain name=HALZ; Domain location=136-180; Score =69.1; E_value=1.4e-17; Accession=PF02183.9; Description=Homeobox associated leucine zipper
  Pfam annotation: Domain name=Homeobox; Domain location=81-135; Score =65.9; E_value=1.3e-16; Accession=PF00046.20; Description=Homeobox domain
  Pfam module annotation: Pfam domain module=HALZ::Homeobox; Domain location=136-180::81-135
MAGEKLHEGSSMTLLLQKERLTCSPELIRSFWVQNSESSFQGSKSLANVVNVTQRPFFQGLEKEENGEDEDFGVCLNQPGKKRRLTSKQVQFLESNFEVENKLEPERKVQLAKELGMQPRQVAIWFQNRRARFKTKQLEKDYGVLKASYDVLKRDYDNLLQESDKLKEEVNSLKTRLIPREQEEQNLDDTSCDAVNSQHKEQKDLITNTVSENGSKVPLPVTVTSKQEDANSAKSDVLDSDSPHFTDGNQFSLMEPADSSHAVEPDHSAFSQDEEDILSQNILTMPFLPKVEDVCYDEPHEDSCSFRFPVEDQTFCFWSY

SEQ ID NO: 159191 - protein, 55 aa, Glycine max
  Coding DNA Sequence Number=SeqID_67506
MVMIIDDDNDGDIMVVATTVIMVITMITKKVVAIDDDVVAMVVMVVATTVVMVID

SEQ ID NO: 159192 - protein, 26 aa, Glycine max
  Coding DNA Sequence Number=SeqID_67507
MQLLTASRGLAVAVANLQDYYNGSSY

SEQ ID NO: 159193 - protein, 144 aa, Glycine max
  Coding DNA Sequence Number=SeqID_67508
SGLDDGGCMNNVRQSIHGAPDSMATNSWGSGLDGGGCMNIARQSIHGAPDLMASANPSEFRSPPTESPTITTYPFAGERGEVHGCVFHGRKMRGVATNVDKSGAFAPTYPPSKRKSDLRSSFKRGESSDSFYLEGGHLRRWTLK

SEQ ID NO: 159194 - protein, 220 aa, Glycine max
  Coding DNA Sequence Number=SeqID_67509
  Subcellular localization annotation: CTP_CleavageSite=61; ConfidenceScore=5.62e-01
MLFGYLGIGDCCLLSVGVATTSSPVMSLSLAPSVPPSAMLVSALPSTSSHPTFLWITYTLSAMLIRCWRNLAILKENRKRVECPKVANTIVTIAKALRSNHQLFSKVGGVLTKLLLTRLDVDELLEQCKGLWREKNELADKVESTMTEKDELAKVVADLEARLKESKSKLEESELRASKERVANKELEEELLMYKKKVMEQLEKGFHKAVRKQDLGGVGS

SEQ ID NO: 159195 - protein, 167 aa, Glycine max
  Coding DNA Sequence Number=SeqID_67510
MECNATSRLRFWIWTIMRPNLSMNFRRDSSSACRRLARATDVIRCDRLVGYCELKCLTRVLKLSMDLGGSPPYQVNASPLRDVGKTEHKIMSSLVYRFAWEMCERSAHRLGGVWHKPPANHGQPLAFQTPPHGVAPSLQCSFGVVGKYQYLSWLLGKDWSLQKGSRV

SEQ ID NO: 159196 - protein, 247 aa, Glycine max
  Coding DNA Sequence Number=SeqID_67511
  Homolog annotation: Hit_ID=A5BSC1; Match level="QueryCoverage=65%, HitCoverage=7%, E-value=5e-20, Identity=33%"; Hit description =Putative uncharacterized protein
  Pfam annotation: Domain name=zf-CCHC; Domain location=68-85; Score =30.4; E_value=6.6e-06; Accession=PF00098.14; Description=Zinc knuckle
MTRKRKELHLKPHLLFKKKVTEDLNEIKEDDDFSFFVKRFNKLLRNKVNQRRTNFNPKKKGEDSPSIPKCYECNKPGHLRVDCPSFKKRMEKSDKKNFKDKKTKKAYITWEDSDIDSSGDSKNEVVNLSLMAKNYDSEEEGFLKKSWYIDSRCSKHMTRDASKFTHIPSKKSGHVTYGDNNKDFLEDMRIHKEGHNDKGNGNNEDSQIDETKTSTYTDLPKEWRTSKHHALDNIIVDNLTLSQRCMQ

SEQ ID NO: 159197 - protein, 54 aa, Glycine max
  Coding DNA Sequence Number=SeqID_67512
MSMDCMGEKKVGGTGRGRGVGKVSSVKVKGPVIIVAVVGSSAAAYEARICVGCA

SEQ ID NO: 159198 - protein, 107 aa, Glycine max
  Coding DNA Sequence Number=SeqID_67513
MTSTHDVLLYYNGRWNMSRQHELVGYSFTRKNPKKFDIPSRCTMDELKDLIKQVAPHGIPPYGIHETQTGNTDQVDPQEPYVCFSWIKLIRRTHTDQVDLYVSYGLS

SEQ ID NO: 159199 - protein, 423 aa, Glycine max
  Coding DNA Sequence Number=SeqID_67514
  Homolog annotation: Hit_ID=A7Q2R7; Match level="QueryCoverage=60%, HitCoverage=29%, E-value=3e-60, Identity=52%"; Hit description =Chromosome chr1 scaffold_46, whole genome shotgun sequence
  Subcellular localization annotation: CTP_CleavageSite=51; ConfidenceScore=5.35e-01
MSKNLKAPDESSQFSKVQSPNSAKSSISSKSPDRTKIASIDDQYAIMVSCRCNYTASRLFFKQATSWRPRSSRDIIISVASEMSGESPGPYERNSQLPVQVLTLQASNLTSEDLTLTVLAPASFTSPPSVVSLSSPISPMSPFIGFKEFLGRISVERHVGATQGGSFTSLIKDNEKQNDDVRPQSVSVNDDVISSSGLSCTHLWLQSRVPLGCIPSQSTATIKLELLPLTDGIITLDSLQIDVMEKGAKHVFSQALLLRSLVYFVHSVIKNSFPALQILIIKMQNANYDIAQCSREANMDDLFTWISNCSSNIHLMAQRCIRLFRVKAMNRLAIHSIRQLQFSEFQLIISGGSLQQQNRMKKEQQSKTRKKKRVQKRKLTGPDTLMIMWLDEVELAAGSRVVLLGSSCRLSGTISLGLYSFSL

SEQ ID NO: 159200 - protein, 267 aa, Glycine max
  Coding DNA Sequence Number=SeqID_67515
MPTPDAFVSTTKGKEKSGNPKTGERSAWRTLLCNSGKILRGPTSHEGLEQTAEWANVGLLLLWSTQVLHLASKRCGPSIPLAGWQMSILKVDRVIRVSRRWEGCQRLEEKGKLVNQGGDVGVGVLGRCNWGEDPDVEILASTVSLKHSPKLRGSDAIMGFKSLNPENNVGAAQGKHMKVHREHSSMHIQRNVEADLATFKLIAISDKHPQGRRGLSLETQGFDHAFLHKIVHTAFVDQDHHQLMRNPATFNDGLFGGSGRCGLSGSG

SEQ ID NO: 159201 - protein, 68 aa, Glycine max
  Coding DNA Sequence Number=SeqID_67516
SYIEIIALHTVFGRLVVETAVGFGQKDLSREVWPKGAAVVEQFSEAAVADKNSGLNTGRSRCYSSAMC

SEQ ID NO: 159202 - protein, 143 aa, Glycine max
  Coding DNA Sequence Number=SeqID_67517
  Gene Ontology: Cellular component=membrane
  Homolog annotation: Hit_ID=A7Q2S1; Match level="QueryCoverage=62%, HitCoverage=95%, E-value=3e-16, Identity=72%"; Hit description =Chromosome chr1 scaffold_46, whole genome shotgun sequence
MEENVGSERDEEGWERFGGEFVFLAKLKKELEKGEKDEGMIREDCHCPKEELQSTVAIKEVFGKHDDGLEPGFHCVPWFFCTQVAGYLSLRVQQLDVRCETKTKEIGASSKSNSVFVPHGPGAVRDIASQFRDSLLQGKVAQS

SEQ ID NO: 159203 - protein, 100 aa, Glycine max
  Coding DNA Sequence Number=SeqID_67518
GIRVCGKSFKLWSVKLVWFARGKAIVTVIVVVGVEEGESGSGSEREWLWPGTVNGKFSFSCEVVVEAEERGGGSGGDTHAKQGTSSTSPNEHLDQLKNWI

SEQ ID NO: 159204 - protein, 179 aa, Glycine max
  Coding DNA Sequence Number=SeqID_67519
  Gene Ontology: Mol. function=phosphoprotein phosphatase activity
  Homolog annotation: Hit_ID=Q9LNG5; Match level="QueryCoverage=33%, HitCoverage=4%, E-value=1e-10, Identity=52%"; Hit description =Serine/threonine protein phosphatase 7 long form homolog
MRTMHDFGSKEDASLCLGAIHNNCDGSVASNCVVGSVVWFAVVPLICFHVEWHQPDRVLRQFGLQQPISGCSSQPQNLHGITLKGKQDENWHKTNMFVDPNNANTITLGEVVETLQYMVSPQGRNTWTIDDLVPYVEKLAIICKEQERITESVSHGPASEREFTAQEFHILQSSVETRA

SEQ ID NO: 159205 - protein, 174 aa, Glycine max
  Coding DNA Sequence Number=SeqID_67520
  Homolog annotation: Hit_ID=A5AWV0; Match level="QueryCoverage=79%, HitCoverage=9%, E-value=8e-11, Identity=28%"; Hit description =Putative uncharacterized protein
MKTSPKSHTVVNVSAYQCYSCGFCKHLTETCMRVGNSDIYGFLEPQSIQRSGQSQFESESYIKSWMQSSQCDVYLGAYLNGFHCRGHWQMVVILPKDLVVWFCSLHNRPDNYLKGIINSAIKGLDDAPQPKSKASARWIVVKCNRQKGSTECGYYVMHWMSTIILGTFRNNWET

SEQ ID NO: 159206 - protein, 110 aa, Glycine max
  Coding DNA Sequence Number=SeqID_67521
MMVNLSMLPPIFSQEYLIEDPLTPLFHTASLFDAFCHGRPSPSACTTWMNHKHSAAFPPAPRATASSSHPIKLHQNSETLKPNMPYVPSLLASGRLCHRPFEMGTVLWEF

SEQ ID NO: 159207 - protein, 95 aa, Glycine max
  Coding DNA Sequence Number=SeqID_67522
MQGSRSGTVATCGAVRVHEEPFPARASLGARRAGRFLRAQQRVERHHVLVGANASLGVVVGRAFDLTTLSDYYDLTYELEKLLEIRGELRSQDKW

SEQ ID NO: 159208 - protein, 109 aa, Glycine max
  Coding DNA Sequence Number=SeqID_67523
MEVWILMDECEEGEMGTAAELVEAHNEGVLVVELSGAMRHHTMRANVVMGKGDGSKAFCFVNKKEYEGVREDRVGEGVREDRLNVDGLKGGCFRDDVAQGIVKGCHSLQ

SEQ ID NO: 159209 - protein, 122 aa, Glycine max
  Coding DNA Sequence Number=SeqID_67524
MDKDTLRYSGQKGLKNLGNLASGDYLTFSALIWAYPYNQQLLGTDAKDTKPFADLAFLVERVNMVVHNNADYVIHLSYSSLPCASRNSKLSARYHRPPLTCYVPWRFTSHSVVMRTFMRILD

SEQ ID NO: 159210 - protein, 84 aa, Glycine max
  Coding DNA Sequence Number=SeqID_67525
MSPSVEEIVINGAYVVVEEKKKMRKRSNVGVELYCHCFDILLFLLLSLMHSCQCLAEWRKKKDDMRCHFKEKMSQEQTYHHRKS

SEQ ID NO: 159211 - protein, 366 aa, Glycine max
  Coding DNA Sequence Number=SeqID_67526
MTQIKDKEIRGRNNGIIGDYHKWLKAQTQELDWLPKLKTSSEEEAETLEESEEAHACKGALWENNSELKLRRAGRNQSRVEGMIFEDKLKTCQREARERVIDSLHKEAMMWMDKFAFPLNGSQELPRLLAKAKAMADMYSAPKDVVNTITKHALRHPYRIRSKTRVMGDIEEVQEQMKADIEALKDQVASIMEAMLSMKRMMESNMTAVAAASIAIEVNPTHPSAINQANQPAPDMVGQGGKVLGSTGGPHLGYNRNAYPYNLPPNYTPPTTHMPNKNVNSAVPVTFEGQQPQPVGGTREEPRERAQGDFDPYPTFTVEGPAFNAMPQPNTAGAPQPRPLQPLHFSVEGHLRQWKGEGNLISSKRD

SEQ ID NO: 159212 - protein, 691 aa, Glycine max
  Coding DNA Sequence Number=SeqID_67527
  Gene Ontology: Mol. function=sucrose transmembrane transporter activity; Cellular component=integral to plasma membrane; Biological process=sucrose transport
  Homolog annotation: Hit_ID=Q000Y6; Match level="QueryCoverage=91%, HitCoverage=88%, E-value=0.0, Identity=63%"; Hit description=Sucrose transporter 2A
  Pfam annotation: Domain name=MFS_1; Domain location=141-639; Score= -14.1; E_value=0.055; Accession=PF07690.7; Description=Major Facilitator Superfamily
  Pfam annotation: Domain name=Sugar_tr; Domain location=63-688; Score=- 172.9; E_value=0.031; Accession=PF00083.15; Description=Sugar (and other) transporter
  Pfam module annotation: Pfam domain module=MFS_1::Sugar_tr; Domain location=141-639::63-688
MTGKSDLLSIRVPYKNLHHDSSAPELELVDVNHRNLPPSPPPPNHSPSPPNNNNINAPLLHLVLSCTVAAGVQFGWALQLSLLTPYIQVPLPLPLPLQPNNFEVSSLTRSFPNRNRILYDVGNRTCVFFVYLALWPHYRSCGLCFVLVGLELENHVCVSIFHKVQPCVGIWSDKCTSRFGRRRPFILAGSLMICLAVILIGFSADIGYVLGDTHEHCRTFKGTRTRAALVFILGFWMLDLANNTVQGPARALLADLSGPDQRNVANAIFCSWMAVGNILGYSSGASGKWNKNTLALSLGLALALFMCFTVVLSMFAADYYFTLSHLCRWFPFLTTRACCEACGNLKAAFLVAVVFLTLCTLVTLYFADEVPLTTASQHHHLSDSSPLLDEQQQNGVDFSKLKPLSVMDESNSKRTENHIEKDTELKHGNFKAGEDHAENVMDGPGAVLVNLLTSLRHLPPAMHSVLVVMALTWLSWFPFFLFDTDWMGREVYHGDPKGDTSEVDLYDQGVREGAFGLLLNSVVLGISSFFIEPMCKWMGAKLVWALSNFIVFVCMAGTAIISLISVRDYSGGIEHIIGANEGIKMASLVVFVLLGFPLAITYSVPFAVTAELTADSGGGQGLAIGVLNLAIVVPQMIISLGSGPWDALFGGGNIPAFVLASVCALAGAVIATLKLPDLSSSSFQSTGFHIG

SEQ ID NO: 159213 - protein, 73 aa, Glycine max
  Coding DNA Sequence Number=SeqID_67528
  Subcellular localization annotation: CTP_CleavageSite=29; ConfidenceScore=5.63e-01
MGASWVGKVPSPSSMTSIGVAAGVSSGVSSSVASCFGYGSWAVGASPPPVEEGWTPGQATWAIKSSMLMMGRC

SEQ ID NO: 159214 - protein, 187 aa, Glycine max
  Coding DNA Sequence Number=SeqID_67529
  Gene Ontology: Mol. function=helicase activity; Biological process =viral genome replication
  Homolog annotation: Hit_ID=Q2A9E0; Match level="QueryCoverage=73%, HitCoverage=9%, E-value=8e-31, Identity=48%"; Hit description =Putative uncharacterized protein
MARDNKLQSLDVCDLKLKLISDRQSYGRLYNLPNTTEADALIVGDKHIVDGYTMIESQKLNYVRQHQQELRVDKYMNLNACNNDPETHGNEKGKRIIPPSSFVGCRRYMEQLYFDGMEICGHIGFPDLFLTLTCNPAWQKIQRKVRKCNLRHDDCPDVVSRISKMKLSHLMNDLKSGHAFGPIVGCK

SEQ ID NO: 159215 - protein, 350 aa, Glycine max
  Coding DNA Sequence Number=SeqID_67530
  Homolog annotation: Hit_ID=Q2HSY3; Match level="QueryCoverage=36%, HitCoverage=58%, E-value=8e-09, Identity=26%"; Hit description =Nucleic acid-binding, OB-fold, subgroup
  Pfam annotation: Domain name=DUF223; Domain location=39-135; Score= -5.0; E_value=0.0087; Accession=PF02721.5; Description=Domain of unknown function DUF223
MFRKENMISELHTKKGTWKIAVQITDMWHVNKHNGKQAIEMVFMDQIGAKIGVTLWQELFPEFEVKLNCGSTHVIQNIKVVENHSEYKVSRIPFLVYLVKTTSVREVERPEIPTNVHVITPFANIIDGVVPRDTLVDVVGVVVEVIERKTVNPTYRVTIKLRDNNYSDRDMILTCWEEYALPLDDAIEKNHFDRKPLVVMLTLAKIKDPKGIPFYARRLSDQGSVSQSQYSQYSQRSSMDKFLHNAQMVMLGEISRLRQNGEKANFHFWDGTCIKIFGKTVDQCRQELIVSGDDIKVFPPCVDELLGKTWAVRFKYRVQMHQSSVLDVTEDEDLIQTMTSTIALQGLNIL

SEQ ID NO: 159216 - protein, 91 aa, Glycine max
  Coding DNA Sequence Number=SeqID_67531
MGCLGCKPIRNGYSKIPSTNFRIGILEGTEHSGTLEHVQPVVVDEPMVIDELVELVKPLKQQDPKATDVFPGGLEDTSLLTSYVDHMARSL

SEQ ID NO: 159217 - protein, 553 aa, Glycine max
  Coding DNA Sequence Number=SeqID_67532
MTLVSQVEYLTSLMKLVMKSLPTSSLTALCHSCPIFLLFCDNDISYASVLKDGEVRVELYTLAKHFVHAHDLSGTIHYGVRFRRLPGGRISGELNLQMQYGYDGSELVECFPANQRKVKELALTEGGHKVDITSGLYSFSCEAKEWTGMRLDVKVIGSRLRGDGESTRNGVDCTFDLSGDVLTKIRSHGTSRWTWLSRVRTSHIRWAPVLVEVVDRVSTRDVFSFLSLPLCLFFCPRHDSYVDPLGVLRLLLLPSGCPASKQTRLGTQPYLVTSNPSLGGHGGGILIGVCNARTWALLGEDGACSACASCLTCVIQSCTSVELTTSSATKKYRSRGTPGLGRLKIGGVAMVFLKAKKDFLQVSSYKEACSQVAMNLQYGTAFVGVHVIFTEFPEDLFQVCHVLGYALRLDDHVIHVYLDISFNLLFEDSIHQSLSKHPGSLTLGIFGERLVHISVVSTHLSFVVGFFYHDNAGEPRVDGKLVANNAAMDSRHVRWLLSKQICIFVLHVSDVLVLMVGEVPTELRIQPKFRFELQLDELFDEFWASIKGVVSWI

SEQ ID NO: 159218 - protein, 981 aa, Glycine max
  Coding DNA Sequence Number=SeqID_67533
MTSHVSPLKTQPLRVGRLCSWTKADMEVSLQAKEVVKSRRRLFDVEGNSLVKYKGDESVEPLSMDKCCPISRVVASTRVKVAAKGCIVVQKIRAPLQLPLVNEESDSSLNAVDDTCHGASNNESSSSERLRVSCRAGGGTSHLHGRVQPSTASLVREPVPVTVILTPSASMGASISVGDVKYKSSITSVASIAPLQCQVKLESPEDSYKIVFSLILPLTSFQCALLEYLNVAPSQLHPNSWAMQDWLGSLNSMSIKLFKFDSNIFRRFNDRFFKVLAIDVMADGLPPMFNKDGEPRFSFYWQNNPTWFKSFDEDLLTLEERVDKAILEQLPTSLDAQTILSLSSASDPLTALDDKCFTLSSSFVKPVGGTMPLFDVALVSREGGQPAVEVGAIASDAEVAHEASSFVLTKRKRDDGVGMLGHKKSRALFSLCALRQATGLTPSSGCPSSLQDVPLAPLTVEAPTSVVVVVIVTPIPRPPLVVFVQEASFAAEVSAPTTSASFVVAPLSTVVVPLLSVDVATTTALVMLSPPFSALPVPSSTVLALVSTSFHLHVSLDHIYTSSDVDSLWGMGYKPEQKTLIGFVSALDKNLIQSDGVKHATNSTKSATTQNVSRVKCPKVVNASVAFAKVEKKKDMVGQVEGIIAEKDELVKESELWAAREKEVYKELEDELIMYKKKVMEQHEKVFNKAVGQVRFFSKDLDLGLFDPFKDMKDGVLLDEKDIATEEEAEEEQDADDADTHQGKTLGLTSLWRIDQGRECPGFWQDSPRVDLGFCELLEMRGSPREDLEFYEPFGELNRKLSVLGFGETHQGRRTMGLTSLETHQGQTLSFANPLKKQPMRLTKGGPWDSPKVDLGFFEPFVEPTNDASILDFGKNKKYSLVSCIRSIEVELRACYDLELAFPVENKLSPSGIFSGFASNSPHEVVGLKGSWLNLCIVSSYCSKLGSFFPDPVGKEFHWSLSGVNNSRPRVYCGVPLSIDP

SEQ ID NO: 159219 - protein, 25 aa, Glycine max
  Coding DNA Sequence Number=SeqID_67534
MGLSSSLFRNLLMEASQGGELSYER

SEQ ID NO: 159220 - protein, 36 aa, Glycine max
  Coding DNA Sequence Number=SeqID_67535
MWEFRQRLEVTWKLLKLPSTVGSYMEVTKTSINDNF

SEQ ID NO: 159221 - protein, 79 aa, Glycine max
  Coding DNA Sequence Number=SeqID_67536
MGIKHFEVVKRRSHADKQWFPDDIRLGISACRLTQGSGSADVVLVRITAGYICLPPDSRVRINKCCVCTDYRWVYPPAA

SEQ ID NO: 159222 - protein, 119 aa, Glycine max
  Coding DNA Sequence Number=SeqID_67537
MTTLIRMWMTLLLSNILPSDHHFDPPCRRIAPIRHQVDPKKSNSVLGFPALITSPCQFYEMLVAPNKVIRHPPEAGARRGTTTAWGRPAAGNRRTATTSRVHLSSSTKRLERCLRHMAD

SEQ ID NO: 159223 - protein, 289 aa, Glycine max
  Coding DNA Sequence Number=SeqID_67538
  Gene Ontology: Mol. function=nucleic acid binding; Biological process= DNA integration
  Homolog annotation: Hit_ID=A3BRV8; Match level="QueryCoverage=86%, HitCoverage=57%, E-value=2e-28, Identity=36%"; Hit description =Putative uncharacterized protein
MAVMDSGPMFLKAIDCSNEIKDKDFIAKHMRERFNPQLKKGLQEMVISDQWSSYKEDDVAKAKFVKDTLLDDKWWDKVDYILSFTSPIYDVLRRTDTEASSLHLVYEMWNSMIEKNSTLLHCLAHSLNPSHEWLSEDSNQVRPHQDMELTCERLKCFKRFFLDVDVRRKVTIEFANFSDGKEGFDDLGSLNDRAEDLVFVHSNLRLLSRNTPQYHQEETKMWDVTGDDFESLDDCGILEIARLSLDEPELEGANDGRTIETLLSHLCGWTWRIMGYNGVVVTTIKGGCR

SEQ ID NO: 159224 - protein, 200 aa, Glycine max
  Coding DNA Sequence Number=SeqID_67539
MEVFGSLAGNDKEKTKKNPSNRACPVVQPCPVTAEATDTACVRCESDAGHADEEFKKAKHHHNLGTGFVKMSYFKEIDKILISEERNRNTKLSFLLSMVASSHHNISIDQNAYANTKKSTPLPTPRVTTTTTNKGLELILIPGHKEECKKVWETQELLPTSLNTKHFCFAGPYPLTLDYEAISSWFPTYENEHLIIHTNY

SEQ ID NO: 159225 - protein, 48 aa, Glycine max
  Coding DNA Sequence Number=SeqID_67540
MAKMAKKLRRSRNGEEEAEEVEMAKNTGLEGRKENEQYGRMGPNEYEL

SEQ ID NO: 159226 - protein, 401 aa, Glycine max
  Coding DNA Sequence Number=SeqID_67541
  Gene Ontology: Mol. function=protein binding
  Homolog annotation: Hit_ID=A7QP08; Match level="QueryCoverage=96%, HitCoverage=83%, E-value=1e-99, Identity=48%"; Hit description =Chromosome chr1 scaffold_135, whole genome shotgun sequence
  Pfam annotation: Domain name=F-box; Domain location=10-57; Score =16.7; E_value=0.088; Accession=PF00646.24; Description=F-box domain
  Pfam annotation: Domain name=Kelch_1; Domain location=135-181; Score =21.6; E_value=0.0029; Accession=PF01344.16; Description=Kelch motif
  Pfam annotation: Domain name=Kelch_2; Domain location=135-181; Score =21.4; E_value=0.0034; Accession=PF07646.6; Description=Kelch motif
  Pfam module annotation: Pfam domain module=F-box::Kelch_1::Kelch_2; Domain location=10-57::135-181::135-181
MATFKDEKEEEEAPMHVDILEAIFSHVPLIHLVPASHVSNSWKRAVSTSLRHVKPAKPWLTVHTQSPRAPHVTTTFAYDPRSREWFQIHAPSPNHTTALRSSHSTLLYTLSPREFTFSLDPLKLAWHHARPPRVWRTDPTVARVGTKIILAGGACDFEDDPLAVEAYDAESHAWLRCEPMPGILKGSTASTWLTVAVAGDKMHVTEKNSGVTCSFDCGTMTWQGPFNLRPDQSVFHCVTGTIRGRLMVAGLVGDAENVKEVKLWEVKGGLGLGLGLGFEEIGAVPKEMVVKLVMGEGDCCCCWGVAGSIEVNWIGDYVYFQNRMEPEEMVVCEVVNGRCEWGSVRNVTVNDVSRMGRMVFSGGHVGLEDLKRAEDDEEHFHAFSSTQKRCYDQANSKSNAI

SEQ ID NO: 159227 - protein, 32 aa, Glycine max
  Coding DNA Sequence Number=SeqID_67542
MCSVLCKKEKDYLYKHEVLAASRSWDLALICL

SEQ ID NO: 159228 - protein, 118 aa, Glycine max
  Coding DNA Sequence Number=SeqID_67543
MKGIIGASYRARCDDLTVIDVCWFPYSDHRGVRGFEMISSFQDICGLHGVACDQPRHAPAPNHEDYMQPDIPQVSVAFDPPRHVVGQSYMISRKIAIARGGANADGSVRARQRQHTEH

SEQ ID NO: 159229 - protein, 121 aa, Glycine max
  Coding DNA Sequence Number=SeqID_67544
MKKEAFNQTPCRQKLDSARHGENLTQTSFCCKQALSENVIEKRNTEKMKSFEMDLAGSRGAVLANKGPTMKDGVEKDEDNEDEEYDDDYESEYIKRKIRNKLPMAPGINLAKLQKVLALVP

SEQ ID NO: 159230 - protein, 85 aa, Glycine max
  Coding DNA Sequence Number=SeqID_67545
MMEIQQANSKTLCVILEMTVLFRFQDVLEIVETGIKEPGASSTESQRAKHKEAIRKDGKTLFLIHQCVDPNIFKKIQASSLAKEA

SEQ ID NO: 159231 - protein, 49 aa, Glycine max
  Coding DNA Sequence Number=SeqID_67546
MERAGEVATEQGPGGGDPPLQAREGPHGGFQVGVGRLGAGLARGQGGYP

SEQ ID NO: 159232 - protein, 428 aa, Glycine max
  Coding DNA Sequence Number=SeqID_67547
  Gene Ontology: Mol. function=pantothenate kinase activity; Cellular component=cytoplasm; Biological process=coenzyme A biosynthetic process
  Homolog annotation: Hit_ID=A7QNY5; Match level="QueryCoverage=89%, HitCoverage=94%, E-value=1e-134, Identity=62%"; Hit description =Chromosome chr1 scaffold_135, whole genome shotgun sequence
  Pfam annotation: Domain name=Fumble; Domain location=23-358; Score =621.0; E_value=1.1e-183; Accession=PF03630.5; Description=Fumble
MGVELYEFWFVGILLGSSALCPGSLAKLVYFTKDDDHLVDGEEGISHRKALEKSDSSKQYPVLNGKLNFKKFETSRINDCIEFIKSMKLHIGGSQPQENPGSQPIAIKATGGGAYKYPDLFKERLGIILDKEDEMDCLVAGANFLLEVVHQEAFTYMGDQKQFVQIDPNDLYPYLLVNIGSGVGMIKVEGEGKFERVSGTSIGGGTFWGLGKLLTKCKSFDELLELSYRGNNRAVDMLVGDIYGGMDYSKIGLSSTAIASSFGKAISDNKERGDYKPEDIARSLLRMISNNIGQISYLNALRFGLKRIFFGGFFIRRHPFTMDTLSVAVNFWSKGEAKAMFLRHEGFLGGVGAFMSSDKHGLKELLANQVVQRSPSKLSFAVDKTLHGSPDGEFNGDEKNNIDAAYEIGGKVGHDNNIQSIAPPLRDE

SEQ ID NO: 159233 - protein, 308 aa, Glycine max
  Coding DNA Sequence Number=SeqID_67548
MVIWACYGKDGVVGLVGALTMIILEGYQHREATKGTHQIEEILLFHGHKKKQKEGARVVNSSLHGQDLDGRTSLSTKRKPAPTVVVVEAVASVVVVEVTAADTVVVGGRQGRSQGAQGGVVRQHNFLEDCLRYSVTYTKYVKRKTGTMVDVVAVLKRQGRVKWCYKLPRSVSSASKRSQQGCEMLAWEAWGGRWKVKSGMVKAQSLKKVVDCGGHGVNGNDQFEFIVEFARYQTSQENVCGCSQNQSQGIELDVQKDKGCAETKGIGPTKMGAGGWLCGMDVVGRGGLGWHDSHGRQPLELNESTKLL

SEQ ID NO: 159234 - protein, 275 aa, Glycine max
  Coding DNA Sequence Number=SeqID_67549
  Gene Ontology: Mol. function=carbonate dehydratase activity; Cellular component=chloroplast; Biological process=carbon utilization
  Homolog annotation: Hit_ID=A9PED7; Match level="QueryCoverage=100%, HitCoverage=100%, E-value=1e-110, Identity=73%"; Hit description =Putative uncharacterized protein
  Pfam annotation: Domain name=Pro_CA; Domain location=78-264; Score =288.4; E_value=1.4e-83; Accession=PF00484.10; Description=Carbonic anhydrase
MAGGSYEEAIAALTKLLSEKADLGGVAAAKIKQLTAELDTATANGSTPFNPDERIRTGFAHFKNEKYQKNPELYGELAKGQSPKFMVFACSDSRVCPSHILDFNPGEAFVVRNIANMVPPYDKTKYSGTGAAIEYAVLHLKVENIVVIGHSCCGGIKGLMSIPDDGTTASEFIEHWVQICTPAKSKVKTEANTLEFSEQCTSCEKAIMLYRIENFLLTSMQEAVNVSLGNLLTYRFVRDAVVKKTLALKGAHYNFVKGTFELWDLDLKISNSVSV

SEQ ID NO: 159235 - protein, 274 aa, Glycine max
  Coding DNA Sequence Number=SeqID_67550
  Gene Ontology: Mol. function=calcium ion binding; Cellular component =cytoskeleton
  Homolog annotation: Hit_ID=A7P0H1; Match level="QueryCoverage=18%, HitCoverage=7%, E-value=2e-15, Identity=73%"; Hit description =Chromosome chr19 scaffold_4, whole genome shotgun sequence
MDFPHDVDQPYETHSSVILIERRVESFSDDLNTQQDIISGKVTFTTKKSVFYDAHLNSVVPKPSLFEGGSNLVVPLLSLASLLSPLPNVFSHALSSSEFAMRVFKFLSEHSDFLAEREKAKKKKREDLKASKERGKSDKRLKEEKEPKAEDTNKDESTSKVPNKGNGLDFGEILLDLITSREAYAYLLNVLAPKHCSPVTLDTKNGNERANLVLDHTERMGCKRYFTPRDVVEDDDKGDDKKLKDQSKNNSSESRTIQEFKIRIKKNSRLKKKV

SEQ ID NO: 159236 - protein, 73 aa, Glycine max
  Coding DNA Sequence Number=SeqID_67551
MTRGGNPGSLNHNIGFMTVFEGRLFYIGCLATTDVEWVDIYIGSKAKTDVEWVDIYIGYQSTDVESERFLHRL

SEQ ID NO: 159237 - protein, 123 aa, Glycine max
  Coding DNA Sequence Number=SeqID_67552
MESSIVDASAASRKRRRDEEEEEELEQVFFIIVSVVTMLLDALTWYHDKYFVKELARNLELERHSFLNRLYRGTETDCIEQLRVSKKAFLSFVEFYKRKGNCYCRSMETISRQFKNVLRAIMK

SEQ ID NO: 159238 - protein, 231 aa, Glycine max
  Coding DNA Sequence Number=SeqID_67553
  Gene Ontology: Mol. function=transposase activity; Biological process= transposition, DNA-mediated
  Homolog annotation: Hit_ID=A7QLP4; Match level="QueryCoverage=89%, HitCoverage=77%, E-value=4e-13, Identity=24%"; Hit description =Chromosome chr13 scaffold_120, whole genome shotgun sequence
GDGGWKRSALNAAAAVLSTSFNVNVTSDNVKNRIKLWRSWYGIVSDILGQSGFDWDGTKHMITVENENAWNEYCISHKSAKPFRYKVLQNWDDIVDLCAKDRATGHGAETAMDVDEAMSRETNEVEFMGLGVTAIDLEEPSSNTKGKRQGIAASLDKMANSFNRMVEKMDGKVDDEDIQEVLREAALIPDLNRQQWAKAIKWLADDPKQLAIVKALPIHQKTDYALTHLGE

SEQ ID NO: 159239 - protein, 157 aa, Glycine max
  Coding DNA Sequence Number=SeqID_67554
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=42%, HitCoverage=7%, E-value=3e-18, Identity=67%"; Hit description =Lipoxygenase
SSKTSEDLIKTTLTVHAKKPLQFKVRAVVTVRNKIKEDFKETMLKHLDAINDSIGTRNVVLELISTEIDPKATTRNQTEGNKDLNHNEKDYLLPKVVEFSEENRHGGKDTSKVELSANEGLNSNKAYRNKSLMTEKWNLGTRGIIPPCLLPLVCNPW

SEQ ID NO: 159240 - protein, 124 aa, Glycine max
  Coding DNA Sequence Number=SeqID_67555
MSEGERNLPVRRRNVTERDAAEREREREWCAERERARILISKTGEGKKGCVGGVAVPLPPLQRSSPEIRAERHDRRRYGVCIQTLKLSHVPEMKGEALPLSAVMFDEAGIGKESGKGIEWEKGK

SEQ ID NO: 159241 - protein, 230 aa, Glycine max
  Coding DNA Sequence Number=SeqID_67556
  Gene Ontology: Mol. function=iron-sulfur cluster binding; Cellular component=nucleus; Biological process=regulation of transcription, DNA-dependent
  Homolog annotation: Hit_ID=A7Q2C4; Match level="QueryCoverage=98%, HitCoverage=45%, E-value=4e-75, Identity=65%"; Hit description =Chromosome chr1 scaffold_46, whole genome shotgun sequence
MGEPLHNIDNVIKAADIMVDEQGLQFSPRKVTISTSGLVPQLKRFLHESNCALAVSLNATTDEVRNWIMPINRKYKLELLLQTLREELCFKKNYKVLFEYVMLEGVNDRSFSSHCPHQALSLVTLDALNQSVMHIDGDAERLIELVKGIPCKINLISFNPHSGSFFKPTKDERMIEFRNTLAGAGLVVILRLSRGDDQMAACGQLGKPGTIQAPLLRVPEQFQMAIGSSA

SEQ ID NO: 159242 - protein, 239 aa, Glycine max
  Coding DNA Sequence Number=SeqID_67557
  Homolog annotation: Hit_ID=A9PHW7; Match level="QueryCoverage=76%, HitCoverage=68%, E-value=3e-11, Identity=26%"; Hit description =Putative uncharacterized protein
MEEQQRQQQKPKSPLPIDWSRQFQSDSPPRDYDILPASSSADQDDLSAIPDHKLRESIQSKKRTLDVTGKNLPDKGTKLRATIDRYQQELTHREQQKRLRQEDDKDRKPQPGQASSTDAVTEGVSNDLREENLLSQAQSQSTFTSCFVKQMEDNTNCTASDAFRKEMSLFKHSDYQKIQDKGEPRRRKRHRSSSRQLQFQCPSKLSKRNTFSDGKTCRATSSFGLRNNGRNLPRCYPKV

SEQ ID NO: 159243 - protein, 136 aa, Glycine max
  Coding DNA Sequence Number=SeqID_67558
MAWSLPDPNFVRGLSFTDVLILASQTGLFDTSYRTRRKIVQCFNQECERYQKGGAKSSPRLASGSLGPSKDFRMKELARLGELRKGFQHSTLREIEKNKREEEEERRGNKAEALPNHDCDQSLRHFSLRVLRLSFD

SEQ ID NO: 159244 - protein, 62 aa, Glycine max
  Coding DNA Sequence Number=SeqID_67559
MMSMRKMMEVNPAAVATTSVATEVDPTHPFGQGWEALGSTVSPHFVQVESKHPFPPYSLPPN

SEQ ID NO: 159245 - protein, 83 aa, Glycine max
  Coding DNA Sequence Number=SeqID_67560
MEMYPFTWIVIGMQNEARKILCLTASRYWAPFVTQYVKFRDMPEIKRKHCYAIREVPPTWAFQDVPPEGGCFCRKQPGSPGRA

SEQ ID NO: 159246 - protein, 76 aa, Glycine max
  Coding DNA Sequence Number=SeqID_67561
MEDGAPPRRHWCMASRSEAAIGTEAMTVAQKWPTMVASKWRNVIGLFAFLGIHAALPSPPKTFFFLLLCTVLSLLT

SEQ ID NO: 159247 - protein, 46 aa, Glycine max
  Coding DNA Sequence Number=SeqID_67562
MRQGWKREGKRKVEGMNEEWEKGKEGRKGTITNLERPISTSFAFSS

SEQ ID NO: 159248 - protein, 469 aa, Glycine max
  Coding DNA Sequence Number=SeqID_67563
  Gene Ontology: Mol. function=potassium ion transmembrane transporter activity; Cellular component=integral to membrane; Biological process=potassium ion transport
  Homolog annotation: Hit_ID=A7Q2E3; Match level="QueryCoverage=100%, HitCoverage=57%, E-value=0.0, Identity=69%"; Hit description =Chromosome chr1 scaffold_46, whole genome shotgun sequence
  Pfam annotation: Domain name=K_trans; Domain location=1-469; Score =452.8; E_value=4.6e-133; Accession=PF02705.7; Description=K+ potassium transporter
MGQAAYFSRHHDVEQEYHFGFYVSVPEKLRWPVLVIAILAAVVGSQSIITGTFSIIRQCSALSCFPRVKVVHTSSKVHGQVYIPEINWLLMLLCLAVTIGFRDTKLMGNASGLAVVSVMLVTSCLMSLVIVICWHKNVMLAIGFVLFFGTIEALFFSASVMKFLEGAWVPVALAFVFLSVMCVWHYGTLKKYEFDVQNKVSLSWLLSLGHTLGFARVRGIGLVHTELVSGIPAIFSHFVTNLPAFHQVLVFLCIKHVPVPHVRPEERFLVGRVGPREFRVYRCIVRYGYHDVHKDDDEFEKDLVCSIAKFIQAGSGCNKNSSNSNDEPEKGGGKMTVVGTCSCTIHHTILVSENNNYAHEVDHVDLAETSSESHKIIKPKKKVRFVVPESPKIDTGAMEELKELMEAREIGVAYIIGQSYMRAKPGSSMLKKLVINLGYEFLRKNSREPSYELSAPHASSLEVGMMYQV

SEQ ID NO: 159249 - protein, 295 aa, Glycine max
  Coding DNA Sequence Number=SeqID_67564
  Gene Ontology: Mol. function=nucleic acid binding
  Homolog annotation: Hit_ID=Q1SKZ9; Match level="QueryCoverage=43%, HitCoverage=35%, E-value=3e-14, Identity=30%"; Hit description=Zinc finger, CCHC-type
IESGSDSGKELSDGGGQQKRTSFRDLMMGQKAPVAPRPKVDLLKYEDGNHLKPKVHLDKKVVEGLSTPWQDALVIKLLEKFVGFNTMKDRLTRLLKFWIFILNISWSSLIMRMTEGRVHFLGLNIVFYDESILLAMPTTIGMPMKGDFGFKIIGIELNRKASIGFVLHAATMDTLRESGDKSTTMPPETLVANPRNVSTNNSATRAPQIDDALHGIEPTTFLQQNVNVETSLNMDEDTIAPQADMEVIYLSYRGTFVVQLVAAPAIYVSPNPTLCTQVWDHLMALGDTITGPWIM

SEQ ID NO: 159250 - protein, 192 aa, Glycine max
  Coding DNA Sequence Number=SeqID_67565
  Homolog annotation: Hit_ID=A7Q2F1; Match level="QueryCoverage=91%, HitCoverage=31%, E-value=1e-61, Identity=71%"; Hit description =Chromosome chr1 scaffold_46, whole genome shotgun sequence
  Pfam annotation: Domain name=NHL; Domain location=162-189; Score =32.8; E_value=1.2e-06; Accession=PF01436.12; Description=NHL repeat
  Pfam annotation: Domain name=NHL; Domain location=89-116; Score=0.8; E_value=14; Accession=PF01436.12; Description=NHL repeat
  Pfam module annotation: Pfam domain module=NHL::NHL; Domain location =162-189::89-116
  Subcellular localization annotation: CTP_CleavageSite=68; ConfidenceScore=5.46e-01
MGKHKLLLLALTLHLLHVSAAPSATSPAKIVSGFLSNAVPAFTKWVWSLKATTKTGVDLMGFEAVSSRSMMKFESGYNVETVFDGSKLGIEPYAVEVLPNGELLILDSANSNIYRISSSLSLCAPDEDNVRCNCADSRPKLVAGSAEGYSGHVDGKLREARMSHPKGITVDDRGNIYVADTTNMAIRKISDS

SEQ ID NO: 159251 - protein, 82 aa, Glycine max
  Coding DNA Sequence Number=SeqID_67566
MEKGVSHIHAKRVEAYVQDGVEKTVGYTKVYNVQRKPWVWAWKKLYDLRKRKKMCLAFTRKGLKLMFKMVLRKLSYNEVYNV

SEQ ID NO: 159252 - protein, 95 aa, Glycine max
  Coding DNA Sequence Number=SeqID_67567
METVATNISKWKGNFETNLFVADVNAKAPLSILDSEVLASWEGPTRWNELDEESASMWKRFKKRCCVRTTKVQEEARGPACARLGFKKKQEVLRV

SEQ ID NO: 159253 - protein, 222 aa, Glycine max
  Coding DNA Sequence Number=SeqID_67568
  Gene Ontology: Mol. function=protein transporter activity; Cellular component=clathrin adaptor complex; Biological process=intracellular protein transport
  Homolog annotation: Hit_ID=A7Q2E8; Match level="QueryCoverage=93%, HitCoverage=25%, E-value=2e-97, Identity=82%"; Hit description =Chromosome chr1 scaffold_46, whole genome shotgun sequence
MSVEDNGGLRVLAINILGRFLSHKDNNIRYVGLNMLMKAVTVDAQAVQRHRATILECLKDSDASIRKRALELVCILVNETNVKALTKELVEYLEVSDPDFRADLTAKICSIVSKFSPEKIWYIDQMLKVLSEAGNFVKDEVWHALIVVISNASELHGYTVRALYKAFKMSAEQETLVRVAVWCIGEYGDILINNAGMLDVEDPVTVSEWFLLESLCIIYTVA

SEQ ID NO: 159254 - protein, 151 aa, Glycine max
  Coding DNA Sequence Number=SeqID_67569
EVAKLPQQLSSGRRSSGKFPEIIFPESFRKNNLCLPEILTDNFRKNVIRNVSWKKLLPEEFHCLPEEASSGIFEDLVVPCSVFEVLLVAVVPILSEVQNDHFRMKVFRKLRRPIPEEGLPEDLHPEVVKANCGRSSSGNYFRKHFFRNWPS

SEQ ID NO: 159255 - protein, 314 aa, Glycine max
  Coding DNA Sequence Number=SeqID_67570
  Gene Ontology: Mol. function=aspartic-type endopeptidase activity; Biological process=proteolysis
  Homolog annotation: Hit_ID=A5AVN0; Match level="QueryCoverage=78%, HitCoverage=42%, E-value=4e-34, Identity=33%"; Hit description =Putative uncharacterized protein
  Pfam annotation: Domain name=MP; Domain location=67-235; Score=-20.1; E_value=0.0029; Accession=PF01107.9; Description=Viral movement protein (MP)
  Subcellular localization annotation: CTP_CleavageSite=33; ConfidenceScore=5.28e-01
MTVMILEDKFIMSRLLHSFSRISFRSNLSSSSSSMMSPKNNNLLNEHENQTHEVAPKHNLFDEEVRFEDIHQNMDDWNIPKIPQDTLYIPETIKDKYNFDYIIKTIENNIPLGQDIGKEFHLLSKNSIYEHSRKYKYLHIGCVQVAIKPLIDMGIDAIVLMCLRDIRHNKFEDSLIGTVETSLGQETFLTLFLNIHFHGLDMKKGSIPAALIYRIQYKVMNTCASRVLLKPQRGEKTLFITDMTMANVSLLRKIKWDEVTLPERWVMDKATLSVPRPTPTIEQIKQDNSGKVEITFNRRNSFSSRIEVSRSEYE

SEQ ID NO: 159256 - protein, 162 aa, Glycine max
  Coding DNA Sequence Number=SeqID_67571
IEEKINNLLIETSEEETETSSSVLSDENLNIIQQDDQLASTDDDGQINTLTREQDLLFEAINSIPDPQEKKVFLEKLKKTLESQFDTSKAAPDQVKNWFQIHPEFLKLADPETSLFLNKKSQLAAFLAGSKSKEILAKNLNEVLPPSTSTGRRRRKTFKKGN

SEQ ID NO: 159257 - protein, 120 aa, Glycine max
  Coding DNA Sequence Number=SeqID_67572
MSIYKTYTEFLYCGIAQHLLAYVVTDRKPVKDKPTADSGSKSRGSAKQHATQHDQIPEVFWNLAAELIIAEVEFADIDGDLAGRDLPDNVFPFSDDKGGEGVDVEVEATIGTRPRVEEAK

SEQ ID NO: 159258 - protein, 295 aa, Glycine max
  Coding DNA Sequence Number=SeqID_67573
MVKTRGLGRALDPAIGKTLGRRQGSDDENDVLDQSTTQVDVPSTCTTKDVPSNVLRQISQAVKPLILCEWGYKRILRREKGDTKEFRRLVICSFGKGRRETPKEFRRKLWKAFGTKKKKKFKEIQGLQRPTASTRRKQQQERVLEDPLATDPPIDVEGFPGGPHDTLVLRDYENHIAPRIWNGEEHPELKLSSHGRKMAKFRRYALEIEGLVETSSFHLPIEEVTITLDDVTSLLHLLIVGAFHSFEQFYVDDAINMLVELLEVNATEARAETIQYHDSYVRLSWLRDVYQMKIE

SEQ ID NO: 159259 - protein, 31 aa, Glycine max
  Coding DNA Sequence Number=SeqID_67574
MAAAAPDEADIDVHHFRRAMEQKCMLLLKNV

SEQ ID NO: 159260 - protein, 101 aa, Glycine max
  Coding DNA Sequence Number=SeqID_67575
MDVEQRVYDSIMSEEVDMNVENKEDAGVKVEHIDYSDAFNTSQLFASRDEVLQWVRSVAHDIGFVAVIMKPDTNTNVRGRASFLLIVCERSGTYKPKKYNL

SEQ ID NO: 159261 - protein, 515 aa, Glycine max
  Coding DNA Sequence Number=SeqID_67576
  Gene Ontology: Mol. function=methyltransferase activity; Cellular component=nucleus; Biological process=metabolic process
  Homolog annotation: Hit_ID=A7P682; Match level="QueryCoverage=96%, HitCoverage=78%, E-value=1e-138, Identity=39%"; Hit description =Chromosome chr4 scaffold_6, whole genome shotgun sequence
  Pfam annotation: Domain name=PPR; Domain location=145-179; Score =37.7; E_value=4.2e-08; Accession=PF01535.11; Description=PPR repeat
  Pfam annotation: Domain name=PPR; Domain location=247-281; Score =26.8; E_value=8.2e-05; Accession=PF01535.11; Description=PPR repeat
  Pfam annotation: Domain name=PPR; Domain location=348-382; Score =38.3; E_value=2.7e-08; Accession=PF01535.11; Description=PPR repeat
  Pfam annotation: Domain name=PPR; Domain location=383-417; Score=7.5; E_value=1; Accession=PF01535.11; Description=PPR repeat
  Pfam annotation: Domain name=PPR; Domain location=7-41; Score=16.5; E_ value=0.085; Accession=PF01535.11; Description=PPR repeat
  Pfam module annotation: Pfam domain module=PPR::PPR::PPR::PPR::PPR; Domain location=145-179::247-281::348-382::383-417::7-41
MRHRDTVSWNTIISAYVSSGDRDTTWKILGAMRRSALAFESCTFGSILKGVARAGELQLGPSVGELTMDTLYSKACQCAITCHGIRLLPVTHELVDNAVDCKIVKHGLELFNTVCNATIMAYSECCSFEDAERVFDGAVQCRDLVAWNSMLGAYLMHEKEDLAFKVFVDMQNFGFEPDPYTYTGIVSACSVQENKTCGKCLQGLVIKSSLDYSVPVSNALITLYIRFNDSMEDAFRIFFSMDLKDCCTWNSILVGCVQGGLSEDALRLFLLMRCLVIEIDHYTFSAVIRSCSDLATLQLGQQVQVLALKVGFDTNNYVGSSLIFMYSKFGIIEDARKYFEATSKDAAIVWNPIIFGYAQHGQGNIALDLFYLMKERKVKPDHIAFVAVLTACSHNGLVEEGCNFIESMESDFGHLKKAKALVETMPFEADEMVLKNLLGACRFCVDIELASQIAKNLLEPEPEEPCTYVILSEMYGCFKMWDEKASVTRMIRDRGVKKVPAFKDSVLYTVSFDKM

SEQ ID NO: 159262 - protein, 101 aa, Glycine max
  Coding DNA Sequence Number=SeqID_67577
  Subcellular localization annotation: CTP_CleavageSite=53; ConfidenceScore=5.37e-01
MVAFPSIVLDSGKYFFRNFSRTSSQVFKLLPLNECSHLLAPPNSENENKLSLTSSSGTPAILTVLQISILSALFLLQVASISKSIGTKLPAEDFLCIHNQA

SEQ ID NO: 159263 - protein, 128 aa, Glycine max
  Coding DNA Sequence Number=SeqID_67578
  Subcellular localization annotation: CTP_CleavageSite=59; ConfidenceScore=5.09e-01
MECTHARSRFVLFSSPCCWASLRQTLQGFARGTQQHCWCTQQIFKMAKMPFSLFANFLRLALAEEELRKNHLPWNYAEELLPPESTEEEMTNKDKGKGKEVARKGSAGKRKGAFDDYKTGGGQKRNKR

SEQ ID NO: 159264 - protein, 372 aa, Glycine max
  Coding DNA Sequence Number=SeqID_67579
  Gene Ontology: Mol. function=diphosphate-fructose-6-phosphate 1 -phosphotransferase activity; Cellular component=6-phosphofructokinase complex; Biological process=glycolysis
  Homolog annotation: Hit_ID=Q2HTG9; Match level="QueryCoverage=40%, HitCoverage=23%, E-value=3e-49, Identity=68%"; Hit description =Pyrophosphate-dependent phosphofructokinase PfpB
  Subcellular localization annotation: CTP_CleavageSite=72; ConfidenceScore=5.10e-01
MAASQKSAINLWWMAPFSFSLTHFLSLYNLEAFSLSKQQGPPPPPPPISVFHTERDTMCLNKFWAFGGNVVSHYMKVAGIEGPKSLGLHTLYDCRACTIYDAMFYGNWIKYGINLAKGILKHHSKGILDSDKPRKLLEDFRIGKLITGLNKFWAFGGNVVSHYMKVAGIEGPKSLGLHTLYDCRACTIYDAMFYGNWIKYGINLAKGILKHHSKGILDSDKPRKLLEDFRIGKLITGNIHRLQVGKIEAEKMLIQMVETELEKRKQWGTYKGGFRGQSHFFGYSVYFRYIILRVVSYEGRCGLPTNFDSTYCYALGYGAATILQSGKTGLISSVGNLCAPVEEWTVGGTALSSLMDVERRHGKFKPVIKKIN

SEQ ID NO: 159265 - protein, 69 aa, Glycine max
  Coding DNA Sequence Number=SeqID_67580
MKYEAKKKSEEVSKSERKSWYGVATYPSAGGQREGSRVRLPREEDARSLHQRLFEENVGKTGKDVVYEL

SEQ ID NO: 159266 - protein, 111 aa, Glycine max
  Coding DNA Sequence Number=SeqID_67581
MDKCQRRSPQTRSPQCGCSHGSTGDFDTRRKKKSDRVQVQGERRRTIGFKRGYVIAYSLIIALASSASCISSCKMESKKSPKEECKVVVTRSQKKEDAKADRKLQDVSKME

SEQ ID NO: 159267 - protein, 142 aa, Glycine max
  Coding DNA Sequence Number=SeqID_67582
MHTSDEIARTTTNKTSNTEHGTTKSSNTSRDHQWKAQKGPPPKATNQNERKKAHLFIKKVKGHLPEEASSGNILDEILPEGVSENFRKSEIRLPEEGSSGKIPKKGLPKSFRKKLLPELDLLKDSFATSLFAGCPSNNAGCT

SEQ ID NO: 159268 - protein, 88 aa, Glycine max
  Coding DNA Sequence Number=SeqID_67583
MACGMSEKSEISEGGANDSMASVGDVIFVKLCGSSWWPAQFVDDNSVNKSVKTSKLTKRFPGDILVRHYGSYTSSVRAYCCTLVLFFE

SEQ ID NO: 159269 - protein, 298 aa, Glycine max
  Coding DNA Sequence Number=SeqID_67584
MKPRGYIESDHVQDDVPYQVEEKSHVNEVIEVESISGLQDLRGGVEEVNSANLLTNEEESANLNGESNNIEQDNEGELEDDFEGTSFMVQVEGTSTWVVVTEDKRGYISCGSVLVDGTSTRLFKENKGGYIPCGSLLLGLPMLQPSPPPTEARPSSSDVNAPKPSPVLASTLSLSSVDARGLSPVPTSTPSPSPPVGNLPIDEDVEEFEARLSQARSDAASSVGESQLIPLDPTEEQRLRSRCWVADAGPKRKGRLYGIGDLAHSYKCGSGSFMQHTQGSSSCAEDATEINRLREELR

SEQ ID NO: 159270 - protein, 115 aa, Glycine max
  Coding DNA Sequence Number=SeqID_67585
MAPMVVALSGRPCHVALVSPFSLATWLFPMWHWSHHSCWRFGHAWCVAPVKVARCFALGLQLGLQVAARFVGCRDVVVGSGTQWQVQGCNRFRDAVLQRGRHHWCLRIAGERRHW

SEQ ID NO: 159271 - protein, 239 aa, Glycine max
  Coding DNA Sequence Number=SeqID_67586
MHGANGGGAFRQAVPRGIGVSILASDLAFSYMALESPFLLAIWPCMELGASQSGALLCPRVAGTQSFQCFFRWQMLLAAAFQVAENDVAGGSMFHSANSLTSCGNNLSNNEAQPARNFSNLHGDKDDDDDDYLVSNSYVEDSLDEDDSVDSISDTGDEVTEMIQPMRIVHPTEGIEGNQNPFWNYALHYNNINWSYPDEEDICGLEMPSTFNVGQELYVGMEFDSKDAVKNAVKQYVMK

SEQ ID NO: 159272 - protein, 172 aa, Glycine max
  Coding DNA Sequence Number=SeqID_67587
  Homolog annotation: Hit_ID=A5ALH5; Match level="QueryCoverage=47%, HitCoverage=6%, E-value=7e-12, Identity=45%"; Hit description =Putative uncharacterized protein
MGDQKYDELLTVEVEIGSFLTSSHEWLTHPIIGHKLNGQNYTQWVRSIHTKEICWIIHGKPLKARQFKSKEGRGNTTFNHQQVELFSMSPNLWEFQILESGKAIDNAEECVGLYLLQVEKLEEKLKNHSYVAATVPSSDNFFMLWHYRLGHRNFMYLEKMFPSLFNKNKKHI

SEQ ID NO: 159273 - protein, 102 aa, Glycine max
  Coding DNA Sequence Number=SeqID_67588
  Homolog annotation: Hit_ID=Q2QMR9; Match level="QueryCoverage=62%, HitCoverage=7%, E-value=8e-07, Identity=46%"; Hit description =Transposon protein, putative, CACTA, En/Spm sub-class
MIHDLGQESLQQAHAPMYDTLESDSNKLFVSEVQEVVDLVAKYGWSDKSFTLLLKVVQDMLLEENMLPKRYYEMNTTRKYRFSIANLTSIFDKTDVNINAVA

SEQ ID NO: 159274 - protein, 228 aa, Glycine max
  Coding DNA Sequence Number=SeqID_67589
  Gene Ontology: Mol. function=transferase activity; Biological process= amino acid biosynthetic process
  Homolog annotation: Hit_ID=A2WZF4; Match level="QueryCoverage=22%, HitCoverage=13%, E-value=1e-11, Identity=73%"; Hit description =Putative uncharacterized protein
  Subcellular localization annotation: CTP_CleavageSite=45; ConfidenceScore=5.23e-01
MLDAQAIMLVHLASPKSTSTRNPYTVSPSNLGGIGDHVSNVVSVVGAVHMGVVVIVGLIIHGGGVDSNIASALLRGGVDRIVFFASVVAEGGKGHGQGDSKGGLVVVHEADGEGERRTVRRLRHKTLRLLRIRCLLLSLSPSFASIAFAYARVLLKVSGEALAGDHSQNIDPKITMTIAREVAVTRLGIELHAFVYLKLKFLCIKQPKILSALFQVINFPIWAKHFSF

SEQ ID NO: 159275 - protein, 495 aa, Glycine max
  Coding DNA Sequence Number=SeqID_67590
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=A7NXR7; Match level="QueryCoverage=87%, HitCoverage=87%, E-value=1e-103, Identity=48%"; Hit description =Chromosome chr5 scaffold_2, whole genome shotgun sequence
  Pfam annotation: Domain name=Branch; Domain location=85-375; Score =227.7; E_value=2.6e-65; Accession=PF02485.12; Description=Core-2I -Branching enzyme
  Subcellular localization annotation: CTP_CleavageSite=51; ConfidenceScore=5.55e-01
MQNSTAPAPSQSQLHWPSLSTFLNLRDPKPKPTLLLYSFLFLSLLSLTLILSLSFTSPSPHSGPDPFLHPIFHTHKPSTPSPPSLAYLISGSHGDSPRILRLLRATYHPLNLYLLHLDPSAPHADRDHLALSVQSDPVFKAAQNVHVVGRPDFAYHKGSSPVSLRLHAAAILLRLSQNWDWFVSLAADAYPLVTQDDLLHILSFLPKDMNFVNHSSYIGWKEAKKLKPIIVDPGLYLSEGTEMFYATQKRELPSAYRVFTGKSFLMESWDFIHMFLTVPKKSTVGNIKNFVPHCPEALRYAKAFYGHTKYLSYIEGYRFCFYLLIGSSFSILSRSFMEFCILGEDNLPRILLMYFANTPSSLSNYFPTVLCNARQFNRTVINQNLLYAIHDSHRNDLRPLNSTDFDDMIHSGAVFAQKFQNDDPVLDLIDQKLLGRSPRSIVPGGWCLGEPGNNTCLTWGDAKILRPGTGSQRLEKAIVELLANGTFRSRQCIYE

SEQ ID NO: 159276 - protein, 186 aa, Glycine max
  Coding DNA Sequence Number=SeqID_67591
MINSYKMQKGHWSMSVELCKACRNHVKFVLVCYLVLGIGLQRLENDRNVLSMCQIGLADPKKEVHVYLENVDPEGGPVNEIGAENVVEDVAEECTQNGIEDMDVDGAKGGSDDENEVVGTVELKPEVVGVETEVNNGADDDEVKEHDGDVEFSYHSKSDPNYVYVSSEDDEQSSDTLADSYQSEEF

SEQ ID NO: 159277 - protein, 102 aa, Glycine max
  Coding DNA Sequence Number=SeqID_67592
  Subcellular localization annotation: CTP_CleavageSite=37; ConfidenceScore=5.51e-01
MTTEVIHGHNSAAPRLHFSSTPSSFVFSLGNSPRRVVACLGELWLNGEGIHSPRRVACLGLKLLFSLSEMDASLGEFRVKNLHEKTILPFLLALFLDLTNNH

SEQ ID NO: 159278 - protein, 102 aa, Glycine max
  Coding DNA Sequence Number=SeqID_67593
MTNTMQNTFKRVDFPHPLGPRIIQNCPQERDEQSLRTEERWWLWRCNEKEAKLCRLGQDRWRNEEVCGKGVLEGSRRRYKQNMKLKKIKITYFCIRRAGVYN

SEQ ID NO: 159279 - protein, 45 aa, Glycine max
  Coding DNA Sequence Number=SeqID_67594
  Gene Ontology: Mol. function=RNA-directed DNA polymerase activity
  Homolog annotation: Hit_ID=Q2HSQ4; Match level="QueryCoverage=100%, HitCoverage=47%, E-value=2e-11, Identity=68%"; Hit description=RNA -directed DNA polymerase ; Zinc finger, CCHC-type; Peptidase aspartic, catalytic, putative
AQIEESQKSTMARFLHGLNRDIQDIVELHHYASLEDLIYQAIKME

SEQ ID NO: 159280 - protein, 120 aa, Glycine max
  Coding DNA Sequence Number=SeqID_67595
  Gene Ontology: Mol. function=aspartic-type endopeptidase activity; Cellular component=chromatin; Biological process=chromatin assembly or disassembly
  Homolog annotation: Hit_ID=Q2QRT1; Match level="QueryCoverage=72%, HitCoverage=12%, E-value=4e-09, Identity=38%"; Hit description =Retrotransposon protein, putative, Ty3-gypsy subclass
MDFLKLILLRVCMRRGKHKLRKRFNNMLDIPIRGERKWLLVWVIRFTSKRKSKLQEKGDGPFQVLKRINYNAYKIALPLDYGTFDINSRANYSQEGGYDRGLSKEEEFGLGGLNMDGPIT

SEQ ID NO: 159281 - protein, 441 aa, Glycine max
  Coding DNA Sequence Number=SeqID_67596
  Gene Ontology: Mol. function=flavin-containing monooxygenase activity; Cellular component=microsome; Biological process=electron transport
  Homolog annotation: Hit_ID=O49312; Match level="QueryCoverage=99%, HitCoverage=98%, E-value=0.0, Identity=75%"; Hit description =Putative flavin-containing monooxygenase
  Pfam annotation: Domain name=FMO-like; Domain location=33-441; Score=- 395.4; E_value=1.6e-06; Accession=PF00743.10; Description=Flavin -binding monooxygenase-like
  Pfam annotation: Domain name=Pyr_redox_2; Domain location=32-401; Score=-42.6; E_value=0.033; Accession=PF07992.5; Description =Pyridine nucleotide-disulphide oxidore
  Pfam module annotation: Pfam domain module=FMO-like::Pyr_redox_2; Domain location=33-441::32-401
MHDICLNMPPMVQTFDPEDLFKRRCIWVNGPVIVGAGPSGLAVAACLKEQGVPFLILERANCIASLWQNRTYDRLKLHLPKQFCQLPNFPFPEDFPEYPTKFQFISYLESYAKHFNISPQFNETVQSAKYDETFGLWRVKTIRKIKKLGEASSGCCGAVECEVEYICRWLVVATGENSEKVVPEFEGLGEFGGHVMHACDYKSGEGYGGQKVLVVGCGNSGMEVSLDLCNHNANPSMVVRSSVHVLPREAFGKSTFELAVMLMKRFPLWMVDKILLVLARLILGNVEKYGLKRPSVGPLELKHTAGKTPVLDIGALEKIRSGKIKVVPGIRRFFPGKVELVDGQVLQIDSVVLATGYHSNVPSWLKENDFFTSDGTPRNPFPNGWRGKGGLYAVGFTRKGLSGASLDAINVAHDIAKNWKEENKQKRKTVAARHRRCISHF

SEQ ID NO: 159282 - protein, 264 aa, Glycine max
  Coding DNA Sequence Number=SeqID_67597
  Gene Ontology: Mol. function=serine-type endopeptidase activity; Cellular component=cell wall; Biological process=negative regulation of catalytic activity
  Homolog annotation: Hit_ID=A7R0N1; Match level="QueryCoverage=50%, HitCoverage=22%, E-value=4e-39, Identity=60%"; Hit description =Chromosome chr10 scaffold_312, whole genome shotgun sequence
MDPKKKIVCSVISGAEDSLHMQICKSWQQSVVKYRLTPYYCPLLGSIIICTFSAGFNNGTSTLHAIIGTSKALGLEGFILVANPNYGDYIAEPIPFAVSGIMIPRVDDDKVIFQHYEEQTKRDRKGTTTEFGAMATVGEGRIASFTGRSPIVSRFSSTSPNIIGMHNNLADVLKTVQQKNHGLAMEELINKTQLSPKIIPTSSCRLGGSSTESHFLHPTAVILLPRTWFVIITCIKYTIQNCKREFIINRINTKTKQSQLEETH

SEQ ID NO: 159283 - protein, 78 aa, Glycine max
  Coding DNA Sequence Number=SeqID_67598
MAGDWPFISDESEVTASLTVKISYWEELKSGIFGDISWYRISYPGAENSTALATPQGFHSKPSIQSQRIGKNSLNEYI

SEQ ID NO: 159284 - protein, 255 aa, Glycine max
  Coding DNA Sequence Number=SeqID_67599
  Homolog annotation: Hit_ID=A7NXN5; Match level="QueryCoverage=48%, HitCoverage=83%, E-value=5e-26, Identity=52%"; Hit description =Chromosome chr5 scaffold_2, whole genome shotgun sequence
MLLSKLRKASGIGKSIENQTSKRDVSTSTEDLASEDPASNSSNPEINDNAAEASSLSSVTETRHSSFGVSPVNIPHDQMRMIENINALISELALEKEELIKALTSESSECSRMKEINMELSRKLEVQTQRLELLTAQSMVNENISAKQPDSRAMYENTSYADEGDEGVGMDYEALSWWTFKTENQQTSLIGFTLDLYLLSPKSYSTVRKDHEAVPQYATKVKNQNISIPDPRVTCRQKSTELLFVLVTSSTHWRS

SEQ ID NO: 159285 - protein, 91 aa, Glycine max
  Coding DNA Sequence Number=SeqID_67600
MIKCLTQVFALSTPLGFFVRLLCTKLELAAKRGDTLGNHLMQAPLELVGLGSSSSMDSFASWKINGSGMEKEEREETPLQGEDKSRRSSPP

SEQ ID NO: 159286 - protein, 96 aa, Glycine max
  Coding DNA Sequence Number=SeqID_67601
MPLSPMILVTLADNELMSVASSFLSLGDAYLHGTTWLFRYGNGIGLTTEGYQSFWGAAPLVKYTTKGLDLPTLLSSADCIHICNSSLPSSPTSSRP

SEQ ID NO: 159287 - protein, 140 aa, Glycine max
  Coding DNA Sequence Number=SeqID_67602
  Gene Ontology: Mol. function=aspartic-type endopeptidase activity; Biological process=RNA-dependent DNA replication
  Homolog annotation: Hit_ID=A5APV4; Match level="QueryCoverage=28%, HitCoverage=7%, E-value=7e-09, Identity=67%"; Hit description =Putative uncharacterized protein
  Pfam annotation: Domain name=G-patch; Domain location=1-42; Score =17.9; E_value=0.0013; Accession=PF01585.14; Description=G-patch domain
MVARVMLGNGYEPGMGLGKDNGGRTNLISARGNRGKFRLGYKPTQADIRKSVAGRKSGGQGSRLRQEVKGGPPCHISRSFISAGLGHKGQVIAICEDDSPSGSDLIKEEVKKQFDTGFLAVARYPEWVANIVLVPKKDGK

SEQ ID NO: 159288 - protein, 102 aa, Glycine max
  Coding DNA Sequence Number=SeqID_67603
MTKFDPDIVLEFYANAWPIEEGVRDMRSWVKGQWIPFDANALSQFLGDPLVFEEGQECEFSQRMNRADGFDEEAIAQLLCTPGQDFARTAVGRRVCHPPGTL

SEQ ID NO: 159289 - protein, 146 aa, Glycine max
  Coding DNA Sequence Number=SeqID_67604
MTLLLSNILPSDRNANLPLQKYQLVCVVPTWGSHPQRHLGDLKKSNRALGFPALVTGLYQSYRVPVPPRQGHVIIGIAPARHLVDPKKANRVLELPALNTGLYQSYGVPVTSGKGIKPPTNRAFIKKYCAPRQAQGETPRQHWDGR

SEQ ID NO: 159290 - protein, 56 aa, Glycine max
  Coding DNA Sequence Number=SeqID_67605
MGCEIYPEVHENPRAFFSSSSPILLESLAHGSSDWSLPREDCIKAGRYKFSQKIYF

SEQ ID NO: 159291 - protein, 67 aa, Glycine max
  Coding DNA Sequence Number=SeqID_67606
MIMRGQNIYSSQDEATTSPSSSESEEAKGEESSEEIYPQEEGQPLIIKQECKDVLKEEAQSFKNLWI

SEQ ID NO: 159292 - protein, 143 aa, Glycine max
  Coding DNA Sequence Number=SeqID_67607
PWIPALITGLCQSFGVPVAPTKAQGDAPQAAGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGD

SEQ ID NO: 159293 - protein, 62 aa, Glycine max
  Coding DNA Sequence Number=SeqID_67608
MGVMARWNDRAIADALQALAQAIGNPNRGEASGAVEYQGLDRIQRNNPSSFNGGYNPNGAQN

SEQ ID NO: 159294 - protein, 132 aa, Glycine max
  Coding DNA Sequence Number=SeqID_67609
IVYARSPTGTLVPLDLEIEATLRRNMDERRRKLLQDRTIASILEEETYFSDSLSPDSPSSRESANQHSKTTTMADEHDQRTTLEDYSRLPNEDPYAHLATFIEICNTVKIASVPDEAIRLSLFSFSLAGEAK

SEQ ID NO: 159295 - protein, 129 aa, Glycine max
  Coding DNA Sequence Number=SeqID_67610
MGSNRTPLLKKRFYQVKVMSLEVASLRELGQLMGQLQWQAFLKAYGKIWDLAMIEVSVCLTFEDFQLVLTVEEFEEILGCPLGGIFSPVSIPPWPELPSEGLGKSRLSYPNFVRGPLLDDVRPFFGPRE

SEQ ID NO: 159296 - protein, 75 aa, Glycine max
  Coding DNA Sequence Number=SeqID_67611
MKNERRTMENLHGFAHGNVSEAFKEAPRLGFSSRKQFFSPKIDEMHSIGEKEKGGCRPARLGELSSPRRARLLPP

SEQ ID NO: 159297 - protein, 63 aa, Glycine max
  Coding DNA Sequence Number=SeqID_67612
MGSMNMMTIWSGSELVKMRHDQLLQNLISKSGTRMSYPNFVRGPLLDDMRLFFGPCKVLGTHH

SEQ ID NO: 159298 - protein, 98 aa, Glycine max
  Coding DNA Sequence Number=SeqID_67613
MTCRDTQGLSIHTFMLPRPVRSQVACRDTLYGNRTHFEDKNVFNHCMPSKATMSSHISKTTMSSVIACLQKATMSSFTFRRRQCLQSLHAFKGHNVLI

SEQ ID NO: 159299 - protein, 191 aa, Glycine max
  Coding DNA Sequence Number=SeqID_67614
MVHYSEGVCIETNIGGSKKEEIGECVANEMLWIGLHYSNKDIQASTYLIPILHFQLTEVRQQNDLQGQDTPNWRDSQSEMELFHWRHTPGQDTPNLRDSKSEMESTHRIQYQRGRGESRKSLSQGKKELTYLLQVNNCRSSPSNSNALNQPNKDLSLHQSSISNKLPHRMQCSHHRKQKVNCGGEAEEDGK

SEQ ID NO: 159300 - protein, 572 aa, Glycine max
  Coding DNA Sequence Number=SeqID_67615
  Homolog annotation: Hit_ID=A5B1M9; Match level="QueryCoverage=8%, HitCoverage=6%, E-value=3e-07, Identity=54%"; Hit description =Putative uncharacterized protein
SRLFRFFRRFPQINVGGDSARIPFVEHASRESRVALPPKGRLRLFPGKLKSKWSGPFTIKEVRAHGAMELVDPREGSFEKKWIVNGQRLKPGANSKTQVGRPALSATPSAKSPGRIVVQNCVNLSCRDHHAKPFQRLSDALINFSEHAKRVLVALSACLLQQTDAPSAGLGLRAHQPRSLLRAAPFYSPHPSSIASRKLRAMPTSGEASNWDSSRFTSEIAWHRYQDNIQLRNILSERNVELGPGMFDEFLQELRRRRWDQVLTHLPEKRIDVALVTEFYSNLYDPEDHSPRFCRVQGQVVRFDADTINDFLDTPVILEDGEEYPAYTRYLSTHPDPDTIAATQCTPGGRFVLNVDGLPWKLLRKDMTTLAHTWSVLSYYDLAPTSHTSDISLIAQSSTSRLGFPAFITVLCDIQGVVSDTLIFESLSPAINLAYVKKNCCNPADPSITFLGTRRTHTRASVSASEAPLPTQPPSQPSSQRPRPPPASTSASMDMHGRMLRSIHVRQQLIMENMHRLSLHLQMDPPLITPEAYHQQGEEPSRAAEDPAVDEDLIADLASTDWGPWADLGGGS

SEQ ID NO: 159301 - protein, 231 aa, Glycine max
  Coding DNA Sequence Number=SeqID_67616
  Gene Ontology: Cellular component=membrane; Biological process =protein secretion
  Homolog annotation: Hit_ID=A1G037; Match level="QueryCoverage=51%, HitCoverage=37%, E-value=7e-45, Identity=79%"; Hit description=Type II secretion system protein precursor
MARLGTAWMFPLTLLLYLLGCWLWVMRRTTKLRAQLLHQLPDFLDNLVRLTALGNSLQAAFQVASMQTSAPLRGLLDTTVRFARSGMELDRALAQAAQPYRMEVLKVLSVVIGAAGAFGDDLRDTHVCVGAGPAATGLRGADGDRQPGLLPAGAARSAWPQDPAACTGHGACRRLPAVSPGQIAMNPRPAGDDAIGAPAPWFAYTLARTLAAAVPAAAVRSQVVSSVQRPR

SEQ ID NO: 159302 - protein, 66 aa, Glycine max
  Coding DNA Sequence Number=SeqID_67617
MWDRNMLRGALKLGVFTPKAYTLKSPSGPLPPDSGSLLSYPNFVRGPLLDDMRPFFGPCEVLGTHH

SEQ ID NO: 159303 - protein, 98 aa, Glycine max
  Coding DNA Sequence Number=SeqID_67618
MQLSSPALSSYKEILFLYSLHTIASLFRPIPILCKSGLKKGFLFVKARLAPFSHKAQVSEIWLGANLALSAEVTTVSLSKLHMRWARAGVEDSLQAYP

SEQ ID NO: 159304 - protein, 100 aa, Glycine max
  Coding DNA Sequence Number=SeqID_67619
  Gene Ontology: Mol. function=peptidase activity
  Homolog annotation: Hit_ID=Q8H6W2; Match level="QueryCoverage=67%, HitCoverage=73%, E-value=3e-12, Identity=51%"; Hit description=Gag -protease polyprotein-like protein
TCKGILQDCGTLKRVAWGLDVGTRGYHYWKTRMQIFIEAIDLNIWEAIEVGPYVPTMVAGNTTIEKPREEWFEDERILVQYNLKAKNIITSALGMDEYFR

SEQ ID NO: 159305 - protein, 110 aa, Glycine max
  Coding DNA Sequence Number=SeqID_67620
  Gene Ontology: Mol. function=peptidase activity
  Homolog annotation: Hit_ID=Q8H6W2; Match level="QueryCoverage=74%, HitCoverage=90%, E-value=2e-18, Identity=54%"; Hit description=Gag -protease polyprotein-like protein
MASSNFPFLEGNSINRPLMFNGEGYHYWKTRMQILIEAIDLNICEAIEVGPFIPTKVVGNAIIEKPREEWNDDERRKVQYNLKAKNIITSALGMDDFLESQIVKCKRNVG

SEQ ID NO: 159306 - protein, 74 aa, Glycine max
  Coding DNA Sequence Number=SeqID_67621
MPSKIILMMPKNQESKRTSTWVMILRTREGTSLVDEDKARNKGKEPLEGLGRPMARARTKKANEALQQVLTHAI

SEQ ID NO: 159307 - protein, 110 aa, Glycine max
  Coding DNA Sequence Number=SeqID_67622
  Subcellular localization annotation: CTP_CleavageSite=53; ConfidenceScore=5.89e-01
MGSPPASTPPPPPPPPPPPSPPPPTSDASASTSAMKRTRKASRLRSLSTRPPRVERPVVHVDPATGKADGPHRKKLRTYLGIVARDKVDITYENWKVVPTAQKDLIWEDI

SEQ ID NO: 159308 - protein, 101 aa, Glycine max
  Coding DNA Sequence Number=SeqID_67623
MDKFDIFDPHPLKNTSLLIQLPPECECKPLGDMRLMGASSKEGKCAESPPTFIRGKRLKNRKMCDLRTLSVKGSGVVFTHGEGCFPCSYVFLNRDKEIRPM

SEQ ID NO: 159309 - protein, 82 aa, Glycine max
  Coding DNA Sequence Number=SeqID_67624
MGDYKEAGWEWKLAWRRPLFDNEKSYPLMVGITVMGESISCFPERPKDAFPTTCSNYDQWFAGQKMEVVVDSCHMDHLEAEK

SEQ ID NO: 159310 - protein, 215 aa, Glycine max
  Coding DNA Sequence Number=SeqID_67625
MDNEDDTRSLIYDGEWAEVTRRRNKNTTASRVQSRPTNQHLANRTVTWWNKADITTFYFSRFPSWVNKKDLWQTFQRWGKDVEDAVGLERKLDNSIFFGGRKMFVNQPKFERSEEAIRKQNNNNMPDNVNLQGECGFAGNEYPLQPEGRISPTRRGCEETSGPRYINSAEGVDTECLGGSFKKYRHVIFHNLQESKATQIIHEERKNGSTPIMDL

SEQ ID NO: 159311 - protein, 229 aa, Glycine max
  Coding DNA Sequence Number=SeqID_67626
  Homolog annotation: Hit_ID=A5ALZ8; Match level="QueryCoverage=58%, HitCoverage=20%, E-value=2e-10, Identity=31%"; Hit description =Putative uncharacterized protein
MAFAPSNFVSQPFPNSVAEKLDDSNYLHWHQHVEPAIKSHKLQRFVVNVVVPSRYLTEDDRIVDRVNPEYETPGRFKTKRFLFGLHSKSRARQLRSTMRAVNLDGKSIEEYLHKIKGYVDELAGVGVLVCHEEYVDALLEGLPTDVSFQPHESLTLFDPTTMHPIPYSAGPPRTSNTWVNPNSKSTGSVHNQPSAMLTNLASHGTAPAGSTWIPDSGASFHVIGDSQNI

SEQ ID NO: 159312 - protein, 598 aa, Glycine max
  Coding DNA Sequence Number=SeqID_67627
  Homolog annotation: Hit_ID=Q2HSY1; Match level="QueryCoverage=18%, HitCoverage=76%, E-value=6e-08, Identity=28%"; Hit description =Putative uncharacterized protein
MWEIFIPKQRNKEGRRYGFIRFKGVSDKRRTERYLDNIIVGGLKMHVNIPKYRRGKASQNQNKDKHKKQGEGVVDMDQMEIAPNRAAHSTAVNRTYGEAVAPHTEKTGQRRISGTHLAEYGGSHSSLILDIPKGDKTCYTDAWVGRMKKPEIFKRLEDEVSWTLGPGVSPKYLGDDMILLLGLSDEKAAEIISEETNQGSTLFYSLVKWSSELRPGNRLVWLRCWGIPLVVWKLENIRKIVATVGDLVEVDDDVEHMQRLDQVRVLVRTPRPPLIQHSVAIHIEGDIHRVHMVEENCSVEMSCAQYRRSSWDSSEEIVSDEGDTVTPRSWMSNHLPKPVGDEHDDNCNIWQSATLPSGHNVEDDPLGNDCTNRAHCPTHVSHSTGGSKGKELEPVEGYLTILPAGYGEEDVDIVGPEAKVAGKRKEAARSSMGGTETCLEEIIADPTLGQKMDSIYGHNGPHTLEFENSRAPNVKNSKENEAHLFFLCDKILPLWWESWSWVRIQGVFPHNPRQHFSQHVNCLAKGIRDIRWRCWWLTLTWAVWQHRNNIIFSNQTFDGNKVMDDAIFTLWTWLKVFEKDFALPYSHWLSNMPSAFVY

SEQ ID NO: 159313 - protein, 90 aa, Glycine max
  Coding DNA Sequence Number=SeqID_67628
MKNGQRTEENLHGFAYGNLSEVKKGEEVAVQLAQVSWVTSTRSNLASKNSLEGLWEFYGSITDLPEDYFLTKRGRWLPPSSPRRARLLSP

SEQ ID NO: 159314 - protein, 128 aa, Glycine max
  Coding DNA Sequence Number=SeqID_67629
HCTPRQAQGDAPQATDAQLPPHQADPTRSLGMERYLQHLVRQQATNHRGQVQIHECLYQLSHSQQGQGFAPFACPTPEQFRAEVAWTGDWPEAQAGEALAGAPGDAEEACMDEEMTDLLDFLGGSGAT

SEQ ID NO: 159315 - protein, 289 aa, Glycine max
  Coding DNA Sequence Number=SeqID_67630
MDTWFTDENKKTDFKMICVLKNVRIPKILNLEWFSKQGFKFSNWFKAHGLSTWVQMKGTFYLELVKVFYRCVHANMEGNLYSTANGVEIIIDATIWKVVVGLDMGGVHKFEESMDGYNKMETYRGMLLDPTRILRNRLGIGGLTAEDRMLVYLIAYILVPRTDEDSKQSIINKETFIARQQHFSVVNLKAIKVDIRRNNPILLVAQEDDPQIAERQSPKQNASPTTRIGRRHCFQKATDEEERPHLEPIQRQHEVVTPPQWVKYDHVHNPLAAYKALPLGAIVVMDTPS

SEQ ID NO: 159316 - protein, 75 aa, Glycine max
  Coding DNA Sequence Number=SeqID_67631
  Subcellular localization annotation: CTP_CleavageSite=40; ConfidenceScore=5.19e-01
MEGDSIGQGDLGRSGKQPLLPSSLPLNPSQRPKLLLHHPRPSMATSSRHCLPLNPHTKRNTLVQGESSKLISRIR

SEQ ID NO: 159317 - protein, 166 aa, Glycine max
  Coding DNA Sequence Number=SeqID_67632
MSRNFTDCLTMGVKFLEAVKQRKEYALRCPYQTRARARLISEIEEVQEQMEADMEAMKEQMAIMMEAMMSMKKVMEVNAATVVAASTATEVDPTHPSGLNIGGEALGSTGGPHFVQVQNKHSFPPYGLPSNYTPPNVAHTPNENVDNSASIPIESQQPQSDHAHVS

SEQ ID NO: 159318 - protein, 879 aa, Glycine max
  Coding DNA Sequence Number=SeqID_67633
  Gene Ontology: Mol. function=triacylglycerol lipase activity; Cellular component=monolayer-surrounded lipid storage body; Biological process=triacylglycerol catabolic process
  Homolog annotation: Hit_ID=A7PVQ6; Match level="QueryCoverage=97%, HitCoverage=96%, E-value=0.0, Identity=69%"; Hit description =Chromosome chr8 scaffold_34, whole genome shotgun sequence
  Pfam annotation: Domain name=Patatin; Domain location=234-437; Score =90.9; E_value=4e-24; Accession=PF01734.13; Description=Patatin-like phospholipase
MDHINNEASVDPFAIGPSSILGRTIAFRVLFCKSISQLRHHIHFVLLDILKRFWGFWGPIVSWLHPRNPQGILAMMTIIAVLLKRYSSVKVRAEIAYRQNFWRNMMRAALTYEEWAHAAKMIDRETPKMNESKDLYDVELVSNKLQELRHRRQEGSLRDIIFCMRADLVRNLGNMCNPELHKGRLQMPRLIKEYIDEVSTQLRMVCNSDSEELALEEKLSFMHETRHAFGRTALLLSGGASLGAFHVGVVKTLVEHKLLPRIIAGSSVGSIMCSIVATRSWPELQSFFEDSLHSLQFFDQMGGIFTVVKRVTTYGAVHEIRQLQMLLRNLTSNLTFQEAYDMTGRILGITVCSPRKHEPPRCLNYLTSPHVVIWSAVTASCAFPGLFEAQELMAKDRSGEIVPYHPPFNLGPEKGSTSVRRWRDGSLEMDLPMMQLKELFNVNHFIVSQANPHIAPLLRFKEIIRAYGDTSIVYKYPVDTRMWIKIITRAAMGPGMTSNLNIDWHLAHLAEMEVKHRCNQVLELGFPLGGLAKLFAQDWEGDVTVVMPATPAQNPSYVELQKAANQGRRCTWEKLSAMKANCGIELALDESVAILNHMRRLKRNAERTAAASHGLPSTGKFSGSRRIPSWNIIARENSTGSLEDLHAAAAATSSLHQGVISPSGATGKNWKSHRSFHDASDSESESAHDLNSWTRSGGPLMRTTSADMFIDFFQNIEVDTELNRGKVTNTTTSPRDFQHHISRHTTPDHNRWCSKRTEIDQKENGNRMIAMNGSNIMVTEGDLLQPERIHNGIVFNVVKKQDFLTPSNRNNDYNSCCNNEVAECVQIEFPGKEVDALSSASENGDDGSTMARSLTEKPDYNSTNHFSKDFGEDQSIADN

SEQ ID NO: 159319 - protein, 99 aa, Glycine max
  Coding DNA Sequence Number=SeqID_67634
MNQNTNQGRNFLAKRPIEFTPIPVSYANLLPYLLNNAMVAITPAKVPQPPFSQGYNSNTTCAYHGRVLGHSIEHCMTPKHKVQSLIDAGWLKFEEDNRL

SEQ ID NO: 159320 - protein, 109 aa, Glycine max
  Coding DNA Sequence Number=SeqID_67635
MLQSPLYHPETIKSDGTWKPLRSSATFAIQRQSSLMARRDKYGHLLPLSKTQCLSIKTIKVSPPSSRDSHVRWHAETNMVICPSLLKTQCLSAETIKVSPSSSKDNQVR

SEQ ID NO: 159321 - protein, 76 aa, Glycine max
  Coding DNA Sequence Number=SeqID_67636
MAPRKLPAKRSRKDTTREGSSAAPRVDVDFDRHRFRSAKQQQRFETIKGWSFLRERRVQLRDEEYPEFQGEIARRH

SEQ ID NO: 159322 - protein, 69 aa, Glycine max
  Coding DNA Sequence Number=SeqID_67637
MFSKGDNDLHLHFKDDNVMQAPLELVGLGSSSSMDSFASWKMNGSGIEKEEREEMPLQGEDESRRSSPP

SEQ ID NO: 159323 - protein, 129 aa, Glycine max
  Coding DNA Sequence Number=SeqID_67638
MGAEEGVRALSIEGIERNKREEEERRGKKVEVLPNRDCNQPLHHSSFGVLRLSFGGALQPWAHLGPSGSFYMKQPARLGKLGGKPLPYFGYKRAWEVEGRGSTPWASIFHLKLVKRRRKKKKIKAEALP

SEQ ID NO: 159324 - protein, 258 aa, Glycine max
  Coding DNA Sequence Number=SeqID_67639
  Homolog annotation: Hit_ID=A5ALV5; Match level="QueryCoverage=25%, HitCoverage=45%, E-value=4e-18, Identity=62%"; Hit description =Putative uncharacterized protein
MVCKGWSFNGVSMEDEEERKSNFLAFLRARRGQFSKVGNIYIKTLRMKPRAWFRGCHNGRNWVQAFSNPFFINGLLTYTKECGSFDKFLSLYLFMRCLDFSKLHGHAEENCYSHLDHSHTRSEGRRRTIRERRTARGRRRTTNTKKEKKKKNDDKNTGRGISGSEEDEEATVGRREGNVLYGRISRSIYSIRVKDIFVISPWVLGALTKMLGAPSNTPLLNMNRPLNNLMGRTNLYKNHTYPTLKGKLLMGNRPKLRL

SEQ ID NO: 159325 - protein, 105 aa, Glycine max
  Coding DNA Sequence Number=SeqID_67640
RSFAIGVGAVTSFGYCKDRDGQWLKKDALPPQDERTPSPPPQRDDSALMTEVLSELWSLRTYVGERFDSLDGCFEGMDTCITQLEENVTYLRRGREMGWYSGVKA

SEQ ID NO: 159326 - protein, 75 aa, Glycine max
  Coding DNA Sequence Number=SeqID_67641
ESVQVIEVSSSEGDLEEDPEELPLEPVVDDLDLPEDDEDPLPNVDSLEDIMSAFEADSTEESGPGGTTNSDDSLS

SEQ ID NO: 159327 - protein, 132 aa, Glycine max
  Coding DNA Sequence Number=SeqID_67642
  Homolog annotation: Hit_ID=A5C4X7; Match level="QueryCoverage=32%, HitCoverage=4%, E-value=8e-10, Identity=67%"; Hit description =Putative uncharacterized protein
MLRVFLCARYQANPEESHLTVVKRIIKYLKGTTNVGLLYPKDDEQPFQSSEESQVLQKEARRVLSIDLIHGLRMRMKENFYLKLLKVFYTCAHADLEEMIIDAEVWKVVTRLDMGGVHKFEESIDEYNKMQT

SEQ ID NO: 159328 - protein, 182 aa, Glycine max
  Coding DNA Sequence Number=SeqID_67643
  Homolog annotation: Hit_ID=A2Q6B4; Match level="QueryCoverage=81%, HitCoverage=53%, E-value=8e-07, Identity=24%"; Hit description =Ribosomal protein L33; Nucleic acid-binding, OB-fold
MARSLDKIKNIDGSKETLKLTVRITDLWFIGTPNKSEQAGMVFVDSDIYYLLFRPLCCNFNAIQGDEIHVVCKQDQLKSWKMDFKENCTYVMHNCKVLKNNDQYRVCDHQFKLVFIGVTVVRQCVQEDLPFRKYRFAGFADVVASQFEPGLLVDVIGVVEEVVFRHVSGKGRRVVFKLKDLR

SEQ ID NO: 159329 - protein, 284 aa, Glycine max
  Coding DNA Sequence Number=SeqID_67644
  Gene Ontology: Mol. function=DNA-(apurinic or apyrimidinic site) lyase activity; Cellular component=intracellular; Biological process= response to DNA damage stimulus
  Homolog annotation: Hit_ID=P45951; Match level="QueryCoverage=31%, HitCoverage=16%, E-value=1e-36, Identity=76%"; Hit description =Apurinic endonuclease-redox protein (DNA-(apurinic or apyrimidinic site) lyase)
MLAIWSMILVTASTIVCHLRELEKSKPVILTGDLNCAHEEIDIYNPAGNKRSAGLTDEERKSFATNFLSRGFVDTFRRQHPGVIGYTYWGYRHGGRKFNRDTRRTRPNLYCEYAVVALQRDSAPSNSMNFQNCPSFKNQNVLPPAICVLHWPSSQQSSRWLAQALVLHFGSLRSSSSLASVSISSVIEVEDEVLPREEASSARVLGDENGVSGRRWSSTSSCGRKVKGSSAGASGRTFLVSSAGARGRTPSSADSIFVLLHSRKNTFFRRVHFLLAEEVVKLLL

SEQ ID NO: 159330 - protein, 50 aa, Glycine max
  Coding DNA Sequence Number=SeqID_67645
MKLSKVVKLSTSPLSNIRYKLKLGALIAKLKLDNKANRTMITTGNIRKNV

SEQ ID NO: 159331 - protein, 124 aa, Glycine max
  Coding DNA Sequence Number=SeqID_67646
MTTLTQIWMTLLLSNILPSDHNSDLPLPKIAPTRHPVDPEKSNRVLGFLALVIGLCQFYGVPVAPSKVIRPPINRVFIEKYRAPRQVQDEAPQQPGDGQQRATNSPPPPLESISSHLQRLERCL

SEQ ID NO: 159332 - protein, 149 aa, Glycine max
  Coding DNA Sequence Number=SeqID_67647
MAIIYILKTTMSSVIACLQKETMSTFTFRRRQFLQSLHAFKRRQCPHLHFEDDNVFSHCMPSKGDNDPHLHFEDDNIFSHCMPSKGDNVLIYMRRQQCLQSLHAFKRRQCPHLHFKDDRNFIQNILDGGELINCGMRSGNFLTKPLEMG

SEQ ID NO: 159333 - protein, 79 aa, Glycine max
  Coding DNA Sequence Number=SeqID_67648
MAFDEASMERKLQLQELEEILLQAYENSNIYKGKVKRLKAQVEKDKAPEWRRMKAQVEKDEGLEAETLSRLLIVAEGPN

SEQ ID NO: 159334 - protein, 65 aa, Glycine max
  Coding DNA Sequence Number=SeqID_67649
MTYQDNPCGVYPDLSSFTGSGVYPDLSSFTGSGVIQKLYSLYQAIRPVRFTSSGIRASALDTDFV

SEQ ID NO: 159335 - protein, 345 aa, Glycine max
  Coding DNA Sequence Number=SeqID_67650
  Gene Ontology: Mol. function=phospho-N-acetylmuramoyl-pentapeptide -transferase activity; Cellular component=endoplasmic reticulum; Biological process=polysaccharide biosynthetic process
  Homolog annotation: Hit_ID=A7PVR7; Match level="QueryCoverage=86%, HitCoverage=70%, E-value=1e-120, Identity=72%"; Hit description =Chromosome chr8 scaffold_34, whole genome shotgun sequence
  Pfam annotation: Domain name=Glycos_transf_4; Domain location=157 -336; Score=278.0; E_value=1.9e-80; Accession=PF00953.12; Description= Glycosyl transferase
MGARKRLSSSEPHSSSPATKENTTTTKPEQKPTTTDPPIAPPKWGLLLKLSLFFLLPYSYLLFRYYPIEPELRRSILINAGMSLAGLFVTVKMIPVASRYVQKRNLFGYDINKKGTPQGTVKVPESLGIVVGIVFLVVAILFQYFNFTSDSNWLVEYNAALACICFMTLLGFVDDVLDVPWRVKLLLPSIAALPLLMAYAGHTTIVIPKPLVPHIGIEVLDLGWMYKLYMGLLAVFCTNSINIHAGINGLEVGQTVVIASAILIHNIMQIGASTDPEYKQAHAFSIYLAQPLLATSLALLSYNWYPSSVFVGDTYTYFAGMTMAVIGILGHFRHRIIDILGTLNL

SEQ ID NO: 159336 - protein, 133 aa, Glycine max
  Coding DNA Sequence Number=SeqID_67651
MEIVKQRCDYGARSGVSRSNASSSLFLTRDSRTHHDKENTLLVRKVFTESVLRVMDDHNWYLGDDCKAYSPKEEEKKVPAERDWETLDQVILDSGETTIREVPQEVAGWLIKESSEEDSEEHMHEISSQEPYC

SEQ ID NO: 159337 - protein, 230 aa, Glycine max
  Coding DNA Sequence Number=SeqID_67652
  Gene Ontology: Mol. function=microtubule motor activity; Cellular component=microtubule associated complex; Biological process =microtubule-based movement
  Homolog annotation: Hit_ID=A7PSX9; Match level="QueryCoverage=50%, HitCoverage=26%, E-value=1e-39, Identity=69%"; Hit description =Chromosome chr8 scaffold_29, whole genome shotgun sequence
  Pfam annotation: Domain name=Kinesin; Domain location=59-230; Score= -100.5; E_value=1.3e-08; Accession=PF00225.14; Description=Kinesin motor domain
  Pfam annotation: Domain name=Mlo; Domain location=18-228; Score= -320.1; E_value=0.0004; Accession=PF03094.6; Description=Mlo family
  Pfam module annotation: Pfam domain module=Kinesin::Mlo; Domain location=59-230::18-228
MNQFSPKLKLLNGGWWYRPEYIINELNINSVITTPCHEEILPINSWTTQRPYLRAGKVPFVSSEAIHQLHIFIFVLAVFHVLYCILTLALGRAKMRRWKGWEVETKTAEYQFSHVLDGFNCTVFTYGQTGTGKTYTMEGGMRNKGGDLPAEAAVIPRAVRQIFDILEAQNDDYSIKVTFLELYNEEITDLLSPEDNSRPTDEKQKKPITLMEDGKDNVFVRGLEEESVYF

SEQ ID NO: 159338 - protein, 119 aa, Glycine max
  Coding DNA Sequence Number=SeqID_67653
MAPKRLSAKRSRKDATGEGSSAALEFDSHWFQSAEHQQRFEAIKGWLFHRERRAQLKEDEYSDFQDALSQFLGDPLIMEENQQCKFRQRKNQVDNFDEEAIAQLLCIPGQDFARTTAGR

SEQ ID NO: 159339 - protein, 303 aa, Glycine max
  Coding DNA Sequence Number=SeqID_67654
  Gene Ontology: Cellular component=integral to membrane; Biological process=vesicle-mediated transport
  Homolog annotation: Hit_ID=A7QHQ0; Match level="QueryCoverage=54%, HitCoverage=14%, E-value=1e-11, Identity=30%"; Hit description =Chromosome chr8 scaffold_99, whole genome shotgun sequence
  Subcellular localization annotation: CTP_CleavageSite=67; ConfidenceScore=5.16e-01
MSSDAVDATASLSPKQNERKGASSIFVNIAKNFKAGNADQNANQSVHTNRLENLKQLFSSPPFLKSSSSTVDKQDPFAIDIDDIQIDEPVVFSSPQKIDIDKRDKGKGTDRQKFLEEASTDLKPKARTADKIKAKYRKTGTWDASAAAALARDKLVERQEKLQAMKKKGVLVPYIQTIQNMYDEITTSVKTPSEETKDFPTRPCEKGYEIKKDNNNQDTTVFMYRCKRGGWSPLFVYNRLPIDEVFLKLSSSFGWYRYHSLCLGPDLVLYLLYDRFLPCKKINQGPIPLGEVLATWITQNHST

SEQ ID NO: 159340 - protein, 117 aa, Glycine max
  Coding DNA Sequence Number=SeqID_67655
MQPSITSPFRHFQTTSSYARDQGLNFHIHIALAYSFLLIAVVGSDAFKPEDDIISCGTITCQLSHKFWGQAKTNYYPWGTSKTEGAKHAHDGDTHNEEGQHYSKVSFLNCPSVSVAE

SEQ ID NO: 159341 - protein, 150 aa, Glycine max
  Coding DNA Sequence Number=SeqID_67656
SSEASSSFPIAGHSHIESVEDTIMVEDPRRVTLEDYSSSTVPQFFTSIAQPEVQAQSVEDTVMASTLNSCLCRSSHSKISQNSLELGPFSLSRTFMHAELLKKGAKLPSQNLISGLNSGSAEEVRLMTWSNALSELDISSSSGFFLALSH

SEQ ID NO: 159342 - protein, 147 aa, Glycine max
  Coding DNA Sequence Number=SeqID_67657
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKAVRSKLDCMHEPPVQSDRCALSGNYRLESNPERHAKAPLAAAT

SEQ ID NO: 159343 - protein, 138 aa, Glycine max
  Coding DNA Sequence Number=SeqID_67658
MGTVGLAAPGGLVDNDHRCEALHVRFTADGEADASEGVGGGGGGETGNYQHQEFFIEIIENNTSNSRGRNDIKTLNDEGMCRNLPFGGRASEARLTGASSMGGKCTESPPTFIERKTLEKPKETGHKEYSRFGSYVYA

SEQ ID NO: 159344 - protein, 267 aa, Glycine max
  Coding DNA Sequence Number=SeqID_67659
  Gene Ontology: Mol. function=hydrolase activity
  Homolog annotation: Hit_ID=A7QB13; Match level="QueryCoverage=19%, HitCoverage=16%, E-value=2e-16, Identity=79%"; Hit description =Chromosome chr5 scaffold_72, whole genome shotgun sequence
MTSSVDDPDFFLKIHLHPTTHLPSGRGNEEEVDQLPKYKFRIIKEFKKEGDIEESSRGIMTESESETATEHVIALEDAAILPPELRQYLPTMLTLRQYFDIVAAPTIRVILGGAFVVNGNVNPTVEVNIFGYSEAADVVFTSGVDVLAVGINVTHQVVLTEFMHKTPVPPWSLIVTVFGVSSTNSASRPSRDGLSTGRDKYPDFQGDISCRHWARLVTPMAKFDPEIVIEFYANAWPTEEGVRDMRSRDRISPGPLQGGRYGSCAPT

SEQ ID NO: 159345 - protein, 96 aa, Glycine max
  Coding DNA Sequence Number=SeqID_67660
GWAKPFCSSSSILYAQVFAVSWGRKDIELVEEEQARIGADPSSGTSNKSENYKKEAWKKTQKHKPKRVESVNADAEAFGDDSKILIALCIVKLLKQ

SEQ ID NO: 159346 - protein, 106 aa, Glycine max
  Coding DNA Sequence Number=SeqID_67661
  Subcellular localization annotation: CTP_CleavageSite=50; ConfidenceScore=5.10e-01
MQNYQHAKRCDSAKARINRKRIMQQKRHAHAQSSSPPTVNCTSEYNMIVSDSSESENSESTQGSDSNFMTPFEDCQSPTNQPVINIEGNDYNSDFQFQMLLYMLLN

SEQ ID NO: 159347 - protein, 70 aa, Glycine max
  Coding DNA Sequence Number=SeqID_67662
  Subcellular localization annotation: CTP_CleavageSite=22; ConfidenceScore=5.12e-01
MESSTVATYPSVGGQRGAHGCVFQGRKARGVATNVYSRKMSEKLERCGLRTLIVKGSGVVFTHGEVVVTV

SEQ ID NO: 159348 - protein, 160 aa, Glycine max
  Coding DNA Sequence Number=SeqID_67663
  Subcellular localization annotation: CTP_CleavageSite=79; ConfidenceScore=5.72e-01
MTGCKQSVNVWPQPHATGAFMTLSADSASSSDFCLSNAMRSSSSLTSQAATSGFVLLWGSAAIFSRLGLDNASPLALLVAMAEGVTPGLIATIMGIQPILTLCLSGGVAAADQRRAVCAGRAAVHDLRCHHAAAGDAASGAGAAAAVRREFTAVPAVAAG

SEQ ID NO: 159349 - protein, 116 aa, Glycine max
  Coding DNA Sequence Number=SeqID_67664
MGEMFATQLAQASKVTSSRSNRLLEESSGGPNRCRGHLIVHRQLPPHGDQLESQGSSKPSDMTPSTSIPAHEKLQLLCGACRPWIFFINGVLCFLEDKWQQNGERKMIGDATSRRR

SEQ ID NO: 159350 - protein, 64 aa, Glycine max
  Coding DNA Sequence Number=SeqID_67665
MNEERMKNGEEQLDLHEIVHGNISEALQKHIGLDFLHGNNFFHLKQLKCIAKREKGEEVAAQLT

SEQ ID NO: 159351 - protein, 295 aa, Glycine max
  Coding DNA Sequence Number=SeqID_67666
  Gene Ontology: Mol. function=motor activity; Cellular component=cell projection
  Homolog annotation: Hit_ID=P15305; Match level="QueryCoverage=98%, HitCoverage=98%, E-value=8e-17, Identity=22%"; Hit description =Dynein heavy chain
FRGLHILPFRGLHVLPFSGLHVLILRGLHALAFRELHVLPFGELHAIAFKGLHVISFIGLHVLPFKELHVLAFRGLLVLTFRGYTSSTSETYTPLPSKDCTSSPLEDYKCSPSNGCTHSPLEDYTLHVFTLRGLNVLAFRALHLLPFRELQAVAFRGLHVFAFRGLHVLTFRGLHVLPFRGLHALPFRGLHVLIFRGLDALAFRGLHDLPFRGLHVLTFRGLHVLPFGGIHVLTFRGLDALAFRGLHDLPFRGLHVLTFRGLHILAFRGLHVLQLKGLQVVAFRGLHVLTFRGLH

SEQ ID NO: 159352 - protein, 176 aa, Glycine max
  Coding DNA Sequence Number=SeqID_67667
MVDKTQGNNKQGEGEWKGHDIVVVENGRDWVLNSFVGRLKDLQKFDKLCNAYALIGSTMVKMKYIQENMVLITGLSEEKLVEMANQSQVKNIPPSPISADARFGRNIQKKGPPPRWQAMYGMKSILLAQNVWRKWMVGGSFSKMVKGDCEAVKDVSVNNFSNDFLHCHKEAHQVVV

SEQ ID NO: 159353 - protein, 45 aa, Glycine max
  Coding DNA Sequence Number=SeqID_67668
MDDFTEDEDQQFFDHTNHQSDDQTDDEGVGKPRHLRHLRCNISNL

SEQ ID NO: 159354 - protein, 396 aa, Glycine max
  Coding DNA Sequence Number=SeqID_67669
  Homolog annotation: Hit_ID=Q2HTA0; Match level="QueryCoverage=76%, HitCoverage=53%, E-value=2e-23, Identity=27%"; Hit description=IMP dehydrogenase/GMP reductase, related
  Pfam annotation: Domain name=DUF1723; Domain location=116-158; Score =14.2; E_value=0.011; Accession=PF08330.1; Description=Protein of unknown function (DUF1723)
GYRKSPGREVNCDSDEAPQRQRPTTPVRRQREATLVTKDVHHVDDAADEVHEQPQEATVDDEVVDAQGFSGGPHDTSVLTVYVDHVAVIVWNGEECPELKLSSHERKVQKSGRPTTTIEKLVVVETCNFHLPVGEVTITLDDVASLLHFPITGAFHSFETLHVDEAVLLLVELLKVSAYEARGETIRSSLSVAFASALFLLTRVQHTRMWVFLDTFQDLTQSGSYAWGAIALVHMYDNLNDESKSSGRQLVEYITLLQHFSFVAEAITAKDYHERKPCAYQWTSWKALSVLTYRKRLDRLTSDGVCWMPYSDHRVVREFELISLFFGYIRWGPVVIHRPERIVRQFGYVQTIPLHSLGSRLCLEDIDDIYMHFSDYLALVDEICVVLGQCTSDYIN

SEQ ID NO: 159355 - protein, 216 aa, Glycine max
  Coding DNA Sequence Number=SeqID_67670
MMTTKAAKEIAEKIDSFEEQPHRDPSSPMDVRMFSPLLLDVQSTLDVSVLLEPLFLPASQRIAIVDPANQGPTRGVHHRKSDATTHGILQPDAVPDAISRTCTASPPSRNDPETGDSDRCGLYIEADPARLVAMGRVYEGAIVVYNTSLLPGQVKVSTSHLPCLADTSGQVLITAAVSPAKPPSKPDPEVDDPLYLMTLTIPELFLRPYQLHGCHP

SEQ ID NO: 159356 - protein, 70 aa, Glycine max
  Coding DNA Sequence Number=SeqID_67671
MNSLSEHVALSEFISTHSELSWAKRDRLQYPLKRASLAKLLTLSRIFEELVPLSAAFKELSANPFGRCSA

SEQ ID NO: 159357 - protein, 107 aa, Glycine max
  Coding DNA Sequence Number=SeqID_67672
ITSNTCAYARKRAVRIKLDEPSLIPVMLASLFHLGYLMNMFISLKPKNRRFKQPMTRSTRQIRSARCIHLARNPAHLVDWETDAILPPKGIGLKTSRRLGQRCKRRP

SEQ ID NO: 159358 - protein, 153 aa, Glycine max
  Coding DNA Sequence Number=SeqID_67673
MSVIKLYIEKDVVGGSTFLSANSVRSCGNNLSNSELEPPRNVSNLDDDEDEDDDDYLVSNSYIEESLGEDDSVDGISDTDDEVTHMVEPVTIFQPREGVEGIQNSFWNDVLHYNNINWSHPDEEDICGLEMPSSFNVGQELYVGMDFDSKDAT

SEQ ID NO: 159359 - protein, 106 aa, Glycine max
  Coding DNA Sequence Number=SeqID_67674
MQYADHLLPAGQLCLVPGQVSTDYMECFFRISHPFMIPTQAVDQPRDAPATDPEDYIQPPSPQVPVAFDPPPHVDDYEGYEAIAQRLERVLNLRIVTAGTELYDIM

SEQ ID NO: 159360 - protein, 47 aa, Glycine max
  Coding DNA Sequence Number=SeqID_67675
MQRVFLSASTCFRNSQRFGGMREKEKVLRGGEGKTKLRERGGVEAIV

SEQ ID NO: 159361 - protein, 179 aa, Glycine max
  Coding DNA Sequence Number=SeqID_67676
  Gene Ontology: Mol. function=hydrolase activity; Cellular component =extracellular region; Biological process=metabolic process
  Homolog annotation: Hit_ID=Q9FF10; Match level="QueryCoverage=68%, HitCoverage=22%, E-value=6e-44, Identity=64%"; Hit description =Heparanase-like protein 1 precursor
MDTWVYLDLKIPMALLPRMIYFVHLLEKYYCSDEHLERKILDPERLSRVESIFGNLSETIKIYGPWSSAWVGEAGGAYNSGGNHVSNRFLNSFWYLDQLGIASCYNTKVYCRQTLIGGNYGLLNATTFAPNPDYYSAVLWHRLMGKKVLAISSDVHIKDFYLQLENFLSVGLALPMARN

SEQ ID NO: 159362 - protein, 87 aa, Glycine max
  Coding DNA Sequence Number=SeqID_67677
MQLKVILFLDIKHPINCKISRGMYKKVIKLVSLRALVLRLVVNHGVSSQLREKLKLEIEKFFKLPIEEKKKYQIRAGDVQGYGTVIR

SEQ ID NO: 159363 - protein, 135 aa, Glycine max
  Coding DNA Sequence Number=SeqID_67678
  Homolog annotation: Hit_ID=A7QFM0; Match level="QueryCoverage=28%, HitCoverage=9%, E-value=2e-07, Identity=58%"; Hit description =Chromosome chr8 scaffold_88, whole genome shotgun sequence
  Pfam annotation: Domain name=DUF623; Domain location=81-121; Score =28.5; E_value=6.9e-06; Accession=PF04844.4; Description=Protein of unknown function, DUF623
MRINSEAAAGKMKHKAKQPFSEETYKDKKNEDIDDNVIPSLTTGFLGVRKDAKKHGKREGTLKLKEKDNIGLGEEGKLLNDEKVSKEMDDLLACYLTLNAYEYHDLIIKVFWQVWSDMRQGGLGNKLNMQWSYYE

SEQ ID NO: 159364 - protein, 591 aa, Glycine max
  Coding DNA Sequence Number=SeqID_67679
  Gene Ontology: Mol. function=binding; Cellular component=protein phosphatase type 2A complex; Biological process=ethylene mediated signaling pathway
  Homolog annotation: Hit_ID=Q38950; Match level="QueryCoverage=17%, HitCoverage=17%, E-value=4e-45, Identity=91%"; Hit description =Serine/threonine-protein phosphatase 2A 65 kDa regulatory subunit A beta isoform
  Pfam annotation: Domain name=HEAT; Domain location=429-467; Score =16.4; E_value=0.096; Accession=PF02985.13; Description=HEAT repeat
  Pfam annotation: Domain name=HEAT; Domain location=470-506; Score =25.6; E_value=0.00018; Accession=PF02985.13; Description=HEAT repeat
  Pfam annotation: Domain name=HEAT; Domain location=509-545; Score =19.2; E_value=0.016; Accession=PF02985.13; Description=HEAT repeat
  Pfam module annotation: Pfam domain module=HEAT::HEAT::HEAT; Domain location=429-467::470-506::509-545
  Subcellular localization annotation: CTP_CleavageSite=43; ConfidenceScore=5.18e-01
MSQGSFVPQGRDDILNTAIGKPDHGGRVRATGSGVTISQYYGRASRGSSSSSITISQEQMTELIGSIREQVKNEFAEEKRRSLETWKKEVKDAIIIEMSQKVSHLTPPTHVDINVLGACVSTKESNAEVAVNRSGEEQVGHMTPTMGLEPLPYIVAYADDVVRVSVDKVIDGETEVPCPTSEIKYVRQALNTIIAWPTPLVKLVLDEQVAESVDGVKDVVVQDPLRELIKCLVDIYDNPVQFEWDSSKFGIPNVDSKLLLTYADVNEITIGDKWLNIAILQLWTISTLGHVSLYGFLEPQSIHNAKDRRGQCEEYIGKWLKESQRQLYLGAYLNQAHWQLIVLCPTNNQVVWFCSMRKRPDVHIKIAINKHYRRLMTAKFLKLHPSGLKLSHVQRGGYKCGYYVMHWTWNIIIGELETDWSLVPNDDFEGIIDEGVAKVVAGLALLDKSWRVRYMVANQLYELCEAVGPDPTRSELVPAYVRLLRDNEAEVRIAVAGKVTKFSRILNPDLAIQHILPCVKELSTDSSHHVCSALASVIMGMAPVLGKGGATLLDIACDPELVNLAIDLTSCPVNSYLLIDVLATLIIWLWT

SEQ ID NO: 159365 - protein, 123 aa, Glycine max
  Coding DNA Sequence Number=SeqID_67680
  Homolog annotation: Hit_ID=A7PRT5; Match level="QueryCoverage=26%, HitCoverage=22%, E-value=6e-08, Identity=81%"; Hit description =Chromosome chr14 scaffold_27, whole genome shotgun sequence
  Subcellular localization annotation: CTP_CleavageSite=40; ConfidenceScore=5.31e-01
MAVITSNLFTLSTTHNATITKFTNRPNSKKILIFNNIGMMLFAKTAIAMLGDLADTLGSNTGPLIQQKAETILTQTNFVHKEFMPLQEEELSMRKIKFKAFDLGGHQIASRVWKDYFAQLTET

SEQ ID NO: 159366 - protein, 94 aa, Glycine max
  Coding DNA Sequence Number=SeqID_67681
  Gene Ontology: Mol. function=protein binding; Cellular component =cytoplasm; Biological process=multicellular organismal development
  Homolog annotation: Hit_ID=A9LDB5; Match level="QueryCoverage=93%, HitCoverage=50%, E-value=2e-37, Identity=79%"; Hit description=TFL1
  Pfam annotation: Domain name=PBP; Domain location=20-93; Score=2.4; E_ value=1.1e-05; Accession=PF01161.11; Description=Phosphatidylethanolam ine-binding protein
MARMSTDPLIIGRVIGDVLGSFTPTIKMTVTYNKKQVYNGYEFFPSTITTRPRVEIGGGDMRSFYTLIMTDPDVPGPSDPYLREHLHWYFNRDI

SEQ ID NO: 159367 - protein, 211 aa, Glycine max
  Coding DNA Sequence Number=SeqID_67682
  Gene Ontology: Mol. function=prenyltransferase activity; Cellular component=integral to membrane
  Homolog annotation: Hit_ID=Q647J9; Match level="QueryCoverage=83%, HitCoverage=42%, E-value=2e-46, Identity=58%"; Hit description =Homogentisate phytylprenyltransferase
MALKTILRYSHCHRESSYITSSCVSKASQCHRKTQIECNLLRSQQSILNHHYKCIEGRPTFQECNRKYVVKAAHAIPSFDSESHASSPKNILDPVKKFLVALYWFCNPHSMIGRTLSATSGCLLAVEKLSDISPLFFIGLLQVLVPNFFMDIYVNGVNQLFDLEIDKINKPFLPLVSGNLSITNAVFIVASSAILVPYRSIPFYNNIFQSK

SEQ ID NO: 159368 - protein, 163 aa, Glycine max
  Coding DNA Sequence Number=SeqID_67683
  Gene Ontology: Mol. function=binding
  Homolog annotation: Hit_ID=A7PJG7; Match level="QueryCoverage=71%, HitCoverage=14%, E-value=5e-21, Identity=48%"; Hit description =Chromosome chr12 scaffold_18, whole genome shotgun sequence
MVDEGGKLGGGFMRSASVNELFSRRSFLSGLIRYPTVAGHLGGTQKRKVENSWQHLCLSGVQKDQSEEQNLVLLEKHLNWRADAQKVGDWKRVLRESEAAIVVGADFSPQSVVQGTEKCGIDGEIEQIVACKVEAYLKLHQLEDVESSLSNVLKLEGCPPECS

SEQ ID NO: 159369 - protein, 305 aa, Glycine max
  Coding DNA Sequence Number=SeqID_67684
MAEPSKKHKGSSSRSQRHSEAQDIPIPSSISSSSLFSSEEQRIRYTNLFSSHSIIDPKFIDLDFFSDESFKCIQAFQKSNLIPFMSLKLPVYSELVKVFYSNLEIQESTLISEVYGIKMVIDQSLFYDLTQLSSNGVPFEVASFGYRKERDDSWVKKGTQPNDDEGQLPVEGDSSLLQSILDRFDGLQTYVGERFDLLEQQVDTRFDETDSRITKDCHHQKGGDCGSNVFQGYFDEAKESRVKQSFKQRFKNQVSRFKNQVSSFKFKDSRFKKNQDQDSRLKIQESREDSIKISTKKFFKTLSST

SEQ ID NO: 159370 - protein, 154 aa, Glycine max
  Coding DNA Sequence Number=SeqID_67685
  Gene Ontology: Mol. function=prenyltransferase activity; Cellular component=integral to membrane
  Homolog annotation: Hit_ID=Q647J9; Match level="QueryCoverage=98%, HitCoverage=36%, E-value=6e-39, Identity=54%"; Hit description =Homogentisate phytylprenyltransferase
MPKFDVLGSCASKALQNKRKIQMEYNLLRFQQPTLNHHYKSTERGHVYQESNIKYVVKAVSKPSFDYEPPTSNSKNMLESIKNFLAAFYWFCYPYTMVGRTLSTISACLIAVEKSSDISPLFFIGLLQALVPYTFLDVYINGVNQLSDLEIDKI

SEQ ID NO: 159371 - protein, 218 aa, Glycine max
  Coding DNA Sequence Number=SeqID_67686
  Pfam annotation: Domain name=zf-GRF; Domain location=89-133; Score =20.1; E_value=0.00011; Accession=PF06839.3; Description=GRF zinc finger
  Subcellular localization annotation: CTP_CleavageSite=66; ConfidenceScore=5.67e-01
MKFKSSGTPSKAQALLDLRGHFSTPTLSPTTLKLSCTSSATPPTPSSSPLSKGGIWDFGTLTEVVRLMGERMKGKGGSSSSSSSSPMMVKCKCEVPVIMFMSRSVNHPRRRFWRCPHWNESSSCIFFQWVNDIEARNNFYVEGSELIQYVHKNEELKLKLASLMEEAKANAKEIVELREKIVAHEEKYRTSSAKVVHLKSKIGRKKKNVVVERNRVKL

SEQ ID NO: 159372 - protein, 309 aa, Glycine max
  Coding DNA Sequence Number=SeqID_67687
MDEIVGLQEVLEVDLGVINKSLANVDGGGEEIDVDLLKQLDLVEPYKDECILSENEIENKGRGGDRRTFNRGRRCGVTLGASVTTNPSTSSIHISTLELMIHVVAPEPNTLPTTQDQPNLTFVKELIPTTPVRDASPLAPDDSLTPKYPRDSNCEHIANRRPFIFAHKREAKFDEPVASWLKVLVDLRNRWFGEFKSFTAKANRTIDKGALAYCGGSISKAGHFKKLSKEFQRPPIAWEGNVYGLGTLRKRFNCSKLALSTPIAPVEDQIEEMYEAITKLNAELLAKANKERTLEEKMLQLMENYDQQS

SEQ ID NO: 159373 - protein, 596 aa, Glycine max
  Coding DNA Sequence Number=SeqID_67688
  Gene Ontology: Mol. function=aminoacyl-tRNA ligase activity; Cellular component=cytoplasm; Biological process=tRNA aminoacylation for protein translation
  Homolog annotation: Hit_ID=A2Q1N3; Match level="QueryCoverage=99%, HitCoverage=96%, E-value=0.0, Identity=80%"; Hit description=Lysyl -tRNA synthetase
  Pfam annotation: Domain name=tRNA-synt_2; Domain location=242-594; Score=432.7; E_value=5.1e-127; Accession=PF00152.11; Description =tRNA synthetases class II (D, K and N)
  Pfam annotation: Domain name=tRNA-synt_2d; Domain location=251-591; Score=-176.9; E_value=0.1; Accession=PF01409.11; Description=tRNA synthetases class II core domain (F)
  Pfam annotation: Domain name=tRNA_anti; Domain location=120-201; Score=53.8; E_value=6e-13; Accession=PF01336.16; Description=OB-fold nucleic acid binding domain
  Pfam module annotation: Pfam domain module=tRNA-synt_2::tRNA-synt _2d::tRNA_anti; Domain location=242-594::251-591::120-201
MEVPSEAPSTGIAAETISKNALKRELKNKQKEEERKRKEEDKAKKAAEMQKAKDNKSAPADEDDMDPTQYLENRLKYLAVQKAEGNNPYPHKFFVTMSLDQYIKEYGGLSNGQHLEDVSVSMAGRIMHKRTSGSKLVFYDLHSGGFKVQVMADASKSDLDEAEFSKFHSNVKRGDIVGITGFPGKSKKGELSIFPKTFVLLSHCLHMMPRQKSAAAADNANLKKNPWVPGSTRNPETYILKDQETRYRLRHLDLMLNPEVREIFKTRSKIICYIRRFLDDLDFLEVETPMMNMIAGGAAARPFVTHHNDLNMRLFMRIAPELYLKELVVGGLDRVYEIGKQFRNEGIDLTHNPEFTTCEFYMAYKDYNDLMDITEQMLSGMVKELTKGSYKIKYHADGIDKEPIEIDFTPPFRRIDMIDELEKVAGLSIPKDLSSEEANQYLKDTCLKYEIKCPPPETTARLLDKLVGHFLEETCVNPTFIINHPEIMSPLAKWHRSKRGLTERFELFVNKHELCNAYTELNDPVVQRQRFAEQLKDRQSGDDEAMAFDETFCTALEYGLPPTGGWGLGIDRLTMLLTDSQNIKEVLLFPAMKPQD

SEQ ID NO: 159374 - protein, 35 aa, Glycine max
  Coding DNA Sequence Number=SeqID_67689
MTAIIETMTMVVGLNNGNEGGKMVTVVVRVTMLVE

SEQ ID NO: 159375 - protein, 238 aa, Glycine max
  Coding DNA Sequence Number=SeqID_67690
  Homolog annotation: Hit_ID=A7PQX1; Match level="QueryCoverage=100%, HitCoverage=79%, E-value=6e-31, Identity=37%"; Hit description =Chromosome chr6 scaffold_25, whole genome shotgun sequence
MEVLYRKLYDKYTRLKSNKLSDLDHLNEEQELKFRNFSSAAEELIEHLMTEKEELLGQVHHLRSELASLRAAKDNQVVDYQRLLMEETRKNEALSEEVEKLLKLRQEGTSHDLNYNSKIMTLDDQFKANYSSSVRMTRKRTRQNALEKEARLISFENDQANSVERESTENTCKETASGKLLEGCTKANDQPGIDVQESGRRNWLIQVLFEYALGMKLSTDYQTEGICLSAVHQSSGNS

SEQ ID NO: 159376 - protein, 147 aa, Glycine max
  Coding DNA Sequence Number=SeqID_67691
MDRAKAKKVFHGNLTSTKSWNGGREEEERPRRTAAAAAHNAMEEEAHHTLPQRGSALEVYTFVCFSETLKFMALVMRRQLFHLFLNFEGTKYGEEKVCTSRVETHSSQKLAQCLLLVVSIANVAPRSFASKAKEILEYITKHHKEIP

SEQ ID NO: 159377 - protein, 137 aa, Glycine max
  Coding DNA Sequence Number=SeqID_67692
  Gene Ontology: Mol. function=oxidoreductase activity; Cellular component=endoplasmic reticulum; Biological process=electron transport
  Homolog annotation: Hit_ID=A7PPH2; Match level="QueryCoverage=65%, HitCoverage=17%, E-value=3e-23, Identity=61%"; Hit description =Chromosome chr8 scaffold_23, whole genome shotgun sequence
MEFQPQRWLKDGVFQPMNPFEYPIFQVGLRVCVGKEMDLKEMKSVVVLLLRKFHIELVSSLSCGINPHFSSRLTTTFSSGLHVMVHEREIITTTESQKRSNLIVTLSTFSNLHCVIMKLMDQTFAFSNNSTQELKHD

SEQ ID NO: 159378 - protein, 696 aa, Glycine max
  Coding DNA Sequence Number=SeqID_67693
  Gene Ontology: Mol. function=identical protein binding; Cellular component=extracellular region; Biological process=negative regulation of catalytic activity
  Homolog annotation: Hit_ID=Q9LZS6; Match level="QueryCoverage=97%, HitCoverage=94%, E-value=0.0, Identity=55%"; Hit description =Cucumisin-like protein
  Pfam annotation: Domain name=PA; Domain location=292-390; Score=30.8; E_value=4.9e-06; Accession=PF02225.13; Description=PA domain
  Pfam annotation: Domain name=Peptidase_S8; Domain location=63-519; Score=10.8; E_value=2.4e-07; Accession=PF00082.13; Description =Subtilase family
  Pfam annotation: Domain name=Subtilisin_N; Domain location=1-65; Score=2.6; E_value=0.098; Accession=PF05922.7; Description =Subtilisin N-terminal Region
  Pfam module annotation: Pfam domain module=PA::Peptidase _S8::Subtilisin_N; Domain location=292-390::63-519::1-65
MGELPVDRAYAPEDHHNNLLATAIGDWQLARESKIHSYGKSFNGFVARLLPYEAEKLLGLPLKLNRHSNVESDIIVGVLDTGISLDCPSFNDKGFGPPPPSWKGKCVTGANFTGCNNKVIGAKYFNLQNAPEQNLSPADDDGHGTHTSSTAAGVVVRGASLDGIGVGTARGGVSRARIAMYKVCWSDGCSDMDLLAAFDEAIDDGVNVITVSLGGTPRKFFSDPTAIGSFHAMKRGILTSCSAGNNGPSTMTVENVAPWILTVAASNTDRQFTTAVHLADGKKARGMSINTFTPEKKMYPLISGALASKVSRDGYGNASACDHGSLSQEKVMGKIVYCLGTGNMDYIIKELKGAGTIVGVSDPNDYSTIPVIPGVYIDANTDGKAIDLYINSTKNAQAVIQKTTSTRGPAPYVASFSSRGPQSITVNILKPDLSAPGVDILAGYSKLATLTGDPADNRRNVFNILSGTSMACPHAASAAAYVKSFHPDWSPAAIKSALMTTAIPMRIKDATAELGSGSGQINPVSALDPGLLYNSSMDSYIAFLCKEGYNSSSIGILIGTKGLNCSTISPPQGTDGINYPSMHTQIIPSNASISAIFYRSVTNVGSGNSTYKAKVRAPKGLSIEVIPDTLNFGGVNQELSFKVVLKGPPMPKETKIFSASLEWNDSKHNEKEDQLVEWKLENLLKRMKMKIETLHS

SEQ ID NO: 159379 - protein, 53 aa, Glycine max
  Coding DNA Sequence Number=SeqID_67694
MVRTRGLGRALGRVIGRALGREERPKLKLSSHGRKVDKFGMPAPKIEGLVVGT

SEQ ID NO: 159380 - protein, 91 aa, Glycine max
  Coding DNA Sequence Number=SeqID_67695
MASSFGYPKREEKDKIKVLRRKGDKLRTPRSSVCLCKSHSSLVFQAHTHYIRGNAKGRLWWREAESLDFVEGLLQCEKGEEEVRDKRNKGC

SEQ ID NO: 159381 - protein, 437 aa, Glycine max
  Coding DNA Sequence Number=SeqID_67696
  Gene Ontology: Mol. function=acid phosphatase activity; Cellular component=extracellular region; Biological process=biological_process
  Homolog annotation: Hit_ID=A7PPF8; Match level="QueryCoverage=91%, HitCoverage=89%, E-value=0.0, Identity=74%"; Hit description =Chromosome chr8 scaffold_23, whole genome shotgun sequence
  Pfam annotation: Domain name=Metallophos; Domain location=141-333; Score=63.1; E_value=9.7e-16; Accession=PF00149.19; Description =Calcineurin-like phosphoesterase
  Pfam annotation: Domain name=PhoD; Domain location=44-400; Score= -249.7; E_value=0.057; Accession=PF09423.1; Description=PhoD-like phosphatase
  Pfam module annotation: Pfam domain module=Metallophos::PhoD; Domain location=141-333::44-400
MAKCNKSLVVILLLLHILCLQSQVNGFSRQPSRQLIFTPHKRSDSDPQQVHISLVGNDHMRVSWITDDKHSESVVEYGTKKGEYSTKATGEHTSYHYFLYESGKIHHVVIGPLQPNTIYYYRCGGSGSEFSFKTPPLKLPIEFVVVGDLGQTEWTTSTLKHVDSKDYDVFLLPGDLSYADTHQPLWDSFGRLVEPYASRIPWMVTEGNHEIETFPIIQPNGFKAYNARWPMPYKESGSTSNLYYSFDVASTHVIMLGSYTDFDAHSQQYTWLQSDLAKIDRKRTPWVIALLHAPWYNTNEAHQGEGEDMRQAMEELLYEARVDLVFAGHVHAYERFTRIYDNKADSCGPLYVTIGDGGNREGLALRFKKPPSPLSLYREPSFGHGRLRIVNETHAYWSWHRNNDTDTFVADGVWIESLSNSKACWNAQGQHVAHEEL

SEQ ID NO: 159382 - protein, 83 aa, Glycine max
  Coding DNA Sequence Number=SeqID_67697
MASTSKTYLVIEWLQGKQQRSFKDNDNDKECNEGRSKTMTVTRKATKTVQGKQESLPRHDGECHNRHDQSATTASQWLCETQP

SEQ ID NO: 159383 - protein, 690 aa, Glycine max
  Coding DNA Sequence Number=SeqID_67698
  Gene Ontology: Mol. function=aminoacyl-tRNA ligase activity; Cellular component=cytoplasm; Biological process=tRNA aminoacylation for protein translation
  Homolog annotation: Hit_ID=Q6D7L6; Match level="QueryCoverage=100%, HitCoverage=80%, E-value=0.0, Identity=84%"; Hit description=Leucyl -tRNA synthetase
  Pfam annotation: Domain name=Anticodon_1; Domain location=528-658; Score=33.6; E_value=5.2e-08; Accession=PF08264.4; Description =Anticodon-binding domain
  Pfam annotation: Domain name=tRNA-synt_1; Domain location=12-489; Score=-317.2; E_value=4e-06; Accession=PF00133.13; Description=tRNA synthetases class I (I, L, M and V)
  Pfam module annotation: Pfam domain module=Anticodon_1::tRNA-synt_1; Domain location=528-658::12-489
VIDGCCWRCDTKVERKEIPQWFVKITDYAEELLNDLDKLEDWPEQVKTMQRNWIGRSEGVEITFDVANSAEKVTVYTTRPDTFMGATYVAVAAGHPLARQAAVNNPALADFIAECSNTKVAEADMATMEKKGMATGLHAIHPLTGEEIPVWVANFVLMEYGTGAVMAVPGHDQRDWEFATKYDLNIKPVVLNLDGTAPDISAAAMTEKGTLFNSGEFDGLDHDAGFNAIADALAAKGVGVRKVNYRLRDWGVSRQRYWGAPIPMVTLEDGTVMPTPEDQLPVILPEDVVMDGITSPIKADPEWAKTTVNGQPALRETDTFDTFMESSWYYARYTCANYNEGMLDPAAANYWLPVDQYVGGIEHAIMHLMYFRFFHKLLRDAGLVNSDEPAKRLLCQGMVLADAFYYVGANGERNWVSPVDVNVERDEKGRITKAIDNQGREVIYAGMSKMSKSKNNGIDPQLMVERYGADTVRLFMMFASPAEMTLEWQESGVEGANRFLKRVWKLAYDHVAKGATVALDVNALNDEQKALRRDLHKTIAKVADDIGRRQTFNTAIAAIMELMNKLLRAPQESEQDRALMQEALVAVTRLLYPFTPHASYVLWQALGGEGSIDDASWPVADEAAMVEDSLLVVVQVNGKVRGKITVAPDATQEQVQARAAQEHLVAKYLDGVTLRKVIYVPGKLLNLVVG

SEQ ID NO: 159384 - protein, 470 aa, Glycine max
  Coding DNA Sequence Number=SeqID_67699
  Gene Ontology: Mol. function=ATP binding; Cellular component =cytoplasm; Biological process=cellular response to phosphate starvation
  Homolog annotation: Hit_ID=P0A9K5; Match level="QueryCoverage=67%, HitCoverage=92%, E-value=1e-164, Identity=91%"; Hit description=PhoH- like protein
  Pfam annotation: Domain name=DEAD; Domain location=104-256; Score= -33.0; E_value=0.012; Accession=PF00270.20; Description=DEADDEAH box helicase
  Pfam annotation: Domain name=PhoH; Domain location=99-303; Score =522.6; E_value=4.4e-154; Accession=PF02562.7; Description=PhoH-like protein
  Pfam annotation: Domain name=UPF0054; Domain location=321-458; Score =202.7; E_value=8.8e-58; Accession=PF02130.8; Description =Uncharacterized protein family UPF0054
  Pfam module annotation: Pfam domain module=DEAD::PhoH::UPF0054; Domain location=104-256::99-303::321-458
MSLCGPFDDNVKQLERRLGIEINRRDNLFKLVGRALSVEAAANILRSLYVDTAPVRGQIPDIEPDQIHLAIKESRVLEQTADSVPEYGKAVNIKTKRGVIKPRTPNQAQYIANILDHDITFGIGPAGTGKTYLAVAAAVDALERQEIRRILLTRPAVEAGEKLGFLPGDLSQKVDPYLRPLYDALFEMLGFERVEKLMERNVIEVAPLAYMRGRTLNDAFVILDESQNTTIEQMKMFLTRIGFNSKAVITGDVTQIDLPRSTKSGLRHAIEVLANVEEISFNFFHSEDVVRHPVVARIVNAYEAWEEADQKRRDKLAEEHLQLACADENGLPAAAAFQRWLEAAVTPFQPESEVTIRLVDEAESHELNLTYRGKDKPTNVLSFPFEAPPGIELPLLGDLIICRQVVEQEAAEQGKSPEAHWAHMVVHGTLHLLGYDHIEDEEAEEMEALETEIMLALGYPDPYISEKEDV

SEQ ID NO: 159385 - protein, 323 aa, Glycine max
  Coding DNA Sequence Number=SeqID_67700
  Gene Ontology: Mol. function=iron-sulfur cluster binding; Cellular component=cellular_component; Biological process=metabolic process
  Homolog annotation: Hit_ID=Q7MB63; Match level="QueryCoverage=91%, HitCoverage=61%, E-value=1e-152, Identity=88%"; Hit description=TRNA- methylthiotransferase MiaB protein
  Pfam annotation: Domain name=Radical_SAM; Domain location=179-321; Score=11.0; E_value=0.011; Accession=PF04055.12; Description=Radical SAM superfamily
  Pfam annotation: Domain name=UPF0004; Domain location=32-132; Score =182.8; E_value=8.5e-52; Accession=PF00919.11; Description =Uncharacterized protein family UPF0004
  Pfam module annotation: Pfam domain module=Radical_SAM::UPF0004; Domain location=179-321::32-132
MTGMLVTPAPKHYNTRPALLCSESMASSMTKKLHIKTWGCQMNEYDSSKMADLLNSTHGYTLTEEAEDADVLLLNTCSIREKAQEKVFHLLGRWKKLKAKNPELIIGVGGCVASQEGDKIRQRAQCVDIVFGPQTLHRLPEMINQVRGSKSPIVDVSFPEIEKFDRLPEPRAEGPTAFVSIMEGCNKYCTFCVVPYTRGEEVSRPCDDILLEVAQLAAQGVREVNLLGQNVNAYRGATFDDQICTFAELLRLVAAIDGIDRIRFTTSHPIEFTDDIIDVYRDTPELVSFLHLPVQSGADRILTLMKRAHTALEYKAIIRKLVA

SEQ ID NO: 159386 - protein, 253 aa, Glycine max
  Coding DNA Sequence Number=SeqID_67701
  Gene Ontology: Mol. function=oxidoreductase activity, acting on paired donors, with incorporation or reduction of molecular oxygen, NADH or NADPH as one donor, and incorporation of one atom of oxygen; Cellular component=...
  Gene Ontology: Cellular component=extracellular space; Biological process=ubiquinone biosynthetic process
  Homolog annotation: Hit_ID=Q7AGN1; Match level="QueryCoverage=52%, HitCoverage=34%, E-value=8e-38, Identity=63%"; Hit description =Oxygenase
  Subcellular localization annotation: CTP_CleavageSite=84; ConfidenceScore=5.40e-01
MRLAMPPGSNFPRTDRARSARCLIVTLRWCGTTRRRGSVSCKICRSASWPKKYRPTSPARVGRFEVKNAASFPAGAPGPCHTLRAAGLALVGDAAHTINPLAGQGVNLGYRDVDALINTLVDARSQAQRWASLPVLQRYHRQRYKDNLLMQGGMDLFYFAFSNALPPLRVVRNLGLIAAENAGVLKRQGFEPRNAGIRIRCLTAWRHPNRCLGFEPRNGGIRIHCLTAWRHPNLFGGYDGNRTCDPIIMSDVL

SEQ ID NO: 159387 - protein, 138 aa, Glycine max
  Coding DNA Sequence Number=SeqID_67702
  Homolog annotation: Hit_ID=A5AD47; Match level="QueryCoverage=94%, HitCoverage=16%, E-value=4e-07, Identity=24%"; Hit description =Putative uncharacterized protein
  Pfam annotation: Domain name=zf-CCHC; Domain location=106-123; Score =12.3; E_value=0.021; Accession=PF00098.14; Description=Zinc knuckle
MKVTTFKQTSHDMIAHIDKARAAVEELKRFLVADSMEEVNKKLNKFYMVIILRSLYPDFDHTSSVPHVLKDENPADVVETSAMITPCGRGGGRNNRGGRSGRGGHPQCTHCNRMGHTQENCHSLHGFPDKVAQMSKSE

SEQ ID NO: 159388 - protein, 209 aa, Glycine max
  Coding DNA Sequence Number=SeqID_67703
  Homolog annotation: Hit_ID=Q6L477; Match level="QueryCoverage=54%, HitCoverage=19%, E-value=2e-07, Identity=29%"; Hit description =Putative uncharacterized protein OSJNBa0009L15.8
  Subcellular localization annotation: CTP_CleavageSite=47; ConfidenceScore=5.76e-01
MGSTPASNPPPPPSPLSPPPSDASSSPSAMKQTHKVSRLRSLSTRPPGAERPVVHVDPAIGKADGPHRKKLRTYLGIVARDKVPTAQKDLIWEDIQAEFDIPEASHSRTKRKLLQTVGERWRQFKSNLTRKWALTADQDGVEDIVCEKYGISKEKDPSWEDVCKKAQAIQKQNTVPHILSRGGYDYLEQKLLAEKTKKKLGGSCTVKKR

SEQ ID NO: 159389 - protein, 175 aa, Glycine max
  Coding DNA Sequence Number=SeqID_67704
MRETHEIPHHNLADFEPCLGYATERQAAGGIPLQNTLEGPQFRPQPQPFYGKMVGYTPSSFADLVFTGERIKVGLEKGKSDHPALMNAKTGANEKNENEGETLAMTAIPTQSNFPSSQQCHYLANNSPSHPIIHKGHPQSSTKPARHTFGVKTLTKMEFCSKKPVGFTPNSGVIC

SEQ ID NO: 159390 - protein, 348 aa, Glycine max
  Coding DNA Sequence Number=SeqID_67705
  Gene Ontology: Mol. function=oxidoreductase activity; Cellular component=glycerol-3-phosphate dehydrogenase complex; Biological process=metabolic process
  Homolog annotation: Hit_ID=Q9F811; Match level="QueryCoverage=88%, HitCoverage=88%, E-value=1e-127, Identity=71%"; Hit description =Putative amino acid oxidase flavoprotein ThiO
  Pfam annotation: Domain name=DAO; Domain location=3-303; Score=142.1; E_value=1.5e-39; Accession=PF01266.15; Description=FAD dependent oxidoreductase
  Pfam annotation: Domain name=FAD_binding_3; Domain location=3-323; Score=-165.2; E_value=0.093; Accession=PF01494.10; Description=FAD binding domain
  Pfam annotation: Domain name=ThiS; Domain location=280-348; Score =21.4; E_value=0.00038; Accession=PF02597.11; Description=ThiS family
  Pfam module annotation: Pfam domain module=DAO::FAD_binding_3::ThiS; Domain location=3-303::3-323::280-348
MSRWSVLGSGVSGLCVAMLLAERGETVEVIDDEARQPASWFAGGMLAPWCEAESAPAEVITLGQHAAAWWQTRVSSVVHQGTLVLAPSRDNPELNRFARMTTAHQWVDPASLEPALENRFVRGLFFPREAHLDPRRALAELRDKLLQRGVRFDARQPSGRIIDCRGIHARAQLSGLRAVRGEMLILQSHEVSFSRPIRLLHPRFPCYLVPRRDGHFMLGATMIESDDASAISARAMMELLSAAYTLHPALAEARVIESGSGLRPAWPANLPEIHYHNGIFYLNGMYRHGFLLAPMMAEQLMQRLSGEQIDAACVATACNGDFVPKSQYASLQLQEGWQLEVLSPMQGG

SEQ ID NO: 159391 - protein, 529 aa, Glycine max
  Coding DNA Sequence Number=SeqID_67706
  Gene Ontology: Mol. function=transcription factor activity; Cellular component=intracellular; Biological process=regulation of transcription, DNA-dependent
  Homolog annotation: Hit_ID=Q92XK4; Match level="QueryCoverage=60%, HitCoverage=79%, E-value=1e-38, Identity=31%"; Hit description =Putative ROK family transcriptional regulator
  Pfam annotation: Domain name=ROK; Domain location=228-411; Score =127.2; E_value=4.9e-35; Accession=PF00480.11; Description=ROK family
MTLKVFNDRIGIKWRAIVEFNVGTQRKFPVQSAVVSMPGERQGRHDFAIVTEPRQAFIHRVQHRAGKGRGLIARVHAARRFVLHNDQLSSQNRCAGKRRQNTRGKCQYPEMLECALHEGLSESVTKSEESLPGRQLTVNARHRLPYALVVLTAADERARRYIRHTLQTKAKIRTAIAEKMKLSKAAISTLIKEMLSAGLLEESIPESNGQGRPSVLLKMRADSAYFLGASLLGDDVYLVLTDMHGRILASTHMPLNPDPVQLAGALAAAIPDLIAQKGISADQLIGLGVTLSGFVDEHQAVCVQSALLGWKNVPLAALLNAQTGLEVSLENDAKALAVSEKIFGVAKKARNFTLISHGDGIGSAHFFQGQLHRGAHGGAGEIAHCTVEPGGRPCRCGKRGCLDTLASLTAMRESMRDKQLPCTSVAELEALAVKGNSAAIAILHQAGDALGLAIANIIQMNDPEMIVIAHQPDAFDGLLRTVVMQAVDSHVLPSIMGKTPIASMAIDQLSWARAAASVAAYRFIAHLPD

SEQ ID NO: 159392 - protein, 15 aa, Glycine max
  Coding DNA Sequence Number=SeqID_67707
MKNIPDSGVVFTFEE

SEQ ID NO: 159393 - protein, 148 aa, Glycine max
  Coding DNA Sequence Number=SeqID_67708
MGLYIVHDQCTQLVALGKVYDSASTIHNVPYADDVVRVSVVKVYDGDAQAIGTFVGWLTHLVEAVCNEDSQKLMLKRITYAGMDNTVAAVDPLGELVKNLFDVYQKLVEFPWDGAKFGIPNVKDSFFITHADVAETILGDKCLNISIC

SEQ ID NO: 159394 - protein, 61 aa, Glycine max
  Coding DNA Sequence Number=SeqID_67709
MGRNVSALIGKSVPQIPEKCKDPGPLQSTDVVIHLANRSVAYPAGFIEDVLVRVGELIFLC

SEQ ID NO: 159395 - protein, 165 aa, Glycine max
  Coding DNA Sequence Number=SeqID_67710
  Subcellular localization annotation: CTP_CleavageSite=61; ConfidenceScore=5.22e-01
MDMNVGYLISHQISLIAQHDSSRLGPKKAKGKQSEAHLLSVPPSTSPSAPSSFTPTPVPAPASAPTGPSGFSFTSETIFAMLQSLHRGQVAWPGVQPSPSGGGGTSTSQEPEPIEEQTPTVEDELIPPGPFIPEPDVEIAQEEAASTSPAPMPRDALLLDQVASE

SEQ ID NO: 159396 - protein, 93 aa, Glycine max
  Coding DNA Sequence Number=SeqID_67711
  Subcellular localization annotation: CTP_CleavageSite=17; ConfidenceScore=5.30e-01
MTKGGAFLHSKTSFPPVATYPSAGGRRETRGMRVPRKEYARSRHQRLFEENVGKDAIYELFSERFGSCIYARGRVFPFAPTYSSIWDEKIRPT

SEQ ID NO: 159397 - protein, 88 aa, Glycine max
  Coding DNA Sequence Number=SeqID_67712
MVTKRDCRVIQRSLYIQGARITSLLQVVYDLLPEKNTLPKSYYQPRRYCVRWVWSIRRFMLARMIAYCTGMHSKKCPNALGVGRHSTK

SEQ ID NO: 159398 - protein, 42 aa, Glycine max
  Coding DNA Sequence Number=SeqID_67713
MSEEVDMNVENDEDAGVKVEHVNYSDVLNTSQLFATRDEVLH

SEQ ID NO: 159399 - protein, 70 aa, Glycine max
  Coding DNA Sequence Number=SeqID_67714
MENWRTALHNNFAGFQTRRLEGGGHMNSARPITSWGAEKRGEWRIGEQRYTIISRGSRLEGGGRMKSARQ

SEQ ID NO: 159400 - protein, 715 aa, Glycine max
  Coding DNA Sequence Number=SeqID_67715
  Gene Ontology: Mol. function=transporter activity; Cellular component= periplasmic space; Biological process=transport
  Homolog annotation: Hit_ID=A8G8A4; Match level="QueryCoverage=43%, HitCoverage=70%, E-value=1e-175, Identity=96%"; Hit description =Extracellular solute-binding protein family 1 precursor
  Pfam annotation: Domain name=Aminotran_1_2; Domain location=29-431; Score=5.2; E_value=1.9e-07; Accession=PF00155.12; Description =Aminotransferase class I and II
  Pfam annotation: Domain name=SBP_bac_1; Domain location=414-710; Score=95.5; E_value=1.6e-25; Accession=PF01547.16; Description =Bacterial extracellular solute-binding protein
  Pfam module annotation: Pfam domain module=Aminotran_1_2::SBP_bac_1; Domain location=29-431::414-710
MKTEGLLAQRIVNVKSSAIRELLKHSKMEHVISLAGGIPSDALFDFEGLSIATQQAITEQPKSAFQYGLTEGSPLLRERICALCAERGVTARAEEVMVTAGSQQALDLVMRAIVNPGDVFVVERPTYLAALQTLELAEANIMSVSSDSDGMVVEELAELLKTQRIKGVYVVPNFGNPSGITLSAARRELLVKLAAEHNFLIIEDDPYGELRFTEERHPTLHQVSQRVLGNTDHIIYTSTFSKILAPGLRLGWAILPPFLLHKVAIIKQAADLHASALSQSIVECYLGLDRLPAQIDKIRTAYKQKGEILAGRHVPVGAFPPAVQRHRMAEYHAAAGRGVRAGGILLLRQPGSFDLPPVVRHRHRATNAGSGGAPAPFAVIPAAAEGMPAADIKLPSSLHSPELGMLTYAIRKTTLCVALTLAVSTQALAATEIPFWHSMEGELGKEVDSLADRFNQSHSDVKIVPVYKGNYEQSLAAGIAAYRSGKAPAILQVYEVGTATMMASKAIKPVYEVFKEAGINFDESVFVPTVAGYYTDNKSGHLLSQPFNSSTPVLYYNKDAFKKAGLNPDQPPKTWQELAADTAKLREAGMKCGYASGWQGWIQLENFSAWHGVPFASENNGFGGTNAKLEFNKPLQVKHIALLEAMNKKGDFTYFGRKDESTEKFYNGDCAITTASSGSLADIKHYAKFNYGVGMMPYDADAKNAPQNAIIGGAS

SEQ ID NO: 159401 - protein, 16 aa, Glycine max
  Coding DNA Sequence Number=SeqID_67716
TGMTDLLDFLGGSGAT

SEQ ID NO: 159402 - protein, 207 aa, Glycine max
  Coding DNA Sequence Number=SeqID_67717
  Homolog annotation: Hit_ID=A5AZG1; Match level="QueryCoverage=45%, HitCoverage=30%, E-value=8e-07, Identity=32%"; Hit description =Putative uncharacterized protein
MRGKKIREEERRKILKELRKEKHASYSSHNSCKSLSEELRDYYEGRHRSHLRPHSHSREKERKYQEANINLPYFHGKDNVEANLDWEIRIEQQLKRKSTSKSYGSHSYPKKDQGQGIFGVTTSKPKDHKGKTIEKQPLKASMQEKTSSMKYFKCLGRGHITSQCPTKKTMIMRGQEIYSSQDEATTSPSSSESEEAKASTPKKKDNL

SEQ ID NO: 159403 - protein, 417 aa, Glycine max
  Coding DNA Sequence Number=SeqID_67718
MLADNFCQRVAHALQKQRVSGEDVTIRRKLDHGDGLLQRTERCAAVTAFLPREARQDSRCNSAEHGGPYYGYGMSARLSALVAKNSPLNDAVAQGIENPRVRGSIPRPGTTHNKALVRKTFSDGGEGVMDIRMLDPDEPGYFFNFRNPLPHNEYYAVKPQFMPPHGARPIVDDATGLCIGYTVAQAPGLWQVYDADGRFTTLEEAPLQTPLIDPLDIAMIAVGVFRLLSSGRAVLDVAAGKSIGSMLSEATLNMLRGRLKGTGLDNFALPYRLSGGTEMFEIKNEDTLFRFSFIERIEEPEDRRLDLIMCWLEIAGCSINLQCQCELTIFDLESLKEMLSEFYASLYKNGRPKPVNFAPRMKAFTCEFNAVEGSDLIGFNFTATPAIYDSWQLTGGIAIDQSYFPALIQGIESILTN

SEQ ID NO: 159404 - protein, 391 aa, Glycine max
  Coding DNA Sequence Number=SeqID_67719
  Gene Ontology: Mol. function=hydrolase activity, hydrolyzing O -glycosyl compounds; Biological process=carbohydrate metabolic process
  Homolog annotation: Hit_ID=A8GCX0; Match level="QueryCoverage=99%, HitCoverage=89%, E-value=1e-166, Identity=76%"; Hit description =Glycoside hydrolase family 4
  Pfam annotation: Domain name=Glyco_hydro_4; Domain location=1-366; Score=330.7; E_value=2.6e-96; Accession=PF02056.7; Description =Family 4 glycosyl hydrolase
VQIIADLTRRMLQKNGLEQVKVSVHFALDEAIRGARFVLTQLRVGQLAARAADERLGLKYGRLGQETTGVGGFAKALRTIPVMLEIARKVEQLAPDAFIINFTNPAGIVTEAVARYSNAKIIGLCNVPVNMHHMIAGMLQAPFDEVALRFAGLNHLVWVHQVLCRGEDVTAGVIEQLCEGQALTMNNIKEMPWSPAFLRALQAIPCPYHRYYWQTPQMLAEEQEKAQHGQAGTRAEQVMKVEAELFTLYADPQLTHKPEQLSFRGGAYYSEVAVELISAIHNNSGQNLVVNCQNRGAIHGLPDDAVVEVNCVVDAQGAHPLVFGALPPLMHGLTQQIKAFERLTIDAAVHGDRGAALLALVGNPLVGDVASAEALLDEVLTLNQPWLPQFA

SEQ ID NO: 159405 - protein, 75 aa, Glycine max
  Coding DNA Sequence Number=SeqID_67720
MEKSNSFPHYYLSLECYHLGPDSSSSWIWEVAVKVLPECLIFLPLLPFLMLETNNLTVADGSPSLREIFHKEKAS

SEQ ID NO: 159406 - protein, 347 aa, Glycine max
  Coding DNA Sequence Number=SeqID_67721
  Gene Ontology: Mol. function=structural constituent of cell wall
  Homolog annotation: Hit_ID=A5B1Z6; Match level="QueryCoverage=92%, HitCoverage=48%, E-value=7e-39, Identity=48%"; Hit description =Putative uncharacterized protein
  Pfam annotation: Domain name=Pollen_Ole_e_I; Domain location=220-346; Score=1.9; E_value=4.1e-05; Accession=PF01190.8; Description=Pollen proteins Ole e I family
MAFLRSTLATSMVLLAMLAIVSATDYYGYGPTPKLENPKPKTDYKVDKPHPRIPDYYAVPKPKGNDELHLLPTIIGVQGVVLCKSGSNYFPIQGAVARVTCGWENELGYETGPISVLSHVTDSKGYFFATLSLGELGSKLKITECKAYLESSPLETCKVPTDVNYGISGARLSSYRLLENKMKLYTVGPFFCTSQPAKPLPNGGDYGPEEEKLLSKTIGIQGIVYCKSASKLTPLEGALTRIACEAVDEYGFETTPFSFLSEATDSKGYFLATLSPQEVEGKGVLKECRAFLDASPLNNCSYPTDVNKGISGAVLRFHRFLHDKKMKLYTVGPFQFTASPTPISDGY

SEQ ID NO: 159407 - protein, 416 aa, Glycine max
  Coding DNA Sequence Number=SeqID_67722
  Gene Ontology: Mol. function=enzyme inhibitor activity; Cellular component=cell wall; Biological process=cell wall modification
  Homolog annotation: Hit_ID=A2YPW0; Match level="QueryCoverage=100%, HitCoverage=70%, E-value=1e-126, Identity=54%"; Hit description =Putative uncharacterized protein
  Pfam annotation: Domain name=Pectinesterase; Domain location=91-402; Score=598.7; E_value=5.4e-177; Accession=PF01095.10; Description =Pectinesterase
MTNLYTCLDGFAYSKGRVGDRIEKKLLQISHHVSNSLAMLNKVPGVEKLTTSSESDEVFPEYGKMQKGFPSWVSSKDRKLLQAKVNETKFNLVVAKDGTGNFTTIGEALSVAPNSSTTRFVIHVTAGAYFENVEVIRKKTNLMFVGDGIGKTVVKGSRNVEDGWTIFQSATVAKFALYCSFMNNDPKSNPNSVDNNGKWYVAAVVGAGFIAKGITFEKSAGPDKHQAVALRSGDTLYVHSLRQFYRERDIYGTVDFIFGNAAVVFQNCNLYARKPNENQKNLFMAQGREDPNQNTGISILNCKIAAAADLIPVKSSFKSYLGRPWKMYSMTVVLKSYVDIDPAGWLEWNETFALDTLYYGEYMNRGPCSNTSGRVTWPGYRVINSSIEASQFTVGQFIQDNDWLNNTGIPFFSGLS

SEQ ID NO: 159408 - protein, 558 aa, Glycine max
  Coding DNA Sequence Number=SeqID_67723
  Gene Ontology: Mol. function=fumarate hydratase activity; Cellular component=tricarboxylic acid cycle enzyme complex; Biological process=fumarate metabolic process
  Homolog annotation: Hit_ID=P93033; Match level="QueryCoverage=88%, HitCoverage=100%, E-value=0.0, Identity=85%"; Hit description =Fumarate hydratase 1, mitochondrial precursor
  Pfam annotation: Domain name=Lyase_1; Domain location=106-436; Score =587.3; E_value=1.5e-173; Accession=PF00206.11; Description=Lyase
  Subcellular localization annotation: CTP_CleavageSite=23; ConfidenceScore=5.14e-01
MKKSHSCGPFKCFSWTRTKVIVRLQLGRRLRNRVSLLGTYFGSIVLVIGQTSVILRWLLPSFAMAFYVLSRRLSAGSNSTTLLALRFASSSRSFSSSFREERDTFGPIQVPSDKLWGAQTQRSLQNFDIGGPRERMPEPIIRAFGVLKKCAAKVNMEYGLDPIVGEAIMQAAQEVAEGKLNEHFPLVVWQTGSGTQSNMNANEVIANRAAEILGHKRGGKFVHPNDHVNRSQSSNDTFPTVMHIAATMEINSRLIPSLKTLHGTLNSKSIEFKDIVKIGRTHTQDATPLTLGQEFSGYTTQVKYGIDRVIGTLPHLYQLAQGGTAVGTGLNTKKGFDAKIAAAVAEETNLPFVTAENKFEALAAHDAFVETSGALNTIAASLMKIANDIRLLGSGPRCGLGELILPENEPGSSIMPGKVNPTQCEALTMVCAQVIGNHVAVTVGGSNGHFELNVFKPMIASCLLHSLRLLGDSSASFEKNCVRGIQANRERISKLLHESLMLVTSLNPKIGYDKAAAVAKTAHKEGCTLKEAALKLGVLSSEDFDKLVVPEKMLGPSD

SEQ ID NO: 159409 - protein, 277 aa, Glycine max
  Coding DNA Sequence Number=SeqID_67724
  Homolog annotation: Hit_ID=A7PMK2; Match level="QueryCoverage=33%, HitCoverage=58%, E-value=9e-17, Identity=47%"; Hit description =Chromosome chr14 scaffold_21, whole genome shotgun sequence
  Subcellular localization annotation: CTP_CleavageSite=91; ConfidenceScore=5.32e-01
MDWVTKSNKNGGEFTGDQQPKSVSVTVQIIRSPKCIKRTGLFGVQSSPGLATTGPMQKTHRPSVQVPATPLHVIATQPMLVPPVLNWRHVSREHQQKRGQRTQLVDPIVLLNLHPPLYPLAVPDSPPPHQIYHHHARVEVAWPPPGERPREARVRPERCGEVLGEVGVAVFRGADGFEEVSEIISGVVEGLFEGLSDRGGDQVADDLGIKVIDLEVQLREGGFDEGFEVGFGDEEVEEDVLRALGVLEDGVDGGDGAAEVLDVEGDGDVDEGGVADG

SEQ ID NO: 159410 - protein, 351 aa, Glycine max
  Coding DNA Sequence Number=SeqID_67725
  Gene Ontology: Mol. function=nucleic acid binding; Cellular component= nucleus; Biological process=RNA metabolic process
  Homolog annotation: Hit_ID=Q84W91; Match level="QueryCoverage=95%, HitCoverage=81%, E-value=1e-120, Identity=57%"; Hit description=Zinc finger CCCH domain-containing protein ZFN-like 1
  Pfam annotation: Domain name=zf-CCCH; Domain location=141-167; Score =44.3; E_value=4.2e-10; Accession=PF00642.15; Description=Zinc finger C-x8-C-x5-C-x3-H type (and similar)
  Pfam annotation: Domain name=zf-CCCH; Domain location=292-318; Score =44.3; E_value=4.2e-10; Accession=PF00642.15; Description=Zinc finger C-x8-C-x5-C-x3-H type (and similar)
  Pfam annotation: Domain name=zf-CCCH; Domain location=50-76; Score =39.8; E_value=9.7e-09; Accession=PF00642.15; Description=Zinc finger C-x8-C-x5-C-x3-H type (and similar)
  Pfam annotation: Domain name=zf-CCCH; Domain location=95-121; Score =47.0; E_value=6.7e-11; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH; Domain location=141-167::292-318::50-76::95-121
MDLYGRGPARNVHNPVNQPEWRSPGTDTGLEESMWHLTLGGGGESYPERPGVPNCVYYMRTGVCGYGGRCRYNHPHDRAAVVAAVRVTGDYPERLGEPPCQYYLKTGTCKFGASCKFHHPKNGGEYLSQAPLNVYGYPLRSDEKECSYYLKTGQCKYGISCKFHHPQPAGTSLPASAAQFYQQVQSPTVPLPEQYVGASSSLRVARPPILPGSYVQGAYGPVFLSPGVVQFPGWNHYSALPGTQPGVGATSLYGVTQLSSPTSAFARPYTLLPSSTGLSGSNLKEQLYPKRPGEPDCQYYLRTGDCKFGLACQYHHPQDHVVAQPLLSPVGLPLRPLHYGQHGQQSIWSRR

SEQ ID NO: 159411 - protein, 564 aa, Glycine max
  Coding DNA Sequence Number=SeqID_67726
  Gene Ontology: Mol. function=ligase activity; Cellular component =cytoplasm; Biological process=response to auxin stimulus
  Homolog annotation: Hit_ID=A7Q094; Match level="QueryCoverage=96%, HitCoverage=100%, E-value=0.0, Identity=67%"; Hit description =Chromosome chr7 scaffold_42, whole genome shotgun sequence
  Pfam annotation: Domain name=GH3; Domain location=12-523; Score =914.4; E_value=4.9e-272; Accession=PF03321.4; Description=GH3 auxin -responsive promoter
MDGKKLEYKGEEALKEIERLTMKAAEVQEGLLKQILTQNRETEYLSKYMRGEKNITDVAEFKSSGTSAGEPKMMPSIVEDLERRTFVYVSDLDEGKAMYLYFVKAEMCTPCGLPARTVLTSYYKSKHFKCRTHDPWNDYTSPDQTILCNDSNQSMHCQLLSGLVHRRHVLRLGAVFASALLRAISFLERNWRHLCEDIRTGQLSSFITDPSCRSCMSTLLSSPDPRLADEITRICSQKSWKGILCQLWPKAKFIEAVVTGSMAQYVPALKHYSDGKLPLVCTMYASSECYFGVNLKPLCDPGDVAFTLLPNMGYFEFLPLGHNGTLLMDFDEGEQVPNDKLVDLVHVKLGCFYEPVVTTFAGFYNNAPQVRFICRRNVVISVDTEKTNEEDLHRGVTMAKKLLEPYDALLVEYTSYPDTSSIPGHYVLYWEILHCGIKTTESSQQLQLLDANVLEECCIAVEEQLDYVYRRCRSYDKSVGPLEIRVVEPGTFDALMDLFISQGASINQYKTPRCIKSKKALKLLKSKVTASFFKPRDPKWSPKMCQLEDYYVWCLIDCLKPQVI

SEQ ID NO: 159412 - protein, 1091 aa, Glycine max
  Coding DNA Sequence Number=SeqID_67727
  Gene Ontology: Mol. function=nucleoside-triphosphatase activity; Cellular component=protein complex; Biological process=cell division
  Homolog annotation: Hit_ID=A7Q0A4; Match level="QueryCoverage=97%, HitCoverage=92%, E-value=0.0, Identity=70%"; Hit description =Chromosome chr7 scaffold_42, whole genome shotgun sequence
  Pfam annotation: Domain name=AAA; Domain location=852-1038; Score =275.1; E_value=1.4e-79; Accession=PF00004.20; Description=ATPase family associated with various cellular activities (AAA)
  Pfam annotation: Domain name=AAA_3; Domain location=852-978; Score= -8.4; E_value=0.0028; Accession=PF07726.2; Description=ATPase family associated with various
  Pfam annotation: Domain name=AAA_5; Domain location=852-984; Score =11.2; E_value=0.0004; Accession=PF07728.5; Description=ATPase family associated with various
  Pfam module annotation: Pfam domain module=AAA::AAA_3::AAA_5; Domain location=852-1038::852-978::852-984
MGGLGLIILLFIFLQNPHVSMSDLIFTVGQGRNCNLWLKDPTVGNVLCKLSHIERGGSSVALLEITGGKGSIQVNGKTYRKNARLILSGGDEVVFGSSGKHAYIFQLLTNNNISPAVIPSSVSILEAQSAPINGTQVEARSGDPSAVAGASILASLSNLPKDLSLLSPPAKTGKNVQQNSDISSLPSGNEDDMPISEMKDATNDVASEVCSADKTVNENPSLDTAEVDINVDADVRKVTAATYELRPLLRLLAGSCPELDLSCGITKILEERRELRELLKDVDTPTILASTRRQAFRDSLEQRILKSKNIDVSFETFPYYLSDTTKSVLIASTFIHLKCMGFGKYASDLSSVSPRILLSGPAGSEIYQETLCKALAKHFGARLLIVDSLSLPGGAPSKEVDSAKESSRPEKPSSVFTKRSSQTATLQHKKPASSVDAEIVGGSTISSQAMLKQEVSTASSKGTTLKEGDRVKFVGNFPSAVSSLPNYPSRGPSYGSRGKVLLAFEDNRSSKIGVRFDKSIPDGNDLGGLCEEDRGFFCSANHLLRVDGSGGDDADKVAISDIFEVTSNQSKSGPLVLFIKDIEKAMVGNYEVLKNKFESLPPNVVVIGSHTLLDNRKEKTQPGGLLFTKFGSNQTALLDLAFPDNFGRLHDRSKETPKVMKQLGRLFPNKVTIQLPQDEAILSDWKQQLERDIETMKAQSNIVSIRTVLNRIGLDCPDLETLSIKDQTLTTESVEKIIGWAISYHFMHSSKASIKDSKLVISAESLNYGINILQGIQNENKNLKKSLKDVVTENEFEKKLLADVIPPTDIGVTFDDIGALENVKDTLKELVMLPLQRPELFCKGQLAKPCKGILLFGPPGTGKTMLAKAVATEAGANFINISMSSITSKWFGEGEKYVKAVFSLASKIAPSVIFVDEVDSMLGRRENPSEHEAMRKMKNEFMVNWDGLRTKDKERVLVLAATNRPFDLDEAVIRRLPRRLMVNLPDAPNREKILRVILVKEDLAPDVDFEAIANMTDGYSGSDLKVNLCVTAAHCPIREILEKEKKERSLALSESKPLPGLCGSGDIRPLKMDDFRYAHEQGVLKSKIAAL

SEQ ID NO: 159413 - protein, 93 aa, Glycine max
  Coding DNA Sequence Number=SeqID_67728
MRNGLSSELGRDRDSVAGDGNEMRVKCVRVLVFNKERVWEGGREGFRCKDGTAPVIWCEVKVGFSIQAKHCVINIPVLRLYIRKLNDDQILKG

SEQ ID NO: 159414 - protein, 265 aa, Glycine max
  Coding DNA Sequence Number=SeqID_67729
  Homolog annotation: Hit_ID=A7Q0D1; Match level="QueryCoverage=98%, HitCoverage=100%, E-value=3e-54, Identity=46%"; Hit description =Chromosome chr7 scaffold_42, whole genome shotgun sequence
MSHKPLDSRHSIDSCLLQLRSWKPFKLQQDGPHPKPYYHKRPCLSDRTTTSFSLDMSKLTLAADDDTIHNPNNNRATNYRLVARKRRRRGSRSLSGRSSDRSGTRRCCSVGASAAYGTCSDFPVAMGTDSSGELFGNGDPNWSSDVSEAKNSRRERERDGEKENVGVGFGVSGCSDANGNESGYGSEPGYRGDAEFGYGDEFDEEEDDPRLLFWGDQLGENDLTFIAPAVDSKREMVGENTLLDQKSHHRCRRRKHDCRMVDALR

SEQ ID NO: 159415 - protein, 112 aa, Glycine max
  Coding DNA Sequence Number=SeqID_67730
  Gene Ontology: Mol. function=protein transporter activity; Cellular component=mitochondrial inner membrane; Biological process=protein transport
  Homolog annotation: Hit_ID=Q9LZH8; Match level="QueryCoverage=77%, HitCoverage=63%, E-value=9e-28, Identity=63%"; Hit description =Putative uncharacterized protein F26K9_310
  Pfam annotation: Domain name=Tim17; Domain location=4-105; Score =10.7; E_value=6.3e-05; Accession=PF02466.10; Description =Tim17Tim22Tim23 family
MEEDLDGVAPCSSLAVEAMIRVGAAGAIWGLCAGPYDARQQGLRGSAKASFVAKSVGRFGTRCGFVAGVFSITRCGVQRYRGRNDWLFLTIPKGWSQYCLVMSGREMNVPNY

SEQ ID NO: 159416 - protein, 296 aa, Glycine max
  Coding DNA Sequence Number=SeqID_67731
  Gene Ontology: Mol. function=orotidine-5'-phosphate decarboxylase activity; Biological process='de novo' pyrimidine base biosynthetic process
  Homolog annotation: Hit_ID=Q5PD06; Match level="QueryCoverage=66%, HitCoverage=80%, E-value=7e-82, Identity=77%"; Hit description =Orotidine 5'-phosphate decarboxylase
  Pfam annotation: Domain name=OMPdecase; Domain location=6-217; Score =235.6; E_value=1.1e-67; Accession=PF00215.15; Description=Orotidine 5'-phosphate decarboxylase  HUMPS family
  Pfam annotation: Domain name=SUI1; Domain location=243-295; Score =40.4; E_value=6.3e-09; Accession=PF01253.13; Description=Translation initiation factor SUI1
  Pfam module annotation: Pfam domain module=OMPdecase::SUI1; Domain location=6-217::243-295
MPVTHSPILVALDYHDLNSALQFVDRIDPGQCRLKVGKEMFTLFGPSLVKTLQARGFEVFLDLKFHDIPNTTAHAVAAAADLGVWMVNVHASGGARMMNAAREALLPFGSDAPLLIAVTVLTSMDEDDLKGLGITLSPAQQAERLARLTRECGLDGVVCSAQEAAHFKQVIGQDFALVTPGIRPAGSEAGDQRRIMTPQQAQQADAAANPAQFTGGLMAQDNPLVYSTETGRITHSEEKPQRPKGDGIVRIQRQTSGRKGKGVCLITGIDLDDDALAKLAAELKKKCGCGGALKEG

SEQ ID NO: 159417 - protein, 575 aa, Glycine max
  Coding DNA Sequence Number=SeqID_67732
  Gene Ontology: Cellular component=membrane; Biological process =cellular response to starvation
  Homolog annotation: Hit_ID=Q6D5S9; Match level="QueryCoverage=95%, HitCoverage=79%, E-value=0.0, Identity=82%"; Hit description=Carbon starvation protein
  Pfam annotation: Domain name=CstA; Domain location=32-431; Score =849.2; E_value=2.2e-252; Accession=PF02554.5; Description=Carbon starvation protein CstA
MNNVRTGLIWLAVALIGAAAFAMLALSRGEHVNAVWLVIASVACYSIAYRFYSLFIARRIFELDDRRRTPAERFNDGLDYVPTNKWVLFGHHFAAIAGAGPLVGPILAAQMGFLPGTIWILVGVMLAGAVQDFLVLFISTRRDGRSLGEMARQELGSFAGVVTMLGALGVMIIILSALALVVVKALANSPWGLFTIAATIPIALFMGVYMRFLRPGKIAEVSIIGFVLMMAAIIYGGDVAADPYWGPIFTLKGTELTWVLVIYGFVASSLPVWLLLAPRDYLSTFLKIGVIIGLAVGILFAMPELKMPAVTRFIDGTGPVFSGALFPFLFITIACGAISGFHALVSSGTTPKLVERESHIRFIGYGAMLMESFVAIMALICASVLDPGVYFAMNSPAALIGTTVENASQVINGWGFVVTPEMLSGIAGEVGESTILSRAGGAPTFAVGMAHIITEVFNSRAMMAFWYHFAILFEALFILTAVDAGTRACRFMVQDLVGTVVPSLANNRSWLGNMAGTTVAVAGWGFFVYQGVVDPLGGINTLWPLFGIGNQMLASMALILGTVVLFKMKKQRYAW

SEQ ID NO: 159418 - protein, 58 aa, Glycine max
  Coding DNA Sequence Number=SeqID_67733
  Subcellular localization annotation: CTP_CleavageSite=52; ConfidenceScore=5.39e-01
MVSGASVASVKFLKTLENPSRGVSVTLPKHFRKQIREGFSSFFTVLHPFFVRSSFFNG

SEQ ID NO: 159419 - protein, 30 aa, Glycine max
  Coding DNA Sequence Number=SeqID_67734
MGIFVYDYLVDTSASVQTRESINEFLTSVK

SEQ ID NO: 159420 - protein, 244 aa, Glycine max
  Coding DNA Sequence Number=SeqID_67735
MNQSSKQKEHYYKKGNQARLIHKNQTKHSIKSSVSNQILHLHPQLLQLLPVHVKHPLAIGICEQQVVEGGPLRDYRLNQVMYAGGGVEGDYGPNDVQFEVAIGVEGVSDASIVTARELDPEETNLVEVLEDLGWGVVGDAAVKVFVGTDGEGGGGRRGCGSGSGDGGRGVFGTEELAEGLNGFHDSAKDEAEEVLERVVVGGGRGGGTIAVRDHVVDADNEIFDLRDEGVEATLALSRMREHEE

SEQ ID NO: 159421 - protein, 53 aa, Glycine max
  Coding DNA Sequence Number=SeqID_67736
QRTLASSPSIQPHDVEELPDSNFQVREEISLNEGVAVREERHWSHCEETREDI

SEQ ID NO: 159422 - protein, 162 aa, Glycine max
  Coding DNA Sequence Number=SeqID_67737
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=6e-24, Identity=34%"; Hit description= UPI00006A17C9 related cluster
  Subcellular localization annotation: CTP_CleavageSite=18; ConfidenceScore=5.32e-01
MKARAWSPMKARACSPLKAMTCSPLKEKACSPLKARTCSPLKVRACSPTKAKVYSPLKRKTCSPLKVRTCSPLKARTCSPLKVRACSHLKARTCSPLMVRTCSPLKERTRSPLKVRACSPTKVRTCSPLKGRTCSPLKARTCSPLKARTCSPLKVRACSPLK

SEQ ID NO: 159423 - protein, 83 aa, Glycine max
  Coding DNA Sequence Number=SeqID_67738
  Subcellular localization annotation: CTP_CleavageSite=49; ConfidenceScore=5.13e-01
MDSRDGGYCRGGSGASDDVNLSRSGSFDTGYSGLDDATSATINSLDSVSAFGPSSFSTRAFILLHSGALSFSTWAFVLLHLGL

SEQ ID NO: 159424 - protein, 164 aa, Glycine max
  Coding DNA Sequence Number=SeqID_67739
  Homolog annotation: Hit_ID=Q6UUU1; Match level="QueryCoverage=69%, HitCoverage=95%, E-value=4e-37, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCYGRVCLISTPDTQFRGRQFAPKLD

SEQ ID NO: 159425 - protein, 200 aa, Glycine max
  Coding DNA Sequence Number=SeqID_67740
MKNIFAFFASFLLAFPLFAQSNKLLGKWVLDFALTEENSLVPVDNPYFSNEVIYEISPNKMKISAYMFDAKYIGDNEIDLGHMKLNYAFIEDYLTVVEKDDFVKKYPEFEEKRILRDGREFYIANNLSKLVFDNGTIDPNSCITNGAPLLKKKTSKNYFLKVEFILDQSNQISNIVVSDIEEDDIRQQVIQSIKRCGQVL

SEQ ID NO: 159426 - protein, 96 aa, Glycine max
  Coding DNA Sequence Number=SeqID_67741
MSSKIILMVPKNQESSKFHKIKSQESFKNQDQDSRFKNNQDQDPRFKNQDSSKESRLKIQESREDSIKISIKRVFQKLLNSTILFKRKFLPKSFTP

SEQ ID NO: 159427 - protein, 76 aa, Glycine max
  Coding DNA Sequence Number=SeqID_67742
MVAVAATSAVAKVNPMPPSDLNQMNHPTSDMDVNNYTPILIESQQPQSDHAHVSQPMGETHGMPHHNLVDFEPCLG

SEQ ID NO: 159428 - protein, 170 aa, Glycine max
  Coding DNA Sequence Number=SeqID_67743
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=84%, HitCoverage=36%, E-value=3e-72, Identity=94%"; Hit description=NADH dehydrogenase subunit B
  Pfam annotation: Domain name=Oxidored_q1; Domain location=23-170; Score=-44.9; E_value=5.3e-05; Accession=PF00361.11; Description=NADH- Ubiquinoneplastoquinone (complex I)
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRREMLFPLGPRHNFTCSNNNLRVKQSQEQRIPL

SEQ ID NO: 159429 - protein, 54 aa, Glycine max
  Coding DNA Sequence Number=SeqID_67744
MEFEETWQGLWLPLNYQLDKGARMTFVDNWVVGKEKGCYWLSNDIVGLVGSLAM

SEQ ID NO: 159430 - protein, 65 aa, Glycine max
  Coding DNA Sequence Number=SeqID_67745
  Homolog annotation: Hit_ID=Q8LNP1; Match level="QueryCoverage=72%, HitCoverage=12%, E-value=6e-08, Identity=61%"; Hit description =Putative uncharacterized protein T18N24.41
MDQAGEERKLQLSDLDEIRLEAYENSKFYKEKPKKFRDSLIAKKDFVLRSKVNPQIRASRSMDTG

SEQ ID NO: 159431 - protein, 58 aa, Glycine max
  Coding DNA Sequence Number=SeqID_67746
MEDPATGEPGTESFPRPPFFSARLFALKNTGFYGRSATPGCRRRPWGDLVVPTGWRRW

SEQ ID NO: 159432 - protein, 159 aa, Glycine max
  Coding DNA Sequence Number=SeqID_67747
  Subcellular localization annotation: CTP_CleavageSite=77; ConfidenceScore=5.41e-01
MKKKLTGCCTRCKASKRSDVGNDNSRNFTAPRLHFSSSFPLPAEGPSSPRRAGCLGPKAFGGLGEPDANLGELGTSRAFDASSIGACRPRIFFINGFLCFLEDEWQRNGERKRERRRHFKEKMSLEEAHHHRRPWIRAWRNKEMNEGRGREEHEILCSK

SEQ ID NO: 159433 - protein, 67 aa, Glycine max
  Coding DNA Sequence Number=SeqID_67748
MAYTHIPMEDSQAILLEISASPHQLDLAPYASGLRNLGWGYGWGFDTGIGVGIAADLETTSVDDWVV

SEQ ID NO: 159434 - protein, 196 aa, Glycine max
  Coding DNA Sequence Number=SeqID_67749
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-26, Identity=29%"; Hit description= UPI00006A17C9 related cluster
  Subcellular localization annotation: CTP_CleavageSite=38; ConfidenceScore=5.62e-01
MCSPLKVRACSPLKASTCSPLKARACGPLRARACGPLRARMCSPLKVRACSPLKVRVCSPQKVRVCGPLKARACNPLMARMYSPLKASACSPLKARTCSSLKVRACNPLKARTCSPLKARACTPLKARTCSPLMVRSRSPLKVRACIPLKARTCCPLSVRAFSPLTARTCSPLKERACSPIKAKTCSPLKARACGP

SEQ ID NO: 159435 - protein, 131 aa, Glycine max
  Coding DNA Sequence Number=SeqID_67750
ENAVNEVTEVPYTMVPSKKDKDHHLVRFLDIFGKLEITMLFGEELQQMPLYSKFLKDMLTRKHKTAKLEETLAQLMQITTSNHKSTESALKNLEVQVGHLAKQIADKSSNSFVKKYRDESQGGMQSCDDKK

SEQ ID NO: 159436 - protein, 297 aa, Glycine max
  Coding DNA Sequence Number=SeqID_67751
  Pfam annotation: Domain name=Retrotrans_gag; Domain location=91-173; Score=15.4; E_value=0.0017; Accession=PF03732.8; Description =Retrotransposon gag protein
MQGKTLAGDLAPLDLEIEATCWRNNAEKRKRVLQERTTNPSGERILSSESSSSFPVDFRGTEVGAFKANTMADDQLQRVTLEDYSSSTVLQFFTRKAKRWLQSFKGNSPKTWEKVVEKFLKKYFPESKTAEGKVAISSFHQFPNESLSEALECFHVGGKIKLKTPEEAMELIENMEASDHAVLRDRTHIPTKRSLLELSSQDALLAQNKLLFKQLESLTKTLSKLPTQLQETQPSYSAVMQVGGYSICGGAHESGYCITQDDATKEVNYMGNQNRQGFHTCGFSRYQQGENFNQNQG

SEQ ID NO: 159437 - protein, 103 aa, Glycine max
  Coding DNA Sequence Number=SeqID_67752
MRGTVHKPRANLGEDQKFSPVDVVATYPSAGGRRVTRGMRVPRKEYARSRHQRLFEENVGKTGKDAIYELLSERFGSCIYARGRVFPFAPTYSSIWDEKIRPT

SEQ ID NO: 159438 - protein, 188 aa, Glycine max
  Coding DNA Sequence Number=SeqID_67753
  Gene Ontology: Mol. function=structural constituent of ribosome; Cellular component=large ribosomal subunit; Biological process =translation
  Homolog annotation: Hit_ID=Q9C828; Match level="QueryCoverage=33%, HitCoverage=27%, E-value=8e-13, Identity=57%"; Hit description =Chloroplast 50S ribosomal protein L22, putative; 25606-24374
MGQTLYGPAMTVTFFSLNARLHFAGHFWVPIGKYPLSSKVFGKRHLISAFCKHKTKKQKNSYEAWIPLLFKVLPCWANSSKETPVLSPLVPVSLLGSSKGEDQKLKVVTMQEKVQVVLMAIKQSREIVNLVAALVRGMLVKDALMQLELTINRAAKTVYQVVTLGIFIVTSLDKLAKSIILIAFKVPL

SEQ ID NO: 159439 - protein, 57 aa, Glycine max
  Coding DNA Sequence Number=SeqID_67754
MVSRIPSVEQQNIKWKAYMQNLKIQVILIPKANFIIYIISSSVDVSDSCDIYTLLKK

SEQ ID NO: 159440 - protein, 123 aa, Glycine max
  Coding DNA Sequence Number=SeqID_67755
  Gene Ontology: Mol. function=RNA polymerase II transcription factor activity; Cellular component=transcription factor complex; Biological process=transcription initiation
  Homolog annotation: Hit_ID=A2WPH2; Match level="QueryCoverage=74%, HitCoverage=65%, E-value=2e-18, Identity=52%"; Hit description =Putative uncharacterized protein
  Pfam annotation: Domain name=TFIID-18kDa; Domain location=29-106; Score=15.8; E_value=6.7e-05; Accession=PF02269.7; Description =Transcription initiation factor IID, 18kD
  Subcellular localization annotation: CTP_CleavageSite=23; ConfidenceScore=5.23e-01
MSNSSAGTSSKPRTASSQPSETSSKRKRGVFQKELQHMMYGFEDDPNPLPESVALMEDIVVEYVTELVRLFNFLVVQLCLSGLDSWSSYAKLVCQELKQARKVFESDEEKLRKVFEVDDSLEG

SEQ ID NO: 159441 - protein, 337 aa, Glycine max
  Coding DNA Sequence Number=SeqID_67756
  Gene Ontology: Mol. function=sequence-specific DNA binding; Cellular component=cytoplasm; Biological process=regulation of transcription, DNA-dependent
  Homolog annotation: Hit_ID=Q9LUH8; Match level="QueryCoverage=92%, HitCoverage=87%, E-value=5e-77, Identity=47%"; Hit description=Heat stress transcription factor A-6b
  Pfam annotation: Domain name=HSF_DNA-bind; Domain location=36-204; Score=248.1; E_value=1.9e-71; Accession=PF00447.8; Description=HSF -type DNA-binding
MNPNNDGPMILVKEEFPEGVAIAPQPLEGLHEIGPPPFLTKTYDIVDDVSTDEIVSWSRGNNSFVVWDPQAFSVTLLPRYFEHNNFSSFVRQLNTYGFRKVDPDKWEFANEGFLRGQKHLLKNIRRKKTLTNQQQALPIDHCVEVGRFGSLDGEVDALRRDKQVLMVELVKLRQQQQNTRNNLQSMENRLKRTQKQQQQMMKFLTRAMQNPNFLQQLVQQREWRKDLEEAATFSNKRIRSDVEECSSFVKLEHEEEHNNDITSSELEVSDMDLVIMNTEEEEEKLLGAEIESINEEVLWEELLNEGTEEDVLIGLEEDDEDIVVLAEELGYLASTPK

SEQ ID NO: 159442 - protein, 189 aa, Glycine max
  Coding DNA Sequence Number=SeqID_67757
  Homolog annotation: Hit_ID=A7NWT2; Match level="QueryCoverage=71%, HitCoverage=29%, E-value=9e-65, Identity=84%"; Hit description =Chromosome chr5 scaffold_2, whole genome shotgun sequence
  Pfam annotation: Domain name=PH_2; Domain location=74-184; Score =250.8; E_value=3e-72; Accession=PF08458.1; Description=Plant pleckstrin homology-like region
  Subcellular localization annotation: CTP_CleavageSite=52; ConfidenceScore=5.07e-01
MHQFVSTWDSFCGFLVLLLTVIPVEKNLGAGGGSNANGNRNGSNDSSNSSFSGEIVPEENFLGICSRELLARGCELLKRTRTGELHWKIVSVYINRMNQVMVKMKSRHVAGTITKKKKNVVLGVIKDMPAWPGRHLLEGGENRRYFGLKTVMRGVVEFECRNQREYDVWTQGVSRLLSIAAERSNRNRI

SEQ ID NO: 159443 - protein, 125 aa, Glycine max
  Coding DNA Sequence Number=SeqID_67758
  Homolog annotation: Hit_ID=A6FJQ2; Match level="QueryCoverage=30%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPPNLSAIRKVLALFNHGTSIPLMLKQALNLGA

SEQ ID NO: 159444 - protein, 92 aa, Glycine max
  Coding DNA Sequence Number=SeqID_67759
  Gene Ontology: Mol. function=glycolipid transporter activity; Cellular component=cytoplasm; Biological process=glycolipid transport
  Homolog annotation: Hit_ID=UPI0000ECBAF8; Match level="QueryCoverage =44%, HitCoverage=48%, E-value=1e-16, Identity=100%"; Hit description= UPI0000ECBAF8 related cluster
MEGTVFTPALQEIEHVKSDQGEILSKPFLDACKHILPVIGMQAWHWPSFYNVVTGKTLALPNLIALQHIPLSPAGVIAKRPAPIALPNSCAA

SEQ ID NO: 159445 - protein, 121 aa, Glycine max
  Coding DNA Sequence Number=SeqID_67760
MVDDVAQRSEDVPQMTADIDVTVVEDLGRDGAEGSHADEGFPGGPRDPSVLTSFAEHVAHAIWTGHEHPELKLVSHGRKVALIRRPVPAIEGLVVATGLSPLIEYSVVTGDPGLISAFVER

SEQ ID NO: 159446 - protein, 141 aa, Glycine max
  Coding DNA Sequence Number=SeqID_67761
MLMCNDQFSCVRPIELLCSIGRTPDEVINLLERTTTPTHEALLYYNGRWNMPLQKKFVGCAFIGKNPKKFEIPSGCTLDELKDLIKQVASKRIPPHGIHESQAVLVQSNYWKKYGSIEILAVFTKHGMEFEHDVDTTSLNE

SEQ ID NO: 159447 - protein, 118 aa, Glycine max
  Coding DNA Sequence Number=SeqID_67762
MDEDQWTYDYTMSQEVHMDYDNEEECGANEPHVDCSNAFNTCQVFGTRDDILQWARTVAHENGFVAMIMRSNIDTGVKGVVCTSVGIKNSLEEILGVGNVVVPSGFVGNQCMEGKVGW

SEQ ID NO: 159448 - protein, 87 aa, Glycine max
  Coding DNA Sequence Number=SeqID_67763
  Gene Ontology: Mol. function=protein dimerization activity; Cellular component=nucleus; Biological process=regulation of transcription, DNA-dependent
  Homolog annotation: Hit_ID=P49679; Match level="QueryCoverage=100%, HitCoverage=48%, E-value=2e-29, Identity=72%"; Hit description=Auxin- induced protein IAA4
  Pfam annotation: Domain name=AUX_IAA; Domain location=1-87; Score= -15.2; E_value=2.4e-08; Accession=PF02309.7; Description=AUXIAA family
MDGAPYLRKIDLRVYVQALETMFKLTIGEYSKREGYKGSEYAPTYEDKDGDWMLVGDVPLESHVYDFLQKAKSHVKGSKARGLGCGV

SEQ ID NO: 159449 - protein, 133 aa, Glycine max
  Coding DNA Sequence Number=SeqID_67764
MYTSHQYRDQRPKHEERRPTLQDMVMEHITESYERNIATLPSQIEANPKNEEVNVVSTRSGKSMAKPKKKRKEEHEDTPLILGQPFINTGGALIDEEEVFKTINKIKVIVAKSNPSMGKKNHTKNKVILKDPR

SEQ ID NO: 159450 - protein, 182 aa, Glycine max
  Coding DNA Sequence Number=SeqID_67765
  Subcellular localization annotation: CTP_CleavageSite=50; ConfidenceScore=5.36e-01
MAYIRKNCWNPDDLTISIRGARRAKARPTNLPSTSTVPTPASTLVAPSVLAQLDSQCFEAMLQSIHQGHIILLQSLQVVAPPRFIPSIEQFLERVKDASSGTTIPEPFTFQLDAGEEQVRPETAATPERSLESTSKPSTPVADLFSLQPEADPCTPVLDIPEDQTTPVWTLNTSPPATPVLH

SEQ ID NO: 159451 - protein, 38 aa, Glycine max
  Coding DNA Sequence Number=SeqID_67766
MALYRILGCLAAAFSVCPEPGRDNDLSVVTLASICVRS

SEQ ID NO: 159452 - protein, 123 aa, Glycine max
  Coding DNA Sequence Number=SeqID_67767
MECLEGVWETLEGNERCRFRGTIRLTATSLVHPEEPARTLKQPVEWILPTPTPYRLVEPVQVIEVSSFEENLEEDPEKLPPKPAMDALDLPEDNEDPLPDVDSPEDIMSASEADSTEVGKPIV

SEQ ID NO: 159453 - protein, 153 aa, Glycine max
  Coding DNA Sequence Number=SeqID_67768
  Homolog annotation: Hit_ID=A0PAV3; Match level="QueryCoverage=42%, HitCoverage=31%, E-value=3e-07, Identity=52%"; Hit description =Restriction endonuclease
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGAALELVDPPGCRNSIGAMFHDFLSADPQGNPPFSLFFGAP

SEQ ID NO: 159454 - protein, 84 aa, Glycine max
  Coding DNA Sequence Number=SeqID_67769
  Subcellular localization annotation: CTP_CleavageSite=61; ConfidenceScore=5.12e-01
MKKKKVAVAGVSLSKAYTLSKQHPLSEALSSLSKLGESGRESAKHARAQCAISSPSESFVSSGTKRAWQAKPKFTNSRLARKWR

SEQ ID NO: 159455 - protein, 36 aa, Glycine max
  Coding DNA Sequence Number=SeqID_67770
MHKNERDGKWENGFKVRVDMRRIFRLKLREKRGNGE

SEQ ID NO: 159456 - protein, 31 aa, Glycine max
  Coding DNA Sequence Number=SeqID_67771
MKRPKNHPFLVNNVLEENARHGQLCVRIMHK

SEQ ID NO: 159457 - protein, 117 aa, Glycine max
  Coding DNA Sequence Number=SeqID_67772
MRVGNSDIYGFLEPQSIQRSGQSQFESESYIKSWMQSSQRDVYLGAYLDGFHCSGHWQMVVILPKEHLVVWFCSLHNMSDNYLEGIINSALKGLDDAPRPKSKASARWIVVKTKKKY

SEQ ID NO: 159458 - protein, 58 aa, Glycine max
  Coding DNA Sequence Number=SeqID_67773
  Homolog annotation: Hit_ID=A5BZX7; Match level="QueryCoverage=100%, HitCoverage=9%, E-value=2e-13, Identity=53%"; Hit description =Putative uncharacterized protein
MKAFGYRASNSDHTLFLKRGNDQDEISSLQQYHASKFEMKQLGNLKYFLGIEVARSKH

SEQ ID NO: 159459 - protein, 129 aa, Glycine max
  Coding DNA Sequence Number=SeqID_67774
  Gene Ontology: Mol. function=protein binding; Cellular component=cell projection; Biological process=keratinization
  Homolog annotation: Hit_ID=Q54WQ8; Match level="QueryCoverage=82%, HitCoverage=26%, E-value=9e-17, Identity=39%"; Hit description =Putative uncharacterized protein
MTDPLNDSISCLLIRVDPWVLVPSPSEGYTSSPSKDYTSSPLEGYTPSPLEDYTSSPLEDYTSSPSEGYTPSPSEGYMPSPSEDYTSSISEDYTSSPLEGCTPSPSEGYTPSPSEGYTSSPSEGYTPSP

SEQ ID NO: 159460 - protein, 52 aa, Glycine max
  Coding DNA Sequence Number=SeqID_67775
MYHLLFSVTTTQVDVSSTSTTKDVPSNVLRQSSQAEEEVEEEVQEDVQRDSK

SEQ ID NO: 159461 - protein, 230 aa, Glycine max
  Coding DNA Sequence Number=SeqID_67776
  Gene Ontology: Mol. function=motor activity; Cellular component=cell projection
  Homolog annotation: Hit_ID=UPI00006A2D9E; Match level="QueryCoverage =70%, HitCoverage=85%, E-value=4e-16, Identity=15%"; Hit description =UPI00006A2D9E related cluster
SRELHALTFRGLHALAFRGLHVLAFRGQHALAFRGLHVLPFKGLHVLTFRGLHVLAFIGLHILAFRGLHILAFRGLHVLAFRGLHALTFKGLHALAFRGLHVLAFRGLHALAFKGLHTLAFRGLHVLAFRGLHALAFRGLHVLAFRGLHISALEDSRDRAYKALNGPGEVQQGPRVSNSDYEPPLVLWSARRPQQGHHAPINRAFIEKYCTPRHRVRHHNSGHQTHRHHL

SEQ ID NO: 159462 - protein, 43 aa, Glycine max
  Coding DNA Sequence Number=SeqID_67777
MAKIMSQITRTSVILNTIHAKEQTYSEVSKPFVMRWKDQLEPY

SEQ ID NO: 159463 - protein, 92 aa, Glycine max
  Coding DNA Sequence Number=SeqID_67778
GTSFVVQVEGTSTWVVVTENKRGYTSCGSVQVEGTSTWLFKENKGGYIPCGSLLVKAKKSQGPHVTWGLDVGTGCCRTSINSYVCLLLPYTL

SEQ ID NO: 159464 - protein, 49 aa, Glycine max
  Coding DNA Sequence Number=SeqID_67779
MAEITQGKTMIGHDWPHIVVSYLQGHDRPSSLPGTRQAEDITARQPSIL

SEQ ID NO: 159465 - protein, 390 aa, Glycine max
  Coding DNA Sequence Number=SeqID_67780
MASRKRKSIGSRPTTQYDTRRFHSLDAWNRYTDNVLGKNILPERKVELYHTELNDFKTELERRNFHKCLANLVDGSIDLALVKEFYANLYSSEGPSPKQARVRGHLVKIYVDSLNRFLETPMVLEEGETLPTYSGYCRLPTNYREIEVALCILGRGFILNAGGHPGRILSKDLTTLAQMTSIAQSNTSRLGFPTLITALCRARGVVSDSLTFERLSLEELLESRGSNYFYPGARRASVRPAKLPSTSAAPTLASTSVVTPPGSIPSVEQFRVMVVWSGAQPSLHREHEGPTAQVPQHVEDESSEATVPEPFIVGEEAGETQVRQVAAVTPERSLVATSEPLAPVVDLSSTQHVADLSTPILEIHEDLTTPVLTMDTSPPATPVLHLKDAE

SEQ ID NO: 159466 - protein, 129 aa, Glycine max
  Coding DNA Sequence Number=SeqID_67781
WNLLRADQRLIFAKKLAQGFPGINRDTRIYLFLRSDLSVTVASVFYQLSLLFQLLTGVVRNGKKHPPDISAGKCSGHAARNHHTPPRLMRRYRARPIRHSGCATVGKGDRCGPLRYYASWRKGDVLQGD

SEQ ID NO: 159467 - protein, 261 aa, Glycine max
  Coding DNA Sequence Number=SeqID_67782
  Gene Ontology: Mol. function=transition metal ion binding
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.12e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSMIVGSMYETFSGRDASRGMAKNSFSDDVLADIHGPIDPLEDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159468 - protein, 214 aa, Glycine max
  Coding DNA Sequence Number=SeqID_67783
MFAAQHVTKICYVQNDTNPNQPLPCYMLLYKRSWIRSLSTRPPSAERPVVHVDPATGKADSPHIKKLRTYLGIVAHDKVDITYENWKEAPTAKKDLIWEDIQRLLTVGRKGSYLRPWARDRGCLNQTSRGNGPLQSIRTVWRTLSVRNTALARKNGPNFARLADTLLGRMCAKRHRPARSRSSWLRRRRKSWRKLHSQEALMASSTLHPRSDAT

SEQ ID NO: 159469 - protein, 145 aa, Glycine max
  Coding DNA Sequence Number=SeqID_67784
MVAQLIHDRVEMECLEGVWETLKGNARCRFRGTIQLTATSLVHPKEPAHTRTLQRTVEWILPTPTPYRLVKPVQVIEVSSSEEDPEEDSEELPPESAVDAIDFPEGDEDPLPDVDSPEDFMSANEANSTEESGPGGIATSGDSSS

SEQ ID NO: 159470 - protein, 85 aa, Glycine max
  Coding DNA Sequence Number=SeqID_67785
VCSHSNPSQKIRVGRRCNPQGDPTNQLPCALRLVLDRAWEDSVLRIFKGRRGRTGHHATCGALPAAGPYLRLSRFQGGQAVKQKR

SEQ ID NO: 159471 - protein, 111 aa, Glycine max
  Coding DNA Sequence Number=SeqID_67786
MTKARQKEVRKENRGGACHPARPGEPGCFLQKQPPSGGIFWKAQVGLLNVCGKVHLKTKLQEIAYPDLDSMCPPPEKFHRCIQDSIENIIDVKADGNCGYRAIAALLGMGE

SEQ ID NO: 159472 - protein, 149 aa, Glycine max
  Coding DNA Sequence Number=SeqID_67787
NHRTGCPKLANLSPYATKLILRTIYYHAQPTRIGSPRPIIPMEHFLEQVAWPESQPPLVGPNLAAPPKPTPARVEPVPTDPQSPVVSSPSSPELEVVPPSPPLIILSDSPSGEVADPPDSPVGGAAYLSDSSSGEVVVVSYSTVFPSDR

SEQ ID NO: 159473 - protein, 97 aa, Glycine max
  Coding DNA Sequence Number=SeqID_67788
  Subcellular localization annotation: CTP_CleavageSite=44; ConfidenceScore=5.47e-01
EWEKGGKMKWGHPLQGSKRTPLMKKIQRPTSSNGATSSGNQSTRASMASPFIFLLLHSAAIRLQEAKDSIDEEDPRPTSSNGATSDISTTNCDDFAL

SEQ ID NO: 159474 - protein, 170 aa, Glycine max
  Coding DNA Sequence Number=SeqID_67789
  Gene Ontology: Mol. function=structural molecule activity; Cellular component=cytoplasm; Biological process=keratinization
  Homolog annotation: Hit_ID=Q28658; Match level="QueryCoverage=63%, HitCoverage=67%, E-value=4e-13, Identity=35%"; Hit description=Small proline-rich protein 3
GYKPSPSEDYTSSPSRGLNVLAFTRLHVLAFRGLHVLAFRGLHAPPLQKDYTSLPSEGYTCSPSEGYTPSPLEGYTPSLSEDYTSLPSLDYMSLPSEDYTSSPSEGYMPSPLEDYTSSPSKGYTSSHSEGYTPSPSEDCTSLSSEGYTSSPSEGYMPSPSEDSTPSPSKG

SEQ ID NO: 159475 - protein, 146 aa, Glycine max
  Coding DNA Sequence Number=SeqID_67790
  Gene Ontology: Mol. function=metalloendopeptidase activity; Cellular component=mitochondrial matrix; Biological process=protein maturation via proteolysis
  Homolog annotation: Hit_ID=A5BFG6; Match level="QueryCoverage=32%, HitCoverage=6%, E-value=3e-11, Identity=70%"; Hit description =Putative uncharacterized protein
MPYPHGQKYFPHDPEKVACDEVAELPHATHGLRLKQETPDPPKALKIVPSLSLQKIPKEPIRVPTEVITTSPRVREAWVEKVVETPYMTPTTSPLFFTPQFTTPISPYNQCGFNPLFETSTDAEFNRLKSSPPPNIQVLTRSRREA

SEQ ID NO: 159476 - protein, 148 aa, Glycine max
  Coding DNA Sequence Number=SeqID_67791
MEDSLVTRGKGKLRKTISKRIKNDLEIQWNIMALSDSCWLGGEWRERGEEKLLAEKTKKKLEEAAQSRSVDGVINPPSLVRRHVKWKMAHTKKMGEMMTKAANEIAEKIDSFEEQATQGSFVPMDVRMFSPLLLDVQSTLDVSVLLEA

SEQ ID NO: 159477 - protein, 213 aa, Glycine max
  Coding DNA Sequence Number=SeqID_67792
  Homolog annotation: Hit_ID=A5B5G7; Match level="QueryCoverage=98%, HitCoverage=14%, E-value=2e-09, Identity=26%"; Hit description =Putative uncharacterized protein
MASMKRKTPSTPTQARFDRSRFTSLEAWERYIDIVVPWKMLPGRNVVVYYTEFDEFKEELERRNWDEKLTDFADSSINIAIVKEFYANLYDPEDKSPKQVRVRGHLVKFDEDTLNTFLKTPVILEEGENLCTYSRFALLRPDPQELAAKLYIPGRGFELNVDGQPLKILRKNMTTLAQTWSVLSFSNLIPTSHTFDVTLDRAKLIYGIIMGIL

SEQ ID NO: 159478 - protein, 68 aa, Glycine max
  Coding DNA Sequence Number=SeqID_67793
MLQALESRFAPSYYDDPHSALFKLQQRGTVNDYLTEFEHLTNWVIGLTLPFLLSYFVLGPTPELHQEV

SEQ ID NO: 159479 - protein, 24 aa, Glycine max
  Coding DNA Sequence Number=SeqID_67794
MARHDVGIRECPKSFPWHAYDDDE

SEQ ID NO: 159480 - protein, 52 aa, Glycine max
  Coding DNA Sequence Number=SeqID_67795
MAGLYCLLQLGSLIGKELAGRPRLVLKKPLSAPREPSSSYIVLLTKSWCLDR

SEQ ID NO: 159481 - protein, 146 aa, Glycine max
  Coding DNA Sequence Number=SeqID_67796
MKKWEREMNTSLAEVRNDIVKEHYGLKQSGGDVLGFSGDGIADDEDVVEADAVVEDAASEGVEEVKDEGLEDGAGKDFEDGDEGGTVWWKWGWRPTQSKNLMPFTEEELKQHNLLHHPLSIGVVSGGGAGLDGGDNDFRWRKERRR

SEQ ID NO: 159482 - protein, 79 aa, Glycine max
  Coding DNA Sequence Number=SeqID_67797
MSVAYVLCHICSKAESSFQIRSAPCGDCRPWIFFINGVLCFLKIMAAEWRRKKDDGRHHFKEKMSQEEAHHHRKPWIRT

SEQ ID NO: 159483 - protein, 275 aa, Glycine max
  Coding DNA Sequence Number=SeqID_67798
  Pfam annotation: Domain name=Transposase_23; Domain location=187-247; Score=-17.1; E_value=0.089; Accession=PF03017.5; Description =TNP1ENSPM transposase
GALSGMTLRLANMDNSSFFQIHPRAQPRSVTLNGWLAKPANWLSEKVFYVQDPCDERWLVVLQGKTIGVNLEDDDSTLDTCHSPFSTHMPTMNGEDEVDDKYGISKDKWNQFCQSRRDPSWEDSLEEQSAQHSFTAHGRKDVLTTTIGQLEHPGRVCVARVGEAVLIARDRTLTLTHPVELNVAPSVADNPPHSIALERVYEGSSIVHHMPLANDMVNVGVEEVRDADARIPIPTEKVQFLQKAVASGGSNPARLGELSSPGRAGRQASPLFCYK

SEQ ID NO: 159484 - protein, 200 aa, Glycine max
  Coding DNA Sequence Number=SeqID_67799
LGFPALITALCKARGVTSDNLVFERLSPVINLAYIRKNYWNPDDLTISIRGARWVRTRPAEPPSTSIAPIPARSIPSVEQFTELVAWPETQSSLPGEDEGPKAQVPQHVEDDSFEATIPEPFVRGMETEETQESTATPERSLEAASEPLAQGEDIPSPQPVADPSTLVLDLSEGQTAPVLIVNTSPPTTPVLHLTDKEDG

SEQ ID NO: 159485 - protein, 18 aa, Glycine max
  Coding DNA Sequence Number=SeqID_67800
MGQNAPKDYGDGWLKFSQ

SEQ ID NO: 159486 - protein, 98 aa, Glycine max
  Coding DNA Sequence Number=SeqID_67801
MANHTTILEEAFNLEVPIQLPKQNTPGRGYQTITKQEQCSEDIKRSSTGTRKQTEDRKTEADKDTSNSGVSDNLHQNKNPPQHVRGVINTIASGFSYE

SEQ ID NO: 159487 - protein, 142 aa, Glycine max
  Coding DNA Sequence Number=SeqID_67802
MVRLLVKKTCGVVTNVYSRKTLEKPKRRRSADFENKGSGVIYRGESLRRWTLKRPQVMFDEKRRESLRRWTLKQSQAIFDEMKKFINDEQRTNEERYRSRLRLQFGSPASTLFFSSFFFFFSLISLNAGPWNPLLNLPHAYL

SEQ ID NO: 159488 - protein, 442 aa, Glycine max
  Coding DNA Sequence Number=SeqID_67803
  Homolog annotation: Hit_ID=A2Q234; Match level="QueryCoverage=40%, HitCoverage=85%, E-value=2e-13, Identity=31%"; Hit description=IMP dehydrogenase/GMP reductase, putative
MGIIPIFILVHSFTKIIVRTRGLGRVLGTGRGRETTQDAPEADVPRRRWPTASACRQQVRVPEDVAQRPEDGPQLHEDAPHVSDGTPDMTSVADAVDTEGVATETSLGSPAVHEGFPGGPRDPSVLTGYAEHVAHNIWSDLHCWIYEHFPSMHTCFVDTACDEGSPRACRWLTGKAHMTGIKGAPYRTRMDAFTVTDVSWMPYAKHRGVRGFDLISSYTGQLRWGQLVVYTRPERVTRQFGYIQTVPPTLVTKSLMSDEIDDWWIHFSDHLVGAGEICVVLGQVALDYMEWFFWISHPFVTPTEETLEPRQPPPPHVEEFIEPPILEVSVASNLPMPFPLALFVISTENAMRPTPIVCSELEKWREEENPLPWNPAEERSSVDTRGRSSSAGFHGRTFFRNCHFNCRRTFFRGIPLKNFFCECQQKNVLFKEQKRSRAFLEF

SEQ ID NO: 159489 - protein, 104 aa, Glycine max
  Coding DNA Sequence Number=SeqID_67804
  Homolog annotation: Hit_ID=A2Q3D1; Match level="QueryCoverage=68%, HitCoverage=38%, E-value=9e-12, Identity=47%"; Hit description =Nucleic acid-binding, OB-fold, subgroup
MGMLVGVGAERENERNGRMSKMNIIQLEADGAQIECTLLGSFVDKLTAFLASGKVDNVVVIVQFAKVQSFQDFEDAKVLAKSYYIFLVLLEHDASEYVLDKWPQ

SEQ ID NO: 159490 - protein, 220 aa, Glycine max
  Coding DNA Sequence Number=SeqID_67805
MARTPNEIKFIDGSRETLKLAVRITNLWFVGTPNKSEQAEMVIVDSDGDEIHAICKPNQLKSWKIDLKENCTYVMHNFKVMKNDGSYPPSVSISLKASKLLINEPVLEIQEFNERYFGHAIFSVSVKPVLTPCGQGSSQLSGSSQLSSKDAFLSKAEAKTIAEINVISKVVLKTDIEATTFTCGCGKDNDQPVLRYRLEVMVKHKDESTKFLLWDRECAE

SEQ ID NO: 159491 - protein, 18 aa, Glycine max
  Coding DNA Sequence Number=SeqID_67806
MTSTTNVVFKEVFKNVRS

SEQ ID NO: 159492 - protein, 212 aa, Glycine max
  Coding DNA Sequence Number=SeqID_67807
  Homolog annotation: Hit_ID=A9YWR9; Match level="QueryCoverage=15%, HitCoverage=4%, E-value=9e-07, Identity=71%"; Hit description =Oligopeptidase A
MSFGRISNFQHILGNNLDFASFFLADIEDLKEFSKIQGALEANDLTHWDITYWCETLCSQVLLKLHIKDKSRVNCTKSLYHGDDTAQGTVRPRRELGSRHGARLIKVILVASTLTCVYPDLSSFTRSGVYLDLSSFIGSGVIQNSKACIKRSAHSQWHPNLSSFTGSGIYPDLSSFTGSGVYLDLSSFTGSGVIQNSKACIKRSAPSQVHIS

SEQ ID NO: 159493 - protein, 187 aa, Glycine max
  Coding DNA Sequence Number=SeqID_67808
MARIFQEDWTRDAGEEDPRVLPSLRGSVRFDDDRMFSQKVHPIGESSNNNPIHLHGGSNVASGQVSDVRVANAIVGGVTVPPDAGQIPWLNPPPNVIDLGLEVTTIQSVPRIPFFWTSSPMKFIKNPIAYMSDSDQENMVVLLIMGKFDYHSIKKAQVEKDEKAKAEKMEEKLKTDFSEAETEILKT

SEQ ID NO: 159494 - protein, 192 aa, Glycine max
  Coding DNA Sequence Number=SeqID_67809
  Homolog annotation: Hit_ID=A5B958; Match level="QueryCoverage=80%, HitCoverage=14%, E-value=3e-09, Identity=27%"; Hit description =Putative uncharacterized protein
MEIHTDGGWEWNLSWRRPLFENEIDSAVHFLTDIEDSAIQQQGTDTWIWSRDPAGHYSTRIAYNLLGEEAAGGRQEDCFEKLWKLKIPVRIAIKGVFPFSPKQDFLQHVGVQLDGLRTNRWQYWWLALTWSIWKLRNNIVFSNATFNANSLFEDTMFLLWSWLRSFEKGFTAHFNQWATSFTKSFMKQKRIT

SEQ ID NO: 159495 - protein, 853 aa, Glycine max
  Coding DNA Sequence Number=SeqID_67810
MALIDISKVLIRKGDGLFEKGPDFKPLIIDIRDTSSLRSLIRTESEENLSVKLRRDLLSSCRTLARATIVRQVYQWSVAPFNLLWRPSAPNGHVETFDTVFIGTWHGRSTKVAALPFFRVPMTSVPSMVDKCPRGGFSVWIVDVLLPFVAIDGAPPRIGVGILANTLQCLSKKCIVDIYPGAVSSESILSWRDNVDLTSVKIDIYAGAVAHELILCQRGNVDLASVNDAWTIRDDKDATKRGTGFALEDGWILVRQQSLLYPIQILNLEPGMPYSYEDGLEFAKVSLLFNQYMQKNEGSANFSNPLVLREEKQIALKLLGREDINFLDGNGIDYDNEYDPSFVCDRNMATKLELHEAPNLENVEWANEQVHGFVLPNFIQMSNRVLAITSSYLSYPNFVRGLSFVDLLILASRLSFLDPSLPRLASGLPGPPKDFKEGFQGSEGEGLREERKKKKKKEKETRPRRYRITIAIIPYFVSCSMIQKSKGVATCPFAGERGEAHGCAFQRRKDAQSRHQRLFVEKRQKNRRKLVKKKIPSSGVVFTFEEGISTSHVDKSGALAPTYPPSKRKSDLPSSFLRVVETHQSLGFLKNHSNFLKICTSGYILQKIVGMNYLFLTIVRVVNDLNLILNSIGHPPIIIDMSVPMGGMKKNYLKKNLLLRIILLNWLTRLEISSLKLFLVVVLLVVSGSDKKKVIWRNKPKPTNKCRSYNIETRSKSLHDLPLPPSKKQNIVDLEGDVQPIRTSLIPTNKLSGPHMWMSSRSKIDRIIMSEDWEAFQKKGLDDVENLLEEFNQLKIHANELEAYVQQEREGNVWLKEKNTQLKGDGEFCMRVNGELIPTRLRALGTVNQDCVT

SEQ ID NO: 159496 - protein, 174 aa, Glycine max
  Coding DNA Sequence Number=SeqID_67811
MPLWESWTVINSITITLYKIEDNGAVESSTKEECQGDGYIITKARSRSASITLRKRSHSRAIATVASKHTKHHAYTPNKWQPKKNILCMTPTARRIPLDDLIRILKGISNLFERTCTDMVALISSWSSDTFETLVVQFGAQYITCKPYHTTSITLINLTQADDEPLRNFMGHFS

SEQ ID NO: 159497 - protein, 129 aa, Glycine max
  Coding DNA Sequence Number=SeqID_67812
KYCTPRQAQGDAPQATNAPPPPHQADPAGLLGMEHYLQHLVRQQAANHWGQVQIHECLYQLSLSQQGQSFTPFACPTPEQFRAEVAWPGDWPEAQAREAPTGAPGDVEEARMDEEMTYLLNFLGGSGAT

SEQ ID NO: 159498 - protein, 81 aa, Glycine max
  Coding DNA Sequence Number=SeqID_67813
MASRKRKNTTSRPQPNYDTSESERALDKVRCRHLQHISGDPSGIGAWGDHPHIFQILQTEDGSSRDSGSPLYSRQGICSKC

SEQ ID NO: 159499 - protein, 31 aa, Glycine max
  Coding DNA Sequence Number=SeqID_67814
MEEIHGEDDEKQGIKNGEGGKVIGVATSRRR

SEQ ID NO: 159500 - protein, 179 aa, Glycine max
  Coding DNA Sequence Number=SeqID_67815
  Homolog annotation: Hit_ID=Q2HSI4; Match level="QueryCoverage=79%, HitCoverage=74%, E-value=1e-06, Identity=30%"; Hit description =Putative uncharacterized protein
MVRTRGLGRALGHVTGRGVDRGDRDDSDDAPQRRWPTASARRQRVVVTTEHNEPVVPATEADIFSDEPMVGGDVEDTRADIPAHTGAQVTEDELEGFPGGLSDPSLLTQYADHVAGSVWMGEEHPELKLSSHGRKVHSLGRPVPAIEGLVAGTGLSPLIACSIDTGDRGLLSSFVERWH

SEQ ID NO: 159501 - protein, 36 aa, Glycine max
  Coding DNA Sequence Number=SeqID_67816
MQQAEWRRKKDDWRRHFKEKMSQEQAHHHKKPWIRA

SEQ ID NO: 159502 - protein, 90 aa, Glycine max
  Coding DNA Sequence Number=SeqID_67817
  Gene Ontology: Mol. function=aspartyl esterase activity; Cellular component=extracellular region; Biological process=cell wall organization and biogenesis
  Homolog annotation: Hit_ID=A7Q4Y5; Match level="QueryCoverage=97%, HitCoverage=21%, E-value=1e-19, Identity=49%"; Hit description =Chromosome undetermined scaffold_51, whole genome shotgun sequence
  Pfam annotation: Domain name=Pectinesterase; Domain location=1-74; Score=-262.5; E_value=0.1; Accession=PF01095.10; Description =Pectinesterase
MAVEDLVPVLSSFKTFLGRPWRERFCPQYFVLWRVQERSSWGSTRDRVKWGGYHAITSATEASKFTVENFIAGKSWLPATGIPFLLGLDD

SEQ ID NO: 159503 - protein, 67 aa, Glycine max
  Coding DNA Sequence Number=SeqID_67818
  Subcellular localization annotation: CTP_CleavageSite=25; ConfidenceScore=5.42e-01
MWYHSSGNSLSVSMPHSHLGKLGSRGKTVRKPHYKRNLKESWASSSKGNNTRKSSLPWIQTENANET

SEQ ID NO: 159504 - protein, 100 aa, Glycine max
  Coding DNA Sequence Number=SeqID_67819
MRNGKRSPYAIGIRVNFGAFLGGGFLVVSEPTPRWALLAGRGWAGAKACGGPLYVDAGAFGWAGAELGDSGVEVTAWASPSFLFAPAIPVLLLLEPAGEM

SEQ ID NO: 159505 - protein, 59 aa, Glycine max
  Coding DNA Sequence Number=SeqID_67820
MERYERPELKLSSHGRKMAKFGRPAPEIEGLVAASGLSPLITCSLDTGDRKQMSAFVER

SEQ ID NO: 159506 - protein, 74 aa, Glycine max
  Coding DNA Sequence Number=SeqID_67821
  Homolog annotation: Hit_ID=A5BKB8; Match level="QueryCoverage=82%, HitCoverage=17%, E-value=3e-25, Identity=93%"; Hit description =Putative uncharacterized protein
MGGGAWPFLVGGAICLVNSVNERDLSLLNSYVEIIAIVGLQRGIPSKRESSARVDYVPALCNQAYRYRRPRGGA

SEQ ID NO: 159507 - protein, 79 aa, Glycine max
  Coding DNA Sequence Number=SeqID_67822
PQERNSENNDEWGTKSLLKERKAELDHSKTEAKGEEDPKKDRVYGKKASNFKHILNHKNTNGQTNFNYNKVIQLHLEFI

SEQ ID NO: 159508 - protein, 135 aa, Glycine max
  Coding DNA Sequence Number=SeqID_67823
  Homolog annotation: Hit_ID=Q9LW49; Match level="QueryCoverage=91%, HitCoverage=48%, E-value=5e-07, Identity=35%"; Hit description =Ethylene-responsive transcription factor 4
MEEAVCAYDVVAREFRDPMAKTNFPLPSKNTSTSPPPLSHPQISRRKFLSFQVGIMIALFGIIYIDETLDLVDYKAKQFRHDIKISNGENARNCVAKMILKFHDDPTVNGFEIVVFLKLVWWAAGKRKGFERRRG

SEQ ID NO: 159509 - protein, 84 aa, Glycine max
  Coding DNA Sequence Number=SeqID_67824
MGEQWRQFKPDLTSKWALAAGKDNVDDIVCKKYGISKEKWAQFCQSRRDPSWEKLMTEKTKKKSEEGAQSGSTEVVIDPPSPIK

SEQ ID NO: 159510 - protein, 40 aa, Glycine max
  Coding DNA Sequence Number=SeqID_67825
MWSPMKEKACSPTKARACSPLKARTCSPLKARACSPLKAW

SEQ ID NO: 159511 - protein, 175 aa, Glycine max
  Coding DNA Sequence Number=SeqID_67826
  Homolog annotation: Hit_ID=Q2QVF2; Match level="QueryCoverage=38%, HitCoverage=7%, E-value=5e-07, Identity=39%"; Hit description =Transposon protein, putative, CACTA, En/Spm sub-class
  Subcellular localization annotation: CTP_CleavageSite=23; ConfidenceScore=5.68e-01
MATPPGSPPPPTPSPLPPPPPPEAALQSPSTLKRTRKATRLRSLATRPPGADKLVVHVDPAIRKADGPHRKQLRTYLGIVACDKVDMTYDNWKQVPAAQKDLIWEDIQTKFDIPEASDVRTKKKILQTMGERSRHFKYDLMSKWALAADKDNVDDTVCEKYNISKEKLAQFCQTH

SEQ ID NO: 159512 - protein, 163 aa, Glycine max
  Coding DNA Sequence Number=SeqID_67827
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=71%, E-value=1e-24, Identity=69%"; Hit description=LacZ protein
  Subcellular localization annotation: CTP_CleavageSite=37; ConfidenceScore=5.56e-01
MTMITPSSKLTLTKGNKSWYRAPPRGRRRWSWCAIVRSTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 159513 - protein, 66 aa, Glycine max
  Coding DNA Sequence Number=SeqID_67828
  Homolog annotation: Hit_ID=Q2AA33; Match level="QueryCoverage=84%, HitCoverage=20%, E-value=5e-07, Identity=50%"; Hit description =Retrotransposon gag protein
MSDPGRLLKKAKRWLYSFKGNSLKTWDEVVEKFLKKCFPKSKTTEGKAVISSFHQFPDESLSEASE

SEQ ID NO: 159514 - protein, 173 aa, Glycine max
  Coding DNA Sequence Number=SeqID_67829
MLTIIDQYKEKVNLAASHGLRLEDEHAKVSALEMEGEARERVIESLHGEAMKWMNRFALTLNGSQELPRLLARAKAMANVYPAPDEEVQEQMKADMEALKDQMTSMMEAMMSMRRMMEDNAAAVATTSAAVEANPTHPPGINQTSLPAPDVYGRSPYGVVTTYTFAGERGETH

SEQ ID NO: 159515 - protein, 87 aa, Glycine max
  Coding DNA Sequence Number=SeqID_67830
MQHKSIKQRGWRVSMLMQKPLTGDSTVLKIGDSAKVVIKQDMKGGEHKYGFNNNKREKTEKKKVVDDETNDKHELYEVLRMPSKTKY

SEQ ID NO: 159516 - protein, 155 aa, Glycine max
  Coding DNA Sequence Number=SeqID_67831
MLAKPADWLSEKHYKITINWESLIPFIQVLYTKVSRFHRLIVVVSPSTIPQPPFPRGYNSNVTCAYHGGVLGHSIEHCMTLKHKVQRTCAPQLISKSTQSKIAHSTRLVRVPPWIFFINGVLCFLKFNGSGMEKEERGLEMPLQGEDESSTSSPP

SEQ ID NO: 159517 - protein, 155 aa, Glycine max
  Coding DNA Sequence Number=SeqID_67832
MERKEKNENKEKNRRKERRIPDQGSERSEKGKKSNSRSMKDRGQKFFKPDCHSKSFSTGNIPPHMNKEEKTETPNFLSKNTTLEKILLVRDRGKNPVHHSVLPTLFRSPMNCVFFHASSTHEFGAMRSDCLVQFSILNLFSEPHELRFRSWILHP

SEQ ID NO: 159518 - protein, 312 aa, Glycine max
  Coding DNA Sequence Number=SeqID_67833
  Homolog annotation: Hit_ID=UPI00006A2D9E; Match level="QueryCoverage =45%, HitCoverage=85%, E-value=2e-12, Identity=18%"; Hit description =UPI00006A2D9E related cluster
IPILTFRGLHALSFRGQHACTFRGLHALAFRGLHVLAFRGLHVLTFRGLHALTFRGLHVLAFRGIHVLTFKGLHALAIRGLHALAFRGIHVLTFKGLHAFAFRGLHALAIRGLHILAFKGSHILDFRGLHALAFRGLCVLTFIPGPPPDLGGRPIVRAQLEEESIAELLCIPGQDFTRAVAKRRHHSAQRPQCRSPPAEVSVGLCRHDIGITPTRHPVDLEESNSALVFPALVTGLCQSYKMPVPPPRSCHRDIGIAPARHLVDPEKSNRVLWFPALITGLCHFYRVPVAPNKVIRPPTNQAFIKKYCAPRQ

SEQ ID NO: 159519 - protein, 143 aa, Glycine max
  Coding DNA Sequence Number=SeqID_67834
LAIPPTGEAEGSTVSPAGESGGAVASSDDASEMTIRGGDGGLLHTQEKMVDSPLEIVGQLALDQPAQVWPQVEQPHWVSHQWKLSFRPGYLLKKMLHSPRNKLCNIGTKVCELWTSCPTVTDGGAGVDDEGMSSVLALFLDAI

SEQ ID NO: 159520 - protein, 219 aa, Glycine max
  Coding DNA Sequence Number=SeqID_67835
  Homolog annotation: Hit_ID=A5C4I3; Match level="QueryCoverage=26%, HitCoverage=22%, E-value=5e-15, Identity=71%"; Hit description =Putative uncharacterized protein
MAARALGVPRHLRAPGVGLWAPHSARLETRTKESDMCASQRASKPVRRKEADWWDPPVAGRSQRKLWWRPAAILTIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 159521 - protein, 82 aa, Glycine max
  Coding DNA Sequence Number=SeqID_67836
MLFESGSALDWGNVTPSSVVLNVVIDEGDLSVTIDEGNLGVVNDEGDVLVLGAGLDLCVTIDEGDLSVLTNQDPIVVRTVTP

SEQ ID NO: 159522 - protein, 207 aa, Glycine max
  Coding DNA Sequence Number=SeqID_67837
MTSRLLVGSLTFDCRIMHYIIVRILMPRSSNLAQASEEDLILMWAFLTGCPIDWAHLIHYRMHKALRSSSPLPYLQLVTLFLRHFEIPLNYQPFVQVKCSFAIGAGAVTSFGYLKDMDGQWLKKDVQPPQDERTPSPPPQRDDSSALMNEVLLELCGLRTYVGERFDSLDGRIDAIDAHFAGMDTRITQLEDDMSFIRHCFDPPADS

SEQ ID NO: 159523 - protein, 57 aa, Glycine max
  Coding DNA Sequence Number=SeqID_67838
MKEIKIKVSDPTLDAFDIGNLILKDNVEDYFSTQEELENDGDGDDIGDDFIRELMDI

SEQ ID NO: 159524 - protein, 111 aa, Glycine max
  Coding DNA Sequence Number=SeqID_67839
KDEQCKEGLNDVFHWKVILTSPIGQTSSTTLAIVGLLLRLRRRVIVGGDNETVVVVRSECARQIINCYGEMGLGAMWVAVGEMDFAARCSGHCLRLLRWRRCRRVPHRTLV

SEQ ID NO: 159525 - protein, 87 aa, Glycine max
  Coding DNA Sequence Number=SeqID_67840
MRYFNILIYERILVNLLMIDLVARLKHKGHLYGTGDLAHSYKCGYDSFMQHVQGSCSRAQDSTKINRLREELCQSKEEICVFYSIVL

SEQ ID NO: 159526 - protein, 92 aa, Glycine max
  Coding DNA Sequence Number=SeqID_67841
MLNPTQFQAKEEKAKAADDSLSDTDPLSEMHPLSETSNSLSGWETLEENKIEICSPSAQLVRPARMLSLLVLSMPTLAKRKSTNSHLARHAC

SEQ ID NO: 159527 - protein, 89 aa, Glycine max
  Coding DNA Sequence Number=SeqID_67842
  Subcellular localization annotation: CTP_CleavageSite=62; ConfidenceScore=5.59e-01
MIRILDQHGWVARTTQKFLMLILSSLRTSGAIGSSGNMSTSTFGAGSTDSSCTAVTGTRYLYADAVGHRRCGASSESSRSPLPAPLPVT

SEQ ID NO: 159528 - protein, 135 aa, Glycine max
  Coding DNA Sequence Number=SeqID_67843
MTLGMPMLLMPTTESILAMLLSTLVIASIADTTMVATKTPVVITTSFIRQQIYLGIHDIMYQVSKQLADIVKPMSLMIRMMQINGVDPSILPVSSPLGQRGPIQASLITMGQPNMAPMPNILLEFVVLVPLSHIA

SEQ ID NO: 159529 - protein, 93 aa, Glycine max
  Coding DNA Sequence Number=SeqID_67844
MYVQLFKKKEKLSAEKQPSLVTSLEKSCGSNVFQGYFDDAKESRVKQSFKQRFKNQVSSFKIQDSRIKIQEKSRSRFKTQDSRIKRRLNQDKY

SEQ ID NO: 159530 - protein, 192 aa, Glycine max
  Coding DNA Sequence Number=SeqID_67845
MLQATLEDPRTSMTTLTQTWMTLLLSNVLPSDHNSDLPLPKCQLVYAILTRMSVHVAQVIADAIYLFAGMAPTRHPLDPANSNRALGFSTLITGLCQSYGVPVTPNKAANHLGQVQIHECLYRFSLSQQGQGSTLFVCPTPEQFGAEVAWPGDWPDAQVGEEPAGSPGEADESHMDEDMTDLLGFLGGSGAT

SEQ ID NO: 159531 - protein, 128 aa, Glycine max
  Coding DNA Sequence Number=SeqID_67846
MKNGRRTVKNGGKSSGNHSRKRLGRVTEAPRLEFSSRKHIFSPKTVEMHSIGVRDPFEKPPFPIYREKGVVLATLLAQASRVTGILRKHYGSPGSHFLTKGGGACRPSEQVASSTSNPACKMFWKTQI

SEQ ID NO: 159532 - protein, 154 aa, Glycine max
  Coding DNA Sequence Number=SeqID_67847
MNQEGEALRDSSECRPWGSPGLSAPLSLCRSHMVGAFSQNSVILTGLPMILLSESDLTYSLCGASCHVLLGARQGRGCHRGHIASQCPTKKTMIMRGQDIYSSQKETTSSPSSRGSEDEVRGEESSEEVYPHEKGDLLMVRRLLGGESCDLSQS

SEQ ID NO: 159533 - protein, 416 aa, Glycine max
  Coding DNA Sequence Number=SeqID_67848
  Gene Ontology: Mol. function=ATP binding; Cellular component =intrinsic to membrane; Biological process=defense response
  Homolog annotation: Hit_ID=Q850J3; Match level="QueryCoverage=26%, HitCoverage=50%, E-value=1e-32, Identity=65%"; Hit description=NBS -like putative resistance protein
  Pfam annotation: Domain name=LRR_3; Domain location=345-364; Score =17.1; E_value=0.065; Accession=PF07725.3; Description=Leucine Rich Repeat
  Pfam annotation: Domain name=NB-ARC; Domain location=91-303; Score= -109.2; E_value=0.0026; Accession=PF00931.13; Description=NB-ARC domain
  Pfam annotation: Domain name=TIR; Domain location=7-124; Score=6.3; E_ value=1.5e-05; Accession=PF01582.11; Description=TIR domain
  Pfam module annotation: Pfam domain module=LRR_3::NB-ARC::TIR; Domain location=345-364::91-303::7-124
MASKTTIHCCFRGEDTRNSFTGFLFQALSRKGTIDAFKDGKDLKKGESIAPELIQAIQGSRLFFIVVFSNNYAFSTIRKKLQYAEIEDLEKITNILGHKFSSLPNDDLVGMESCVKELAKLLRLGSVNDIQVVGMSGIGGIGKTTLGHARELIVLDNVDQVGLLKMFPRSRDTLLRECLGEGGRIIIISRDKHILMRHGVDDVYQVQALDHEHAVQLVCRNAFKSNYVMTDYKKLAYDILSHAQGHPLAMKIPRREYFWILLACLFYIYPVQYLMKVIDFRGFHPKYGLQVLIDRSLITIKYELIHMRDLLRDLGRLGNLSNELGYLTWNEYPFECLPPSFELDNPVRLLLPNSNIKQLWEGMKALNLEWLDLQGRIQLRQIDPSIGLLRKLIFVNFKDCKSLTKLPHYHIWPQFS

SEQ ID NO: 159534 - protein, 94 aa, Glycine max
  Coding DNA Sequence Number=SeqID_67849
MKMKANKTRNELKVSDSNSYQLKNEERTKNGRRMVKNGGKSSQICSRKRLGRITEALRLYSSSRKHGEEGNIVRVDVVSRTSEVIREDSGNQAG

SEQ ID NO: 159535 - protein, 123 aa, Glycine max
  Coding DNA Sequence Number=SeqID_67850
  Homolog annotation: Hit_ID=A5BFT3; Match level="QueryCoverage=52%, HitCoverage=4%, E-value=1e-07, Identity=42%"; Hit description =Putative uncharacterized protein
MIVLLIVSALIMKPGRSKIKHSCLHTKTQARQLRTAIRAVTLDGKTIEEYLQKIKGFVDELAGVGVQVRHEECIDTLLEGLPSNYASVVFVIESLTTRLVATISTLYYAIISIFIRRTPFICL

SEQ ID NO: 159536 - protein, 595 aa, Glycine max
  Coding DNA Sequence Number=SeqID_67851
  Homolog annotation: Hit_ID=A5AG09; Match level="QueryCoverage=46%, HitCoverage=32%, E-value=6e-19, Identity=25%"; Hit description =Putative uncharacterized protein
MGLAYSGRVVFIMRVETRLCIDNVSIYQKVGVQLGVEERTERSPYCVLMCLTLEGKLVMFHVASLARSKASPEVDSVLHNEDEGCTLPQGFYNNLQATTEKTRELWTSNGSRDSQRASNLLPGETFSFPKKFDVSSILASSYADGVDFQNKKCTMGATNDLGSIGGKPFLVQDVNDISPTINFSNRLVQIVKSSTQKFLPSNEQHGTPSTLGISNSDLSKQFGNINEMTKELDLVLKSIEEAGGFRDSCTRSLQSSIEAVEQDMNALSKKCKILTVEPIIRSHHLEGYIINPKIPHKYASIEDHNADKVTSEYSVKYEQDQFLLAWLQSTIFGGIVLQVRQVRNELCNLSFDNCSILDHLLHVQMLVNELTLIGETVSNSEHLDLILNGLPDEYESSDSLITSRFDPFTIDEVETLLLACEVCIERSCKKVLGSINLTQGLGFVNLNFGSSSLDNSVNPNSAYSCGGRNFGLSNCVGHGSSRSGGRGRFANSLMASAPTQTQTWYPDSGGSHHMTNMSQNKQQVTPFEWPNQITIGNVQGLNINSSGFVRSDGLYQFPQLLAFMPKCKLPSPVCNSVKTVVQSPFVNTVTSDSDF

SEQ ID NO: 159537 - protein, 41 aa, Glycine max
  Coding DNA Sequence Number=SeqID_67852
MEGQCTSPPTNIHNIQHMNVAQSKFQRPWKVTPTYPGRGRD

SEQ ID NO: 159538 - protein, 80 aa, Glycine max
  Coding DNA Sequence Number=SeqID_67853
MPRHPLVSRWIVHVALKLTSLIAVATYPSAGRRHEAHGCVFHGRKMRGVTTNVYLRKNIGKIEKVVDKGVSLAPTYPQLR

SEQ ID NO: 159539 - protein, 61 aa, Glycine max
  Coding DNA Sequence Number=SeqID_67854
MATEWRRKRERRRHFKEKMSLEEAHHHRRPWIRAWRKKEMNEVMVQPTNPRSIPRFSTKCA

SEQ ID NO: 159540 - protein, 61 aa, Glycine max
  Coding DNA Sequence Number=SeqID_67855
MNRHCSPLKPHTERNPSTEVKSSILPRGFGRERNPNLTFHSPSRRLHGTDERRRKRNLQVT

SEQ ID NO: 159541 - protein, 131 aa, Glycine max
  Coding DNA Sequence Number=SeqID_67856
MGDSGGSREAYGHGQECLFLGYSSSHKVTNSYLLLSFDNTEPVPQTSTSTISASVQLVNSESTTLASSSLESIYVPNSIPVNTHPIQTRSKSSICNPRLHRFLLILSLKLQNRLWQMQIGSLLCDKNMMPC

SEQ ID NO: 159542 - protein, 195 aa, Glycine max
  Coding DNA Sequence Number=SeqID_67857
  Gene Ontology: Mol. function=binding
  Homolog annotation: Hit_ID=Q8S912; Match level="QueryCoverage=43%, HitCoverage=4%, E-value=1e-34, Identity=87%"; Hit description =Microtubule bundling polypeptide TMBP200
MVQKGDFGAKIVPPKRILKMLLELFDHQDQNVRASSKGLTLELCRWIGKDSVKLILFETMRDTMKKELEAELVNVTGTAKPTRKIRWMSDFDGFEFSHPEYSIQGLGLLYTHCSMHTFVTENEVALIAARGEGTQVTMEHFEVAIDRIIGGLEKRNNGRAWCSRPKQTSQNTERERERESRFRKKMDAYYSATIH

SEQ ID NO: 159543 - protein, 207 aa, Glycine max
  Coding DNA Sequence Number=SeqID_67858
MAARLRPLVPMKQLRLEKEKVEPNKWTANWVSDPDDLPCRHTIVVIRYNNHILEDYSDDMLTIGSYNATYENYILPTKSQQYWEKTTFNRPTSPHNKKRPSRSKNVEEIIRMRNKMRLTTLNLLYKLNNLQLILKKTIFIPPPSSAAFRLPLVRPLAPIQIILSDVPSHRMNQPNYMSYTHTRDAPLPRFEEVKLGYACLLFIVDCD

SEQ ID NO: 159544 - protein, 225 aa, Glycine max
  Coding DNA Sequence Number=SeqID_67859
  Subcellular localization annotation: CTP_CleavageSite=61; ConfidenceScore=5.55e-01
MIANMAIFDWLSKSSQNAFSLPSLFFFSHPQNALSLRKDSQNPFSPRKDDTYFPTTTNVLSLLMEVHIFVFSIAPPDLVNVWTTQELCKAYHNYVKFASMYYLVPDSEKEVYVYLKHDRLEEGPINETGLETEVDVFQMLKRKLLELKLKLIMKMMDNQVTQVMIVTTLKNLSLFPTVMMKGDVSSIGACRPRIFFINGFLCFLEDEWQRNGKGREKGNATSRRR

SEQ ID NO: 159545 - protein, 73 aa, Glycine max
  Coding DNA Sequence Number=SeqID_67860
  Homolog annotation: Hit_ID=A5AYU6; Match level="QueryCoverage=65%, HitCoverage=9%, E-value=2e-10, Identity=57%"; Hit description =Putative uncharacterized protein
MTKNHESDEEESLKKKWYIDSGCSKHMTGDASKFTTISPKKSGHVTYGDNNREVIGYHLILKNVSLNMNMIRT

SEQ ID NO: 159546 - protein, 176 aa, Glycine max
  Coding DNA Sequence Number=SeqID_67861
  Homolog annotation: Hit_ID=Q96467; Match level="QueryCoverage=47%, HitCoverage=24%, E-value=5e-08, Identity=35%"; Hit description =Putative uncharacterized protein
MKKNKQATTKSLGESSSTNCPSTEKPFVEDNMVDRGGEGNRPPTRILGDYAYQQGPKHYNNIVIPPFSNKVVELKAALLSLIDSHPFAGMDHEDLYTHLSTFIELCSTMEAFDEDVEAVYLKAFPFSLAEIQSFVAEMATVQHLVIVNKKKMVIICRIKPDLNRTSKEATKAIKVA

SEQ ID NO: 159547 - protein, 177 aa, Glycine max
  Coding DNA Sequence Number=SeqID_67862
MVTKGWSFVGQQWWRKKKRMATHMKRKIWPFEMPKPCLGLRVVPLVPVPRISLRPSGPIFESRQYIYQNTQNETPSVVQRLVLLNFKLHAEFEDKEKILQTVRERWRQFKLDLTSKWALAHGKEGEDDKAKRRFLVGAGLTGKLCHPQTSGCNDCSHWATRAPGRVRVVGSSITIKN

SEQ ID NO: 159548 - protein, 225 aa, Glycine max
  Coding DNA Sequence Number=SeqID_67863
  Homolog annotation: Hit_ID=Q6UUU1; Match level="QueryCoverage=26%, HitCoverage=40%, E-value=2e-18, Identity=78%"; Hit description =Putative uncharacterized protein
ASGITGTQIYLFCEVISVTGIYSAQSASAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159549 - protein, 109 aa, Glycine max
  Coding DNA Sequence Number=SeqID_67864
MKAQVEMDEGPEAETLSRQLITYQGNPCGVYPDLSSFTGSGVYPDLSSFTGSGVYLDLSSFTGSGVIQKLYSLYQVIRRVRFTSSSIKASALDTSSILSYPIIFFVICP

SEQ ID NO: 159550 - protein, 64 aa, Glycine max
  Coding DNA Sequence Number=SeqID_67865
DIEATTIQEEPLSSEASSSFPKKGESHTVLIEANIMADEPRQVTLEDYSSTYVPQFFTSIVQPK

SEQ ID NO: 159551 - protein, 64 aa, Glycine max
  Coding DNA Sequence Number=SeqID_67866
MFMTPRLCISAILGKKTRFREEKSSRSVSITLSRHFREQICEDFPLFFVLQPQNLTDRSRRNLG

SEQ ID NO: 159552 - protein, 272 aa, Glycine max
  Coding DNA Sequence Number=SeqID_67867
IILDPKYLDIDFLNDEMFDCYQVFQNSGLVDFMSLKLPHYPELVKVFYCNLKIQDGIISSEVHGIPMIIDQSLFFSLTHLPSQGAPFEGTIVDDWQFDYSCHDARRMEDLILMWAFLTGHQIDWAHLVRYRMHKALWANAPLPYPQLITLFLRHFQIPLDDEPFVQVKRSFAIGAGAVTSFGYHKDRNGQWLKKDALPPQDEHTPSPPPQRDDSAFMNEVLIELRGLRSYVGESFDSLDTRFAGMDIRLTQLEEDIGYIRQSFNLPPPPPPS

SEQ ID NO: 159553 - protein, 175 aa, Glycine max
  Coding DNA Sequence Number=SeqID_67868
  Subcellular localization annotation: CTP_CleavageSite=52; ConfidenceScore=5.15e-01
MTIQNMQFQQETRASIQSLTNQMGQMATQLNQAQSQNSNKLSGNQIQVPPPVAAPAPEPVKLPSTLEKKDEIVAQKRRLSNKNFHRGCVAYPAVPIILGRPFMKTARTKIDVYAGTLSMEFGDIVVHFNILVGLGSSSPMDSFASWKMNGSGMEKEEREETPLQGEDESRRNSPP

SEQ ID NO: 159554 - protein, 128 aa, Glycine max
  Coding DNA Sequence Number=SeqID_67869
  Gene Ontology: Mol. function=cellulose synthase (UDP-forming) activity; Cellular component=membrane; Biological process=cellulose biosynthetic process
  Homolog annotation: Hit_ID=A7PBB7; Match level="QueryCoverage=98%, HitCoverage=12%, E-value=3e-57, Identity=75%"; Hit description =Chromosome chr16 scaffold_10, whole genome shotgun sequence
MAGAKGSSCAIPGCDSKVMSDERGADILPLKIGGGICLGCKEPYKNTELDEVAVDNGHPLPLPPPSGMSKMERRLSMMKSTKSALVRSQTGDFDHNRWLFETKGTYGYGNAIWPKEGGFGNEKEDDFL

SEQ ID NO: 159555 - protein, 210 aa, Glycine max
  Coding DNA Sequence Number=SeqID_67870
MGEAEEVQEKMKADMEAMKEQMATMMEAMMSMKKIMEANDAATSAVAKVNPMLPSGLKQMNHPTSNMVGKDLGSTDDPMMCKFKTSTPSRHMACLPNYTPPNVAYIPNGDVNNSTPIPIKSQQPQSDHAHVSRPMEETHEIPHHDLANFEPCLGYAAEGQVIGGIPLQNTLEGPQYHPQPQPSRSTTVKNPHNYGRNGKVGLSRGKAQGH

SEQ ID NO: 159556 - protein, 205 aa, Glycine max
  Coding DNA Sequence Number=SeqID_67871
MASNSQQFSARNDAIVIRGVHEVATNPFASSETKKLEGKLDALVNLVTQLAVHHRKDLCPSMQQPVAIEQPEAYAANIYNRPPQPQQQNQPQQSNYDLSSNRYNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATQLNQQQS

SEQ ID NO: 159557 - protein, 412 aa, Glycine max
  Coding DNA Sequence Number=SeqID_67872
  Homolog annotation: Hit_ID=Q6WAY6; Match level="QueryCoverage=91%, HitCoverage=64%, E-value=8e-45, Identity=32%"; Hit description =Putative uncharacterized protein
MGSSQMPSLKKRFYQVKVKSLGTTSLKELGQLMVQLQRQAFRKAYGKIWDLAMVEVSTEVVASLAQYYDQPMRCFTFGDFQLSPMVEEFEEILGCPLGGRKPYLFSGFYPSLARISKIVQILAQELDHRKQVENGVVGIPRKYLEAKARILASKGEWASFIDILALLIFGGVLFPNVDGLVDLAAIDTFLAYHNNKESLVVAMLADLYDTFDRRCEKSSTRICCTPALYVCLVSHLFLQEVRHACPLEGRRSCTEKGGANWDQLLANKEGASINWFPRWKEGRTGVLISCGGFPNVPLMGTRGCISYNPVLAIRQLGYPMRGAPLEDELTPIISRGFNKTNVETLQKVRKAWEMLQKKDKELRGSNNGPIGGYRKWLRAHVQGLDWLPSFRTAKKEEVEAPQGILLSDHQQL

SEQ ID NO: 159558 - protein, 64 aa, Glycine max
  Coding DNA Sequence Number=SeqID_67873
  Gene Ontology: Mol. function=sequence-specific DNA binding; Cellular component=intracellular; Biological process=regulation of transcription, DNA-dependent
  Homolog annotation: Hit_ID=Q7NA84; Match level="QueryCoverage=59%, HitCoverage=25%, E-value=2e-09, Identity=92%"; Hit description =Regulatory protein AsnC
MSAVYRHHFEKRARLSGRAQQTGSAGRSGGSLQVLINKIQTIDEIQSTETLISLQNPIMRTIKP

SEQ ID NO: 159559 - protein, 463 aa, Glycine max
  Coding DNA Sequence Number=SeqID_67874
  Gene Ontology: Mol. function=nucleoside-triphosphatase activity; Cellular component=cytoplasm; Biological process=proteolysis
  Homolog annotation: Hit_ID=A7MMV2; Match level="QueryCoverage=100%, HitCoverage=92%, E-value=0.0, Identity=73%"; Hit description =Putative uncharacterized protein
  Pfam annotation: Domain name=AAA; Domain location=41-241; Score= -40.2; E_value=0.069; Accession=PF00004.20; Description=ATPase family associated with various cellular activities (AAA)
  Pfam annotation: Domain name=AAA_3; Domain location=41-173; Score =4.5; E_value=0.00011; Accession=PF07726.2; Description=ATPase family associated with various
  Pfam annotation: Domain name=AAA_5; Domain location=41-179; Score =160.4; E_value=5e-45; Accession=PF07728.5; Description=ATPase family associated with various
  Pfam module annotation: Pfam domain module=AAA::AAA_3::AAA_5; Domain location=41-241::41-173::41-179
MAQPHLLAERISRLSNALEKGLYERHHAIRLCLLAALSGESVFLLGPPGIAKSLIARRLKYAFQHARAFEYLMTRFSTPEEVFGPLSIQALKDEGRYQRLTKGYLPDAEIVFLDEIWKAGPAILNTLLTAINERRFRNGDSEEPIPMRLLVTASNELPEADSGLEALYDRMLIRLWLDNVHEKQNFRSMLTHQQDENANPVAESLCISDEEYQQWQKGISQVSLPDHVFELIYQLRQQLENLPEAPYISDRRWKKAIHLLQASAFYSGRVAIAPLDLILLKDCLWHDVASMQLLDREIDALMTQHAWQQQAMLHTLQQIKARRLALQQQQSVEQALTLEKHSGMFSRKPHYELPASITDEQLTLMLQQPLTLHDMQVTHVVVARDALNQWLLKAGEIRGKLNGIGFGQTLDLLVDAHHCLTLRDVSLQSTRLTLPGAASSSDVPQEIIEEYDALEAQLREQRT

SEQ ID NO: 159560 - protein, 674 aa, Glycine max
  Coding DNA Sequence Number=SeqID_67875
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q6DB91; Match level="QueryCoverage=60%, HitCoverage=91%, E-value=1e-103, Identity=49%"; Hit description =Sensor protein
  Pfam annotation: Domain name=HAMP; Domain location=158-227; Score =26.3; E_value=0.00011; Accession=PF00672.16; Description=HAMP domain
  Pfam annotation: Domain name=HATPase_c; Domain location=342-460; Score=77.7; E_value=3.7e-20; Accession=PF02518.17; Description =Histidine kinase-, DNA gyrase B-, and HSP90-like ATPase
  Pfam annotation: Domain name=HisKA; Domain location=231-297; Score =53.8; E_value=6.1e-13; Accession=PF00512.16; Description=His Kinase A (phosphoacceptor) domain
  Pfam module annotation: Pfam domain module=HAMP::HATPase_c::HisKA; Domain location=158-227::342-460::231-297
MSLFLRLAIGFLLLIILCGASATFSAWQQTRDTVNELFDTQQMLFAKRLLALDASRLQAASLPKTKAILRHHRGDQDDDALAFAVFSADGKPLLNDGENGRDLPFTADRDGFHDGRLRGDDDRWRLLWLTSADKQWRVVVGQEWEYRDDMTRDLALSSLLPWLVAMPLMLLLLLALVWFELRPLKRLTASLQQRAPDDATPLTPQRLPLEVKPLVAALNGLFARMAQLVQRERRFTSDAAHELRSPLAALRVQSEVIQLAGDDEAMRNHALQQLDSGILRATRLVDQLLTLSRVEADDLRSEFQPVPLAPLLHQLVTEHQAQAAAQHTRLTLTADAEPVMNGHPLLLGLLLRNLLDNALRYTPSGSEIQLRLSARRLEIADNGPGVSAEQLARLGERFWRPPGQAQTGSGLGLSIVKNVAQLHGHPANLQRGAAAGAARHPQLVTRDASDFDLSTELDYPVRRNFKLIRRAQGVALQRKEQLAAQTQIPRAFADDQRLPFEAAAVENLLDVRRFAPAVACHHAPEGGRQLLNGHATHVVHIRRIFGTQRQQHHALVQHLVVLQVMQHGKGDDIERPRHVDRRARHAHRRRLLQRGDHRLQRIAMLMHTTQQAEALALPRGHHDKHHQRQRQRQPAAGEYFDQVGGEQRNVDAQHRDENQHHQIAIPVPVLNRHR

SEQ ID NO: 159561 - protein, 131 aa, Glycine max
  Coding DNA Sequence Number=SeqID_67876
MGENNDTSTTKEITKKIEQASQGSFVPHELQDVLTAAIGRLEHSGHVRAVGAGVSIKQYFGPAQRTSRISSSIAPEELEKLTQQIRDQLEESITEKGIALPPEPEVGPSAARVITKGSCVDPSTTDPNTDD

SEQ ID NO: 159562 - protein, 109 aa, Glycine max
  Coding DNA Sequence Number=SeqID_67877
MGLLQRIDVALVREFYANAYDLEDDTPKFCRVRGKVIRFDAKTLNHFLEIPVIIPEGEEYPTYSQYLHTYPDHQAIAAKWCTSGGQFILNANGAPWKLFRKDLTILAQT

SEQ ID NO: 159563 - protein, 62 aa, Glycine max
  Coding DNA Sequence Number=SeqID_67878
MEKSEKKNINEKKLKKAYITWDENDMESSEDSENEEINLCLMAKSYESDEEENKDMPPIRLD

SEQ ID NO: 159564 - protein, 59 aa, Glycine max
  Coding DNA Sequence Number=SeqID_67879
MEVEEPWLGLWLPLNYQVVFSIGCVGLLHDKRTLRSSRILGKMEVEEPWLGLWLPLNYQ

SEQ ID NO: 159565 - protein, 43 aa, Glycine max
  Coding DNA Sequence Number=SeqID_67880
MPIWGEKALEAARGETCALKPRFCLVLQEGFADKVDRGRTRIK

SEQ ID NO: 159566 - protein, 37 aa, Glycine max
  Coding DNA Sequence Number=SeqID_67881
MEDCTRGSCRNLPFGGRATRDSRDACSMKGIRAESPP

SEQ ID NO: 159567 - protein, 153 aa, Glycine max
  Coding DNA Sequence Number=SeqID_67882
MATTKALEQETKRARREEHGRDKFRGALWGSNSELKLRREERDQSRVDALILKDELKACSRSKRSLSQRLCETETNMLAIIIKYQEELSLATAHEHRVADEYGQVYAENEARGRVIDSLHQEATMWMDRFALTLNGSQELPQLLAKAKAMADT

SEQ ID NO: 159568 - protein, 138 aa, Glycine max
  Coding DNA Sequence Number=SeqID_67883
MMHAPDLNSQMQCGTYRIQYQGNSPKRVYMTPHLGNHAVFVEATQSCIVTPPLGDQLGATRSSLPGDTPPSTKYILPQFILFPVSYKFPTQETSDKVNAPPNGHTQHTMYKRGHHQGHPTRPMHPTTNILLDKWPQIS

SEQ ID NO: 159569 - protein, 168 aa, Glycine max
  Coding DNA Sequence Number=SeqID_67884
MPVPKQPPILEISNNLVKSYTSKDPQVMYPSPVNEYDLKEEDKEKVQQWEQCSQVHTQQENNLQVNTFPHQLIVKEERHEDHEVPIIMGQPCLSTASCVLDMGKAMKHPDDSEAYFEEEILEQEIELTASTMVLQTPLEKEFDDVTECLVSENGGEMLACIEELDDPD

SEQ ID NO: 159570 - protein, 237 aa, Glycine max
  Coding DNA Sequence Number=SeqID_67885
  Gene Ontology: Mol. function=structural constituent of ribosome; Cellular component=ribonucleoprotein complex; Biological process =translation
  Homolog annotation: Hit_ID=A7ZSC5; Match level="QueryCoverage=54%, HitCoverage=91%, E-value=5e-67, Identity=95%"; Hit description=50S ribosomal protein L13
  Pfam annotation: Domain name=Ribosomal_L13; Domain location=110-237; Score=291.9; E_value=1.2e-84; Accession=PF00572.9; Description =Ribosomal protein L13
AQPARLHRAVAPLPQRAAVRCAGDDLQNRRPGAAVPRAGHAAEIRISALSVAPAGDAERGVSSPAAPALRGKQKSPLRAQKESIFRFDFSIILRPHVTAQAFFSRKTRDWYVVDATGKTLGRLATELARRLRGKHKAEYTPHVDTGDYIIVLNADKVAVTGNKRNDKIYYHHTGHIGGIKQATFAEMIERRPERVIEIAVKGMLPKGPLGRAMYRKLKVYACNEHNHAAQQPQVLDI

SEQ ID NO: 159571 - protein, 57 aa, Glycine max
  Coding DNA Sequence Number=SeqID_67886
MVDQQTTKSKDKDVKEVLLGGNLELATKQLPAKWFKKGTIEEDSSVAPQADTGFDKH

SEQ ID NO: 159572 - protein, 136 aa, Glycine max
  Coding DNA Sequence Number=SeqID_67887
MAKIQGPKEGKTYSNIYKVEWTQPWPMGSEIYPEVNMFNMNTSNKKTILGCQFESLTRKAMTCLVTRVAPWHCNLPSATLPCYNMVVQVLFFLKLLLAGSLPIIIYGHTLHRINIRESQARSISFITLESATVQEK

SEQ ID NO: 159573 - protein, 140 aa, Glycine max
  Coding DNA Sequence Number=SeqID_67888
  Gene Ontology: Mol. function=helicase activity
  Homolog annotation: Hit_ID=Q2A9I1; Match level="QueryCoverage=72%, HitCoverage=7%, E-value=1e-15, Identity=37%"; Hit description =Putative uncharacterized protein
MGFLQDDREYVEAIKEAKDKGTTDYLRKLFVLILLTGAMSKPEEVWNQCWHWLADDIAYQYTKSTINSEVQINDDTLRNLTFIEIEQLLHINQRSLKDYPTMHILRISISHPTYKTTWYYQNSTITMMQQDQNLSIFLHP

SEQ ID NO: 159574 - protein, 37 aa, Glycine max
  Coding DNA Sequence Number=SeqID_67889
INETLGLIRILVVDLKRANKAALSGTERSTGLFHLKG

SEQ ID NO: 159575 - protein, 86 aa, Glycine max
  Coding DNA Sequence Number=SeqID_67890
  Homolog annotation: Hit_ID=Q6F1U9; Match level="QueryCoverage=94%, HitCoverage=74%, E-value=3e-07, Identity=42%"; Hit description =Putative uncharacterized protein
MGESLTEQCRVKVEGLRVMNFFSRRRSNDAAAVRQRMQALSGMIGRKASVGGFLSSPSNPRAQPWTGGGTTKLEYGRGRGNFTGIL

SEQ ID NO: 159576 - protein, 365 aa, Glycine max
  Coding DNA Sequence Number=SeqID_67891
FDRADALAEAQRAGAAQRGGAQRGGCIQRGGVVGHGLGQDRRRAVLAEHVQVVVAGAAVGADRQVHAGALQGAGRAETGGQLQVRFRAVHHADATFGAQVDFRVGQLGHVHRDQAVVDQAESIQPRQRTLAVQLDRIGDFLRGLVGVQVHLHVELVGQHPHPLEVGIVDGVRRMRRERGADQRIGAPLVMQFTGLGEVLVVGLGPGGGEIDDDRANQRAETVLLVDRGLHIAEEIVLVGAGGATAQHLGDGQGGAVGNEFGADYRGFHRPDVLLQPGHQRQVVGDAAQQGHRVVRVRVDQARHQCGLGAADHLGGAETRARLGTRQDRDDLAATHGHGMVFQHHRMRLDRNDVTGFDEQVAGFGE

SEQ ID NO: 159577 - protein, 127 aa, Glycine max
  Coding DNA Sequence Number=SeqID_67892
  Subcellular localization annotation: CTP_CleavageSite=37; ConfidenceScore=5.08e-01
MGERMNGKGGSSSSSSSPSVNHPGRRFWKCPHWNESSSSKKFEWIGDIETGKNVFVKGSELVRFLVVVFLSLVGCPTMLGIDAILPRKGPITKAMTRRLQKDWARDTGEGPRVLMSLRVDVGPMDYV

SEQ ID NO: 159578 - protein, 235 aa, Glycine max
  Coding DNA Sequence Number=SeqID_67893
  Homolog annotation: Hit_ID=Q2HTA0; Match level="QueryCoverage=90%, HitCoverage=34%, E-value=4e-17, Identity=31%"; Hit description=IMP dehydrogenase/GMP reductase, related
MYDQLDEACRTTIRQLAGYLTLLQAHMKGITGAPYRARCDGLTITDVSWLPYTEHWGVRAFQEISSFQGQLRWGPMVVTARPEMVVRKFGYIQTIPPPPVSARLSHDEIDGRWMQFAEHLLPAGQLCLVLGQVSADYMEWFFRISHPFMIPTQAGDQPRDAPVADLEDYIQPPSPQDDYDGYEAIAQRLERVLNLRIVTAGTELYDIMQDCLTIARGGPSADGTVKARQRHRTDH

SEQ ID NO: 159579 - protein, 79 aa, Glycine max
  Coding DNA Sequence Number=SeqID_67894
MRVSERLTGEKGEFYLQLVRKRERKGLSEKQGREKERENNTKLLEFLNVERDIMVISEKKGCFDDDVVGVLRCRVNDPF

SEQ ID NO: 159580 - protein, 164 aa, Glycine max
  Coding DNA Sequence Number=SeqID_67895
  Homolog annotation: Hit_ID=A5B0H6; Match level="QueryCoverage=67%, HitCoverage=7%, E-value=6e-09, Identity=30%"; Hit description =Putative uncharacterized protein
SQFNLERNYSDHCPIVMHSKCIDWGPKPFKVYDGWLMHKQFQKVVRDCWLDYQPMGKVKQLQQKLNDLENSMPVQPSEQQVKDLKKTQADLWEKATMQESIVRQKSRCRWIKDADALYIFLNFKGVLWVRPTTMWVSTERFLVDFRREEKENSDFKQEDDKEKR

SEQ ID NO: 159581 - protein, 199 aa, Glycine max
  Coding DNA Sequence Number=SeqID_67896
MEKITILSEEQERITEPVAHGPASERRFPPQEFHMLQSSVETRGFGRHRQAVEAEEFSQQMEERGHGMYYTPPTFSQYPSQMYQYPFEGHDTDMSASEHSFGGVAKTHPHFSWSTMTPSQQHDAPMPTPNAPLAPQWNVPKAIPDMGDLLGVDLRHEFFAEAEQVEAGRHRGKRNPDRQAQRWDRSCGTSSHHHGHHNE

SEQ ID NO: 159582 - protein, 239 aa, Glycine max
  Coding DNA Sequence Number=SeqID_67897
  Pfam annotation: Domain name=Transposase_23; Domain location=44-115; Score=-7.5; E_value=0.0078; Accession=PF03017.5; Description =TNP1ENSPM transposase
MSQKNTPQISAHIEPDMHVLGARVSTKGSNAEVAVNPYGPDHVANVIPRIGLYVQCEDATELVGLGKIYEGGPTIHNVTYADDVVRVSVDKVINGDAKVLWPSLEIKYVKQALGTFIAWPRSLVKVVSNEISEISPNKVTDAVKLVINVVVEDPLRELIRTLVDIYEKPVQLVWDVTKFGISDVIASLFVTCVDVNEIISGVQCLNIAILQLWTMHMDEWSNNLGQGSVYGFKIGVWIP

SEQ ID NO: 159583 - protein, 98 aa, Glycine max
  Coding DNA Sequence Number=SeqID_67898
MVKKCSYLHLNYYHGDNDGDEDYVVIGFEGLRSGVRVSFLRSNNEREVKREWCGCGTHVVAVAVKMRSDVGATIRFRGRKVKERLKENETTMEESSNL

SEQ ID NO: 159584 - protein, 193 aa, Glycine max
  Coding DNA Sequence Number=SeqID_67899
MPSSFIDLVFAGERIDAGPRKEKFSYVASMNPGNREPDRSGERKKEGELHVVAEVPAWPNFPLPPYNPMYQYPPQQYHHSANISPAHYPPPYQPRTPNQPQRPPVNWPQNPPVAQPRLNTTPNTNQNTNQRRNFPKKKSIEFTLILISYADLLLYLLNNAMVATSPTNSTSISSRIQLECDMLLSWRSLEAFH

SEQ ID NO: 159585 - protein, 92 aa, Glycine max
  Coding DNA Sequence Number=SeqID_67900
MVKRRKLNIIQNEGKKRTIGCTHMLDVWDLPNGEFILVEVDHWGNPMGWEGKTLLNAIGSLVRRHQCAPINFLSWKDMPEDYITNMVELIQV

SEQ ID NO: 159586 - protein, 188 aa, Glycine max
  Coding DNA Sequence Number=SeqID_67901
LKFNDDAYVSIVFESKPSKTVLTINFKDGAYVNTVLEGWRFSKMVAFDPSLKGLAFDNVGFYDGQRPSLALLGMRSFRVDWIPVVLNIEAFGEKDRLETTEGETPKIVLSERSWMVMGHYLAIQRWHPGFNPQRMNLRKSQFGLGLDYNTLHRIEYGRGNEFMTERTHFARLCIAVDLTKTVVLAFEI

SEQ ID NO: 159587 - protein, 204 aa, Glycine max
  Coding DNA Sequence Number=SeqID_67902
  Gene Ontology: Mol. function=ATPase activity; Cellular component =chromosome; Biological process=chromosome organization and biogenesis
  Homolog annotation: Hit_ID=A7Q542; Match level="QueryCoverage=63%, HitCoverage=10%, E-value=6e-34, Identity=58%"; Hit description =Chromosome undetermined scaffold_51, whole genome shotgun sequence
MKSLSEKVDALSQNLVRETSILNNKEDTLRSEEANKANLVKNIEELKHFVKEKSSAVKTAEEGATDLKKKVDELTKSLEEHDKEYQCVLAGKSSGNEEKCLEDQLRDAKVAVPRVHSLLTKFYILFLKCNGIFSSNQGAPRWIKPKTNVQSGGFECGYYVMHWMWCIVTTGLKDDWHKINIMHGVTIWFSDGSSLDVEAITTVR

SEQ ID NO: 159588 - protein, 97 aa, Glycine max
  Coding DNA Sequence Number=SeqID_67903
MAGIDTQALGACKLCATGKTQVTPQLHEDRRTTSFHGRYENDHRICPDVTVTSIVNNHSSRGLDGLVNNHTNYTGQIIKSSNYMAVDIDNDDDAILA

SEQ ID NO: 159589 - protein, 140 aa, Glycine max
  Coding DNA Sequence Number=SeqID_67904
  Subcellular localization annotation: CTP_CleavageSite=38; ConfidenceScore=5.35e-01
MSVSIFHETLFLFPPSVFVSAPPALLVPSFIPPVNNCEASRHVVVLLCRRVIGRALGKTFNRDADEVPQQRRPTTSARRQQEAAPVAEDIQHMDHADDKVHEYPKEAVVDDVVTDAEGFPSGPHDTLVLMDYVYHVTTKV

SEQ ID NO: 159590 - protein, 115 aa, Glycine max
  Coding DNA Sequence Number=SeqID_67905
VADSDDEGSIDLRTNPLQEGGDDEILPRREPITRVMARRLQEDWARDVGEGPRVLMSLWGGEHLLVIPHCHIDVSSIGACRPMIFFINGFLCFLDDEWQWNGEGRERGDATSRRR

SEQ ID NO: 159591 - protein, 199 aa, Glycine max
  Coding DNA Sequence Number=SeqID_67906
MVSRYFVEFERVNYVGIDNSRYGCRRRTAHDLPCACELVRYVLGSIPLETIPMFWRRLSFSDQGLFDLEVSRTEEIEAISKRFEELDVKTEGVQKKQMTKQQRSMKCDPSYLEYVDALHSVQNGNSLMKCWASSSEQPKPKRKMPMLDQFHPYIHDFIENIVDVKGDAPCGAYRPWIFFINEVLFFLKINDNGMEKEER

SEQ ID NO: 159592 - protein, 144 aa, Glycine max
  Coding DNA Sequence Number=SeqID_67907
  Homolog annotation: Hit_ID=A5AWV0; Match level="QueryCoverage=59%, HitCoverage=5%, E-value=5e-07, Identity=38%"; Hit description =Putative uncharacterized protein
MHLTETSMRAGNSDVYGFLEPQSIQISGQLQFESKSYIKSWMQSSKRSVYLGAYLNGPDNYLKGIINSALKGLDDTPQPKSKAVVRWIVVKCNRQKGSTECGYYVMHWMSTIISGTLRNNWRTTIGSRGIQGVSHPVNTVLSKS

SEQ ID NO: 159593 - protein, 312 aa, Glycine max
  Coding DNA Sequence Number=SeqID_67908
  Gene Ontology: Mol. function=phosphoprotein phosphatase activity; Biological process=intracellular signaling cascade
  Homolog annotation: Hit_ID=A5AU60; Match level="QueryCoverage=62%, HitCoverage=20%, E-value=1e-21, Identity=31%"; Hit description =Putative uncharacterized protein
MASSSSCSSNIQTRSGPTDSEVLWMQPKHVAEHVWNEEPDRKLHIRLVVPTYQGVRPQEGELEGNVVKLSWLAQHFSNLNNHDGNVKQLQRFTRACILRFIGGVLFVNKSSSRVSLSASLMHGDLSCLRIYIERCAAPPITKLNQLEFVWEPYTITVMAALPPICVVGSVAWFVVVPLICFHVVEWHQTDRVLRQFGMQQPIPECPSQPQNLHGITLKGKQDENWFQLLAPMIIQWNNRAEFRVDVYPRQEGLLSFNSDYMGEVMEDLQYMVSPQGRNTWTVDDLVPYVEKLTILSEEQERIIEPVSHGPTS

SEQ ID NO: 159594 - protein, 100 aa, Glycine max
  Coding DNA Sequence Number=SeqID_67909
MSLLEPLHYTNTSREFGTQSRTMMHSFPWEYDANKEVANATRRLLGLCSRGLRIIGNVKVRDLGVMTMFAFTGSREEVYWTMHMGEGSETGNANSLSSLA

SEQ ID NO: 159595 - protein, 98 aa, Glycine max
  Coding DNA Sequence Number=SeqID_67910
  Subcellular localization annotation: CTP_CleavageSite=24; ConfidenceScore=5.09e-01
MFAHSIKGCRPLGRACGVLIPSPCVNTTPEPFHLKVRRSRLFRFFRRFPQINVGDDSARIPFVGHASRESRVALPPKDLSSEGDAMRRKEGEMREEME

SEQ ID NO: 159596 - protein, 146 aa, Glycine max
  Coding DNA Sequence Number=SeqID_67911
MEPIVSWESVDAKAHVVPAMPERQHGMYYTLDQFTQEPSQMSPLYPYPYQSETSSDAYFMGTQPPLQPRYVMVDLFGSPSPAGTPSFAHGCQISMPNAPMGPPGIVSGNIPNITDLLGVDLGNQFSIEADEWRGDRRRNPDRQARR

SEQ ID NO: 159597 - protein, 124 aa, Glycine max
  Coding DNA Sequence Number=SeqID_67912
MGERGGLGFWTSLKHGVGRMNCWDGRGKGARKKRGERGGMVWRKESDDDDAGKNIFVEVTDSHKSQCLLQMSLKGDGMYVAIVQITLCCMLLSNNKTLPHVFKCSRNTIFSLFFSQIPGSPTTE

SEQ ID NO: 159598 - protein, 41 aa, Glycine max
  Coding DNA Sequence Number=SeqID_67913
MKTVQSLLRLSDVWEFYRSSRRNNWRNLMEPLEMPLSLSED

SEQ ID NO: 159599 - protein, 250 aa, Glycine max
  Coding DNA Sequence Number=SeqID_67914
  Gene Ontology: Mol. function=helicase activity; Biological process =viral genome replication
  Homolog annotation: Hit_ID=A2Q378; Match level="QueryCoverage=52%, HitCoverage=8%, E-value=5e-27, Identity=42%"; Hit description =Putative uncharacterized protein
  Pfam annotation: Domain name=DUF889; Domain location=1-175; Score =49.4; E_value=7.8e-15; Accession=PF05970.5; Description=Eukaryotic protein of unknown function (DUF889)
MHLQTNPASHTNHHDLKQFSDWLLDIGDGKLGEPNDEYDKITIPDEFLIKDFNDPIQSIVEATYPDLLQNYSNGDFLQKKIVLASTKDVVDSINDYVLALIPTEEKEYCSVDKSDELLNPAFGILTPEFLNSLKTSGIPNHKLKIKSLGNWVSRNWKSCGTKKPRSYSSPEPQNHNLNLNFIQHGVRLCKEEVIVVMQKLGMSVERDGDGIEDFGEQEITQMSENEVISVEEVKEAFNVFDENKDGFIDA

SEQ ID NO: 159600 - protein, 87 aa, Glycine max
  Coding DNA Sequence Number=SeqID_67915
MSEIKEVQEQMKADMEAMKDQMAAMMETTLSMKKIMESSAAAVATTSATTEVDPTHPLGLNQVNPPISDMVGQGGEALGSTDGPHVV

SEQ ID NO: 159601 - protein, 140 aa, Glycine max
  Coding DNA Sequence Number=SeqID_67916
MEREMITMIVDTLLVFYYEKMVGYTPSSFANLVFADERIEVGLRRGKFDYPALMNRKLGANGESKKQEGTHVVTVIPSWPNFPPTQQYQYSANISLSHYPPPYQPRTLNHPQRSPLNQPQNSPAAHPIPDATLNTNQNTN

SEQ ID NO: 159602 - protein, 225 aa, Glycine max
  Coding DNA Sequence Number=SeqID_67917
MGTKEELKGVVIRVRKECNRLRDVNMSITKASKQEMRRAKGEETNRTRYQGALSCNSNEVKLRRRTQRDQAIVENVTLRDELKDCKDDEGEARFGYYTWAGFEKQAGGSASLTGMNRFALTLNESQELSKLLARAKAIADIYSDPNEVHSLFDYYQHMKDSALQHPYRMRAKTKIMSEIEQVQEKMKADMETMKEKMTAMMEAMIDMMQIMEVNIVAAATASTTT

SEQ ID NO: 159603 - protein, 89 aa, Glycine max
  Coding DNA Sequence Number=SeqID_67918
MPLMPEIFVTSIVGMLDPTRMTDTSYPPLNTCMLYLCRNMPFCGRAKVRLTGALSKGGKMRGVATNVYLWKTSEKPKETGQNENSKFGS

SEQ ID NO: 159604 - protein, 176 aa, Glycine max
  Coding DNA Sequence Number=SeqID_67919
  Gene Ontology: Mol. function=endonuclease activity
  Homolog annotation: Hit_ID=Q9AY32; Match level="QueryCoverage=31%, HitCoverage=84%, E-value=1e-22, Identity=94%"; Hit description=RRNA intron-encoded homing endonuclease
LDLENGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGRAPPGIIAIVGLQRGIPSKRESSARVDYVPALCTHRPSLLPIEWSGEVFGLRRRERFAARDV

SEQ ID NO: 159605 - protein, 233 aa, Glycine max
  Coding DNA Sequence Number=SeqID_67920
SRGLHVLAFRGLHVLSIRGLRALTFRGLHVLAIGGLHALTFRGLRVLTFRGLHALAFRGLHALVFKGLHALAFKGRQVLYFRGLHALAFRGLCVLTFRITTTRYPVDPGKSNRALGFPALVRASVSPTGCPSPPARSCHRDIGIAPARHLVDPEKSNRVLGFPALITGLCKFYRVSVAPSKIIRPPTNRAFIKKYYTPQASTGRDTTAARGWQAAGNRCIAATSRAPQRIHKK

SEQ ID NO: 159606 - protein, 166 aa, Glycine max
  Coding DNA Sequence Number=SeqID_67921
MKRVRKKGEIHVATAIPTWPNFPPAQQCHYLANNKPSPYPPPSYPQRPSLNQPQSPPTTRPMLNTTFSTNRSTNQKGILQQKACRIHPKFRCHMLNLLSYLLDNSMVAITPARFPQPPFFRKNDSNATCACHGEAPGRSTEHCRALKHKVQGLIDAGWLKFEENRV

SEQ ID NO: 159607 - protein, 295 aa, Glycine max
  Coding DNA Sequence Number=SeqID_67922
  Homolog annotation: Hit_ID=A5C1A4; Match level="QueryCoverage=87%, HitCoverage=52%, E-value=1e-13, Identity=23%"; Hit description =Putative uncharacterized protein
PFEHPEHSVIGDFEHYSFKHSDFEYSENMAHPPPRERTLRELVAPDFTYESLCIQYSDEDVPYVLKTGLIHLLPKFHGLAGEDPHKHLKEFHIVCSTMKPPDVQEDHIFLKAFPHSLEGVTKECLYYLAPSGGAHGDMTPAEARNLIEKMASNSQQFSARSDAIIIRGVHEVATNSSGETKKLEGKLDALVNLVTQLAMNQKSAPVARLCGLCSSADHYTDLCPSEAIEQPEAYAANIYNRPPQPQQQNQPQQNNYDLSSNRYNLGWRNHPNLRWSNPSQQQQQQQPYFQNATGP

SEQ ID NO: 159608 - protein, 126 aa, Glycine max
  Coding DNA Sequence Number=SeqID_67923
  Homolog annotation: Hit_ID=A7PD81; Match level="QueryCoverage=56%, HitCoverage=29%, E-value=1e-12, Identity=56%"; Hit description =Chromosome chr17 scaffold_12, whole genome shotgun sequence
MEEEKGVPNYDELTCKGERAAWFKLGLRFSSSAAKDDVPKPSSSFLSKFVKASSESKKQAQLQSIHDNLKKSLLSSLGAYKTLETKSEGKFGHSTPRWIEVKSHVQSGTYECGYYVMHWMWNIIVG

SEQ ID NO: 159609 - protein, 36 aa, Glycine max
  Coding DNA Sequence Number=SeqID_67924
GVMDGQNDHVIVDALQALAQAIGNPNRGEVSGVVEY

SEQ ID NO: 159610 - protein, 193 aa, Glycine max
  Coding DNA Sequence Number=SeqID_67925
EVSRLILLHLLRRFKHRANISPTGLLDNHGKCCRKLRVDSASGRCLRCNCLQPDGPDFPGNLAADFQEKRCRVSRVRRRCLAQIGHTFEAAVIHRARVPALRAGEAFGREPVAKVFAGDDEIAGERRSGAIALEFQQVRWQINGSRGKLLPFDGFCPGRWYGGKRSGRQIEIGISRFGANYRTIGGPANINCE

SEQ ID NO: 159611 - protein, 138 aa, Glycine max
  Coding DNA Sequence Number=SeqID_67926
  Gene Ontology: Mol. function=nucleotide binding; Cellular component =cytoplasm; Biological process=mitotic chromosome condensation
  Homolog annotation: Hit_ID=A8AIF5; Match level="QueryCoverage=100%, HitCoverage=9%, E-value=5e-66, Identity=92%"; Hit description =Chromosome partition protein mukB
MEVDVNRGSDGWLRAESGALSTGEAIGTGMSILVMVVQSWEDEARRLRGKDISPCRLLFLDEAARLDARSIATLFELCERLDMQLIIAAPENISPEKGTTYKLVRKVFQNSEHVHVVGLRGFAPQPPESLPGTTADAS

SEQ ID NO: 159612 - protein, 45 aa, Glycine max
  Coding DNA Sequence Number=SeqID_67927
MARADPGRIYLAKATLGLERNPKEFCMGDQYQKTNTLWLEGGSKG

SEQ ID NO: 159613 - protein, 117 aa, Glycine max
  Coding DNA Sequence Number=SeqID_67928
  Homolog annotation: Hit_ID=Q5QJQ3; Match level="QueryCoverage=64%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDFRGS

SEQ ID NO: 159614 - protein, 81 aa, Glycine max
  Coding DNA Sequence Number=SeqID_67929
STYTSDLLYEVQAEEPSSSPTLVPPTVQPPPTPELKPLLATLKYAYLEDKEKFPVITSASLATEQEEKLLLVLKKHKKAIG

SEQ ID NO: 159615 - protein, 302 aa, Glycine max
  Coding DNA Sequence Number=SeqID_67930
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRFTLSMSNEYPLLVEYKVNEIGFIRYYLAPKMNEADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159616 - protein, 551 aa, Glycine max
  Coding DNA Sequence Number=SeqID_67931
  Gene Ontology: Mol. function=transferase activity; Cellular component= Golgi apparatus; Biological process=response to stress
  Homolog annotation: Hit_ID=P42620; Match level="QueryCoverage=58%, HitCoverage=98%, E-value=1e-163, Identity=82%"; Hit description =Uncharacterized protein yqjG
  Pfam annotation: Domain name=DoxX; Domain location=1-73; Score=69.0; E_value=1.6e-17; Accession=PF07681.3; Description=DoxX
  Pfam annotation: Domain name=GST_C; Domain location=299-394; Score =15.9; E_value=0.0022; Accession=PF00043.16; Description=Glutathione S-transferase, C-terminal domain
  Pfam module annotation: Pfam domain module=DoxX::GST_C; Domain location=1-73::299-394
MTILFITAGWGKITAYAGTAQYMQAMGVPGFLLPLVILLELGGGLAILFGFLTRFTALFTAGFTLLTAFLFHSNFAEGVNQLMFMKNLSIAGGFLVLGLVGPGAYSIDRLIRLMGQLIDGVWHDTWYDTKSTGGRFKRTEAVWRNWITADGSAGPTGKAGFAAERDRYHLYVSLACPWAHRTLLMRQLKGLEEMISVSVVHPLMLENGWTFDDDFPAATGDSLYQNEFLYQLYLHADPQYSGRVTVPVLWDKKQHTIVSNESADIIRMFNSAFDAQGARAGDYYPPELRDKIDELNGWIYDTVNNGVYKSGFATSQSAYDEAVTALFHSLARLEQILGQHRYLTGDRLTEADLRLWTTLVRFDPVYVTHFKCDRHRISDYRNLNGFLRDIYQMPGIADTVNLPHIRHHYYCSHKTINPNGVISLGPAFDWDEPHGRGKFNQHHPGQQQCHAQPAAGVQALPEQNPACRYGSHQTETAPQGVGHREIDPLHCLRQGAKCRQDSHQRYHAIQRTTEAVGVFQRDVRHNFQHDGQRQPGQMHDVKRGHDAAPYG

SEQ ID NO: 159617 - protein, 140 aa, Glycine max
  Coding DNA Sequence Number=SeqID_67932
  Homolog annotation: Hit_ID=A1AG32; Match level="QueryCoverage=62%, HitCoverage=65%, E-value=1e-35, Identity=68%"; Hit description =Putative uncharacterized protein
MGVLCGFIWLRAVFCPHPNPLPRGEGIVKCVVGGRILNSSHAQSVPSPACGRSHSSRPAIAHWLKQPTRVQYGPYHVNPYLALLRVEFTVPRTVASRAACAPQALPGTLPYGARTFLPSARLPRKGRRQSGDCLVSFGAG

SEQ ID NO: 159618 - protein, 168 aa, Glycine max
  Coding DNA Sequence Number=SeqID_67933
  Homolog annotation: Hit_ID=A4WET7; Match level="QueryCoverage=23%, HitCoverage=17%, E-value=5e-07, Identity=65%"; Hit description=Pirin domain protein domain protein
MMTTRCASACGQADFADGLRLAARAKSGSAGARCGISAAHLSAGGCAQPGVAGDAAVGPPGRQLQRTQYQQGSPTDAHAAVAGRLSGTGKSAAAKTRAAAANPCADCVTGWRGRQFAAAPAGVGTSGHTGTRRAEQLRCGDGAFVSEEAQITLQAETPLRALVIDIPV

SEQ ID NO: 159619 - protein, 45 aa, Glycine max
  Coding DNA Sequence Number=SeqID_67934
MIKSRLVLRKLEMQMLLFMYPLKRDPCDQQNLQIGRIMMLMIPYI

SEQ ID NO: 159620 - protein, 79 aa, Glycine max
  Coding DNA Sequence Number=SeqID_67935
MYKNFFASTQKNSSPFLTCFYCAPCGVCRPWIFFINGVLCFLKIMAAEWRRKKDDWRCHFKEKMSQEEAHHHRKPWLRA

SEQ ID NO: 159621 - protein, 107 aa, Glycine max
  Coding DNA Sequence Number=SeqID_67936
  Gene Ontology: Mol. function=structural constituent of ribosome; Cellular component=intracellular; Biological process=translation
  Homolog annotation: Hit_ID=Q32703; Match level="QueryCoverage=35%, HitCoverage=90%, E-value=3e-11, Identity=84%"; Hit description =Putative uncharacterized protein
MVRYSGVLGVEEPHQSIPNLVVKLYCGDDTVGEAGERKCSHFLGYSGEQISSGDDGVGPVAQRIRARGYEPRCRGFESLLAHNRPKKGRIFPSGGRKIMIGLADPKL

SEQ ID NO: 159622 - protein, 368 aa, Glycine max
  Coding DNA Sequence Number=SeqID_67937
  Homolog annotation: Hit_ID=A7UQU7; Match level="QueryCoverage=80%, HitCoverage=53%, E-value=2e-17, Identity=26%"; Hit description=IMP dehydrogenase/GMP reductase, putative
  Pfam annotation: Domain name=DUF1723; Domain location=98-147; Score =37.8; E_value=3.9e-08; Accession=PF08330.1; Description=Protein of unknown function (DUF1723)
MVDAAAQDTGAETDAQDTDAETDGDEPMGFPGGPRDPSVLTEYADHVAGSVWSGQERPELKLCSHGRKVHNLGRPIPAIEDMVARTGLSPLIACSIDIGDRGFISSFVERWHRETSSFHLPEGEVSITLDDVVSLLHWPIIGTFHDFQPLRTDEAVRCPWPRQANVVDHTYACSGCETYTSTDVRRSTRQLLLAIIFYIFWVALFLLIRVQPMFMSHTYRRSVTSLLLGGMHGELQASSLCTISLMMPVSTPIDSLLIYEHFLSVAESNVDLDYDEVSPCACRWIVTKKTVKKLGYVQCIPAHPVHSWVSYDDVDDTWTHYSDHLEAAGDLCVVPSECAPDYMNWFFIISHPFMTTPQTDPPRDTYVT

SEQ ID NO: 159623 - protein, 182 aa, Glycine max
  Coding DNA Sequence Number=SeqID_67938
IDVYAGTLSMEFGDIVVHFNILDAMKHLFEDHSVFRTEIIDQIVDDYMFDFDYVLYGRKHPFLSDLHTCHSLCIESDSEFEFDLVSDFYAESEFEFESGIVPLDVDFLESECTNHVAGSTYTSDLLYEVQVEEPSSSSPTLVPPTFQPPPTPELKPLPTTLKYAYLEDKEKFPVIIFASLAA

SEQ ID NO: 159624 - protein, 54 aa, Glycine max
  Coding DNA Sequence Number=SeqID_67939
MFAFNSALKGLDDTPQSKSKAAARWIVVKTKRKHRVWILRHALDVNYNLRKFQE

SEQ ID NO: 159625 - protein, 120 aa, Glycine max
  Coding DNA Sequence Number=SeqID_67940
  Gene Ontology: Mol. function=serine-type endopeptidase activity; Cellular component=periplasmic space; Biological process=proteolysis
  Homolog annotation: Hit_ID=A4WF47; Match level="QueryCoverage=93%, HitCoverage=37%, E-value=1e-39, Identity=59%"; Hit description =Periplasmic serine protease DegS
  Pfam annotation: Domain name=PDZ; Domain location=35-109; Score=26.1; E_value=0.00013; Accession=PF00595.15; Description=PDZ domain (Also known as DHR or GLGF)
MGINTLTFDKSNDGETPEGIGFAIPTALATKIMDKLIRDGRVIRGYIGITGRELPPLHGQGSNLDRVQGIIVSEVTPGGPADRAGIQANDVLLQVLRNEQKMTLPVTIQEFPEAANNTSP

SEQ ID NO: 159626 - protein, 178 aa, Glycine max
  Coding DNA Sequence Number=SeqID_67941
MAPLHGNNNQTQYENGSWFMAEEEEEESNQEEEEGSARETGPRGHQHNTKMALRKKKNEVLCEEEEESKGLSITGFSPQVLGAPTKMLGAPSSTLVCDSEARLSGAFSKGGKCVESPPTFICGKCQKNRRKSVIKNIPDSGVVFTFEEGISTSHVDKSRALAPTYPPSKRKSNLRSSF

SEQ ID NO: 159627 - protein, 126 aa, Glycine max
  Coding DNA Sequence Number=SeqID_67942
DKYLGKEEQRPGLAVGTTSQRGSVVPHQQELHKCGFKTRRSSRHDMRWRLPEEIGFGTAMPSQFPTRKLAGYRSDDESREGTSTGDLAVDFDQKASQTENEEDENVGLPLELERIIAQEDREIRLH

SEQ ID NO: 159628 - protein, 164 aa, Glycine max
  Coding DNA Sequence Number=SeqID_67943
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=65%, E-value=3e-33, Identity=100%"; Hit description=LacZ protein
MAAHPGELRLTPEVTGSPRRVSSFSLKSFGGPGKPEASLGELGSRKLKEKPGQASLKSFEQSFVLCDLGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 159629 - protein, 506 aa, Glycine max
  Coding DNA Sequence Number=SeqID_67944
  Gene Ontology: Mol. function=ATP-dependent DNA helicase activity; Cellular component=intracellular; Biological process=cellular metabolic process
  Homolog annotation: Hit_ID=A7MQK9; Match level="QueryCoverage=100%, HitCoverage=82%, E-value=0.0, Identity=81%"; Hit description =Putative uncharacterized protein
  Pfam annotation: Domain name=DEAD; Domain location=1-115; Score= -27.5; E_value=0.0048; Accession=PF00270.20; Description=DEADDEAH box helicase
  Pfam annotation: Domain name=HRDC; Domain location=456-506; Score =50.6; E_value=5.5e-12; Accession=PF00570.14; Description=HRDC domain
  Pfam annotation: Domain name=Helicase_C; Domain location=178-254; Score=112.2; E_value=1.5e-30; Accession=PF00271.22; Description =Helicase conserved C-terminal domain
  Pfam annotation: Domain name=RQC; Domain location=334-437; Score =148.0; E_value=2.7e-41; Accession=PF09382.1; Description=RQC domain
  Pfam module annotation: Pfam domain module=DEAD::HRDC::Helicase _C::RQC; Domain location=1-115::456-506::178-254::334-437
MKDQVDQLLANGVAAACLNSTQTREQQQQVFADCRSGKLRLLYIAPERLMMDNFLDTLQHWNPVMLAVDEAHCISQWGHDFRPEYGALGQLRQRIPQLPVMALTATADEATRNDIVHLLQMHDPLIQISSFDRPNIRYTLVEKFKPTEQLLRYVQDQRGKSGIIYCNSRAKVEDTAARLQSRGISVGAYHAGIDSEQRARVQEAFQRDDLQIVVATVAFGMGINKPNVRFVVHFDIPRNIESYYQETGRAGRDGLPAEAMMLYDPADMAWLRKCLEEKAPGPLQDIERHKLNAMGAFAEAQTCRRLVLLNYFGEGRQQPCGNCDICLDPPRRYDGLVEAQKALSGIYRTGQRFGMSYIVEVLRGSTNQRIRDNGHDKLPVYGLGREQSQEHWVSVLRQLIHLGMVTQNIAMHSALQLTEAARPVLRAEVPLMLAVPRTVTVKSRSSAPKVYGGNYDRKLFAKLRKLRKAIADEENIPPYVVFNDATLIEMAEQMPVSASEMLSVNG

SEQ ID NO: 159630 - protein, 330 aa, Glycine max
  Coding DNA Sequence Number=SeqID_67945
  Homolog annotation: Hit_ID=A7QGC5; Match level="QueryCoverage=63%, HitCoverage=70%, E-value=9e-39, Identity=44%"; Hit description =Chromosome undetermined scaffold_91, whole genome shotgun sequence
MDALNFLKFWRNATMSTTSEPHLVVETDTESDEDDSFFDLELTPLDFDNKENNTNTTTTKNDDDPKQTTTSELKSLGSKDNLLSKTDNGVQRKTPLPLSPPSEPISKRKVLPIEPISKPQSPIALLRSAPSFRIFMFRKRNRTPPQQKTEHSVNEAKVFAVKLSVDDFRSSPALSRDNSTRSFGSKVRGLSYEEEPKPERFSKEVLRKYLKLIKPLYVKVSKRYSDKVRFSGEGYAASPSSSPSVASVSSRTEKQGKGMRVVSKHLGKSRSASSTVAGVSSPAKKSDDTMQQQLDGIQSAILHCKRSFNSREGSMYSVRKSFDGEHGEKV

SEQ ID NO: 159631 - protein, 583 aa, Glycine max
  Coding DNA Sequence Number=SeqID_67946
  Gene Ontology: Cellular component=integral to membrane
  Homolog annotation: Hit_ID=A7QGD4; Match level="QueryCoverage=76%, HitCoverage=92%, E-value=1e-164, Identity=63%"; Hit description =Chromosome undetermined scaffold_91, whole genome shotgun sequence
  Pfam annotation: Domain name=C4dic_mal_tran; Domain location=245-510; Score=267.8; E_value=2.3e-77; Accession=PF03595.8; Description=C4 -dicarboxylate transportermalic acid transport protein
MGQECRPASSALLQYICMSRPSMENNLNRETEGHGLPKIPSLVQHISSNDEGNFDNGDLKNLSSSFKENETILAGSQGDEHAAINHRNKHSVSINIPFSCEEVQLHNTVRVLYSGENDFSSQSTTTDSKPPLPSQSMPNGSLHSEPASGVNFNNQESVISLNNKRIDFFKTWSSKLGGHISVMSGKVHTESAEDDNSLCNTNKPLPVDLFFKTLEGPQLQTPKKSSEEMVLPQDKQWPFLLRFPVSSFGICLGVSSQAILWKALATSPSTAFLHITPKINFILWFISIAIVATIFTTYLFKIILHFEAVRREYQHPVRVNFFFAPWIALLFLALGVPPSVTKDLHQAVWYILMIPLFCLKLKIYGQWMFGGKRLLSKVANPTNLLAIVGNFVGALLGASMGLKEGPLFFFALGLAHYMVLFVTLSQMLPTNKTIPKDLHPVFFLFVAPPSVAAMAWAKIQGSFHYESRIFYFTAMFLYISLAVRVNLFRGFKFSLSWWAYTFPMTAAAIATITYTNQVTNVLTQALSVILSLIATFTVTAVLVSTIVHAFVLRDLFPNDLAIATSERKQKPRRKWLPFKTWEP

SEQ ID NO: 159632 - protein, 88 aa, Glycine max
  Coding DNA Sequence Number=SeqID_67947
MEWRVNIEATPGSDYPMELNRNGMSYLSRRSEDKMSTHLVVRMSHITCLNSRSVAYISVGQIHLAPIGFKLKPNIVSKPIAHLGSCFF

SEQ ID NO: 159633 - protein, 334 aa, Glycine max
  Coding DNA Sequence Number=SeqID_67948
  Gene Ontology: Mol. function=molecular_function; Cellular component =cellular_component; Biological process=biological_process
  Homolog annotation: Hit_ID=A7QGE6; Match level="QueryCoverage=95%, HitCoverage=48%, E-value=1e-97, Identity=59%"; Hit description =Chromosome undetermined scaffold_91, whole genome shotgun sequence
  Pfam annotation: Domain name=WD40; Domain location=138-176; Score =46.0; E_value=1.3e-10; Accession=PF00400.23; Description=WD domain, G-beta repeat
  Pfam annotation: Domain name=WD40; Domain location=183-221; Score =5.9; E_value=5.9; Accession=PF00400.23; Description=WD domain, G -beta repeat
  Pfam annotation: Domain name=WD40; Domain location=285-322; Score =12.9; E_value=0.82; Accession=PF00400.23; Description=WD domain, G -beta repeat
  Pfam module annotation: Pfam domain module=WD40::WD40::WD40; Domain location=138-176::183-221::285-322
MNATNLLKRDIVHLNLKLSQLQALLDEKEAQLRQFRSMEGGSTGSSSNLREETARVSKDSSELFPTGIPQVGQTEISQDSVAGGLGNIRSELIGSTSGNDSTTFLSNDRMRNGRADNATLKDNNGEVFGEEDFAEVKVEYQETFLGHTGPISRCCFSASGNNIASASLDGTVRIWTYDTSTPVSRNATIYCGTEILSLDWECKSDRLLLIGTSDGCIKAWNVDAKRVVCDLNTTEAFPSVLDIKCSPVEPIFVSAAASGGAGSNYIDNLGFASLTVWNMKTWKAMTVLPLGEDPPAITSLCFNHNGKILAASAVDGMIHMFGILNFIHLIVSLV

SEQ ID NO: 159634 - protein, 194 aa, Glycine max
  Coding DNA Sequence Number=SeqID_67949
  Homolog annotation: Hit_ID=Q9FLX0; Match level="QueryCoverage=100%, HitCoverage=16%, E-value=1e-12, Identity=33%"; Hit description =Arabidopsis thaliana genomic DNA, chromosome 5, P1 clone:MXC20
MIANALDEDGKFTAAQVSRKLKQLGLSLPQKSSGGKMHPKDADLMDLSNDRMDESDDETLVTLIKRKKMENDKLSRGQLHGQISEDRLSTDDSDDEMLSSVLKRTRRSSLKSKQVELENIQIQESIMGDDSFNEGKTDVLERDNRVDSMNSSQIEHQQMDDLADSEDEVAVSAFPDNARSRRQLRMVIDPEDDD

SEQ ID NO: 159635 - protein, 107 aa, Glycine max
  Coding DNA Sequence Number=SeqID_67950
MDDLVEYKSINTCSGFYLYLPIINTSSCVIMGASPRGKLRRRSVHMIRHEELRRARRRIEEIPGTPATPSPAVITRAKEERVRGLKDTEAREEEGPCHMDACIHKDL

SEQ ID NO: 159636 - protein, 304 aa, Glycine max
  Coding DNA Sequence Number=SeqID_67951
  Gene Ontology: Mol. function=hydrolase activity, hydrolyzing O -glycosyl compounds; Cellular component=vacuole; Biological process =carbohydrate metabolic process
  Homolog annotation: Hit_ID=Q43684; Match level="QueryCoverage=92%, HitCoverage=93%, E-value=1e-145, Identity=88%"; Hit description =Basic chitinase class 3
  Pfam annotation: Domain name=Glyco_hydro_18; Domain location=29-291; Score=226.3; E_value=7.1e-65; Accession=PF00704.19; Description =Glycosyl hydrolases family 18
MAKSKNCHALPLLLALILFFTLLGTSHAGGIAIYWGQNGNEGTLSEACATGKYTHINIAFLNKFGNGQTPEMNLAGHCNPATNSCTKFSSEIKDCQSKGIKVLLSIGGGIGSYTLASVEDARNVSTFLWNTFLGGKSSSSSRPLGDAVLDGIDFDIELGSTQNYEHLARFLKAYSGVGGKRVYLGAAPQCPIPDRFLGTALNTGLFDFVWVQFYNNPPCQYANGNITNLVSSWNRWTSTVPAGKIFLGLPADPAAAGSGFIPADTLTSEILPVIKESPKYGGVMLWSRFFDVQNGYSTSIIGSV

SEQ ID NO: 159637 - protein, 1493 aa, Glycine max
  Coding DNA Sequence Number=SeqID_67952
  Gene Ontology: Mol. function=ATPase activity, coupled to transmembrane movement of substances; Cellular component=integral to membrane; Biological process=transport
  Homolog annotation: Hit_ID=A7QTU6; Match level="QueryCoverage=100%, HitCoverage=100%, E-value=0.0, Identity=72%"; Hit description =Chromosome undetermined scaffold_171, whole genome shotgun sequence
  Pfam annotation: Domain name=ABC_membrane; Domain location=308-577; Score=79.2; E_value=1.3e-20; Accession=PF00664.14; Description=ABC transporter transmembrane region
  Pfam annotation: Domain name=ABC_membrane; Domain location=918-1192; Score=84.4; E_value=3.6e-22; Accession=PF00664.14; Description=ABC transporter transmembrane region
  Pfam annotation: Domain name=ABC_tran; Domain location=1268-1457; Score=138.2; E_value=2.4e-38; Accession=PF00005.18; Description=ABC transporter
  Pfam annotation: Domain name=ABC_tran; Domain location=652-831; Score= 152.0; E_value=1.6e-42; Accession=PF00005.18; Description=ABC transporter
  Pfam module annotation: Pfam domain module=ABC_membrane::ABC _membrane::ABC_tran::ABC_tran; Domain location=308-577::918 -1192::1268-1457::652-831
MAGFWSVFCGESGCSEAGRMPCSYDFRLLIDPSTCVNHLLNSCFDVLLLIMLACIMIQKSSLKPSRGLTQVQRYSYFQLVSAIANGALGLTLLCFGIWVLEEKLRKNQTALPLNWWLLEIFHGLTWLLVSLTITLKLKQLPKAWSRPFSVLIFLVSDFFCASSVFYAISSRELSLKISSDILSFLGAILLLLCTYKESKHRDTDSEIDENLYAPLNGESNKNDSIRYVTPFAKTGFFGRMTFWWLNPLMKMGKEKTLHDEDIPRLREEDRAESCYLLFLDQLNRQKLNDQSWQPSVLRTIILCHWKEILISGFFALLKVVALSSGPLLLNSFILVAEGNESFKYEGFVLAISLFFTKNIESLSQRQWYFRCRLIGLKVRSLLTAAIYRKQLRLSNSARLMHSSGEIMNYVTVDAYRIGEFPYWFHQTWTTSFQLCISLVILFRAVGWATIASLVVIVITVLCNTPLAKLQHKFQSKLMVTQDDRLKACSEALVNMKVLKLYAWETNFRSSIERLRNEELKWLSAVQLRKAYNTFLFWSSPVLVSAASFGACYFLNVPLHANNVFTFVATLRLVQDPIRTIPDVIGVVIQAKVAFARIVKFLEAPELQSVNITQRCLNENKRGSILIKSADFSWEDNVSKPTLRNINLEVRPGQKVAICGEVGSGKSTLLAAILREVLNTQGTTEVYGKFAYVSQTAWIQTGTIKENILFGAAMDAEKYQETLHRSSLLKDLELFPHGDLTEIGERGVNLSGGQKQRIQLARALYQNADIYLLDDPFSAVDAHTATNLFNVRKSSFLQEYIMEGLAGKTVLLVTHQVDFLPAFDSVLLMSDGEIIEAAPYYHLLSSSQEFQDLVNAHKETAGSDRLVEVTSPQKQSNSAREIRKTSTEQHYEASKGDQLIKQEEREKGDQGFKPYIQYLNQNKGYIYFSVAALSHLTFVVGQILQNSWMAASVDNPQVSTLQLILVYLLIGVISTLFLLMRSLFVVALGLQSSKSLFSQLLNSLFRAPMSFYDSTPLGRILSRVSSDLSIVDLDVPFGFVFAVGATMNCYANLTVLAVVTWQVLFVSIPMIYFAISLQRYYFASAKELMRLNGTTKSFVANHLAESVAGAVTIRAFEEEDRFFEKNLDLIDVNASPYFQSFAANEWLIQRLETVSAVVLASAALCMVVLPPGTFSSGFIGMALSYGLSLNMSLVFSIQNQCNIANYIISVERLNQYMHIPSEAPEVIAGNRPPANWPVAGRVQINELQIRYRPDAPLVLRGITCTFEGGHKIGIVGRTGSGKSTLIGALFRLVEPAGGKIIVDGIDICSIGLHDLRSRFGIIPQDPTLFNGTVRYNLDPLSQHSDQEIWEFSFHMKALGKCQLQETVQEKEEGLDSSVVEAGANWSMGQRQLFCLGRALLRRSRILVLDEATASIDNATDLILQKTIRTEFSDCTVITVAHRIPTVMDCTKVLAISDGKLVEYDEPMNLIKREGSLFGKLVKEYWSHFQSAESH

SEQ ID NO: 159638 - protein, 440 aa, Glycine max
  Coding DNA Sequence Number=SeqID_67953
  Gene Ontology: Mol. function=oxidoreductase activity; Cellular component=integral to membrane; Biological process=electron transport
  Homolog annotation: Hit_ID=A7QG56; Match level="QueryCoverage=100%, HitCoverage=60%, E-value=1e-158, Identity=62%"; Hit description =Chromosome undetermined scaffold_91, whole genome shotgun sequence
  Pfam annotation: Domain name=FAD_binding_8; Domain location=50-150; Score=102.2; E_value=1.6e-27; Accession=PF08022.3; Description=FAD -binding domain
  Pfam annotation: Domain name=NAD_binding_1; Domain location=161-247; Score=0.0; E_value=0.002; Accession=PF00175.12; Description =Oxidoreductase NAD-binding domain
  Pfam annotation: Domain name=NAD_binding_6; Domain location=157-424; Score=152.5; E_value=1.1e-42; Accession=PF08030.3; Description =Ferric reductase NAD binding domain
  Pfam module annotation: Pfam domain module=FAD_binding_8::NAD_binding_ 1::NAD_binding_6; Domain location=50-150::161-247::157-424
MYEVFFYTHHLYTLYILFYAMHVGVEWMCMISPGIFLFLIDRHLRFLQSRQCAPLLSARLLPCGALELNFSKNPSLYYNPTSMVFINVPKISKLQWHPFTVISSCNMETDILSVAVKTGGSWSNKLYQELSSSALDHLNVSVEGPYGPTTTSQFLRYKQLVLVSGGSGITPFISIIRDLIFQNRQEQESHVPKVLLVCAFKNSADLTMLDLLLPLFVSTTQFSNLHQLQIEAYITREKEEAPRDSQKQIQTKWFKPILSDSPISLVLGPNNWLWLGAIISSSFLMFLLLLGIITRYYIYPIENNSDEVYHWTFKVLWFMFLLCAVICICSSAVFLWWKRQNSLESKQIMNVEFPTPTRSPGSWIYGSERELESLPHQSLVQATNVHFGARPDLKKILFECKDKDIGVLVSGPRSMRHEVGKICASGLADNLHFESFSFTW

SEQ ID NO: 159639 - protein, 118 aa, Glycine max
  Coding DNA Sequence Number=SeqID_67954
MPCKGKIKFLSSELCFLHMETIRGICLDAELFHFTLIPVPGPLSAIMCMLLCTAVNNDPIICPVGKDTDDSKESHLIGEDKKQNSVSTTEQDPTRLTMYLLRKCEEKSATNRTSDAKQ

SEQ ID NO: 159640 - protein, 460 aa, Glycine max
  Coding DNA Sequence Number=SeqID_67955
  Gene Ontology: Mol. function=hydrolase activity, acting on glycosyl bonds; Cellular component=extracellular region; Biological process =cell wall organization and biogenesis
  Homolog annotation: Hit_ID=Q2HUV5; Match level="QueryCoverage=98%, HitCoverage=97%, E-value=0.0, Identity=70%"; Hit description =Glycoside hydrolase, family 28
  Pfam annotation: Domain name=Glyco_hydro_28; Domain location=79-426; Score=28.7; E_value=1.4e-10; Accession=PF00295.8; Description =Glycosyl hydrolases family 28
MKLCSQVIGAISLVLILGSLNVKVVECKVGRGLKNTEYYAINCRKHSAVLTDFGGVGDGKTSNTKAFQSAIRKLGQYASDGGAQLIVPPGKWLTGPFNLTSHFTLFLHKDAVILASQCNPLKGHLHYHIDRLNQNGPNFLYCLHMEEEEMLPEEGHNGTIDGQGSYWWDKFHKNQLNLTRPYMIEIMYSDQIQISNLTLVNSPSCNITIKGLTILAPVDSPNTDGIDPDSCTNTRIEDCYIVSGDDCVAVKSGWDEYGIKFGKPTQHLVIRRLTCISPDSAMIALGSEMSGGIQDVRVEDITAINTQSAVRIKTAVGRGGYVKDIFVKGMTLSTMKYVFWMTGSYGSHPDPAFDPKALPNITGINYRDVVATNVTYSAKLEGISNDPFTGICISNVSIQVSEQKKKLQWNCTDVAGVTSNVTPNTCQLLPEKGKFDCPFPNDKLSIENVQLKTCSIKKVF

SEQ ID NO: 159641 - protein, 210 aa, Glycine max
  Coding DNA Sequence Number=SeqID_67956
  Gene Ontology: Mol. function=hydrolase activity, acting on glycosyl bonds; Biological process=cell wall organization and biogenesis
  Homolog annotation: Hit_ID=Q2HUV5; Match level="QueryCoverage=99%, HitCoverage=44%, E-value=1e-88, Identity=74%"; Hit description =Glycoside hydrolase, family 28
KSGWDEYGIKFGKPTQHLVIRRLTCISPDSAMIALGSEMSGGIQDVRVEDITAINTQSAVRIKTAVGRGGYVKDIFVKGMTLSTMKYVFWMTGSYGSHPDPAFDPKALPNITGINYRDVVATNVTYSAKLEGISNDPFTGICISNVSIQVSEQKKKLQWNCTDVAGVTSNVTPNTCQLLPEKGKFDCPFPNDKLSIENVQLKTCSLQNVF

SEQ ID NO: 159642 - protein, 245 aa, Glycine max
  Coding DNA Sequence Number=SeqID_67957
  Homolog annotation: Hit_ID=A7QJ45; Match level="QueryCoverage=79%, HitCoverage=77%, E-value=1e-38, Identity=52%"; Hit description =Chromosome chr2 scaffold_105, whole genome shotgun sequence
MSDPDAAAIKVITSNGGIMEFSAPVTVSFITNEFPGHAIFRSHDLFWKPLSQFEELEPGQSYYLLPFSNRNNNNNNNNSNNNIDTLPCDGENVNVVVRQGHVRSQSVPTISNPALYRMSLDYHHHNQGMGLLKRSSNNNIDAFSSRSSGVVNSSNSIGGGGSSRFWKVKLVITPEQLLDILAQEARTKELIESVRMVAKCGINAGGAISNSAADSLAITSNCRISEHLLCNSNSGTFKALAYNFL

SEQ ID NO: 159643 - protein, 616 aa, Glycine max
  Coding DNA Sequence Number=SeqID_67958
  Gene Ontology: Mol. function=transporter activity; Cellular component= integral to membrane; Biological process=transport
  Homolog annotation: Hit_ID=A7QKE3; Match level="QueryCoverage=99%, HitCoverage=95%, E-value=0.0, Identity=72%"; Hit description =Chromosome chr2 scaffold_112, whole genome shotgun sequence
  Pfam annotation: Domain name=MFS_1; Domain location=215-614; Score =24.7; E_value=0.00034; Accession=PF07690.7; Description=Major Facilitator Superfamily
  Pfam annotation: Domain name=SPX; Domain location=2-148; Score=115.7; E_value=1.4e-31; Accession=PF03105.10; Description=SPX domain
  Pfam annotation: Domain name=Sugar_tr; Domain location=183-580; Score= -170.2; E_value=0.025; Accession=PF00083.15; Description=Sugar (and other) transporter
  Pfam annotation: Domain name=Voltage_CLC; Domain location=220-608; Score=-184.9; E_value=0.095; Accession=PF00654.11; Description =Voltage gated chloride channel
  Pfam module annotation: Pfam domain module=MFS_1::SPX::Sugar _tr::Voltage_CLC; Domain location=215-614::2-148::183-580::220-608
MVAFGKKLKERQIQEWQGYYINYKLMKKRVKQYAQQIQLGTLDRRHVLKDFSRMLDNQIEKTVLFLLEQQGLLASRIAKLGEEHEVIQQEPHISRIAELREAYRAVGQELLKLLFFVEVNAVGLRKILKKFDKRFGYKFTDYYVKTRANHPYSQLQQVFKHVGFGAVVGALSRNLHELQENQESQGSFLSIYDQPTLPLQDPVIDSIRAAIDRLSNSTNFLNFLGQHALIMHEELPAPVDERVDEQTDDYSMSLGAAPTVCGIVIGAMAVAQVFSSVYFSAWSNRSYLRPLIFSSIVLFLGNVLYALAYDLNSIWILIIGRLLCGAVNRRYISDCVPLKIRMQASAGFVSASALGMACGPALAGLLQTNFKIFNITFNQDTLPGWLMTIAWLIYLVWLWITFKEPYREIEEKHVPHQSNAENNALEKGIKQPLLTSLKDKVDEDDDQDYEDSEEAPEDSHQPANSIGAAYRLLTPSVKVQLLIYFMLKYAMEILLSESSVITTYYFNWTTSTVSIFLACLGLTVLPVNIIVGSYISNMFEDSFNVIFPYTEPQYICSGLLMFVSAEVLEGVNLSLLSRVMSSRLSRGTYNGGLLSTEAGTLARVIADATITLAGYG

SEQ ID NO: 159644 - protein, 157 aa, Glycine max
  Coding DNA Sequence Number=SeqID_67959
  Gene Ontology: Mol. function=metal ion binding; Biological process =metal ion transport
  Homolog annotation: Hit_ID=Q1SWG8; Match level="QueryCoverage=43%, HitCoverage=61%, E-value=2e-19, Identity=66%"; Hit description=Heavy metal transport/detoxification protein
  Pfam annotation: Domain name=HMA; Domain location=23-91; Score=37.1; E_value=6.1e-08; Accession=PF00403.17; Description=Heavy-metal -associated domain
MDRCKLEIACRESKRENEEDEKVVLKVEIHDDKIKKKAMKAVSGILGVELVSADTKDKKLTIIGDIDPVKVVAKLRKQLCHADIVFVGPTKEEKKEEPKKDSAKEIVVTIAYGKPRKLLAESRTMSLFLRRFVALPKIMQADYLPRSPQDKTAQITV

SEQ ID NO: 159645 - protein, 827 aa, Glycine max
  Coding DNA Sequence Number=SeqID_67960
  Gene Ontology: Mol. function=binding; Cellular component=nucleus; Biological process=metabolic process
  Homolog annotation: Hit_ID=A7QGA5; Match level="QueryCoverage=96%, HitCoverage=98%, E-value=0.0, Identity=41%"; Hit description =Chromosome undetermined scaffold_91, whole genome shotgun sequence
  Pfam annotation: Domain name=PPR; Domain location=108-142; Score =41.8; E_value=2.5e-09; Accession=PF01535.11; Description=PPR repeat
  Pfam annotation: Domain name=PPR; Domain location=210-244; Score =30.9; E_value=4.6e-06; Accession=PF01535.11; Description=PPR repeat
  Pfam annotation: Domain name=PPR; Domain location=245-279; Score=1.6; E_value=5.1; Accession=PF01535.11; Description=PPR repeat
  Pfam annotation: Domain name=PPR; Domain location=312-346; Score =40.5; E_value=6e-09; Accession=PF01535.11; Description=PPR repeat
  Pfam annotation: Domain name=PPR; Domain location=413-447; Score =21.0; E_value=0.0046; Accession=PF01535.11; Description=PPR repeat
  Pfam annotation: Domain name=PPR; Domain location=42-76; Score=5.2; E_ value=1.9; Accession=PF01535.11; Description=PPR repeat
  Pfam annotation: Domain name=PPR; Domain location=514-548; Score =43.7; E_value=6.3e-10; Accession=PF01535.11; Description=PPR repeat
  Pfam annotation: Domain name=PPR; Domain location=549-583; Score=7.0; E_value=1.1; Accession=PF01535.11; Description=PPR repeat
  Pfam annotation: Domain name=PPR; Domain location=585-619; Score=5.5; E_value=1.7; Accession=PF01535.11; Description=PPR repeat
  Pfam annotation: Domain name=PPR; Domain location=651-685; Score=1.1; E_value=5.8; Accession=PF01535.11; Description=PPR repeat
  Pfam annotation: Domain name=PPR; Domain location=7-41; Score=38.3; E_ value=2.7e-08; Accession=PF01535.11; Description=PPR repeat
  Pfam module annotation: Pfam domain module=PPR::PPR::PPR::PPR::PPR::PP R::PPR::PPR::PPR::PPR::PPR; Domain location=108-142::210-244::245 -279::312-346::413-447::42-76::514-548::549-583::585-619::651-685::7 -41
MPHRDVVSWTTLLSAHTRNKHHFEALQLFDMMLGSGQCPNEFTLSSALRSCSALGEFEFGAKIHASVVKLGLELNHVLGTTLVDLYTKCDCTVEPHKLLAFVKDGDVVSWTTMISSLVETSKWSEALQLYVKMIEAGIYPNEFTFVKLLGMPSFLGLGKGYGKVLHSQLITFGVEMNLMLKTAIICMYAKCRRMEDAIKVSQQTPKYDVCLWTSIISGFVQNSQVREAVNALVDMELSGILPNNFTYASLLNASSSVLSLELGEQFHSRVIMVGLEGDIYVGNALVDMYMKCSHTTTNGVKAFRGIALPNVISWTSLIAGFAEHGFEEESVQLFAEMQAAGVQPNSFTLSTILGACSKMKSIIQTKKLHGYIIKTQVDIDMAVGNALVDAYAGGGMADEAWSVIGMMNHRDIITYTTLAARLNQQGDHEMALRVITHMCNDEVKMDEFSLASFISAAAGLGIMETGKQLHCYSFKSGFERCNSVSNSLVHSYSKCGSMRDAYRVFKDITEPDRVSWNGLISGLASNGLISDALSAFDDMRLAGVKPDSVTFLSLIFACSQGSLLNQGLDYFYSMEKTYHITPKLDHYVCLVDLLGRGGRLEEAMGVIETMPFKPDSVIYKTLLNACNLHGNVPLGEDMARRCLELDPCDPAIYLLLASLYDNAGLPDFGDKTRKLMRERGLRRSPRQCWMEVKSKIYLFSAREKIGNDEINEKLESLITEIKNRGYPYQESEDKLYHSEQLALAFGVLSVPTLAPIRINKNSLICTHCHSFIMLLTQFVDREIIVRDRKRFHVFKDGQCSCRAMSMKPERGPRLVRPGLKAVAKIGV

SEQ ID NO: 159646 - protein, 180 aa, Glycine max
  Coding DNA Sequence Number=SeqID_67961
MREASVGKVRESEFGEEGGDGGGEVGGFGFEELCGEEEGFGDGEEGEAVVVLGDIGGELAEGGGDERGGVEEEGAVGGEGAGGEDVEEGGFSGAAGAHHGQDLGGEGGQGDVFEDEIDVAVSFHFRVFVALVVGVVETNLRGLPWRVEVREKSYGVGIETRIGSFPCVGVYKPWCMDDTE

SEQ ID NO: 159647 - protein, 166 aa, Glycine max
  Coding DNA Sequence Number=SeqID_67962
MPMTHLTGDARRAEQGLSVAHPLFMYGWFLIFSAMKVVDSPVLYKVTACVPRKGKQIGSNSWVPERPLDGNEGKDKELRGSNNGIIGGYHKWLKARTKRLRSPRRAKRCNLMELERTQIVKEKFKMAAIKVRKECDELRDVNTATAAALERETKRARKEEWGRNKF

SEQ ID NO: 159648 - protein, 170 aa, Glycine max
  Coding DNA Sequence Number=SeqID_67963
MATTKALERETKRACREEHGWNKFRGALWGSNNELKLLREERDQSRVDRHTLRHPYRTRARARVMSKVEEVQEQIKADMEAMKEKMATMMEANMSMKEIMEVNAVALLRDDPHNVQIQNKHAFPPYGLPPNYTPPNVAYTPSENTHEIPHHNLADFEPCLGYATGGQEVG

SEQ ID NO: 159649 - protein, 66 aa, Glycine max
  Coding DNA Sequence Number=SeqID_67964
VRTPIVMGSCRNMPFCGRAKARLTDALSKGGKVRRVATNVYLWKTSEKPKEIGQNENSKFGSCIYV

SEQ ID NO: 159650 - protein, 38 aa, Glycine max
  Coding DNA Sequence Number=SeqID_67965
LWFKLKPETITWLDFVECPKVQDEKIQDLEIDLMESAM

SEQ ID NO: 159651 - protein, 39 aa, Glycine max
  Coding DNA Sequence Number=SeqID_67966
MCTPEGWMLCVFPRNTKRTQMIWGIPLSLNHWPSPYPDM

SEQ ID NO: 159652 - protein, 40 aa, Glycine max
  Coding DNA Sequence Number=SeqID_67967
MAFVDNWVVGKEEEWQSQHGFLPHPRPLYFAPVFSVVLVG

SEQ ID NO: 159653 - protein, 253 aa, Glycine max
  Coding DNA Sequence Number=SeqID_67968
  Homolog annotation: Hit_ID=Q9SI94; Match level="QueryCoverage=63%, HitCoverage=48%, E-value=5e-09, Identity=30%"; Hit description =En/Spm-like transposon protein
  Pfam annotation: Domain name=Transposase_23; Domain location=132-202; Score=13.5; E_value=4e-05; Accession=PF03017.5; Description=TNP1ENSPM transposase
  Pfam annotation: Domain name=Transposase_23; Domain location=46-116; Score=19.7; E_value=8.3e-06; Accession=PF03017.5; Description =TNP1ENSPM transposase
  Pfam module annotation: Pfam domain module=Transposase_23::Transposase _23; Domain location=132-202::46-116
  Subcellular localization annotation: CTP_CleavageSite=29; ConfidenceScore=5.22e-01
MASFSQLQSQMQSQAPPEPLVGPGPSSPRVSTKGSCVDPSGNDLETGDSDRCGLYIEADPARLVAVGRVYEGSTLVHNTPLLPGQVKVSVDEVKDADASVPVPTAEVSLVGQALHTFLAWPTHLIKSLSHQTGDSDRCGLYIEADPARLVAVGRVYEGSTLVHNTPLLPGQVKVSVDEVKDADAPVPVPTAEVSLVGQTLHTFLAWPTHLIKSLSHQVVVSPPKPPPKPDPEVDDPLYLMTLTIPELFLRPYQ

SEQ ID NO: 159654 - protein, 766 aa, Glycine max
  Coding DNA Sequence Number=SeqID_67969
  Gene Ontology: Mol. function=oxidoreductase activity, acting on NADH or NADPH; Cellular component=plasma membrane; Biological process =cell redox homeostasis
  Homolog annotation: Hit_ID=P19480; Match level="QueryCoverage=56%, HitCoverage=95%, E-value=0.0, Identity=72%"; Hit description=Alkyl hydroperoxide reductase subunit F
  Pfam annotation: Domain name=AhpC-TSA; Domain location=4-134; Score =156.9; E_value=5.4e-44; Accession=PF00578.12; Description=AhpCTSA family
  Pfam annotation: Domain name=GIDA; Domain location=337-551; Score= -238.6; E_value=0.025; Accession=PF01134.13; Description=Glucose inhibited division protein A
  Pfam annotation: Domain name=HK; Domain location=679-766; Score= -77.3; E_value=1.9e-06; Accession=PF02110.6; Description =Hydroxyethylthiazole kinase family
  Pfam annotation: Domain name=Pyr_redox; Domain location=480-573; Score=86.0; E_value=1.2e-22; Accession=PF00070.18; Description =Pyridine nucleotide-disulphide oxidor
  Pfam annotation: Domain name=Pyr_redox_2; Domain location=337-617; Score=155.1; E_value=2e-43; Accession=PF07992.5; Description =Pyridine nucleotide-disulphide oxidore
  Pfam annotation: Domain name=Redoxin; Domain location=6-155; Score =38.0; E_value=3.3e-08; Accession=PF08534.1; Description=Redoxin
  Pfam module annotation: Pfam domain module=AhpC-TSA::GIDA::HK::Pyr _redox::Pyr_redox_2::Redoxin; Domain location=4-134::337-551::679 -766::480-573::337-617::6-155
MSIINTKIKPFKNAAFKNGEFIDVTEKDVEGKWSVFFFYPADFTFVCPTELGDVADHYEEFQKLGVDIYSVSTDTHFTHKAWHGSSDTIAKIQYAMIGDPTGALTRNFEIMREAEGLADRGTFIVDPEGIIQAIEITAEGIGRDASDLLRKVKAAQYVASHPGEVCPAKWKEGDATLAPSLDLELTMLDTNLKTQLKAYLEKLTKPVELIATLDDGAKSAEIRTLLTDIASLSDKVSFREENDQPTGGHPSKEAQSLLDQALNLMAVLNPRIRHTAIDGGMFQNEITERNVMGVPAVYLNGKEFGQGRMSLAEIVGKVDTNADKRAAEELNKRDAYEVLIVGSGPAGAAAAIYSARKGIRTGLMGERFGGQVLDTVDIENYISVPKTEGAKLAGSLRAHVDDYDVDVIDTQSAIKLIPAAKEGGLHAIETASGAVLKSRSIIIATGARWRNMGVPGEEQYRTKGVTYCPHCDGPLFKGKRTAVIGGGNSGVEAAIDLAGIVEHVTLLEFASEMRADKVLQDKLRSLKNVDVILNAQTTEVKGDGSKVTGLTYIDRNNQTSHELALSGIFVQIGLLPNTNWLEGAVERNRMGEILIDAKGETSLKGVFAAGDCTTPATRLFIADIAIINFMDALAAAFAFGFEVRGIPVTAAGGNGALTGNGDIVPVPDPLSPAQLAHSLQLLRQQAPLVHCMTNDVVQTFTANVLLALQASPAMVIDGDEAAQFAGFADALLINVGTLTRERRDAMLAAVQAANQAGTPWTLDPVA

SEQ ID NO: 159655 - protein, 99 aa, Glycine max
  Coding DNA Sequence Number=SeqID_67970
MGVVTDFGRMVAAISGVAPIHSAIAVPDTMARQRQRHHGGLQQLIKQRAAGEIARVGQVRQQQQWNNDRHGYQQRVDDGEVDSGCQTACQQIRHHGKRQ

SEQ ID NO: 159656 - protein, 256 aa, Glycine max
  Coding DNA Sequence Number=SeqID_67971
MDLAVIDAFLSFHHGKESPVVGILTDMYDTFDQRCEKSGARIICCTSTLYVWLVSHLFRHEGRPVCSLQGYCSCAEKGKANWDQLLASMEGASVNWFPRWKEGRTENLSSCEGFQNLGYPMRGAPSEESIVPFIAWGFNDPNARVLQGVRKAWDAVPRMDKELRGNSNGIIGGYQEEAEAPKENEEVQALKAELERAWAVREKFKSAAILNETEGNMWTIIDEYKEKLNLAATHEQRLEDEYTKISAEREARGGIL

SEQ ID NO: 159657 - protein, 102 aa, Glycine max
  Coding DNA Sequence Number=SeqID_67972
FSSNKRWWRLRAYSFRGTRIPRVTHRPPTEGLIKVILVASTLNYLPSLEVASTLTYLPSLGSGVYPDLSSFTGSGVIQTFIACIKRSAPTQVHIIWYQSFGS

SEQ ID NO: 159658 - protein, 266 aa, Glycine max
  Coding DNA Sequence Number=SeqID_67973
  Homolog annotation: Hit_ID=A6EGF7; Match level="QueryCoverage=62%, HitCoverage=75%, E-value=6e-47, Identity=54%"; Hit description =Probable capsular synthesis response regulator transcription regulator protein
  Pfam annotation: Domain name=DUF1508; Domain location=165-211; Score =80.2; E_value=6.5e-21; Accession=PF07411.3; Description=Domain of unknown function (DUF1508)
  Pfam annotation: Domain name=DUF1508; Domain location=214-262; Score =82.2; E_value=1.7e-21; Accession=PF07411.3; Description=Domain of unknown function (DUF1508)
  Pfam module annotation: Pfam domain module=DUF1508::DUF1508; Domain location=165-211::214-262
VHKSIRENEPYDLLITDLYYEEDHRQQNIKDGRDLIQQIKALQPSLKVIVFSAEHKSGIIDSLFKDYHINGYVRKARNDSKELKKSIASVYINENYLSLDLKQEIKKLNSYEFSAYEITLVSLLSKGVLQKNIPDLLQEKNIKPNSLSSVEKKLNSLKEDLERINNEYQFNLKAGNGEIILTSEGYVQKASCHKGIESVRINSKEDSRYDRREAVNGKDYFVLKARNGEIIGKSQLYSSKTAMENGIHSVKSNAPTAEIIDETLKN

SEQ ID NO: 159659 - protein, 149 aa, Glycine max
  Coding DNA Sequence Number=SeqID_67974
  Gene Ontology: Mol. function=N-acetyltransferase activity; Cellular component=cytosol; Biological process=metabolic process
  Homolog annotation: Hit_ID=A5I409; Match level="QueryCoverage=96%, HitCoverage=96%, E-value=2e-36, Identity=47%"; Hit description =Acetyltransferase (GNAT) family protein
  Pfam annotation: Domain name=Acetyltransf_1; Domain location=51-130; Score=36.9; E_value=7.3e-08; Accession=PF00583.15; Description =Acetyltransferase (GNAT) family
MSNIIWKIKTFDEFTVPELYKVLKARIDVFVIEQNCPYPDLDNYDQKGIHIWAEEDGEILAYCRVFDKGIKYDETSFGRVLTTEKARGKSLGKQLIRYAVETIENRFHTSEIKISAQDYLLRFYSEFGFIDTGKKYLEDDIPHTEMIRK

SEQ ID NO: 159660 - protein, 125 aa, Glycine max
  Coding DNA Sequence Number=SeqID_67975
MELAWDGAKFGLPNSTNGFFITHADLWMMFMNDWSTSIGLLQCTGFLEPQSICCTKDMREECQQYIETAMKKICSNFQGKDNAPPPPPQWIEAKFFFNGTPLDTDTITTLRKKWAAYFLEDGKWM

SEQ ID NO: 159661 - protein, 332 aa, Glycine max
  Coding DNA Sequence Number=SeqID_67976
  Gene Ontology: Mol. function=chlorophyll binding; Cellular component =integral to membrane; Biological process=photosynthetic electron transport
  Homolog annotation: Hit_ID=Q2MI75; Match level="QueryCoverage=94%, HitCoverage=75%, E-value=1e-146, Identity=70%"; Hit description =Photosystem II P680 chlorophyll A apoprotein
  Pfam annotation: Domain name=PSII; Domain location=1-332; Score =443.9; E_value=2.2e-130; Accession=PF00421.10; Description =Photosystem II protein
MALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFMGMEFVRADVPFRGAESKYSVEQVGVIVEFYGGELNGVSYSDPATVKNMLDVLNGWKFLIRSWLL

SEQ ID NO: 159662 - protein, 114 aa, Glycine max
  Coding DNA Sequence Number=SeqID_67977
  Subcellular localization annotation: CTP_CleavageSite=23; ConfidenceScore=5.36e-01
MVHDIFVKVKLEVTGTSAALNVFGSRRSSDVTRSFAPIFFKMGTSILQLDSMNLFVKARAWFNPITQEMAILIANTSSTIHRDERLGNMHAINGFMIPTWLAHGENARVTHEQT

SEQ ID NO: 159663 - protein, 132 aa, Glycine max
  Coding DNA Sequence Number=SeqID_67978
MAPKKLATKSSRMDTTKEGSSAAQEFDAHRFRSVEHQQHFEAIKGWSFLRERREELARRHWAPLATSMAKFDPDIVLEFYANTWPTEEGVRDMRSWVRFQWIPFDADALNQFLGHPLMLEEGQQCEYGQRRN

SEQ ID NO: 159664 - protein, 66 aa, Glycine max
  Coding DNA Sequence Number=SeqID_67979
MMSIGKCSIGIIRRSFFIRPQGSVILTRIMKLAKYKLKAQVEKDEGPSGEGQSPRVEKDEGPSGEG

SEQ ID NO: 159665 - protein, 200 aa, Glycine max
  Coding DNA Sequence Number=SeqID_67980
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=43%, HitCoverage=72%, E-value=7e-24, Identity=66%"; Hit description=LacZ protein
MTPVNRKAGTGERTREPPGGNAGIFIVLSGFATTDLSVRFRDACQEERSLWKNGFAAALSLPSGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 159666 - protein, 229 aa, Glycine max
  Coding DNA Sequence Number=SeqID_67981
  Gene Ontology: Biological process=transposition, DNA-mediated
  Homolog annotation: Hit_ID=Q6UUU1; Match level="QueryCoverage=26%, HitCoverage=40%, E-value=3e-18, Identity=78%"; Hit description =Putative uncharacterized protein
RNIQLNESDYRYIEQLTEMPQNVLYDAIGDISTVGHQDLFILRSDLPSQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 159667 - protein, 124 aa, Glycine max
  Coding DNA Sequence Number=SeqID_67982
  Subcellular localization annotation: CTP_CleavageSite=52; ConfidenceScore=5.10e-01
MYPPLFSLNLVDVPSTRTDPQDMYSLVLSQTQVDVPSTCTTKDVPSNVLRQRSQAVKPLILCEWGYKRILRREKGDTKEFRWLVLCSFGKGRRKTQKEFRWLVLGEFFLAKGEEMKRMNSTSFK

SEQ ID NO: 159668 - protein, 351 aa, Glycine max
  Coding DNA Sequence Number=SeqID_67983
MAPRKLASKRSRKDKAAEGTSSAPEYDSHRFRSAEHQQCFEAIKGWDDEYTDFQEEIVRRRWASLVTPMAKFDPDIILEFYGNAWPTEEGVRDMRSWVRGQWIPFDADAIGQFLGYPLVLEEGQECEYGQRRNRSDGFDEEAIAQCYIWMTLLLSNILPTDHNSDLPLPKCQLVYAILTRMSIHVAQLIADAIYLFAGMVPTRHPLDPDKSNRALGFPALITGLWQSFGVPVAPTKAAGAPPPPHQAGPAGSFDTEQYLRHVVRQEAANHRAHVRTNETLYQLSLSMQSQGFASFSCPTPDKFRVEVAWPGDWPEAQAGEAPAEAPGEADEAHEDEDMADLLDFLGGSGAT

SEQ ID NO: 159669 - protein, 50 aa, Glycine max
  Coding DNA Sequence Number=SeqID_67984
MWDRHRLKGALKPGVFTPKAYTSKSPSGPLPPDSDTAHELYNTYDLTLVF

SEQ ID NO: 159670 - protein, 67 aa, Glycine max
  Coding DNA Sequence Number=SeqID_67985
VATPLAKRNLRAKQILVHALSETLLALSASTPVHWLKGRVISLSAQLHLSKRPLCAKLNFLSVGPFM

SEQ ID NO: 159671 - protein, 150 aa, Glycine max
  Coding DNA Sequence Number=SeqID_67986
GETLPTYSRYCRLPTDYREIEAALCIPGLGFILNTEGHPGKILRKDLTTLAQSNSSRLGFLALITALCRARGVVSDSLVLEHLSPVINLAYIRKNCWNPDDLTVTIRGARRARARPAELPSTSAAPTPASTSAAPSVPANTDSQRFEAML

SEQ ID NO: 159672 - protein, 286 aa, Glycine max
  Coding DNA Sequence Number=SeqID_67987
  Gene Ontology: Cellular component=photosystem II; Biological process =photosynthesis
  Homolog annotation: Hit_ID=Q5Z5A8; Match level="QueryCoverage=14%, HitCoverage=10%, E-value=1e-12, Identity=85%"; Hit description =Photosystem II stability/assembly factor HCF136, chloroplast precursor
  Pfam annotation: Domain name=Auxin_resp; Domain location=26-81; Score= -24.7; E_value=0.059; Accession=PF06507.4; Description=Auxin response factor
MPTLNHSMSIWMIIRSQIELDELESVSILSMTLAWDEFSFSTFQEAHYSLQVSLDQVPGTIIGNEDINSIRWPGSAWRRLKDTLYLENIEERETGGTPPIIQTVRAWDLILMWQGQGIYLWTFELEVIQIDKLRYQDVLSKGFRSAADKVDTADSDCWEFRSQLKSMKGYIILGEHRGKGNWGHASNNPDSESMGPAVQVKSTRKEKQKKQERDDGMNNGCGIVSTGISGASYCTGTFNTVDCSPDGRYVLVSSRGNFYLTWESGCGGKSRFCATYFEASQNVQWL

SEQ ID NO: 159673 - protein, 131 aa, Glycine max
  Coding DNA Sequence Number=SeqID_67988
  Homolog annotation: Hit_ID=A5BCI2; Match level="QueryCoverage=69%, HitCoverage=6%, E-value=4e-07, Identity=37%"; Hit description =Putative uncharacterized protein
MTSPATGDLPLAILIYRSSISLFHSLQEQFPTKKMEEAEKEILETFRKVEELCTNKRKLKGSERISMGRNVSALIGKSVPQIPEKCKDPGPLHSTDVVIHLANRSVAYPVGFIEDVLVRVGELIFPVDFIF

SEQ ID NO: 159674 - protein, 105 aa, Glycine max
  Coding DNA Sequence Number=SeqID_67989
  Gene Ontology: Mol. function=protein serine/threonine kinase activity; Cellular component=integral to membrane; Biological process=protein amino acid phosphorylation
  Homolog annotation: Hit_ID=A3B2K8; Match level="QueryCoverage=92%, HitCoverage=15%, E-value=7e-16, Identity=43%"; Hit description =Putative uncharacterized protein
MAQGLCCYLSLKEMKQATNNFDEPNVIGVGGFGKVYKGVIDNGFKVAIKRSIRNQGHVSTPLKGSFGYLDPEYFRRHQLTKKSDVYSFGVVLSEALYLRKVALDT

SEQ ID NO: 159675 - protein, 336 aa, Glycine max
  Coding DNA Sequence Number=SeqID_67990
  Homolog annotation: Hit_ID=Q2HTA0; Match level="QueryCoverage=44%, HitCoverage=29%, E-value=5e-18, Identity=30%"; Hit description=IMP dehydrogenase/GMP reductase, related
  Pfam annotation: Domain name=DUF1723; Domain location=111-160; Score =49.1; E_value=1.6e-11; Accession=PF08330.1; Description=Protein of unknown function (DUF1723)
MVRIRGLGHALGRAIGKVLGRKQGSDDDNDASRGEDLSHLLAGSSYDCRGIARQGTTTKAPVEDPPTDERLELKLSSYGKKIAKFRRLALEIKGLVIVSGLSPLIACSLNTGDRGLISTFVERWHKETSSFHLPIGEVTITLDDVESLLHLPIVRVFHNFEQLHVDDAVDILVELLEVSAAEARAETIQCHDSYVRLSWLRDVYQMKIEACYWIVAARVGSYAWGAAVLVHMYDNLNKALKSTTRQLAGYITLLQQYDTFVEPDVYQQLMATAAPDKADIDVHHLRHAVDGHVAIANKLERQLNLRIMTEGTEAYTIVEECLSIARSYISQSIVGH

SEQ ID NO: 159676 - protein, 747 aa, Glycine max
  Coding DNA Sequence Number=SeqID_67991
  Gene Ontology: Mol. function=RNA polymerase II transcription factor activity; Cellular component=nucleus; Biological process=regulation of transcription, DNA-dependent
  Homolog annotation: Hit_ID=Q680U9; Match level="QueryCoverage=53%, HitCoverage=96%, E-value=1e-123, Identity=50%"; Hit description=MRNA, complete cds, clone: RAFL22-33-O09
  Pfam annotation: Domain name=Tfb2; Domain location=383-642; Score= -14.6; E_value=1.2e-15; Accession=PF03849.5; Description =Transcription factor Tfb2
MYVASMRKSFKDSLKVLEADIQHANTLVMITVAEGLVIAKASDFPREYDGACLQMRMSYSPAAHLFLFLVQWTDCHLAGALGLLRILIYKVYVDGTTTMSTHERKASIREFYAVIYPSLLQLEKGVTDTEDKKQKVVCMERYRRRDDEEYRQSSDIDIEREDECGICMDMNSKIVLPNCNHAILKRVNSGDLWVFTDRRDVVDMATVTRENLRRLFMYIDKLPLIVPDSLFDTYDSHISLPNAYDRFSNSLKVVTHLFSSHLISCLHHPSPTSRDPFKSKTVRIITAARDPFRTTITETIRIKDKEKGGGGGVGITMPEVRIIAKNFMDMVASMPAMKLDKLYENGFICEAILSSELSNPKGWCNGIRLHCVYMSEKDPFSGRTRVRFPSRVKFPWPAAAIHSGSLLPLAKKYVIQMLHIDVSVAAKLLEEWVLPGGVSKHRVAIDRLVQLRVFLEAVDRKNEKTYKVNPTFQRSLQKLLVQGGTLPRESMPSNITVRLPTLENLEAYALEQWELFPDEGFPAAYPELQLMDTNAQLWYIIREYISNSEDRGVDAADLISFMLELSFHDIGEGFVVVETNFRVYAYSTSKLHCEILRLFSRVEYQLPNLIVGAITKESLYSAFENGITAEQIITFLQQNAHPRVAERIPSVPENVTEQIRLWEADLNRVEMTDAYYYDEFPSRDVFEGACDCAREWNGLLWEDSKKMHMVVKTEKYQVYHLAGQWGIQVVALALVVASAWSPASVAC

SEQ ID NO: 159677 - protein, 131 aa, Glycine max
  Coding DNA Sequence Number=SeqID_67992
MGLRGRDQNRIFLDVGGESSSDGYQRVEEGSGRGGGENEHMGLLALEHKAQRRKFKHSGTWWWGYRLKFSCTLLWRGGVDYGGNGRGTTKKRLLPRYVIFILNPQFPTFGLHDQRQRPRVYEATFGHNFVC

SEQ ID NO: 159678 - protein, 277 aa, Glycine max
  Coding DNA Sequence Number=SeqID_67993
  Gene Ontology: Mol. function=hydrolase activity; Cellular component =soluble fraction; Biological process=metabolic process
  Homolog annotation: Hit_ID=A7QYP2; Match level="QueryCoverage=99%, HitCoverage=76%, E-value=2e-91, Identity=61%"; Hit description =Chromosome undetermined scaffold_252, whole genome shotgun sequence
MDPIQHKFVNVGALKLHVAETGTGENHSSAFYFYSLYFTYHQSPFSGPNAVVFLHGFPEIWYSWRHQMIALAGAGFRAVSFDYRGYGLSDPPPEPDKTSWSDLLSDLLHILDALALSKVTLKQDRVGMIRHTNVGMKGCLHVFLVGKDFGARPAYLFSILHPERVLGVVTLGVPYVPPGPSQYHKFLPEGFYILRWQEPGRAEADFGRFDAKTVVRNIYILFSRSEIPIANENQEIMDLVEPDTPLPTWFTEEDLATYGALYEKSGFQTALQIPYRC

SEQ ID NO: 159679 - protein, 103 aa, Glycine max
  Coding DNA Sequence Number=SeqID_67994
  Gene Ontology: Mol. function=aspartic-type endopeptidase activity; Biological process=RNA-dependent DNA replication
  Homolog annotation: Hit_ID=Q6VPE8; Match level="QueryCoverage=63%, HitCoverage=8%, E-value=5e-10, Identity=45%"; Hit description =Putative gag-pol polyprotein
MEGTSDSGGEYHQLDESQHLLLDVMTTQMQRLENQLNQNVGRLYGGNIGGNDRPGQNRMEGQNKIEGVKLNVPHFKGRSDPDAYLDWEMKIEHVFSCNDYTEE

SEQ ID NO: 159680 - protein, 171 aa, Glycine max
  Coding DNA Sequence Number=SeqID_67995
MVLGDSVDKGENLGGTREHKLYKTLEMFEEWKRQRDPRCRMQCPDILLENTGVATQCISQDKLSSEALKLQDPRCRMQCPDILLENTGVATQCISQDKLSNFQESDRSHPASRSCSPESYTAIKTWRLHEFCTKSGIEELVCEFLGLESFVSHLDGTLASSVGPECVELIS

SEQ ID NO: 159681 - protein, 55 aa, Glycine max
  Coding DNA Sequence Number=SeqID_67996
MEMRNQPFMKRVCDLNQARTEVVTIVRVCNLNEVFVTEGVRTRVARESVWVERNE

SEQ ID NO: 159682 - protein, 168 aa, Glycine max
  Coding DNA Sequence Number=SeqID_67997
  Pfam annotation: Domain name=DUF1723; Domain location=76-116; Score =9.6; E_value=0.039; Accession=PF08330.1; Description=Protein of unknown function (DUF1723)
MSPSPSCYFRRQGKDVHHVDDATEEIFQQPKEVAFDAHGFLGTPCDISILTAYVDHVAVIERLELKLSFHGKKVQKSGRPAVKIEGFHIPVGEVTITLDDVASLLHLPITGTFHSFETLHVDEAVLMLVELLEVSVDEAKAETVQCHGTYVQLSWLRDIYRSKCDVEH

SEQ ID NO: 159683 - protein, 1010 aa, Glycine max
  Coding DNA Sequence Number=SeqID_67998
  Gene Ontology: Mol. function=telomeric DNA binding; Cellular component=telomerase holoenzyme complex; Biological process=mRNA catabolic process, nonsense-mediated decay
  Homolog annotation: Hit_ID=Q2HTS7; Match level="QueryCoverage=100%, HitCoverage=99%, E-value=0.0, Identity=59%"; Hit description=Cig3, related
MTTNSSLPSGVHKEKHILFEIGNSERQLWALIHSKGLLHSDVQVLYHNIRSSYERAILNNHTHSELQEVEYSLWKLHYKHIDEFRKIMKRSSGNAENKKSGMPKDGVVQINNDNHIQAFKSFLSEATEFYQTLIVKLRKHYGVPEEALFHKKGCVSASFEPESMLKCQYLHHRCLVCMGDLARYKQHYENLNAQKQNWSVSATHYLEATRIWPDSGNPQNQLAVLATYIGDDFLALYHCVRSLAVKEPFPDAWDNLILLLEKLHKLPSLMILQNRSSHLECVSSEVCFDFFKPSQRISKETGTQPNNDSSNGNLFEGESNHFTDTKLWSHIVRTVSYLFITSSLEKFPIALASTIEVLDEIMELEDIKLKTMLESYGQMDLARKGPFRALQIVSILIFTLKNLIDKHEKDESKDKNDCQQLVLIQLALAAAFIFMGRFVERCQKSSPLNHCPLLPSVLVFMEWCASMLDTIEVYATDQKSETAISYFFYVLIELLNQLNENRKETRKLVDSSTPLWEDYELRGFASVAFSHVSLDFSCRWEHINNFESGTELRAQRMSEAAMRIANRSNNLQKWIICDELERKFYSARSDENHEKKETGNVESTDKWTSGDDPNQKTRKDNGEDGKCDTRDNPSSSSTNGKPSAVEEEEVILFRPLARYNSAPLYALFPPHEQMSSPKDKDDKVLPSDDCLRRTTSLPMAQNPFQIDPWGFQGDITNSRMNKSFQLLEPSMKESNAHTFSEGPISAGHPSLNAWALDTNRLHPIEELASSYLADLSIDRTQNAVISSADEFPNFPSSSATYTVPVPSAPLLPDNAPWYTDVIVQSTVSAPSLPENPSPINSYSALSSTYGPLGYDTSFPSYSNGYAPPPGRITSSEWLRWYRGNPTPERVNYNMQPAHLNVHGNHENFLHLDTYRFNQFDQWGNPSSPNQYTYVKPPGPPPLLPGYYPYAFGAGEHITNHFHNFQRPSPYGCGSVTEQRNEPLPLLEYLKEREWRLQQDPSLRGPTFTGN

SEQ ID NO: 159684 - protein, 70 aa, Glycine max
  Coding DNA Sequence Number=SeqID_67999
MIFDGQSLEQDCVLETIKRKSWLWLDSYVKQFKYSFFEYWHSNEPTAMPQMVMKREEIKGSRDMDIKSCM

SEQ ID NO: 159685 - protein, 924 aa, Glycine max
  Coding DNA Sequence Number=SeqID_68000
  Gene Ontology: Mol. function=small conjugating protein ligase activity; Cellular component=intracellular; Biological process =regulation of protein metabolic process
  Homolog annotation: Hit_ID=A7R7R4; Match level="QueryCoverage=90%, HitCoverage=99%, E-value=0.0, Identity=54%"; Hit description =Chromosome undetermined scaffold_1973, whole genome shotgun sequence
  Pfam annotation: Domain name=UQ_con; Domain location=681-821; Score =128.2; E_value=2.3e-35; Accession=PF00179.17; Description=Ubiquitin -conjugating enzyme
MDLIISDSDWETSSGSNSSEDQDEIDFLYGGKAQSILSSLEESIGRIDDFLSFERAFVHGDVVCSLSDPSGQMGRVTSMDLFVDLESVKGKVLKNLNSKKLLRIRSIAEGDYVIKGPWLGRVQRVVDKVAVLFDDGAKCDITALEREKLLPLTGNFPEDSQFPYYPGQRVKVKSSSASKSTRWLCDTWRDNHDEGTVCAVEAGLVYVNWISHVLVGCDFSVSAPKCWQDSKTLTVLSCFSHANWQLGDWCMLSVADQKEQITQHAPIGDLTMEHCVSRGCKGSNLNSYSGELFIIGKIKTKVDVVWQNGEYTLGLDPENLLPVNVINNHEFWPHQFVLEKGASDDPLKTSSQRWGVVQCVDAKECTVKVQWKTISISDPDNLTGDKLEETVSAYELVEHPDYSCFFGDIMFKAAQKQLGNQAEKEQAKSVTDFNAEAVPKNGNQMSYQDEFPDNYFMSCIGSVTGFKDGDVEVTWATGFTTKVAPYEIFRIEKHEGSTVTPTPFETNVEEFTHEIIEHRSLPSDQKGKDLLNGDGTRENCEKNLGECSSFSLPRAAFELFSSIKASIFQTFRGTLISGAVSSVPTFEKKNGYDCLDKKDLETSDLFTEQHPMAELQYTEDKTSYPENIEIHEKNDFPFSLDSNSSNQFKQFDVIENCPDHHFFVEGKGLSTSQVKRSWVKKVQQEWSILEKNLPERMDLMRAAIVGASGTPYHDGLFFFDICFPPEYPNEPPMVHYNSAGLRLNPNLYESGKICLSLLNTWTGTDTEVWNPGASTILQVLLSLQALVLNEKPYFNEAGYDQQIGRAEGEKNSVSYNENAFLVTTKSMMYLLRKPPKHFEALVEEHFRKCSQHILLACKAYLEGASIGCAFGSGKTGHENQKGTSTGFKIMLAKLFPKLVEAFSDKGIDCSQFVDLQKEPLLTKL

SEQ ID NO: 159686 - protein, 270 aa, Glycine max
  Coding DNA Sequence Number=SeqID_68001
  Homolog annotation: Hit_ID=A7QJI4; Match level="QueryCoverage=72%, HitCoverage=100%, E-value=4e-54, Identity=59%"; Hit description =Chromosome chr8 scaffold_106, whole genome shotgun sequence
MSATKSASRKRASESERAKSDKNKRSAPDNFDLDLDFDLSEFVFAAFAFSFIFFGIVLTVSYIARICSDIKGIVSALHLIRDKAQKDGQKKNEETISSVGSEVKSMIEGLRSKIEKDRQSFAKALSKSSKEEGICVLFKTGLIIAVTASMQYESSLKNETAKFQALHENFCKEKASSLQALKDANYFCQLIDIISKFEEEKEKLFVRYEQLRKKERVMISEQEKACNDKIAQLEDSLKKKKKDDKTLSILRKTLGSFLGNASDEDFPPDD

SEQ ID NO: 159687 - protein, 82 aa, Glycine max
  Coding DNA Sequence Number=SeqID_68002
MHKQNQKDFHRLVVRLGYKKSLVFLTNGAKDTILIQGVAATSCLTYVSPASSSTMNGPGMVASDDASSTCYGTWAVGPSSSL

SEQ ID NO: 159688 - protein, 189 aa, Glycine max
  Coding DNA Sequence Number=SeqID_68003
MAGKSQCCVRGLHYGTRMWHLSCTTWGMVARRPSRVWPPPNDFPIMRATTWNMPWEQERTRLSGGIVRCYNSLQELYYWLAGEWLELCVGQAFFLLREALPLELGGNFQLGSKSSGGCVGSSIVVGGNVGGIFKLAFPQSGLDSFSGEDKVCKVSRHISYQLLVVERRQRIYHNPDHFPFRHRWDDLGR

SEQ ID NO: 159689 - protein, 372 aa, Glycine max
  Coding DNA Sequence Number=SeqID_68004
  Gene Ontology: Mol. function=protein-N(PI)-phosphohistidine-sugar phosphotransferase activity; Cellular component=intracellular; Biological process=phosphoenolpyruvate-dependent sugar phosphotransferase system
  Homolog annotation: Hit_ID=Q6DAB2; Match level="QueryCoverage=68%, HitCoverage=49%, E-value=3e-69, Identity=55%"; Hit description =Probable PTS system regulatory protein
  Pfam annotation: Domain name=HTH_11; Domain location=103-160; Score =21.2; E_value=0.0014; Accession=PF08279.3; Description=HTH domain
  Pfam annotation: Domain name=HTH_11; Domain location=190-249; Score =10.5; E_value=0.017; Accession=PF08279.3; Description=HTH domain
  Pfam annotation: Domain name=Mga; Domain location=165-264; Score =17.1; E_value=0.00049; Accession=PF05043.4; Description=M protein trans-acting positive regulator (MGA)
  Pfam module annotation: Pfam domain module=HTH_11::HTH_11::Mga; Domain location=103-160::190-249::165-264
ARIRYNASPQTTLDRPAPPSFPGRPPADSARHPRYAPISEFCAGVKPQLGHGINNAALHRLETVTDLASSLRGPQRRVIRRSFGEDSTLFAGFSHREAVEDRKNLPALNNVTPAAPQPIGQLALQLGVSGKTIQRDLQWLESWLSNWALTLEKTPGRGVRLRVKDMQQRLQLEQQLNGDEAGDALSHNSRRIKIASQLLSDAPRATSISKLSERYFISHASIVNDLKVIEEWLQPLGLTLQRGPGGTHIEGHEQALRQAMVSLINDVMQQQVAGTPLLPRLDPGSQQALVHYFGEEDVAFVQTLLQQMEQQLSYPLGDAWYLNLCTHILIMMHRMAQGNALALDILTTAHDLDQSILTIARQMVVRIEQRIG

SEQ ID NO: 159690 - protein, 119 aa, Glycine max
  Coding DNA Sequence Number=SeqID_68005
  Pfam annotation: Domain name=RVT_2; Domain location=56-119; Score= -184.2; E_value=0.016; Accession=PF07727.5; Description=Reverse transcriptase (RNA-dependent DNA pol
GTSFVVQVEGTSTWVVVTENKRGYISCGSVQVEGFYKVEKKSQGPQVAWGLDVGTAVKAEYDAFMNNDTFTLDPLPPNKVPIGCNFSFSSSKCHPSLFVYSKGSTTVYMLIYVDDIIIT

SEQ ID NO: 159691 - protein, 98 aa, Glycine max
  Coding DNA Sequence Number=SeqID_68006
MELIENMYASYPVVPYVVLLMNLVFAFLLKSKCKRLATWGNNKGRDTIEVDSQVSSKVFTTNKDSGDHTLVINSTKTRVDLPTGHLNKGLTFFRGQPS

SEQ ID NO: 159692 - protein, 41 aa, Glycine max
  Coding DNA Sequence Number=SeqID_68007
MAKRIDNSGRRMSCIEALSEGQLAKRTVFTFRLGSFPAMES

SEQ ID NO: 159693 - protein, 118 aa, Glycine max
  Coding DNA Sequence Number=SeqID_68008
VEQQLKWKSTSKSCGPESYPKKDQGQGILRAAPSKPKDDIGKTIENQDEATTSPSSSESEEAKREESSEEIYPKKKEWMMQSYPLMALDRRLQEDWARAAEEGPRVLNSLRVDFGAVG

SEQ ID NO: 159694 - protein, 111 aa, Glycine max
  Coding DNA Sequence Number=SeqID_68009
DSAQSFGVPVAPTKVIRPPITRAFIEKYCTQRQAQGDAPQAAVEPQHAEPGLRFFSCPTPDQFRAEVAWPGDWPEAQAGEVPPEAPGDGEEAHEDEEMADLLNFLGGSGAS

SEQ ID NO: 159695 - protein, 99 aa, Glycine max
  Coding DNA Sequence Number=SeqID_68010
MYKVRATASLDDELERSTIPPTGESGGSAVSPAGESGGAAVSSDDASKMIIRGGDGGTTSSSGEGGGFTTRDHGLADIGSTCAGAGLGGAASLGLTNGS

SEQ ID NO: 159696 - protein, 57 aa, Glycine max
  Coding DNA Sequence Number=SeqID_68011
MREDAEKARKHEVGRERKCRVVIIKKGEIVEASFMMMNQVDSSSFDNDKDDDKNSKE

SEQ ID NO: 159697 - protein, 85 aa, Glycine max
  Coding DNA Sequence Number=SeqID_68012
MTLMNKVPLKLVLLFPARFFFSFLHYFFCKWLQFPSVIQPNHLQKIYAAYKALARAAKFPGNGAKILVRSLNNCKFIGKCTESSK

SEQ ID NO: 159698 - protein, 138 aa, Glycine max
  Coding DNA Sequence Number=SeqID_68013
MSCLVIITPTFLCQSVSWCMPPTRHPLDPDKSNRALGFPALITGLCQSFGVPVTPSKAWNGIYSTWFASRRPTTGGRCIYMSVSTSLASFRAEVAWPRDWPEAQAGEAPAEAPGDTEEARMDEEMMDLLGFLGGSGAT

SEQ ID NO: 159699 - protein, 79 aa, Glycine max
  Coding DNA Sequence Number=SeqID_68014
MPKWRRTKVQVEKDKAPEWRRTYQGNPCGVYPDLSSFIGSGVYPDLSSFTGSGVYPDLSSFTGSGVIQTFVACIKRSAP

SEQ ID NO: 159700 - protein, 293 aa, Glycine max
  Coding DNA Sequence Number=SeqID_68015
  Subcellular localization annotation: CTP_CleavageSite=45; ConfidenceScore=5.55e-01
TTCPPLQRATCPRLRRATCPHLQRTTRPRLQRATLPRLQTTTRPRLQRAARSRLHRAARPHLHRTPHLRLQRTQVPGLPPDIGGRPTVQAQPEREAIVQLLCIPGQDFTQPLQGDECGSCTPPYLQSPPAEGLHPQDTQWTQRSPIGPWGFQLWLWAFVSPTGCPPPPARSHHRDIGIAPARHPTDSEKSNRVLGFLALITGLFQFYGVPIAPNKVIRPPINRAFIKKYCAPQAGAGRDTTTAWGWSAAGNRRTAATSRAPQLIYIGWSIAYNPWLTSRRPSPKPKVSKVLGP

SEQ ID NO: 159701 - protein, 197 aa, Glycine max
  Coding DNA Sequence Number=SeqID_68016
MIMRGQDIYSSQDKATTSPSSSESEKAKGEESSEEIYPQEERQPLVVKEKCKEVSVSSKRLAKKETHFTIKTNIKETFPLRQPPHFLFCKKTLASIATLLGLQFIPQSQNRFGIIRHQVPKIGGMMNVLSGATLFCKITRAPNIFMVCVHRDPLGLGSSSSMDSFASWKMNGSGMEKEEREETPLQGEDESRRSSPP

SEQ ID NO: 159702 - protein, 451 aa, Glycine max
  Coding DNA Sequence Number=SeqID_68017
IPQQDPVAAMQAGKLNEGVPHAQHQRHAHRVAEQRRGRTQMATEAQPDIRPATQAFTRQMVIALRQRTADECASPADRYVAGAGGRSPAVQSYAQSDYRGATAGAARYSLPAGDRPAPACSAAAESETAPRCSASHRATGDIADATSWRAREYPAPQNSNAGCAACCASRGRRVELRHQLTIDHRGGDQRRVILLTAVGIKQIGLGFQIARQLGKAGGQLLLHRAHRKHQVADKGQQVVPQRANQQQRRLHPPLRKQANAQHGVHRDQQGTKRNGGQLDRDRGNAEAHQRDEQVAHAAGPAIVKIGQRRRHDAERNGGTAGQREEDAQQVAQAAVEQITAPAGQSRDSGDFKVGNAGRNTDDAQTLQDAGRDVHQAQPPAKENQPEQVEEGAAGVQHVAFALRAQHVYVNRFIAKRQQGQFGDLPAGAGQRQGKDQHDADQRGQQPAESGD

SEQ ID NO: 159703 - protein, 308 aa, Glycine max
  Coding DNA Sequence Number=SeqID_68018
  Gene Ontology: Mol. function=RNA binding; Cellular component =cytoplasm; Biological process=metabolic process
  Homolog annotation: Hit_ID=A6T766; Match level="QueryCoverage=100%, HitCoverage=78%, E-value=1e-158, Identity=87%"; Hit description =Putative SAM-dependent methyltransferase
  Pfam annotation: Domain name=Cons_hypoth95; Domain location=120-262; Score=-73.3; E_value=0.097; Accession=PF03602.6; Description =Conserved hypothetical protein 95
  Pfam annotation: Domain name=MTS; Domain location=133-266; Score= -84.2; E_value=0.018; Accession=PF05175.5; Description=Methyltransfera se small domain
  Pfam module annotation: Pfam domain module=Cons_hypoth95::MTS; Domain location=120-262::133-266
WRDWLAQRDGLDSYRLIAGESDGLPGVTIDRFGNFLVLQLLSAGAEYQRPALVSALQQCYPDCAIYDRSDVAVRKKEGLELAQGPVSGELPPALLPITEHGMQLLVDIQGGHKTGYYLDQRDSRFATRRYAENARVLNCFSYTGGFAVSALLGGCREVISVDTSQDALDVAKQNVALNGLDVSRAQFLRDDVFKLLRRYRDSGEKFDMIVMDPPKFVENKNQLMGACRGYKDINMLAMQLLNPGGILLTFSCSGLMATELFQKIIADAAVDAGRDVQFIEQFRQAADHPVIASYPEGLYLKGFACRVL

SEQ ID NO: 159704 - protein, 307 aa, Glycine max
  Coding DNA Sequence Number=SeqID_68019
  Gene Ontology: Mol. function=RNA binding; Cellular component =cytoplasm; Biological process=protein amino acid methylation
  Homolog annotation: Hit_ID=A7ME44; Match level="QueryCoverage=98%, HitCoverage=76%, E-value=1e-148, Identity=85%"; Hit description =Putative uncharacterized protein
MTVRLILAKGREKSLLRRHPWVFSGAVARMEGKAQSGETIDICDSNGKWLARAAYSPQSQIRARVWSWQQDESIDIAFFVRTLQKAQQWRDWLAQRDGLDSYRLIAGESDGLPGVTIDRFGNFLVLQLLSAGAEYQRPALVSALQQCYPDCAIYDRSDVAVRKKEGLELAQGPVSGELPPALLPITEHGMQLLVDIQGGHKTGYYLDQRDSRFATRRYAENARVLNCFSYTGGFAVSALLGGCREVISVDTSQDALDVAKQNVALNGLDVSRAQFLRDDVFKLLRRYRDSGEKFDMIVMDPPKIRRK

SEQ ID NO: 159705 - protein, 309 aa, Glycine max
  Coding DNA Sequence Number=SeqID_68020
  Gene Ontology: Mol. function=transporter activity; Cellular component= membrane; Biological process=transport
  Homolog annotation: Hit_ID=A7MFX9; Match level="QueryCoverage=98%, HitCoverage=68%, E-value=1e-139, Identity=82%"; Hit description =Putative uncharacterized protein
  Pfam annotation: Domain name=Xan_ur_permease; Domain location=16-309; Score=208.1; E_value=2.1e-59; Accession=PF00860.11; Description =Permease family
MSDNGLIAPDETLPLGQTFVLGLQHAVAMFGATVLMPLLMGLDPNLAILVSGIGTLLFFVITGGRVPSYLGSSAAFVGVVIAITGFNGQGLNPNLALALGGVIACGALYTLIGLVVMKVGTGWIERLMPPVVTGAVVMAIGLNLAPIAVHSVSASMFDSWMAVMTVLCIGLVAVFTRGMVQRLLILVGLIVAWALYALLTNVMGFGKPVDFSRVASAAWFGLPHTTAPVFDMQAIVMIAPVAIILVAENLGHIKAVAGMTGRNLDPWMGRAFVGDGLATMLSGSIGGSGVTTYAENIGVMAVTKVYSTL

SEQ ID NO: 159706 - protein, 104 aa, Glycine max
  Coding DNA Sequence Number=SeqID_68021
MTRGNPSDLQPFDPEIDRTFHRLVRHHLVPFEHPEHAVIGDFEHYCFEHSENIAQPPPRERTLREMVAPDFTYESLCIQYPDEDVPYVLKTGLIHLLPKFHGLA

SEQ ID NO: 159707 - protein, 143 aa, Glycine max
  Coding DNA Sequence Number=SeqID_68022
MGGTKRLLVIIPKVVISLLMVSRGIIPFKKHIAVVGTTSNNMLSKRKTLDEGSLLSSKSKTQHDHRFTSTPYVPMDPVESPTVATYPSAGGRREGSRVRLPRMENARSHHQRLFEENVGKTGKGCGLQTLSVKGSGVVFTHDE

SEQ ID NO: 159708 - protein, 389 aa, Glycine max
  Coding DNA Sequence Number=SeqID_68023
  Gene Ontology: Mol. function=hydrolase activity, acting on ester bonds; Biological process=biosynthetic process
  Homolog annotation: Hit_ID=Q4ISP1; Match level="QueryCoverage=94%, HitCoverage=29%, E-value=1e-25, Identity=28%"; Hit description=Amino acid adenylation
  Pfam annotation: Domain name=PP-binding; Domain location=46-112; Score=46.0; E_value=1.4e-10; Accession=PF00550.16; Description =Phosphopantetheine attachment site
  Pfam annotation: Domain name=Thioesterase; Domain location=133-384; Score=-14.4; E_value=0.0005; Accession=PF00975.11; Description =Thioesterase domain
  Pfam module annotation: Pfam domain module=PP-binding::Thioesterase; Domain location=46-112::133-384
MAPSRYHLIERFPLSRNGKLDRTLLSPGTERSQASDVAPAASAELMLLRELLANTLGCTPDKIDPHASFFSNGGSSLSGITFLGNIKRALNVELTLAEILGYSQLDKLVERLRANAPLPLSMLSGSADRPSLPTLYLVHGAGGQVHQYAKWTKQLCACANIITIASPGLAAPGADDTLTLQRLAASHLAAIPRAKRDTAVIAGWSLGGQLAVHMAALATEQGAPFAHAVVVDSGLPAQQPAVKRRFSVAQSYLSLFDSLGIARHLCRRQETNAIDSFANEIKMHYALNQSVLAEKVTLEHAETFCWALKKSFELTNNAGPLPQIAIPLTLWLSQQRQRKHPHLAQRWEMQSSHSVQLSYCAETHYSILNNAQLLRALTQLLHALSTSLE

SEQ ID NO: 159709 - protein, 164 aa, Glycine max
  Coding DNA Sequence Number=SeqID_68024
  Homolog annotation: Hit_ID=A1IW39; Match level="QueryCoverage=42%, HitCoverage=98%, E-value=2e-17, Identity=69%"; Hit description =Putative uncharacterized protein ophh-69
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGLRKVVRPCMGADACPVPEGQG

SEQ ID NO: 159710 - protein, 94 aa, Glycine max
  Coding DNA Sequence Number=SeqID_68025
MDQKVTTGEIQQSDLIPIDLEIKATCIRRNSERVRKFLQDLEAAATSEEEPRSSEASSSFPIAGHSHIEPVEDTIMAEELRRVTLEDYSSSTVP

SEQ ID NO: 159711 - protein, 94 aa, Glycine max
  Coding DNA Sequence Number=SeqID_68026
MKIVISIPLRNCDFAGREHYQDICFSYSINNSNWTQESIMYNHHEKGRAPDLESVLAGFMTYQASSKDNCYSTQQQGAQKDPIVGARRNAINSL

SEQ ID NO: 159712 - protein, 104 aa, Glycine max
  Coding DNA Sequence Number=SeqID_68027
  Pfam annotation: Domain name=G-patch; Domain location=31-69; Score =8.3; E_value=0.019; Accession=PF01585.14; Description=G-patch domain
MDPLSGSRPLHTPPEAEICGGRTFGHSMGLGRRPGHVYKPEMGLGKNNGGRDSLVNIKGNLEKLGLGYKPTQADIRKNISERKNRGQGPWSRPQAKEVPPCPHQ

SEQ ID NO: 159713 - protein, 73 aa, Glycine max
  Coding DNA Sequence Number=SeqID_68028
ADNQKVFPYATRLLGHDSKRARKSLATGFWLAIKGRGPLQVVGKDGHSHTGSRFMVSWDFGSRLVEPVDKIYA

SEQ ID NO: 159714 - protein, 109 aa, Glycine max
  Coding DNA Sequence Number=SeqID_68029
MAYTNWHLDRGRSELWLLGKTLLSSNVIHIWVKVVMLVRMIRTRLPIAVQAKSLPRYAQLLGDGFLIEIVCLAPPLAEFTLLVFLQNRRVTQELADGICIKGDPVTPHP

SEQ ID NO: 159715 - protein, 33 aa, Glycine max
  Coding DNA Sequence Number=SeqID_68030
MTVDVARKDERSGSKKVTKVWMTPLPMKEDKSG

SEQ ID NO: 159716 - protein, 76 aa, Glycine max
  Coding DNA Sequence Number=SeqID_68031
MARQLVVHAKCSVGPQPVAPFSSTNEPAKLHSTPEKGESSIGNSDLQKQHIPPLPFPPRAVSNKKMERRERDLGNI

SEQ ID NO: 159717 - protein, 326 aa, Glycine max
  Coding DNA Sequence Number=SeqID_68032
  Gene Ontology: Mol. function=translation release factor activity, codon specific; Cellular component=cytoplasm; Biological process =translational termination
  Homolog annotation: Hit_ID=P35614; Match level="QueryCoverage=100%, HitCoverage=100%, E-value=1e-142, Identity=64%"; Hit description =Eukaryotic peptide chain release factor subunit 1-3
  Pfam annotation: Domain name=eRF1_1; Domain location=5-86; Score =42.5; E_value=1.5e-09; Accession=PF03463.6; Description=eRF1 domain 1
  Pfam annotation: Domain name=eRF1_2; Domain location=90-224; Score =189.8; E_value=6.7e-54; Accession=PF03464.6; Description=eRF1 domain 2
  Pfam annotation: Domain name=eRF1_3; Domain location=211-307; Score =39.5; E_value=1.2e-08; Accession=PF03465.6; Description=eRF1 domain 3
  Pfam module annotation: Pfam domain module=eRF1_1::eRF1_2::eRF1_3; Domain location=5-86::90-224::211-307
MADGESDKNIEIWKIKKLIRALESARGNGTSMISLIMPPRDQISHVTKMLGDEFGTASNIKSRPINASLYLCDNKFHIEALNELLESDDKFGFIIMDGNDTLFGTLTGNTREVLHKFTVDLPKKHGRGGQSALCFACLRMEKRHNYVRNTAELATQFFINPATSQPNVSGLILAGSVGFKTELSQSDMFNPRLQAKILNVVDVSYGGENGFNQAIELSAEMLSNVNTLKALEMGAVGTLIVWENLDINRYVLKNSSTGEIVIKHLNKEQEGNQSNFRDSPTSAELEVQEKMPLSGFGGIGGILCYQLNIRSFDELSDDGEVYEDSD

SEQ ID NO: 159718 - protein, 133 aa, Glycine max
  Coding DNA Sequence Number=SeqID_68033
  Gene Ontology: Mol. function=hydrolase activity
  Homolog annotation: Hit_ID=A7PWY7; Match level="QueryCoverage=95%, HitCoverage=36%, E-value=2e-33, Identity=58%"; Hit description =Chromosome chr12 scaffold_36, whole genome shotgun sequence
MLGFPFMLPGPSVIQNLPKGSYVIKWQEAGRVEADFVCFDVKSVIRNIYTLFSGSEIPIAGDNQEIMDLYDPTTPLPPWFSEEDLATYESLYKKSGFRFALQFYSLGYFSNIIAANDPQRTLGVDSGIAGISS

SEQ ID NO: 159719 - protein, 140 aa, Glycine max
  Coding DNA Sequence Number=SeqID_68034
  Gene Ontology: Mol. function=hydrolase activity
  Homolog annotation: Hit_ID=A7PWY7; Match level="QueryCoverage=37%, HitCoverage=16%, E-value=3e-18, Identity=73%"; Hit description =Chromosome chr12 scaffold_36, whole genome shotgun sequence
MSVILRRSSHRNRLRMCGQKALVFLHGFPEIWYTWRHKMIVAANAGYRTIAFDFRGYGLSQHHAKPQKANLLDLVDDVVGLLDSLGITKGEGRHKRIQAVSPRLVLRSFGKGRRETQKEFRRLVLVEFFLAKGEENEKDE

SEQ ID NO: 159720 - protein, 136 aa, Glycine max
  Coding DNA Sequence Number=SeqID_68035
MSRKVNMVAIGFLLLCGLKAGTKKRIYDEISEIKQTANGTGEFAFCDGPSSGNGDIAMHGEPPVKLASSKLQVVGFRLQVVGLADVLFSDGRPKVHHEFGYNSVVFNGRVYEENDGVIFEGSKKAIQIKRGLVSMH

SEQ ID NO: 159721 - protein, 99 aa, Glycine max
  Coding DNA Sequence Number=SeqID_68036
MGNCQSNWRVPTGSTVRREVRPCRRDAVQQELANPIGGLLLGEGIASLAGGVDLRHEFSAEAEQVEAGRQCGRRNPNRQARRWDRPCDTSSRHHGHHNE

SEQ ID NO: 159722 - protein, 110 aa, Glycine max
  Coding DNA Sequence Number=SeqID_68037
  Subcellular localization annotation: CTP_CleavageSite=72; ConfidenceScore=5.16e-01
MPHNFVPLLTLFTKNFFKKVWAPRLWRCKVADKSSIVHNNRYPTNQTSKLTKLRNHVVVCFIWKNSLQVYTVQQTATPSGEFAGKTPRGTENATRSGELPSCRPKGELVI

SEQ ID NO: 159723 - protein, 118 aa, Glycine max
  Coding DNA Sequence Number=SeqID_68038
  Gene Ontology: Mol. function=hydrolase activity, hydrolyzing O -glycosyl compounds; Cellular component=cell wall; Biological process= carbohydrate metabolic process
  Homolog annotation: Hit_ID=Q8LNZ5; Match level="QueryCoverage=42%, HitCoverage=17%, E-value=4e-09, Identity=57%"; Hit description =Probable xyloglucan endotransglucosylase/hydrolase protein B precursor
MSTLHETVHFRKKNVQGERSKESNFQDRVMCLYISICGNKDLHNIFSFPSLNTKKIMGSSLWTLCIILASLASAAFCAFPRRPVNVPFGRNYVPTWAFDHIKYFKGVLKFNFILISTL

SEQ ID NO: 159724 - protein, 208 aa, Glycine max
  Coding DNA Sequence Number=SeqID_68039
  Homolog annotation: Hit_ID=Q2HRU8; Match level="QueryCoverage=100%, HitCoverage=98%, E-value=2e-65, Identity=60%"; Hit description =Putative uncharacterized protein
  Subcellular localization annotation: CTP_CleavageSite=42; ConfidenceScore=5.22e-01
MKNRTSGFLKEIIANLSSMAKSKTMALKSKTNAIRARLIIFSLMKNKKFLMSSLSEKFHSVWGQSSSQQKEDHCLLEDGSNDHQSKAIVLYNSNAHSYEALPNPSETQLVVEEEQDQDGYDGYYNYHCDDDEKYPDLTHTLFESEDLDLGGSVIDLMKNSKEEAGKEFKLEDEIDLAADLFIMKFRRQMVLQKQESLKRKREVLENGA

SEQ ID NO: 159725 - protein, 93 aa, Glycine max
  Coding DNA Sequence Number=SeqID_68040
MIESFQQQQEMSVIELCVEVDVVGVSALNVANSLLSCGNNIAGNESKDEEEDIDDISDTDEEVTLIGVIQMKKTFVVSIWDQPSILAKNYLLA

SEQ ID NO: 159726 - protein, 301 aa, Glycine max
  Coding DNA Sequence Number=SeqID_68041
  Homolog annotation: Hit_ID=Q2HRW3; Match level="QueryCoverage=100%, HitCoverage=100%, E-value=4e-36, Identity=53%"; Hit description =Putative uncharacterized protein
  Pfam annotation: Domain name=DUF716; Domain location=110-270; Score= -18.8; E_value=0.0049; Accession=PF04819.3; Description=Family of unknown function (DUF716)
MGSLVYQVISSAALLTLGMYHLISTTRNYLKSPHAYAAKPFHPFPYPRRLPLYLIILSLLLAMAHHLLVSADADPLVRGATAVHRITSLQSAATLFLFLLLAFALLIADASPALLPLSPDLSFALASVLFLLHAALASARAALQTSAIEAKCLSVSANLSHLSALLCLLLAALPRLFPADAALSATFCLRGLWALQSGLSLYADAFIPEGCHRLLDVTSGVEGSTQCDLDESKLRAVAILDLAFLIHAIIVVLIVLLTYALFARSFGGRRLGSYEALPTAASPTDPNHSLIQMKALTGTQA

SEQ ID NO: 159727 - protein, 38 aa, Glycine max
  Coding DNA Sequence Number=SeqID_68042
  Homolog annotation: Hit_ID=A5Z1P0; Match level="QueryCoverage=73%, HitCoverage=35%, E-value=3e-09, Identity=96%"; Hit description=60S ribosomal protein L37a
MRCGSRRRERYAVKRKVVGIWGCKDCGKVKAGGAYTLK

SEQ ID NO: 159728 - protein, 119 aa, Glycine max
  Coding DNA Sequence Number=SeqID_68043
  Gene Ontology: Mol. function=structural constituent of ribosome; Cellular component=ribonucleoprotein complex; Biological process =translation
  Homolog annotation: Hit_ID=Q9M2F1; Match level="QueryCoverage=72%, HitCoverage=100%, E-value=9e-36, Identity=81%"; Hit description=40S ribosomal protein S27-2
  Pfam annotation: Domain name=Ribosomal_S27e; Domain location=63-117; Score=114.8; E_value=2.5e-31; Accession=PF01667.8; Description =Ribosomal protein S27
MATKVRCSGNDNDSGTNVGYGGSDMDNVVAMAAMVLQNDIDLLNPPAELEKRKHKLKRLVQSPNSFFMDVKCQGCFNITTVFSHSQTVVVCGNCQTVLCQPTGGRARLTEGCSFRKKGD

SEQ ID NO: 159729 - protein, 130 aa, Glycine max
  Coding DNA Sequence Number=SeqID_68044
MAAQARQVFYVQDPCDSRWSVVLQGRTICIGDHSDGSTLDVNDMPPFAQQMPFINGEDQDDDVHANHNEGQQKDNPSVKYGIDATTWVEFAKIRQIPNWQEYGKRPRKYKNTMTVPTYCLVGVMICLKRN

SEQ ID NO: 159730 - protein, 118 aa, Glycine max
  Coding DNA Sequence Number=SeqID_68045
  Homolog annotation: Hit_ID=Q9FKM4; Match level="QueryCoverage=75%, HitCoverage=13%, E-value=6e-32, Identity=74%"; Hit description =Arabidopsis thaliana genomic DNA, chromosome 5, P1 clone:MUA2
MSDEINKQQELVEGFKKTKDPSSTDLTSALEGLNVTTLPPLKVTQSTQINVEGFERNYNGVEFGHEQASIGEAFEGFNDAWGGGLDPFEFGKKEKGLDNTVVVIGDDGSMVVVVSVGE

SEQ ID NO: 159731 - protein, 570 aa, Glycine max
  Coding DNA Sequence Number=SeqID_68046
  Gene Ontology: Mol. function=calcium ion binding; Cellular component =mitochondrial inner membrane; Biological process=transport
  Homolog annotation: Hit_ID=A7PA49; Match level="QueryCoverage=98%, HitCoverage=100%, E-value=1e-154, Identity=52%"; Hit description =Chromosome chr14 scaffold_9, whole genome shotgun sequence
  Pfam annotation: Domain name=Mito_carr; Domain location=296-383; Score=109.8; E_value=8.1e-30; Accession=PF00153.18; Description =Mitochondrial carrier protein
  Pfam annotation: Domain name=Mito_carr; Domain location=393-484; Score=109.1; E_value=1.4e-29; Accession=PF00153.18; Description =Mitochondrial carrier protein
  Pfam annotation: Domain name=Mito_carr; Domain location=491-569; Score=77.1; E_value=5.6e-20; Accession=PF00153.18; Description =Mitochondrial carrier protein
  Pfam annotation: Domain name=efhand; Domain location=232-260; Score =25.3; E_value=0.00023; Accession=PF00036.23; Description=EF hand
  Pfam annotation: Domain name=efhand; Domain location=27-55; Score =12.2; E_value=0.89; Accession=PF00036.23; Description=EF hand
  Pfam annotation: Domain name=efhand; Domain location=63-91; Score =26.4; E_value=0.00011; Accession=PF00036.23; Description=EF hand
  Pfam annotation: Domain name=efhand; Domain location=94-122; Score =13.7; E_value=0.62; Accession=PF00036.23; Description=EF hand
  Pfam module annotation: Pfam domain module=Mito_carr::Mito_carr::Mito_ carr::efhand::efhand::efhand::efhand; Domain location=296-383::393 -484::491-569::232-260::27-55::63-91::94-122
MKKVASGVTMDHVLLASQETKEAREARIRSLFDFFDRENLGFLDYSHIEAGLSALQIPAEYKYAKDLLNACDANKDGRVDFQEFRKYMDDKELELYRIFQAIDVAHNGCILPEELWEALVRAGIVGGWRSMAKIVVMSKNDGDRDPQLTSDITEIVMGTILLSRAVNYKFNKKKADFNQVVVQAGIKCSSQVIRKIGVLATFADVECVWFPVEIPTFQDEKVEASIKIDDEELARFVERVDKDNNGVITFQEWRDFLLLYPHEATIENIYHYLERMCMVDIGEQTVIPAGIGKHIHASRYLIAGGVAGAASRTATAPLDRLKVVLQVQTTRAQIMPAIKDIWKEGGLLGFFRGNGLNVLKVAPESAIRFYSYEMLKTFIVRAKGEEAKAADIGAMGRLLAGGIAGAVAQTAIYPMDLVKTRLQTYACKSGRIPSLGTLSKDIWVQEGPRAFYRGLIPSLLGIIPYAGIDLAAYETLKDMSKQYILHDGEPGPLVQLGCGTVSGALGATCVYPLQAQRSYKGMADVFRKTLEHEGLRGFYKGIFPNLLKVVPSASITYMVYESMKKNLDLE

SEQ ID NO: 159732 - protein, 236 aa, Glycine max
  Coding DNA Sequence Number=SeqID_68047
MVAHSSLRIEISQAIYLLSQRGSLLGLTHSTVAHSSLRIETSQAIYLLSQRGSLLGLSHPMVAHSSLRIETSQAIYLLSQRGSLLGLSHPMVAHSSLRIETSQAIYLLSQRGLLKLEDRNFSSYLSSLSERLSTWIDSLYGDSLKLEDKDFPSYLSSLLERLFLTLRNGFTLAWMDRNEGSYPYLYYSTSTMNGGDYLYPRVETNSLECSTHSRSLYTLLLSSILFHKVPEGFTHL

SEQ ID NO: 159733 - protein, 169 aa, Glycine max
  Coding DNA Sequence Number=SeqID_68048
MEILPLYKKIVGLQGCVYKIDSLYGGSLKLEDRDFPSYLSSLSERLSTWIDSFYSGSLKLEDRDFPSNLSSLSERLSTWIESPYGGSLKLEDRDFSSYLSSLSERLTQRDSILGLTHSTVAHSSLRIETSQAIYLLSQKGSLLKKWIHSCLGWIGMKAPTLIYTTPPPQ

SEQ ID NO: 159734 - protein, 61 aa, Glycine max
  Coding DNA Sequence Number=SeqID_68049
MALHESHHRGREDPHGANNSAYFHSQQRPIRLDKRVFNVGKTRSQKYKTETYNTDWRFVVP

SEQ ID NO: 159735 - protein, 553 aa, Glycine max
  Coding DNA Sequence Number=SeqID_68050
  Gene Ontology: Mol. function=transferase activity, transferring groups other than amino-acyl groups; Cellular component=cellular _component; Biological process=flavonoid biosynthetic process
  Homolog annotation: Hit_ID=P51075; Match level="QueryCoverage=68%, HitCoverage=95%, E-value=0.0, Identity=88%"; Hit description =Chalcone synthase
  Pfam annotation: Domain name=ACP_syn_III; Domain location=161-243; Score=1.3; E_value=0.00075; Accession=PF08545.1; Description=3 -Oxoacyl-[acyl-carrier-protein (ACP)
  Pfam annotation: Domain name=ACP_syn_III_C; Domain location=287-373; Score=-11.0; E_value=0.0002; Accession=PF08541.1; Description=3 -Oxoacyl-[acyl-carrier-protein (ACP)
  Pfam annotation: Domain name=Chal_sti_synt_C; Domain location=238 -388; Score=328.0; E_value=1.7e-95; Accession=PF02797.6; Description =Chalcone and stilbene synthases, C-te
  Pfam annotation: Domain name=Chal_sti_synt_N; Domain location=2-228; Score=622.7; E_value=3.4e-184; Accession=PF00195.10; Description =Chalcone and stilbene synthases, N-te
  Pfam annotation: Domain name=Collagen; Domain location=418-477; Score= -30.7; E_value=0.016; Accession=PF01391.9; Description=Collagen triple helix repeat (20 copies)
  Pfam module annotation: Pfam domain module=ACP_syn_III::ACP_syn_III _C::Chal_sti_synt_C::Chal_sti_synt_N::Collagen; Domain location=161 -243::287-373::238-388::2-228::418-477
MVTVEEIRNAQRSHGPATILAFGTATPSNCVSQADYPDYYFRITNSEHMTDLKEKFKRMCEKSMIKKRYMHLTEEFLKENPNMCEYMAPSLDVRQDVVVMEVPKLGKQAATKAIKEWGQPKSKITHLVFCTTSGVDMPGADYQLTKLLGLRPSVKRLMMYQQGCFAGGTVLRLAKDLAENNKGARVLVVCSEITAVTFRGPSDTHLDSLVGQALFGDGAAALIIGSDPDPAVERPIFEMISAAQTILPDSDGAIDGHLREVGLTFHLLKDVPGIISKNIEKSLVEAFEPIGISDWNSIFWIAHPGGPAILDQVEEKLRLKPEKLQSTRHVLSEYGNMSSACVLFILDEMRKKSKEEGKSTTGEGLEWGVLFGFGPGINHADAVTSDLRVINKEPSEIPGKRLPKGRVHRKGDTLQHLGRALRTGTTGASGRVGDSGATGRAGDPGATGRAGDPSATQLARPVAPGSPTRPDAPAAAALPVAPFAVDDRDGEQVAQVRDKGILAGEGDRSRKTHRERDVHGRRILVGDILLPRRQEPRGQLRLRLRLREWLRQR

SEQ ID NO: 159736 - protein, 172 aa, Glycine max
  Coding DNA Sequence Number=SeqID_68051
MLMCNEQYSCVGPIELLCTIIRTPDVILNLLQSTITPTHDALMYYNGKWNIPRQGQFLGYSFTRTNPIRFGIPSGCSMDKLKDLIKQVAPIGNSRITIVIQGGSKAACGGAIRNSMDLWLTSFTFNLGSCTVLRAELMGILSRLKLAWEKDFRNTIWLESDYVTVNKLILDT

SEQ ID NO: 159737 - protein, 260 aa, Glycine max
  Coding DNA Sequence Number=SeqID_68052
  Gene Ontology: Mol. function=ammonium transmembrane transporter activity; Cellular component=integral to membrane; Biological process=transport
  Homolog annotation: Hit_ID=A5C3C2; Match level="QueryCoverage=25%, HitCoverage=11%, E-value=2e-10, Identity=57%"; Hit description =Putative uncharacterized protein
MLFPEFGSIAAGMSGEVFDGQDAGYVPENPVSWLTMINEETLKKLCFNTLVVAVVAGPWPAPVAQMILLGLQEVADIIRLLFSDNSNRRLMHEGDLDSGDVPSSLASLVPIVIAALQIEEENPRVAYLWLMQSWDAIVMGILSGSIPWVTMMILPKKSTLLQKMDWVQMDRCRVAALLPSIKEKQLESHSNCVRHDRENQGLDKGNMAEIDGYQNLFGLMKQRFLSFKNQKYIKELEHFQALAEAQFPKVIIDLPSPFSI

SEQ ID NO: 159738 - protein, 110 aa, Glycine max
  Coding DNA Sequence Number=SeqID_68053
  Gene Ontology: Mol. function=nucleoside-triphosphatase activity; Biological process=protein metabolic process
  Homolog annotation: Hit_ID=Q39889; Match level="QueryCoverage=41%, HitCoverage=5%, E-value=1e-11, Identity=78%"; Hit description=Heat shock protein
  Pfam annotation: Domain name=Clp_N; Domain location=10-58; Score =15.8; E_value=0.02; Accession=PF02861.11; Description=Clp amino terminal domain
MNLMKAIKRAQGAQKSCGNTHLAIDQLILGILEDSQIRELLKEAGVARLMKLILYFPVLQEDPAFHAISRLIAEFEYHLCLIHTKFDACLMLHPGSIGVLTREMENNPEV

SEQ ID NO: 159739 - protein, 60 aa, Glycine max
  Coding DNA Sequence Number=SeqID_68054
MGVQEKRGGEGEYCNSKGKNEGEGSGVSEQGVHLMVEEGRGEPCDTEWKKASESITGKTS

SEQ ID NO: 159740 - protein, 87 aa, Glycine max
  Coding DNA Sequence Number=SeqID_68055
MVAQGMVVATQESNVGGSTGGREGKMKLERWKGKEDSGVGWGSGKGKCEEGERFWLEKKRGGEVGKEERWRSGKDNMEKGEGFRVKK

SEQ ID NO: 159741 - protein, 58 aa, Glycine max
  Coding DNA Sequence Number=SeqID_68056
MGEEEKKPEENKVGEKKAKEEQKKEEEKKLEESKDDKESKEESALSEIMQGITFAHWC

SEQ ID NO: 159742 - protein, 85 aa, Glycine max
  Coding DNA Sequence Number=SeqID_68057
  Homolog annotation: Hit_ID=A2Q5Z6; Match level="QueryCoverage=75%, HitCoverage=21%, E-value=8e-07, Identity=44%"; Hit description =Phosphoglycerate/bisphosphoglycerate mutase
MNAKRREDKVGVLPRRRILMRHGKSQRNRGTPAYTTTPDHSIQSTVQGMTQAFRVVEHLCRVMDTTVAPQTSGCSFMCPPTPTPD

SEQ ID NO: 159743 - protein, 72 aa, Glycine max
  Coding DNA Sequence Number=SeqID_68058
MDHSSSIQNVLPIPSPCPLDTSHQNVSEVPSSPPHSTDVGPPVLEGSPHDFHSPSITPQAMDPAISPSSDSD

SEQ ID NO: 159744 - protein, 142 aa, Glycine max
  Coding DNA Sequence Number=SeqID_68059
  Gene Ontology: Mol. function=aspartic-type endopeptidase activity; Biological process=DNA integration
  Homolog annotation: Hit_ID=Q6L3N8; Match level="QueryCoverage=44%, HitCoverage=4%, E-value=2e-09, Identity=53%"; Hit description =Putative gag-pol polyprotein, identical
MDIIRSKPSCSLADEEVLENRLAWLRIVDLPLNVWSKQCFQQVVATVRTLITIDESIESLATLEFTRVCIQTYCLDSICKNIKFWSLKMKTLFKSQELWGFVEDGFEDAQPPEPDQQLREKRKKDSKALFMYNRPWMMKSFP

SEQ ID NO: 159745 - protein, 41 aa, Glycine max
  Coding DNA Sequence Number=SeqID_68060
MKQHDQSLLNQGSKSPDHVCLWRKQKLADEADPIMLDVVEL

SEQ ID NO: 159746 - protein, 344 aa, Glycine max
  Coding DNA Sequence Number=SeqID_68061
  Gene Ontology: Mol. function=transcription factor activity; Cellular component=nucleus; Biological process=regulation of transcription, DNA-dependent
  Homolog annotation: Hit_ID=A5BDJ3; Match level="QueryCoverage=69%, HitCoverage=64%, E-value=2e-29, Identity=36%"; Hit description =Putative uncharacterized protein
  Pfam annotation: Domain name=AP2; Domain location=127-178; Score =80.2; E_value=6.8e-21; Accession=PF00847.11; Description=AP2 domain
MLQVHHQVYSEREKRPIYCVHRNKTIEKPFIELNKVDRRHGKRPFPSDHASREEREGFNFSVLPSPPKSQGEEASQFSFIHPINNTSDDSTPSTPIPQYGQISNSCLIETQDPSQQPLNQGGNGRKRHYRGVRQRPWGKWAAEIRDPKKAARVWLGTFDTAEAAAAAYDAAALKFKGSKAKLNFPEHVLVPPPPISSSPYNNNHQNNHSYCYGSSALAPPPPLPLPSSQHVYDQPQQPLLSSSSQEEGFPNLMQYAQLLWSRDDDDLQRVASGLHHQQHHHHHHHPNEAFYDSSSSTLFSSSSTTSSMAVSDQQQIGDDTSTAPKRGEYYDSCFFRGNDFHDKN

SEQ ID NO: 159747 - protein, 84 aa, Glycine max
  Coding DNA Sequence Number=SeqID_68062
MKKKKKEGNTFGAIEGYDSDTVLMNRALHKFFGHSGKCSQRKGRLQLAYMKPESLVIDCMKEETKRIKGKEEKIEEEKDGERED

SEQ ID NO: 159748 - protein, 98 aa, Glycine max
  Coding DNA Sequence Number=SeqID_68063
  Homolog annotation: Hit_ID=Q7X9K2; Match level="QueryCoverage=33%, HitCoverage=25%, E-value=2e-08, Identity=84%"; Hit description =Pyrophosphate-dependent phosphofructo-1-kinase
MAVGLSKDDIESRKSNRYIPFYRITQGQNKVLITNRMWARLLSSTNLPSFTIAKTVSLKKKGKKKQTVMSLTLAGMSTEYLIYGFSKGGLDDIRKLGI

SEQ ID NO: 159749 - protein, 560 aa, Glycine max
  Coding DNA Sequence Number=SeqID_68064
  Gene Ontology: Mol. function=lithium ion binding; Cellular component =integral to membrane; Biological process=calcium ion transport
  Homolog annotation: Hit_ID=Q9FKP2; Match level="QueryCoverage=85%, HitCoverage=85%, E-value=1e-101, Identity=45%"; Hit description =Na/Ca,K-exchanger-like protein
  Pfam annotation: Domain name=Na_Ca_ex; Domain location=106-240; Score= 103.1; E_value=8.8e-28; Accession=PF01699.15; Description =Sodiumcalcium exchanger protein
  Pfam annotation: Domain name=Na_Ca_ex; Domain location=408-551; Score= 76.2; E_value=1.1e-19; Accession=PF01699.15; Description =Sodiumcalcium exchanger protein
  Pfam module annotation: Pfam domain module=Na_Ca_ex::Na_Ca_ex; Domain location=106-240::408-551
MGFTLFLNTSFLVIVFCVSLIVPFHSSSEHVVLRSNRVGLRGEEQDCKSFHSLEDSKAKCLYLKSNDPCVSQGYVDYLYLFYCKFGGFPLLGHSLLFLWLLVLFYLLANTASEYFCPSLDNLSKLLRLSPTIAGVTLLSLGNGACDVFATLVSFKGSGTRDIGFNTVLGGASFVSCVVVGIVSIAIRHRGIRVKKWDLVRDVCFLLLVLLCLLTILIAGEINVPGAIGFCLMYVVYVVVVYVLSTRGNKGVCGDADGEIGCDLNHGGGSDLSVPMLSGMEKGLVNGAQECNMKIERKRCCLQSSMCSMLLFVLEMPLYLPRRLTIPGVCEERWSKVYAVCSAMLAPLLLSFLWIPNHLNGFNSIIVYGIGLLIGIILGVIAFFTTNVSNPPRKYLLPWLAGGFVMSVTWSYISAQELVGLLVSLGYICGVSPSILGLTVLAWGNSLGDLVTNLTMALNGGPEGAQIAISGCYAGPIFNIVVGLGLSLVSSSWSEYPLSVVITRDPYLWETLALLGVGLVWALVVLIRRDMKLDALLGGGLLLLATDITFCAGAILCNHDR

SEQ ID NO: 159750 - protein, 61 aa, Glycine max
  Coding DNA Sequence Number=SeqID_68065
MKEKEKRGMNVGFDPDFSGPWTSNRIADSTQAFCGIESNDPSITLANHHNPDSTWREFPSA

SEQ ID NO: 159751 - protein, 225 aa, Glycine max
  Coding DNA Sequence Number=SeqID_68066
  Homolog annotation: Hit_ID=A5B6K0; Match level="QueryCoverage=97%, HitCoverage=28%, E-value=4e-18, Identity=27%"; Hit description =Putative uncharacterized protein
  Pfam annotation: Domain name=zf-C2HC_plant; Domain location=18-73; Score=42.0; E_value=2.2e-09; Accession=PF07567.3; Description =Protein of unknown function, DUF1544
MLNSEGSSLFKPTGDRVDAFWKWNSLKDKNNRKSVTCDFCHKTTTRGISRAKRHQLQIKGDVGSCKKVPEDVKLEMIAAYEKKIAETAAYMEAMQEEDEEEEDGILEIARLKSGKKRPTTSNEASSTASNKRITTKKGPIDFLFSKAPKESIKLRKTMRQSSVNETYNKAARDRAVQYIARFFFRNGIPFNVAKSKSLKLMIEAIGTYGPHLKPPSYHEIESSTP

SEQ ID NO: 159752 - protein, 268 aa, Glycine max
  Coding DNA Sequence Number=SeqID_68067
MNAVVAFVGLPSPFLVLVLLLPPKPSDPGAPVLALCQPGFRSLVFGTMDIGWRWQVIDGEESLGKKFFGLKEALCASGRTCSQCRTGSCAVAIEGGKGTFGKVLLFILKNQQKELRGAAMTPSDGGVETNDEELVVKRGDRGPMVEENRDRGGPENDNGDEPETLPELASEVVGPVPHAAQSGPRRKTVQNRLRGRGEKETTRIVGHSETSIGAMPTLDHPCRRRLWERLDGLQSFQAKDKVVDLGGHVDLRVGESSNGVFDTVYVGL

SEQ ID NO: 159753 - protein, 407 aa, Glycine max
  Coding DNA Sequence Number=SeqID_68068
MVRTRGLGRALGRVIGRALGREDRHDSDDAPQRRRPTTSARRQQGAVLVAEDELVLPADEPVVPTVDPVVASDEPMIDADVQDTGAEAVADEPEGFLGGPRDALVLTKYANHVAASVWSREACSCNWGLVAGTGVSPLIACSVDTSDQGLISSFVERWHRETSSFHLPIEEERQLGPRQDIAMDHTYAYLGYEIYISANVKPDIGQLQLTGRYAWGAAALVHMYDHLNDACISSSRQLAVAECIVDPDYDEVSPRACRWIAMKKTGASTSPGVLVDFMLFRLAPLGARCCQTLTRKGEMCVVPGQCAPDYIDWFLVISHPFVAVAQPLDPPRDAPATHHAAFVEPHRPQEACQVIAERLERHLNLRIVTPGTKTHEIIEQCLRIARGVTEDRTVYVRSRRRRRTDQL

SEQ ID NO: 159754 - protein, 131 aa, Glycine max
  Coding DNA Sequence Number=SeqID_68069
  Homolog annotation: Hit_ID=A5BEV8; Match level="QueryCoverage=66%, HitCoverage=12%, E-value=2e-09, Identity=36%"; Hit description =Putative uncharacterized protein
MDEDQWMYESIMSEEADMEYQNEETCGVNEPYVDCSDALNTSQVFDSREDVLRWARSVAHENGFVAVIIRSDTNTDIRGRTLFVIIGYERSGKYRCRKKEFVRRNTGTRKCGCPFKFRGKPVVGRQGWMVK

SEQ ID NO: 159755 - protein, 111 aa, Glycine max
  Coding DNA Sequence Number=SeqID_68070
  Homolog annotation: Hit_ID=A2I5F0; Match level="QueryCoverage=41%, HitCoverage=24%, E-value=1e-12, Identity=78%"; Hit description =Polynucleotidyl transferase
MEDFPNAYVYCQQLKELFDQLKNVGAPVSNNCLVLQMVVDLTKAYNGATVNLGENVNVRIHDFDDVKKESNKAASKDKHCFEINTRLLNKALLQDFFKIKPCLKTKDFKVI

SEQ ID NO: 159756 - protein, 131 aa, Glycine max
  Coding DNA Sequence Number=SeqID_68071
MAKRPISSFRANTEIKLKEECKVIFTMRETAEKERRIKEDMRDEEGEKKKREEKIRVRRVVIRSQPLRPRPRAIIQKLPPKFKDPGSVTIPCSIGSVFVADDDAANVEANDDYVANINDAYRAWDLGPTQD

SEQ ID NO: 159757 - protein, 112 aa, Glycine max
  Coding DNA Sequence Number=SeqID_68072
MTDSNKFHAALAVSNIKNHISITLKIGNVQYVTWAELFNIHARYHKVLHHIVPPEKGKEKVPKTDKEKELWSTLDVVVLQWIYAIISHDLLHTILEPDAMTMEAGNRLRDIF

SEQ ID NO: 159758 - protein, 192 aa, Glycine max
  Coding DNA Sequence Number=SeqID_68073
MVLLNIHEESIKARGYIYLGLTENKRGYISCGSVLVEGTSTRFKENKGGYIPCGSLLKRHDPRRSWGTFDKEATFLGKTKQRKLKEARQTQGLPLVNLISLSNPRSALGESHFSKGSINPRFALALPLLSSASQELKEYKFAGISETQGPPLVQKPKVCPWYKNPRSILGTHSYKKPRHALGKLTPWELQQV

SEQ ID NO: 159759 - protein, 191 aa, Glycine max
  Coding DNA Sequence Number=SeqID_68074
  Gene Ontology: Mol. function=nutrient reservoir activity; Cellular component=extracellular region; Biological process=cell wall organization and biogenesis
  Homolog annotation: Hit_ID=Q9SC38; Match level="QueryCoverage=89%, HitCoverage=87%, E-value=2e-63, Identity=68%"; Hit description =Germin-like protein
  Pfam annotation: Domain name=Cupin_1; Domain location=37-188; Score =151.7; E_value=2e-42; Accession=PF00190.13; Description=Cupin
  Pfam annotation: Domain name=Cupin_2; Domain location=72-150; Score =36.8; E_value=7.9e-08; Accession=PF07883.2; Description=Cupin domain
  Pfam module annotation: Pfam domain module=Cupin_1::Cupin_2; Domain location=37-188::72-150
MTKWNASPIELSVKNGLVYVNGKFCKHPNLTIPEDFFRHVEPGSTANQLGLGLSPVNVAQLPGLNTLGVSMSRIDYAPKGLNPPHTHPRGTEMLMVMEGTLFVGFVSSNQDNNRLFSKVLNKGDVFVFPIGLIHFQYNVGKGNAVAITAFSSQNAGVIGISSAVFLSTPPIPSEILAKGFQVGQNVIDEFR

SEQ ID NO: 159760 - protein, 168 aa, Glycine max
  Coding DNA Sequence Number=SeqID_68075
  Subcellular localization annotation: CTP_CleavageSite=42; ConfidenceScore=5.14e-01
MLSPAKPNSSSLDSPLSPKTRLWRFTDSKAYSIKSGYSQVIKKMIVEGPINRGLSPFKPNPKSWVRPREGVIKANFDASLKQNHGTGLGVVFRDHYGEVLSVGSVLLPNCYEAHIVEVITFRGVAKMTVNLSFGLIQFKSDFQRLVQTWKNKDSTGNNYLDNVIKETL

SEQ ID NO: 159761 - protein, 815 aa, Glycine max
  Coding DNA Sequence Number=SeqID_68076
  Gene Ontology: Mol. function=catalytic activity; Cellular component =nucleus; Biological process=metabolic process
  Homolog annotation: Hit_ID=A7PA26; Match level="QueryCoverage=98%, HitCoverage=98%, E-value=0.0, Identity=68%"; Hit description =Chromosome chr14 scaffold_9, whole genome shotgun sequence
  Pfam annotation: Domain name=PPR; Domain location=105-139; Score =45.6; E_value=1.7e-10; Accession=PF01535.11; Description=PPR repeat
  Pfam annotation: Domain name=PPR; Domain location=206-240; Score =39.1; E_value=1.6e-08; Accession=PF01535.11; Description=PPR repeat
  Pfam annotation: Domain name=PPR; Domain location=307-341; Score =24.5; E_value=0.0004; Accession=PF01535.11; Description=PPR repeat
  Pfam annotation: Domain name=PPR; Domain location=408-442; Score =36.6; E_value=9e-08; Accession=PF01535.11; Description=PPR repeat
  Pfam annotation: Domain name=PPR; Domain location=43-77; Score=1.0; E_ value=6; Accession=PF01535.11; Description=PPR repeat
  Pfam annotation: Domain name=PPR; Domain location=443-477; Score=7.3; E_value=1.1; Accession=PF01535.11; Description=PPR repeat
  Pfam annotation: Domain name=PPR; Domain location=509-543; Score =44.1; E_value=5e-10; Accession=PF01535.11; Description=PPR repeat
  Pfam annotation: Domain name=PPR; Domain location=544-577; Score =10.5; E_value=0.44; Accession=PF01535.11; Description=PPR repeat
  Pfam annotation: Domain name=PPR; Domain location=580-614; Score =15.2; E_value=0.12; Accession=PF01535.11; Description=PPR repeat
  Pfam annotation: Domain name=PPR; Domain location=647-681; Score=2.2; E_value=4.3; Accession=PF01535.11; Description=PPR repeat
  Pfam module annotation: Pfam domain module=PPR::PPR::PPR::PPR::PPR::PP R::PPR::PPR::PPR::PPR; Domain location=105-139::206-240::307-341::408- 442::43-77::443-477::509-543::544-577::580-614::647-681
MNLIKSCTRKTHLHNLGTLTSPKRHFQHVDASMIKTGFDPNTCRFNFQVQTHLQRGDLGAARKLFDEMPHKNVISTNTMIMGYLKSGNLSTARSLFDSMVQRSVVTWTMLIGGYAQHNRFLEAFNLFADMCRHGMVPDHITLATLLSGFTEFESVNEVAQVHGHVVKVGYDSTLMVCNSLLDSYCKTRSLGLACHLFKHMAEKDNVTFNALLTGYSKEGFNHDAINLFFKMQDLGFRPSEFTFAAVLTAGIQMDDIEFGQQVHSFVVKCNFVWNVFVANALLDFYSKHDRIVEARKLFYEMPEVDGISYNVLITCCAWNGRVEESLELFRELQFTRFDRRQFPFATLLSIAANSLNLEMGRQIHSQAIVTDAISEVLVGNSLVDMYAKCDKFGEANRIFADLAHQSSVPWTALISGYVQKGLHEDGLKLFVEMHRAKIGADSATYASILRACANLASLTLGKQLHSRIIRSGCLSNVFSGSALVDMYAKCGSIKEALQMFQEMPVRNSVSWNALISAYAQNGDGGHALRSFEQMIHSGLQPNSVSFLSILCACSHCGLVEEGLQYFNSMTQVYKLEPRREHYASMVDMLCRSGRFDEAEKLMARMPFEPDEIMWSSILNSCRIHKNQELAIKAADQLFNMKGLRDAAPYVSMSNIYAAAGEWDSVGKVKKALRERGIRKVPAYSWVEIKQKTHVFSANDTSHPQTKEITRKLDELEKQMEEQGYKPDSTCALHNVDEEVKVESLKYHSERIAIAFALISTPKGSPILVMKNLRACNDCHAAIKVISKIVNREITVRDSSRFHHFTDGSCSCKDYW

SEQ ID NO: 159762 - protein, 187 aa, Glycine max
  Coding DNA Sequence Number=SeqID_68077
MQFLGFNVTPHILAEANVNFGKVNPIIPMPQSFLIGFNDDQDIEGFSLDCSNKEDTIIDKEDVGNLGALGQTFIVLTINKHGERCGSYASIDHTAPFLGKSPLSTTLSDTHVVKAFESNQGIKTTSDKICFNLLAMVFVTILKMTLQRLIRWNFVVHLVKGIPNFLSKELPVKGRTMALRHPPNNQR

SEQ ID NO: 159763 - protein, 106 aa, Glycine max
  Coding DNA Sequence Number=SeqID_68078
MDEDQWRYDYAMSQEVHMDYDYDNEEECGVNGPHVDCSNAFNTFQVFGTRDDVLQWARTVAHENGFVAVIMRSDTETSSKGRRIKNLLEKTLGVGNVVVPSGFMGN

SEQ ID NO: 159764 - protein, 90 aa, Glycine max
  Coding DNA Sequence Number=SeqID_68079
MDIDEDKDCMENNSYDDHLLASEIMFSFPIRFRYNLAFLQDLRDLQCKLLTVSCQLSLDNWVTNSHMLISLNQLILPRLALLFLAGPKPG

SEQ ID NO: 159765 - protein, 40 aa, Glycine max
  Coding DNA Sequence Number=SeqID_68080
MALDALNITKLPGHPIWKIRPHVRIAPDEAREKGLLGKRK

SEQ ID NO: 159766 - protein, 186 aa, Glycine max
  Coding DNA Sequence Number=SeqID_68081
  Homolog annotation: Hit_ID=A5BK17; Match level="QueryCoverage=29%, HitCoverage=3%, E-value=5e-09, Identity=60%"; Hit description =Putative uncharacterized protein
MAAPLYSHWVVVKRILMYLKGTLFHGLLLQPALITKPLVLRAFCDADWASNVDDRSDWWRFGWVWVEGGSSDWGDSVGVWLVIMDWLPRVWKREICDAMRKGVGHEGLEIAREKCFFPLSAAIFFISTPFKKGYLDFSLTPLLDRDGQGVGGITLPIMRKALLQARDGRKHILGKVKTLTSWWYDL

SEQ ID NO: 159767 - protein, 312 aa, Glycine max
  Coding DNA Sequence Number=SeqID_68082
  Gene Ontology: Mol. function=hydroxymethyl-, formyl- and related transferase activity; Cellular component=chloroplast; Biological process='de novo' IMP biosynthetic process
  Homolog annotation: Hit_ID=Q7XJ86; Match level="QueryCoverage=100%, HitCoverage=100%, E-value=1e-145, Identity=85%"; Hit description =Glycinamide ribonucleotide transformylase
  Pfam annotation: Domain name=Formyl_trans_N; Domain location=102-284; Score=233.3; E_value=5.4e-67; Accession=PF00551.10; Description =Formyl transferase
  Subcellular localization annotation: CTP_CleavageSite=78; ConfidenceScore=5.70e-01
MSMEAQQILSRFCPKPSSVPSIPIVKQQFSPKFPRLPSSSLYPSSQSQNLNVPSGAFHPISIVHKEVCSSSCKRIWCSSSSSSTAEPKEGHEVRAQVTVRRKKLAVFVSGGGSNFRAIHEASKRGSLHGDVLVLVTNKSDCGGAEYARNNGIPVILYHISKDESNPSDLVDTLRKFEVDFILLAGYLKLIPVELIRAYKRSIFNIHPSLLPAFGGKGFYGMKVHKAVIASGARFSGPTIHFVDEHYDTGRILAQRVVPVLANDTVEELAARVLKEEHQLYVEVVEALCEERVVWRQDGVPLIQSKENPNEFR

SEQ ID NO: 159768 - protein, 616 aa, Glycine max
  Coding DNA Sequence Number=SeqID_68083
  Gene Ontology: Mol. function=nucleotide binding; Cellular component =cytoplasm; Biological process=meiosis
  Homolog annotation: Hit_ID=A7Q869; Match level="QueryCoverage=99%, HitCoverage=99%, E-value=0.0, Identity=54%"; Hit description =Chromosome undetermined scaffold_62, whole genome shotgun sequence
  Pfam annotation: Domain name=ATP_bind_4; Domain location=1-190; Score= 29.5; E_value=3.4e-10; Accession=PF01902.8; Description=ATP-binding region
  Pfam annotation: Domain name=Ribonuc_L-PSP; Domain location=333-436; Score=3.2; E_value=1.4e-05; Accession=PF01042.12; Description =Endoribonuclease L-PSP
  Pfam module annotation: Pfam domain module=ATP_bind_4::Ribonuc_L-PSP; Domain location=1-190::333-436
MKVVALVSGGKDSCYAMMKAIHYGHEIVALANLMPLDDSVDELDSYMYQTELGYKETQGDEVEDLCILLREVKRQIPSVSAVSSGAIASDYQRLRVESVCSRLGLVSLAYLWKQDQSLLLQEMITNGIVAVTVKVAAMGLDPAKHLGKELAFLNAYLHKLKEYNARIVLDEYQVVMHSSDSIAPVGILHPLAFHLENKADVQYLKSQDKIHESFTQKLGSVFEVQDSVEGCEATCKPEDLKIVLGKIESQLLGLGFGWENVLYIHLYIDDMNNFSEANETYVKFITQEKCPFGVPSRSTVEMPLIEMGFSRAYIEVLVANNKDKKVLHVQSISSWAPSCIGPYSQATLHEGILHMAGQLGLDPPTMNLCKGGPGVELEQALKNSEAEKQETILRQMKISHLQERTTYKALDPLFLYVLVPDLPKRAYVEVKPILYVEDDTDVAFEVVTERFCLETPPSYWGFKPENWHDSCTQKCVISGKTCAIILSITSELAAKICFDSLPAEYVNNGQHSLPKAHMEKISKFCIYLLDKVMTDDDFAWEDIMSLRFYIPVSLQMSVQLLQPMFCNALFELSEMSQKKLKTGEEPIFNIVPVIGSGRSASSMDDVVTCELMAQKS

SEQ ID NO: 159769 - protein, 57 aa, Glycine max
  Coding DNA Sequence Number=SeqID_68084
MLKLKNKIWTLQKRVCCVSVLRLCRTPKHLCQPLCPGFIGCDNLSYIPMTSNFYSSS

SEQ ID NO: 159770 - protein, 301 aa, Glycine max
  Coding DNA Sequence Number=SeqID_68085
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=Q2HVC7; Match level="QueryCoverage=55%, HitCoverage=48%, E-value=1e-66, Identity=76%"; Hit description=HRDC; Polynucleotidyl transferase, Ribonuclease H fold
  Pfam annotation: Domain name=HRDC; Domain location=113-183; Score =56.2; E_value=1.1e-13; Accession=PF00570.14; Description=HRDC domain
MAFVKSFMTYEARTPHPLAVSGCPTRVRVCVRHDTDTDKYGREDTHYLLYIYDLMRIKLFALSKESEGSDNPLLEVYKRSYDVCMQLYEKELLKEDSYLHIWGLRGAGFNAQQLAVVSGLWEWRDGLARADDEGPGYVLPNRIILEIANQMPVIISNLRRIVGRTKHPYVERSLDVIVNIVRHSMQNAAAFEEAALRLKEEHAASLSNVIPVKDGTEVPHTLQKDGCAARGSMGIENGSCVDITQNCMLSYDQEEKSFQHQVEDGLSDCLNSDLLRVSPTIPYKNRDNANVIVLSTAKVVK

SEQ ID NO: 159771 - protein, 527 aa, Glycine max
  Coding DNA Sequence Number=SeqID_68086
  Gene Ontology: Mol. function=protein binding; Cellular component =plasma membrane; Biological process=cytoskeletal anchoring
  Homolog annotation: Hit_ID=A7QRI7; Match level="QueryCoverage=88%, HitCoverage=81%, E-value=0.0, Identity=67%"; Hit description =Chromosome chr8 scaffold_150, whole genome shotgun sequence
  Pfam annotation: Domain name=Ank; Domain location=172-204; Score =33.9; E_value=5.6e-07; Accession=PF00023.21; Description=Ankyrin repeat
  Pfam annotation: Domain name=Ank; Domain location=205-237; Score =18.7; E_value=0.022; Accession=PF00023.21; Description=Ankyrin repeat
  Pfam annotation: Domain name=Ank; Domain location=238-270; Score =17.6; E_value=0.048; Accession=PF00023.21; Description=Ankyrin repeat
  Pfam annotation: Domain name=Ank; Domain location=271-303; Score =38.9; E_value=1.9e-08; Accession=PF00023.21; Description=Ankyrin repeat
  Pfam annotation: Domain name=Ank; Domain location=305-337; Score =39.8; E_value=1e-08; Accession=PF00023.21; Description=Ankyrin repeat
  Pfam annotation: Domain name=Ank; Domain location=338-391; Score=5.9; E_value=4.6; Accession=PF00023.21; Description=Ankyrin repeat
  Pfam annotation: Domain name=Ank; Domain location=392-424; Score =40.8; E_value=4.8e-09; Accession=PF00023.21; Description=Ankyrin repeat
  Pfam annotation: Domain name=Ank; Domain location=425-457; Score =45.7; E_value=1.7e-10; Accession=PF00023.21; Description=Ankyrin repeat
  Pfam annotation: Domain name=Motile_Sperm; Domain location=4-114; Score=14.4; E_value=0.0018; Accession=PF00635.17; Description=MSP (Major sperm protein) domain
  Pfam module annotation: Pfam domain module=Ank::Ank::Ank::Ank::Ank::An k::Ank::Ank::Motile_Sperm; Domain location=172-204::205-237::238 -270::271-303::305-337::338-391::392-424::425-457::4-114
MDRLIKVDPTNTVPIRIEPGQKCHGQITLRNVMYTMPVAFRLQSLIKTRYTLKPQSGIISPLSTVTIEILYNLPLGSTLPHSFPHSEDSFLLHSVVVPGATVKEPSSMFESVPSDWFTAKKKQVFIDSGIKIIFVGSLILAQLVHNGSIDEIREVLEHSEHTWKAVDSVDQNGDTLLHVAISKSRPDIVQLLLEFNADVESKNRTGETPLESACASGEELIVELLLAHKANTERTESSSLGAIHLSAREGRREVLRLLLLKGASVDSLTKDGYTALHLAVREGSRDCARLLLANNARTDIRDSRDGDTCLHVAAGVGDESMVKLLLNKGANKDVRNFNGKTAYDVAAEKGHARVFDALRLGDGLCVAARKGEVRSIQRLIEGGAVVDGRDQHGWTALHRACFKGRVEAVRALLERGIDVEARDEDGYTALHCAVEAGHADVAEVLVKRGVDVEARTNKGVTALQIAEALGYGGIARLLGAAAGHVAEGEQQSVLGEMKKEKKNKLGRRRREREIRGSFDRSMPLPVL

SEQ ID NO: 159772 - protein, 674 aa, Glycine max
  Coding DNA Sequence Number=SeqID_68087
  Homolog annotation: Hit_ID=A7QRH5; Match level="QueryCoverage=94%, HitCoverage=64%, E-value=0.0, Identity=64%"; Hit description =Chromosome chr8 scaffold_150, whole genome shotgun sequence
  Pfam annotation: Domain name=DUF639; Domain location=1-668; Score =852.9; E_value=1.6e-253; Accession=PF04842.3; Description=Plant protein of unknown function (DUF639)
MAMKLKYLSSIAEDVIKRCSQKLDTSVEKLVVDFEGGWHPEMGNYCRKLVEFCSGKAVSELCHNIEGNINDGSFSRLTYDMMLAWERPSYYDEEDTTENVAKEKEERKITLNTTQEQDDIPLFYSDIMPLLVNNEPNVGEDAFVWLGSLVPLVADVANGRFTFESLTAPTGNRLHFPAYDMFLKEMDKCIRHLQKHATPNGVELAEDEYILHVDGTASTQRVVRHIGSTSWPGRLTLTNYSLYFEASGVIRYEDALKIDLSKNIEQSVEPAATGPWGAQLYDKAIIYDSTDLSETVVLEFPELTSSTRRDHWLALVREIMFLHQFLSKYQIKCPIQTWELHARTILGIVRLQAAREMLRISPPVPTKFLIFSLYDEIPKGDYVLEELADSLKKGNNGQSCSASSILRSMNISKTVDSCIITDEASQADGSVNVVDDSPLLEAAIKQSREEEKEILIAKATTEKLKDEGVIDSVLVITELLKPLKHVVPWFQEIFTWERPIITLAVLAASLMIIYMEWVGKTFAAFLIWAIIKMLDARKKKIREKCYEIVISRSSMASDQSTMESIVSAQHGLYTIHDMMQIANIAMLKIWSILISKADKHANLVMVAMSGLAILLAVIPFKFFLMALILQSFTMTLGKSSGSGTGNRRLREWWDSIPIVPIRVVDDVPNTVDAK

SEQ ID NO: 159773 - protein, 46 aa, Glycine max
  Coding DNA Sequence Number=SeqID_68088
MMHAPDSTLRCNVGTMQSSSRPPDCARNYPSPIGDQPGSPKEFPTR

SEQ ID NO: 159774 - protein, 727 aa, Glycine max
  Coding DNA Sequence Number=SeqID_68089
  Gene Ontology: Mol. function=protein binding; Cellular component =nucleolus; Biological process=RNA metabolic process
  Homolog annotation: Hit_ID=Q67Z79; Match level="QueryCoverage=84%, HitCoverage=80%, E-value=1e-150, Identity=45%"; Hit description =Putative uncharacterized protein At5g17930
  Pfam annotation: Domain name=MA3; Domain location=529-635; Score =75.9; E_value=1.4e-19; Accession=PF02847.8; Description=MA3 domain
MKKHGNDSDSELETKSKSDTSVSPSVKVLKEAQVEKFESYSRKYETDEEYMLSEEERGGSVAKKKKKTKGSSKSSGKSMVEMGMQLVSIAAEKDLELERKLSKKLKVKEGKLRGVDDGLNIILDGMSSAFDFIMGEGEVPGTGELSAMRLKKSLSSKKDKLSNKRIKVEAVVAVSGHVETSDEDIESDDVPDSVPSRKKHKKRKVSGQQQKDNVEDDGVGMSKPVESCGKEVKLGDAPAEVPEKKAKEKYIAPHLRARAGNEPEEHTQIRRRVRGLLNRLSESNVESITGELSLIFQSVARSVASQILTEEVLASCSSGPRGNQQQFVELYFGFRGRYAAVFAAFVAGMACLVGVDFSAKADDPAAMKDFILSVQNTSNKLKASSEDDNEKKNSKRMEFMLEIICDIKNNKRKPNEDSAHHTRIKKWLRKGVSMTVEILGLLKDSVEFNSYDASSFRTDDLLRVDDILIRGLKWSKLLDPDKKGQWWLSGDVASSTGNVEEVANRIDKDVLETQRMLQLAAAQKMNTDARRAIFCIIMSGEDYLDAFEKLLRLELPGKQDRDIMRVLVECCLQEKVFNKYYTVLASKLCEHDKNHKFTLQFCLWDQFKDLESMPLMRSMHLAKFVAEMVASFTLSLSVLKTVDLNDITLLTPKRIMHFRILFEAILEYPENLVWNIFTRAAVTPELESFRQGLEFFIKEYIVKTNKDLTQKFKLAKRALNNVEGILM

SEQ ID NO: 159775 - protein, 59 aa, Glycine max
  Coding DNA Sequence Number=SeqID_68090
MGMFCSLLHLLANRPKRGVCFWRELASGVGELDMWQQLEKLASGDSETRSTWRVPSFVM

SEQ ID NO: 159776 - protein, 377 aa, Glycine max
  Coding DNA Sequence Number=SeqID_68091
  Gene Ontology: Mol. function=protein binding; Cellular component =membrane; Biological process=meiosis
  Homolog annotation: Hit_ID=A7PTQ1; Match level="QueryCoverage=77%, HitCoverage=83%, E-value=1e-106, Identity=64%"; Hit description =Chromosome undetermined scaffold_30, whole genome shotgun sequence
  Pfam annotation: Domain name=CDC50; Domain location=110-377; Score =348.8; E_value=9.2e-102; Accession=PF03381.6; Description=LEM3 (ligand-effect modulator 3) family  CDC50 family
  Pfam annotation: Domain name=zf-C3HC4; Domain location=6-51; Score =25.0; E_value=0.00013; Accession=PF00097.16; Description=Zinc finger, C3HC4 type (RING finger)
  Pfam module annotation: Pfam domain module=CDC50::zf-C3HC4; Domain location=110-377::6-51
MAKKNCRICQESGSATLIELECSCKHDLAFARKHCAEKWFSTRPDKICEICRSIARNVALQGAAETTTTLSERRNAPNNHVSEMQLPEWRNAISIFTVIGLIFIPVGLASLFASESVVEVPFRYDDECLPPDHKNDAVAYIKDVGSNKTCTKKLTVKNKMKAPVYVYYQLDNFYQNHRRYVKSRDDKQLRSKAAENDVGSCSPEDYTPNDMGHKPIVPCGLIAWSLFNDTYKLTSNNKDLVINKKNIAWKSDQNGKFGSDVYPKNFQAGGLIGGARLNESLPLSEQEDLIVWMRTAALPTFRKLYGKIETDIEVNDVVLVIENNYNTYEFGGRKSIVLSTTTWVGGRNNFLGMAYILIGGISLLLAAAFLLLYVMQP

SEQ ID NO: 159777 - protein, 631 aa, Glycine max
  Coding DNA Sequence Number=SeqID_68092
MKELALAYTPLRKWELSNLGFGHRALAYMPLAMGGTHWRNGNMLLHICHLSWVAHIGVVGARAYMSLILGGMYWSHQGDMLLHSHQGDTLLHVCHSSWVAHIGVMMLEEGLTKDGPWVLKALEVGCDPKGTFPVGAKLSCSGIFFDLTSDSPYEVARLEGSRLNLSIESSGCSNSLLVDGSPTSTGIIASVPYGPDDDSVSCLCVFVSLRMFDRGSIGAKTVKVVRRICTALVAREHPPDPTNQEAFVGAHPVWFLLFSDHNFLSIYGESLEHLLDDGLEVHSGIAFPGDVGNFETFKIIDERLRYVIVLEQHCFLSLALKLRLRACSRVILSGPPRMISAPFPFTLDAPLSQNLLDGVICLDYHLMTLEVGPESSAEVMNASATFNHLVALLGVMKHASGKVDRELVLPFLLSGGASGLGRLKTSDVAMLFMKARKACSQLTVELLDFLNVGGTVHLQYDSAFVEVGIIPFVHDHEAEELAATYPKSTFFKAEWHDLVAKDGIFSDECRFLLVQRMHSNLVVYGISVITAHSPFVVGLFDHDNAGEPNGKPDLSDEVYMEESTSSLTHVDDAPMLMTGELDKLFDWLQASIGGVISRIYVKFSTQTLGWEDMVLPSGSLHSTVVLAFGQH

SEQ ID NO: 159778 - protein, 229 aa, Glycine max
  Coding DNA Sequence Number=SeqID_68093
  Gene Ontology: Mol. function=aspartic-type endopeptidase activity; Biological process=RNA-dependent DNA replication
  Homolog annotation: Hit_ID=Q69F85; Match level="QueryCoverage=62%, HitCoverage=10%, E-value=5e-11, Identity=25%"; Hit description=Gag -pol polyprotein
MADTNTLQQLQNHITEMEQRHEEELTKLKVDYDQLEARVRRPQGDEQYIHTLPECNQGESHLQRTGNTAEDLSLFHMHAPAAQTANLYTNNNVILCRVFPTSFKGVALTWSHCMTLAALASLRQVNEESLKKFMDRFGCMVVQIQNLNPKVALHSMLLVLRPGKFRNEVRQAEQKRNKHEAHTKADSHKSNNMHKLDKSQPFSKGSRYERYTPLMTNHTIILEEAFNLE

SEQ ID NO: 159779 - protein, 91 aa, Glycine max
  Coding DNA Sequence Number=SeqID_68094
  Subcellular localization annotation: CTP_CleavageSite=83; ConfidenceScore=5.07e-01
MKLNGCAPALPAIEVKFSSSLNVLLKLKTCVQFQKKWNAPCDPFFKLNTNGSSMRNPGRSRFGGIIRNSLRHWISGYCGNVVTLQTSTQNF

SEQ ID NO: 159780 - protein, 87 aa, Glycine max
  Coding DNA Sequence Number=SeqID_68095
MTPSLETPTKLFVEIEMKTASSTFPCVRVNACVTDTSLNVALNGSGKCYKYLRHKPLEYVITVCSLINWLNLLLEIVVYHLRSCTKF

SEQ ID NO: 159781 - protein, 53 aa, Glycine max
  Coding DNA Sequence Number=SeqID_68096
MEASKMKFFLVLVVSVLAMAATGVSAAEAPAPEGFFFFEDALNWRFGVRKDDK

SEQ ID NO: 159782 - protein, 46 aa, Glycine max
  Coding DNA Sequence Number=SeqID_68097
MNRTREGSVDDDSQGRWRVNETSAGKGGRRGGAKRRRCSTSRDCKR

SEQ ID NO: 159783 - protein, 145 aa, Glycine max
  Coding DNA Sequence Number=SeqID_68098
  Gene Ontology: Mol. function=homoserine dehydrogenase activity; Cellular component=chloroplast; Biological process=aspartate family amino acid biosynthetic process
  Homolog annotation: Hit_ID=O63067; Match level="QueryCoverage=37%, HitCoverage=6%, E-value=1e-11, Identity=58%"; Hit description =Aspartokinase-homoserine dehydrogenase
MAARVSIRFGTKERRLLEYLESEQRLEKWYSLNPCKVIIAIGFIASTPQIIATGVLALTYIVFNSQQASGWTPSHEGQWENMDHLGTAMAVVGLVACRAYAVKKNSSVKRSSGLNVKIVSSGANCQQVRFFHQDGCVLIIRGIQK

SEQ ID NO: 159784 - protein, 308 aa, Glycine max
  Coding DNA Sequence Number=SeqID_68099
  Gene Ontology: Mol. function=1-acylglycerol-3-phosphate O -acyltransferase activity; Cellular component=integral to membrane; Biological process=phospholipid biosynthetic process
  Homolog annotation: Hit_ID=A9PGT0; Match level="QueryCoverage=40%, HitCoverage=35%, E-value=2e-36, Identity=49%"; Hit description =Putative uncharacterized protein
MDEHQQNWKEMTNIMVKINKESNEMFNIVHVIDQDELDPTRRLLHSSGNMHFVTYNQDFVSPTLLAGWTEFRDFYGLTENHQEPPRFDPITKCSTQDRSNQTIASDLDGTLLVSRSAFPYYFLVALEAGSVYFTYLVLSETLAIKTLIFITFTGLKLKDVELAVAKTFLGADTALGTELVVTASGRVTGLAKEAGVLVGVHKKEVILKEFGTWGQCNGHELLVDLQDMCPLRFILIFFSTMLAAYIAWTTVSSSPEIDVTSQDTENRASSNKDHFNFIKMIQNEFWVFVDMASGRYVWRNLKSRSQGI

SEQ ID NO: 159785 - protein, 49 aa, Glycine max
  Coding DNA Sequence Number=SeqID_68100
FCSGGGDKDYKEVPPPPLFKPAGGHINQAVTFNRSYYKVISSMEKWLSH

SEQ ID NO: 159786 - protein, 148 aa, Glycine max
  Coding DNA Sequence Number=SeqID_68101
  Gene Ontology: Mol. function=RNA polymerase II transcription factor activity; Cellular component=transcription factor TFIID complex; Biological process=transcription initiation from RNA polymerase II promoter
  Homolog annotation: Hit_ID=A3CIU0; Match level="QueryCoverage=82%, HitCoverage=46%, E-value=9e-62, Identity=97%"; Hit description=TATA -box-binding protein
  Pfam annotation: Domain name=TBP; Domain location=31-117; Score =150.7; E_value=4e-42; Accession=PF00352.12; Description =Transcription factor TFIID (or TATA-binding protein, TBP)
VCTGAKSEQQSKLAARKYARIIQKLGFPAKFKDFKIQNIVGSCDVKFPIRLEGLAYSHSAFSSYEPELFPGLIYRMKQPKIVLLIFVSGKIVLTGAKVRDETYTAFENIYPVLTEFRKNQQCYQNIIASDVGLRLLLSREQEQDLIEL

SEQ ID NO: 159787 - protein, 128 aa, Glycine max
  Coding DNA Sequence Number=SeqID_68102
  Gene Ontology: Mol. function=aspartic-type endopeptidase activity; Biological process=DNA integration
  Homolog annotation: Hit_ID=A5BTR2; Match level="QueryCoverage=66%, HitCoverage=4%, E-value=2e-24, Identity=65%"; Hit description =Putative uncharacterized protein
METVVVRRSHGGTWCNVRRGEEESECEREESWQHPHVSKSVNFSDIKCGIPKLKDDNYKVWKERVLLHLGWMDIDYTIRKEKPLAITETNTLVAVDLYEKWDRYNRLSMTFIKTNIFVCIRGSIVQPL

SEQ ID NO: 159788 - protein, 257 aa, Glycine max
  Coding DNA Sequence Number=SeqID_68103
NIGGVLQNVYFGHNFLKFLSIGDSSSIGSEESSDFSTYLNQLLERVADNIGKRPPSSEAAKTTVDSPNPSMKVMRQKCQHVLTEKKHTRLPFDDFTMDVLCALNVALFELHPNKWAAIQAFQALCLYTFVKATLGMFLHYFCRLSHKKARWGNRCSLFINNSVPIDMASRDEGVGEKALNVEASNKLNKEEMARLEVALDIVEREINARKKERLWIEHKAYNDVYEAHEFDFNHCLRQVLFHYEAPDESIFDINKDV

SEQ ID NO: 159789 - protein, 281 aa, Glycine max
  Coding DNA Sequence Number=SeqID_68104
  Gene Ontology: Mol. function=metal ion binding; Cellular component =nucleus; Biological process=negative regulation of transcription, DNA-dependent
  Homolog annotation: Hit_ID=A2Q5P5; Match level="QueryCoverage=99%, HitCoverage=100%, E-value=1e-126, Identity=79%"; Hit description =Zinc finger, FYVE/PHD-type
  Pfam annotation: Domain name=PHD; Domain location=226-276; Score =48.0; E_value=3.4e-11; Accession=PF00628.20; Description=PHD-finger
MAIARTGVYVDDYLEFRFAFVSEFSISTDASTLPAELQRLLNTVRELDDRSQSMITQTRQQTKYTMGFSSHGSKKGNHSYNNNYGNEDDDAAIEKMRKEIEVNQDSALSLCTEKVLLARQAYDLIDSHIKRLDEDLNNFAEDLKQEGKIAPDEPAILPPLPIVPKAEKRKPIYITPQSKRIDYRERDWDRERDRDFELMPPPGSHKKEYATPMDVDQPIDPNEPTYCVCHQVSFGDMIACDNENCQGGEWFHYSCVGLTQETRFKGKWYCPTCILLPQCQR

SEQ ID NO: 159790 - protein, 118 aa, Glycine max
  Coding DNA Sequence Number=SeqID_68105
MVGPTIEGHRDGRRRGLSVRGLRRGEQGPEMSSRLQILQSDLIHLGGRWRERARFSEGEERSTLNGERGCPKGIPKLVCSKLEIQRSFLWGGNGEWKKKIAWVKWEGVNKDKCIGGLC

SEQ ID NO: 159791 - protein, 25 aa, Glycine max
  Coding DNA Sequence Number=SeqID_68106
MGKRYPPLEAILFESGKTTTAKFSL

SEQ ID NO: 159792 - protein, 346 aa, Glycine max
  Coding DNA Sequence Number=SeqID_68107
MAAQNNSFLTSSFPSSISHKLDDLTLLLWRQQLIEQLELRIHHTKFGSNKIRIHDYFHKQTRAPARQLLSELRATTLGGRSMREFLMQIKTIFDSRLDWNLLLAHEACLNKFNKQSLSYSPSINYMQAHNKSFSSHGSDGYMVPNKSFLHSDPESFSNSRGGGFNNRGGGWCDGTGGGGRGRGWFANFQCQVCLKYGHTTSVCHYRHEQHYQPNSTLVLQDPTTMRVRLRILVIGKLILILGSRMVIIVLLMFEASFHVTGESQNIQQIEPFEGLDQIFIGNGQGLKITSSNSSSFISPYTSPKDNAVFFEFYSNYCVVKSQFTNEVLLQGTVGPDGLYSFSNIQF

SEQ ID NO: 159793 - protein, 199 aa, Glycine max
  Coding DNA Sequence Number=SeqID_68108
MKQKLKEAIKIELSLRGSQYSPPIEVEIQVLSAHVSTKGSNAETAVTPSGEEHVAHVIPIMGLKALDTFIAWPTNLVKLVSHEDSHITVEPVQRSNNVVVDDPLCGLIKSLYDIYEKPIELLWDTTKFGIPNVDASFFLTYSDVNETISGSWMSGAQAWVMVRCMDSLSLSPYTMQRIDVLNVNITLKHGLRNPNERST

SEQ ID NO: 159794 - protein, 313 aa, Glycine max
  Coding DNA Sequence Number=SeqID_68109
  Gene Ontology: Mol. function=DNA binding; Cellular component=nucleus; Biological process=transcription, DNA-dependent
  Homolog annotation: Hit_ID=Q0GPD6; Match level="QueryCoverage=16%, HitCoverage=22%, E-value=8e-18, Identity=88%"; Hit description=BZIP transcription factor bZIP77
MANKTEEGQSVMFENHVYEPDKQQVTYKNGSTEYFQRLICKVAFCQSKGVSHGNLKVASITGYEGAHADILSCGVILFVLLASYLPFNDKDIKTLYIKTILDPCPATIDEMLEDEWFKNEHQPFRSFQQNISSDKVSAGFSGAAEKAFGFYEVVLLVAQDNEKGNDLYEQETSFSILLLGRLEDTTDEHCIIFYDKEKVELVEGGTFWLFKSPSLPGSMSWGFQYTKGINYWTLSSWKIKLSASDGIAKHRIFTLIGSFSEPGTPVSIQTPPKSYGNTDQGLMKKLKDFDGLAMSIGNGHAESAERRGENRLS

SEQ ID NO: 159795 - protein, 322 aa, Glycine max
  Coding DNA Sequence Number=SeqID_68110
  Gene Ontology: Mol. function=sugar binding
  Homolog annotation: Hit_ID=A9PGH1; Match level="QueryCoverage=49%, HitCoverage=46%, E-value=1e-61, Identity=66%"; Hit description =Putative uncharacterized protein
MSFPFNHSHATHTHHRRDDDDDERPTVYPPPGNSFSNPPPPFYGVPQPPPPQPETHVFHSAHVTPGHVSHDFNNYSAPPPPPPSHHHHDRHHDSFTHAYPPAPAAADYPAHGGSSTTVHHVAHESHHHTPHSAFSSHNNAPPTTVHHVSHQVNTGGLSTKPTVRVFTKANPNFSLTIRRGQVILAPSDPTNEYQHWYKDEKYSTRVKDEEGCPAFSLINKATGEALKHSIGATHPVRLIPYKPDYLDESILWTESRDLGDGHRAIRMVNNVHLNVDAFHGDKNSGGVRDGTTIVLWDWNKVSQVSTFGQRIPNDSEVILSTQ

SEQ ID NO: 159796 - protein, 143 aa, Glycine max
  Coding DNA Sequence Number=SeqID_68111
MEDVDAAAGAAGVEDDGVGAGGFLDGGYFPVNEGVASDGLVRDAGRHDVEDEGDEEKRDRHDEQRPPEPVDLVGEGLLAAGALQHFAGLELRRVLVGGVRRRRVAAGLAVEELSGGRRPVADLTVGGGGGRRLQLGVLGLILN

SEQ ID NO: 159797 - protein, 32 aa, Glycine max
  Coding DNA Sequence Number=SeqID_68112
MELLRKIKEKRGIFQGYAKGILAYSKNMPKTS

SEQ ID NO: 159798 - protein, 29 aa, Glycine max
  Coding DNA Sequence Number=SeqID_68113
MARASMPVGVWCEVGSLSQIRHLRVVHPL

SEQ ID NO: 159799 - protein, 358 aa, Glycine max
  Coding DNA Sequence Number=SeqID_68114
  Homolog annotation: Hit_ID=A5APQ3; Match level="QueryCoverage=48%, HitCoverage=12%, E-value=2e-13, Identity=32%"; Hit description =Putative uncharacterized protein
  Pfam annotation: Domain name=DUF1723; Domain location=117-165; Score =17.1; E_value=0.0049; Accession=PF08330.1; Description=Protein of unknown function (DUF1723)
MVRTGGFGRTLGRVIGKVLGREDNPSPVAEDVHHVDDTVDKVFQQPQEEVDAQGFSGRPHDTSVLTGYANHVAIIVWNGELSSHGRNVQKFGRPTVEIEGLVAATRLSLMIACSLNTSNRGLISAFADRWHKDTSSFHLPVGKTLHVDEAMLLLVKLLEVNANEVREETVQFHGAYSTTHVHLVFLDAFRDLTQSGSYAWGVVALVHMYDNLNDASKSSGKQLAGYITLLQTIPPPSPGSRLCLEDIDDRWMHISEYLAPPEDLVRHPPIVQDDTYVKPDMPQYLVATTVMEEVRAHASSQMEQPRHVVACQEIPERLEWLFNLRIVIEDTETYNVMEDCLRIARGVTTDCNVYVRSR

SEQ ID NO: 159800 - protein, 72 aa, Glycine max
  Coding DNA Sequence Number=SeqID_68115
MRRERELYRIRCSSEENNVGDDMEGGILVVYALDAPWLRVPMTADEVETPFHFFNGGHTVIDYIVPVIDYQN

SEQ ID NO: 159801 - protein, 74 aa, Glycine max
  Coding DNA Sequence Number=SeqID_68116
  Subcellular localization annotation: CTP_CleavageSite=49; ConfidenceScore=5.27e-01
MAVPPSAIIVELSAVGVSSISSRLLSSLRMMAITSLRTGFTISATGEIKAAMSNEDSNEGCDRFKGCAAMRAAT

SEQ ID NO: 159802 - protein, 46 aa, Glycine max
  Coding DNA Sequence Number=SeqID_68117
MDFDFIISRMGFAPVETTAVAESINQKKKANGIGKEWRSDFDQIVS

SEQ ID NO: 159803 - protein, 62 aa, Glycine max
  Coding DNA Sequence Number=SeqID_68118
MVKEIGSLSSGSSNNWRVNYTRWWWRVRKIVCGGLAGVACIGGLTSIRVAVNPGEDWITTYF

SEQ ID NO: 159804 - protein, 344 aa, Glycine max
  Coding DNA Sequence Number=SeqID_68119
  Pfam annotation: Domain name=RRM_1; Domain location=164-235; Score =14.3; E_value=0.007; Accession=PF00076.13; Description=RNA recognition motif. (a.k.a. RRM, RB
MKKSRGMKMREKQGEGERDRVREKERNRVRERIRVRERNRVRDTETRVRERVGATEGNRRRGREREPESTHRRRDNHHQRFSSRRSSARTWTNEDAGYNHHNGVEVRWSTDKQEEYDHTNNHGVWHEVSHRRKRRLVEIRGSMESPKWQERKVTWRDKGDITTFYFSRFPEGVKEGDLWQIFQKWGKVWEVFIPKTKNREGHRYGFVRFKEVQDERSLETQLDTNIYISGMKLFVNSPRYERGRVLRVKQNATSTQKVAHTHKMHMENQEEVKPKGPGTRPRSFVEVVRQDMQGDVASYRKKEPPLCTSMAMQRPVVLSSRMESNEWLQKAWVGKLKNRGMFEK

SEQ ID NO: 159805 - protein, 181 aa, Glycine max
  Coding DNA Sequence Number=SeqID_68120
MELHANIPKYGRQTPTQVAPGANLKGQHERNGNEEHNIEPHSCESSASSVYLDIAPDNTKWLDEAWVGRLKNPTMLERLEDHLLWDVGADRLQSRTNANRRKPRWCPDVPLIGKVESDPVFGLQANWVQCWGIPIVAWDAKQIQKIVAGMGDMVDLDNDGEDVWRRDRARVLIKTPWKPAI

SEQ ID NO: 159806 - protein, 267 aa, Glycine max
  Coding DNA Sequence Number=SeqID_68121
  Gene Ontology: Mol. function=2-oxoglutarate decarboxylase activity; Biological process=menaquinone biosynthetic process
  Homolog annotation: Hit_ID=A7PNB6; Match level="QueryCoverage=61%, HitCoverage=28%, E-value=2e-62, Identity=69%"; Hit description =Chromosome chr1 scaffold_22, whole genome shotgun sequence
MVLTTLDSAVHWATSSPCGPVHINCPFREPLESSPCRWLSSCLSGLDLWMANAEPFTKYIHMQLSHTCINAPGEMTEVLNLILRANNSLLLFGAIHTEDEMWAALLLAKHLQWPVVADILSGLRLRKLLTSFPDIERNFIFVDNLDHALLSDSVKGWLEVDVVIQSVTNKGHLGNMGEGVIVVESNDLSVALGYMPCLQSFNLSIGSNFNGKGLATTNKGSVHWGRYKGIVGFGKVKDDESIATGGMIGVGDEGPIPSIEGASTCVG

SEQ ID NO: 159807 - protein, 206 aa, Glycine max
  Coding DNA Sequence Number=SeqID_68122
  Gene Ontology: Mol. function=molecular_function; Cellular component =anchored to membrane; Biological process=biological_process
  Homolog annotation: Hit_ID=A9PEG5; Match level="QueryCoverage=82%, HitCoverage=52%, E-value=4e-72, Identity=74%"; Hit description =Putative uncharacterized protein
  Pfam annotation: Domain name=Thaumatin; Domain location=17-203; Score= 135.6; E_value=1.4e-37; Accession=PF00314.8; Description=Thaumatin family
  Subcellular localization annotation: CTP_CleavageSite=59; ConfidenceScore=5.72e-01
MTKGLVRGFRATSVSQNPASNTAPKRTLSAKGRLVLQTGASTTIAAPTSWGGRFWGRTLCSEDSTDKFSCVTDDCGSGKLKCSGNGAAPPATLAEFTLDRAGGLDFFDVSLVDGYNVPMLVVPQGGSGEKCTATGCVGDLNGACPSELKVMGADGREGVVACKSACEAFNSPQYCCSGAYGTPDTCKPLAYSAIFKSVTPSTPTYI

SEQ ID NO: 159808 - protein, 162 aa, Glycine max
  Coding DNA Sequence Number=SeqID_68123
MATLNANVSCNIPDFFTSWQHLHYDTSHGGTSLNILVGQNPPPIKTLCRVLHPRHSRVKHIAQMVRNHSRKIVPKALVKEAPIPKMKAIIKLFMPIEDLDDDWTPLPPPPPFEPYKHGEGAMEVIDLGEDKSHPTMKVSNLTWYYPVDEPYQPIDKASCNCL

SEQ ID NO: 159809 - protein, 205 aa, Glycine max
  Coding DNA Sequence Number=SeqID_68124
  Homolog annotation: Hit_ID=A7NSU8; Match level="QueryCoverage=76%, HitCoverage=37%, E-value=1e-45, Identity=64%"; Hit description =Chromosome chr18 scaffold_1, whole genome shotgun sequence
MHMSSGAEKVKFAVPLLDMNINKMVACCPWRYSQKIFLQVVYPVGRKYMSAPSAARLKLVSSPELKAVFSIDDVKLPPWLDGMCLAEYLPNLEEYLGKQAVSLIEVRRHFIEALSSPFGRPVEADAVSSRDTYSQIARVFCRKATFLAASGVFTFLKQKKYRVTEMLGSNCKIWDLSSTLESGLVERPVHSQPTWALGLQSMVGC

SEQ ID NO: 159810 - protein, 127 aa, Glycine max
  Coding DNA Sequence Number=SeqID_68125
MDLDLGYFKRYCMVLSDIAIVLPEVFSGHVQWPGVRPTILDEEGVVIAAKDARNRANDDEDNGGVYVKVGQAIEEDQDEGLGLKYGHVEKGSHAIHSTRPTSKSLWVEEIAIPFGNFEELPKQVGLN

SEQ ID NO: 159811 - protein, 43 aa, Glycine max
  Coding DNA Sequence Number=SeqID_68126
MTYSRERKTVHCQKKWNKVPQANPYKVDKCVDIIHCASNTTVN

SEQ ID NO: 159812 - protein, 158 aa, Glycine max
  Coding DNA Sequence Number=SeqID_68127
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=71%, E-value=1e-24, Identity=69%"; Hit description=LacZ protein
MGVSPRLRLEFDGLRIGPTGNEDGMDFGRQGIRTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 159813 - protein, 162 aa, Glycine max
  Coding DNA Sequence Number=SeqID_68128
MSMSVSVSGVCVKVRASWTESDRKLKSKQKKVSVKHLHVKTKAELKEAMCVAQHEQMDCMVEIESSINANANFHRIALEAPPTSTFVSDGCKEFYREGFILSLVLEEGSVGYGENDHLSVMGSSRSNGRPGSGRGLHWGRLIMVWTSARGVGTGATGWFRRH

SEQ ID NO: 159814 - protein, 249 aa, Glycine max
  Coding DNA Sequence Number=SeqID_68129
MLEQKTMREFLLRIKCIVDALELCGDPILLREQLHTIVEGLLEEYGPVIESYNSSSNKFNQKINPIILEIVVTSIVAVATVLEAMILIAAVATVAEAMALAMVKVVVVATEAAVVMQIFSAKFASSHTAAVCHFRYDYDFQPNASLTLMEPMFQSNSSNTFGSKQNQGTNSHIDSQPSAMLSSLFHIIPTVVVATRTSTTTDRCTIIRGVRNKGRVLPGRRGRVSKSMRCGETQQLLLNHVTGRNNGTR

SEQ ID NO: 159815 - protein, 60 aa, Glycine max
  Coding DNA Sequence Number=SeqID_68130
MIGDYSYKITYWKPPRPSTPPGSPIHFSFDSDDSSDEFQQKLDEEVSEQKREKKLYLKVL

SEQ ID NO: 159816 - protein, 370 aa, Glycine max
  Coding DNA Sequence Number=SeqID_68131
  Gene Ontology: Mol. function=methyltransferase activity; Cellular component=mitochondrial outer membrane; Biological process=metabolic process
  Homolog annotation: Hit_ID=Q43445; Match level="QueryCoverage=84%, HitCoverage=92%, E-value=1e-173, Identity=90%"; Hit description=S -adenosyl-L-methionine:delta24-sterol-C- methyltransferase
  Pfam annotation: Domain name=CMAS; Domain location=94-327; Score= -186.1; E_value=0.038; Accession=PF02353.11; Description=Cyclopropane- fatty-acyl-phospholipid synthase
  Pfam annotation: Domain name=Methyltransf_11; Domain location=157 -226; Score=34.9; E_value=2.9e-07; Accession=PF08241.3; Description =Methyltransferase domain
  Pfam annotation: Domain name=Sterol_MT_C; Domain location=236-365; Score=301.1; E_value=2.1e-87; Accession=PF08498.1; Description =Sterol methyltransferase C-terminal
  Pfam module annotation: Pfam domain module=CMAS::Methyltransf _11::Sterol_MT_C; Domain location=94-327::157-226::236-365
MAQGWGLVDKVNKDVVRVDGCGSKREGVGGSELGSQVVEGERSKVVAVEEVGDEVAAAMDLASNLGGKIDKAEVLSAVQKYEKYHVCYGGQEEERKANYTDMVNKYYDLVTSFYEFGWGESFHFAPRWKGESLRESIKRHEHFLASQLGLKPGQKVLDVGCGIGGPLREISRFSLTSITGLNNNEYQITRGKADFMKMPLPDNSFDAVYAIEATCHAPDAPGQCFAAYEWCMTDSFDPQNPEHQKIKAEIEIGDGLPDIRLTAKCLEALKQAGFEVIWEKDLAVDSPLPWYLPLDKSHFSLSSFRLTAVGRLFTKNMVKVLEYVGLAPKGSLRVQDFLEKAAEGLVEGGKREIFTPMYFFLARKPDSDRN

SEQ ID NO: 159817 - protein, 151 aa, Glycine max
  Coding DNA Sequence Number=SeqID_68132
MGSKETEFWKDRLEKVWEKRGDIGTHILHLEMQKVKLEKLNLTNIWKIGFSSIGHFSYSSWYILPEEEVYALGVYGDRKPEIKEFPLWQIVALNPNKSNVEVESSSMVVQVYDPSFSRAYVCMIEDELVKTREALAQALKDCAHVEKEARK

SEQ ID NO: 159818 - protein, 208 aa, Glycine max
  Coding DNA Sequence Number=SeqID_68133
MDIEECVLHWEKHESGIGIDVSNSEWRIGRLKAMVEIENKANDDAEDGVEEHNVEVNSGSDTGRDCIGASVVINCFSGDIDGRRGGAMGRGGGMILVGSGDFAKEEDGEVATCLIMAASRQSRLAEEGLASAIGGRQDKGPPYYTKGGAASRIGGKSVLPPISPFLLVIQPIPPFVLARHPSEAMPPYVLAIHPFPFRYSNWRDMSWQ

SEQ ID NO: 159819 - protein, 70 aa, Glycine max
  Coding DNA Sequence Number=SeqID_68134
MRGVRWFSLCRWAFPGGSGPWRRGNGGERTLGREEKAVGRGERALKRGEQEDGYVRPVSFLCKMSIPNVR

SEQ ID NO: 159820 - protein, 75 aa, Glycine max
  Coding DNA Sequence Number=SeqID_68135
MAAEWRRKRERRRHFKEKMSLEEAHHHRRPWIRAWRKEMNEGRGREEHEILCSKRALKSEPTNPRSIPRFSTKCA

SEQ ID NO: 159821 - protein, 459 aa, Glycine max
  Coding DNA Sequence Number=SeqID_68136
  Gene Ontology: Mol. function=structural molecule activity; Cellular component=cytoskeleton; Biological process=multicellular organismal development
  Homolog annotation: Hit_ID=A7Q282; Match level="QueryCoverage=73%, HitCoverage=67%, E-value=8e-66, Identity=78%"; Hit description =Chromosome chr13 scaffold_45, whole genome shotgun sequence
  Pfam annotation: Domain name=Actin; Domain location=85-457; Score= -88.2; E_value=7.4e-10; Accession=PF00022.10; Description=Actin
MKLIYLSLMSQRLKDSRNKLGRRRSKAELSSLKVELVQKCWFIISNVTFWVGCSFSLLSSVPRVEARAPLRKSNTSVGLGFSFWCRAMEAAVVDPGSSLLKAGFAIPDQAPAMIIPTQMKRMLDDGSMTDNLTFDDIAVDPVCRGYVRDWDALEDLLHYVLYTGLGWEMGNEGQILFTDPLCTPKANKEQLVQLMFETFNISGFYASEQAVLSLYAVGRISGCTVDIGHGKIVNLIIPPRYLTEDDRVAGRINPDYEAWEVQDQTLLTWWISLTWCIWHHRNRIIFSNDSFNAYKLMEDAVFLCWTWFKNLEKGFHTPFHFWSSNIREDIAPVIEGAVNHIASRRFEFGGVDLTNFLAQELGKSNPLVNISISDVEKIKQQYSCCAEDELAYQKTKGSCPVETHTLPDGQGSERFVVTIPVFRRNDVVNEMGNIEVVYEVIGFLLVECYHRGGGKAMNL

SEQ ID NO: 159822 - protein, 87 aa, Glycine max
  Coding DNA Sequence Number=SeqID_68137
MFSKKEGMMRIMNLAKYRLKAQVEKDEGSSGEGQSPEWRRTYQGNPCGVYPDLSSFIGSGVYPDLSSFTGSGVNQKLYSLYQAIRAP

SEQ ID NO: 159823 - protein, 101 aa, Glycine max
  Coding DNA Sequence Number=SeqID_68138
MSQYHILSEHCVPTSSSMRFSIAIHLTIYFHEHKVRDHHTIQTQIAHRDEKPHRAPRSTRQDRPHTGRPVRVTLFCENAPTIWGQHKLKGTLKQGIFTPKA

SEQ ID NO: 159824 - protein, 126 aa, Glycine max
  Coding DNA Sequence Number=SeqID_68139
MAQPPPRERTLREMAAPDLTYESLCIQYPDEGVPCNMERSMIDAARGGALGVMTPIEARNLIEKMASNSQQFSNAAGPSKPYVPPPMKQQQQQQQRQQAIEAPPQTSLEELVRQMTIQNMQFQQET

SEQ ID NO: 159825 - protein, 578 aa, Glycine max
  Coding DNA Sequence Number=SeqID_68140
  Gene Ontology: Mol. function=pseudouridine synthase activity; Cellular component=plasma membrane; Biological process=pseudouridine synthesis
  Homolog annotation: Hit_ID=Q47417; Match level="QueryCoverage=55%, HitCoverage=94%, E-value=1e-101, Identity=54%"; Hit description=tRNA pseudouridine synthase C
  Pfam annotation: Domain name=DUF446; Domain location=244-346; Score =153.5; E_value=5.8e-43; Accession=PF04287.3; Description=Domain of unknown function, DUF446
  Pfam annotation: Domain name=PseudoU_synth_2; Domain location=342 -489; Score=125.0; E_value=2.2e-34; Accession=PF00849.13; Description= RNA pseudouridylate synthase
  Pfam annotation: Domain name=Syd; Domain location=7-195; Score=333.5; E_value=3.7e-97; Accession=PF07348.3; Description=Syd protein
  Pfam module annotation: Pfam domain module=DUF446::PseudoU_synth _2::Syd; Domain location=244-346::342-489::7-195
MQQTAEALRDFTARYVAHWQQQHGHFPASAELYGVPSPCIISELDERVLWQPQDFTLPASLAAVERALDIQLQPDLTTFYTTQFAGDMHAQFAQQSLTLLQVWSEDDFTRLQENLIGHLVMKRRLKQSPTLFIATTDSEQDVIAVCNLTGEVIVEQPDFSRSSCKRSLTTGVRDRQNIAQTSGSPQFTTGRKPRIERRSGKCQPGGRNVTEFTSQGRLQDEAGHSGATESAGTVVMDEQGAQRWRECCKRTGSTVEAVMREHGHWQTHAPAAEAFNSTQPFCLDTLQPLEWLQWVLLPRMQALLDAGAALPQNFAVTPYYEMALPPTTPCHAALLLTLSQLDALWLDRKEKVVVMQTVRDQIGQHVFTAHRLDRPTSGVLLMGLSSEIGRLLAQQFEQHQIQKTYHAVVRGWLDGSATLDYPLVEELDKIADKFVTEPRAPQPAVTDYRALAQAELPVAIGKYPSARYTLVELSPHTGRKHQLRRHMAHLRHPIIGDSSHGDLRQNRGAAAHFGMDRLMLHASALTLTHPVTGEPLVIRAGLDRVWQQMLQSFGWQQQLPEVPRVEFAAEAVQDKPTE

SEQ ID NO: 159826 - protein, 765 aa, Glycine max
  Coding DNA Sequence Number=SeqID_68141
  Gene Ontology: Mol. function=N-acetylmuramoyl-L-alanine amidase activity; Cellular component=extracellular region; Biological process=peptidoglycan catabolic process
  Homolog annotation: Hit_ID=A8GIG7; Match level="QueryCoverage=50%, HitCoverage=92%, E-value=1e-146, Identity=69%"; Hit description=N -acetylmuramoyl-L-alanine amidase precursor
  Pfam annotation: Domain name=Amidase_3; Domain location=436-653; Score=301.9; E_value=1.2e-87; Accession=PF01520.9; Description=N -acetylmuramoyl-L-alanine amidase
FENPADVVDVGAANLLGRFHDNLRTDTVTREQFLQQCAIFLIANQMAAAHAAAAGFDRATQERTLGNDGAFAVGYALFGAETDHLLGFQLNRQLRRHLFRGQVKAFAGHRDRYWTQQHNGIVIQLTMDRLFVNPADAAAVAVIDAVIHAQRLSDDEVTAHYINMRALQRRIIQAHRQTRRNIELHAGVFVINRLQLLLREAGIDLRPRAINHHQANAETMQQADIVNDAGEVLMLDGLATQHDDKRLVTVGINIGNGMAKTLNQFGALWLLSVTRSGFAASQHIVAVRIWPSSTYSRVTLESNVALHYKQFTLSNPERLVIDIQNLHINSALKGIDKLVRVDDPYIKTARVGQFDPTTVRVVLELKRSVAPKTFTLDPVAGIRHRLVVDLYPSQSSQEEDPLLALLKDYNQGELERDQPAQAPLPGKAGRDRPIIIMIDPGHGGEDPGAHGKYKTREKDIVLKIGRYLKALIDKERNMKAYMTRNEDVFIPLRVRVAKARKQRADLFVSIHADAFTSRAARGSSVFALSTSGATSAAARFLAQTQNEADLIGGVSMSGDRYLDHTMFDMVQRQTISDSLKFGKEVLTRMGHINHLHKRTVDQAGFAVLKAPDIPSILVETAFISNVEEERKLRTPRYQHQGGSDAAFYRAQKQKNTRQGVVMFFRRRSGCGGRIRTDDLRVMSPTSYQAAPPRPDELPGCSTPRPSVALSDLPHCLFITKNWLRGPDLNRRPSGYEPDELPGCSTPRPWMRTIHRVYDDATPFLR

SEQ ID NO: 159827 - protein, 66 aa, Glycine max
  Coding DNA Sequence Number=SeqID_68142
  Homolog annotation: Hit_ID=Q9FZN9; Match level="QueryCoverage=92%, HitCoverage=2%, E-value=1e-07, Identity=50%"; Hit description =Retroelement pol polyprotein-like
QGHIVALSQFTVWWALWRKQNSSQGPFPSSAGNEYILVVVDDVSKWVEAMATARNDAKTVVIFSIW

SEQ ID NO: 159828 - protein, 57 aa, Glycine max
  Coding DNA Sequence Number=SeqID_68143
MRPSHEVLKVTVELSSSKNLDAILPRKAPVTRAMSKRLQEDWARATEEGPRVLMNLR

SEQ ID NO: 159829 - protein, 145 aa, Glycine max
  Coding DNA Sequence Number=SeqID_68144
  Subcellular localization annotation: CTP_CleavageSite=24; ConfidenceScore=5.24e-01
MFAHSIKGCRPLGRTCGVLIPSPCVNTTPEPFNLKVRRSRLFLFFRRFPQINVGGDSARIPFVEYASRESRVALPPKGRFVIIKKGEIVEAKLFKFILMMPKTQVKNQESNKFQESKSRSIKNQDSSEDSREDLRYARTSRKASR

SEQ ID NO: 159830 - protein, 93 aa, Glycine max
  Coding DNA Sequence Number=SeqID_68145
MEEKVKLKISGGLRSTYLKLLCSDTTCWKLAYEASMEAGSLSFNKEKLHHQESGLDKKLKEEASMEEENTRERGRGGGARCGNWRRLEREVEL

SEQ ID NO: 159831 - protein, 76 aa, Glycine max
  Coding DNA Sequence Number=SeqID_68146
MQPILLSVGGLPSIAEGKEKLDLIEERLRAVEGFSDYPFMDMTDLCLVPDVIIPSKFKRSSGILTLKLPVSTLGRI

SEQ ID NO: 159832 - protein, 200 aa, Glycine max
  Coding DNA Sequence Number=SeqID_68147
MAESMKKRKGSSSTSTAASHHRHEPFEAPTAPVPPSFQGVPFEGTIIDDWKFDYSSHDARRMVCNDQADMTGRLLAGSLTFDCRIMHYIIVRILLPHLSNLAQASEEDLILMWAFLTDRQIDWAHLVRYYLPPPIPDERAPSPPPPRVDSSSLLTKVLIELCALRAFVGERFDAMDTCLDAMDARFDGMVTRGSLVSKMI

SEQ ID NO: 159833 - protein, 187 aa, Glycine max
  Coding DNA Sequence Number=SeqID_68148
  Gene Ontology: Mol. function=sugar binding; Cellular component =integral to membrane; Biological process=recognition or rejection of self pollen
  Homolog annotation: Hit_ID=A7P1A1; Match level="QueryCoverage=85%, HitCoverage=36%, E-value=2e-51, Identity=62%"; Hit description =Chromosome chr19 scaffold_4, whole genome shotgun sequence
  Pfam annotation: Domain name=B_lectin; Domain location=69-181; Score =148.2; E_value=2.3e-41; Accession=PF01453.15; Description=D-mannose binding lectin
TRDVLTLTDLNMADVVDQDSNIVFFHGVSQYVTDGETLVSNSGVFELGFFSPGKSTKRYLGIWYKNITSDRAVWVANRENPINDSSGILTFSTTGNLELRQNDSVVWSTNYKKQAQNPVAELLDTGNFVVRNEGDTDPETYSWQSFDYPSDTLLPGMKLGWDLRTGLERKLTSWKSPDDPSAGDFSW

SEQ ID NO: 159834 - protein, 92 aa, Glycine max
  Coding DNA Sequence Number=SeqID_68149
MPPTRHPLDPDKSNRALGFSALITGLCQSFGVPVNPSKVIRLPITRAFIEKYCTPRQAQGDAHQAADAPPPPHQADPAGSLGMERYLQHLVR

SEQ ID NO: 159835 - protein, 111 aa, Glycine max
  Coding DNA Sequence Number=SeqID_68150
NTQERRLLEQTDKWLTLTFRWKLNKQRCVRERMSILSISFSIVTVDSTSDSPQISASPYQLDFTLYASGSYNAQWNALGLLHDKHTLRSSRILRKMEVVFVIGSAVDRLCG

SEQ ID NO: 159836 - protein, 62 aa, Glycine max
  Coding DNA Sequence Number=SeqID_68151
  Subcellular localization annotation: CTP_CleavageSite=27; ConfidenceScore=5.27e-01
MRGYHMVTRTFCQSGANVPDDARRVTSSSAPFVVLTRDVRSKRARWRAETYIIFCTFCRPDP

SEQ ID NO: 159837 - protein, 211 aa, Glycine max
  Coding DNA Sequence Number=SeqID_68152
YPELRRSEFLIGGYVGARASLLSTAPPFVTMTQELVACGDTLRLSAPRHSVTPSVIDEQRPMWSEFLIGGYVGARASLLSATFTSSVMLTQESRDMRRYPSEAASPMTCGDNLWSFRTPSAIQTQSCPMARRDKLWSFCTLLSSRGGGPDDMRRQIMVIPHTFCHSDTVVFDGTQRQIMSCPIARRDKLWSFCTLLSSRGGEPDDMRRQLM

SEQ ID NO: 159838 - protein, 193 aa, Glycine max
  Coding DNA Sequence Number=SeqID_68153
  Homolog annotation: Hit_ID=A2FDT0; Match level="QueryCoverage=64%, HitCoverage=17%, E-value=1e-10, Identity=32%"; Hit description =Putative uncharacterized protein
  Subcellular localization annotation: CTP_CleavageSite=45; ConfidenceScore=5.27e-01
TTRPPLQKTTRPPLQRTTHPYLQRTTCPHLYRTTCPRLQRTTRPRLQRAACPHHLRAACPHLQRTTRMHPVSFRGLYVLAFRGLHAHAFRVLHVLAFRGLHVLTFRGLHFVAFRGIHALVFRGLHILAFRGLDALAFRGLHVLPFQGLHVLPFRGLHVLTFRGLHVLTFKGLHILAFRGLHALPSQGCMPSPS

SEQ ID NO: 159839 - protein, 154 aa, Glycine max
  Coding DNA Sequence Number=SeqID_68154
  Homolog annotation: Hit_ID=Q6UUU1; Match level="QueryCoverage=57%, HitCoverage=78%, E-value=9e-22, Identity=54%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFLPGGSLVRSPVPAFRVTGVIPLYGRVCLIPRLTLSS

SEQ ID NO: 159840 - protein, 302 aa, Glycine max
  Coding DNA Sequence Number=SeqID_68155
  Gene Ontology: Mol. function=2,3,4,5-tetrahydropyridine-2,6 -dicarboxylate N-succinyltransferase activity; Cellular component =cytoplasm; Biological process=biosynthetic process
  Homolog annotation: Hit_ID=A8T4Q8; Match level="QueryCoverage=41%, HitCoverage=99%, E-value=5e-38, Identity=67%"; Hit description=tRNA pseudouridine synthase C
SVVVSGNLPSKDGKYSLYCAVIVKKVDAKTRGYVEIKGTAMYDNLKSLGITNPDEIDRYSLRQEANNDILKIYFHKDKGEFFAKSVKFKYPRQRKTVVADGVGQGYKEVQEISPNLRYVIDELDQICQRDRTEVDLKRKILDDLRHLESVVTNKISEIEADLEKLTRRGRKALRGQLHRFAGKVIRGFELQLQRGQQCARFVMELFEGIFQAINHFLIVDGGGLPVAVFIKQAKLVAIGKTFLLSFHFHPPAPEFTFFGCRLHVDANSQAVEKKAILFTLLFSNIRAESHKFLNQPTFRVST

SEQ ID NO: 159841 - protein, 135 aa, Glycine max
  Coding DNA Sequence Number=SeqID_68156
MAAATNTTREAEPVLQPAMNSSRDRSTTGFNWRLHSPYRYRQFELSPYLQGATPSSCRLPSRGRRRGRCPFGPFTSPKGADTHELPWPNIIHHAPSQSAPVREPVPISKDKGKINLLEERLRAVEDLGNYPFSEQ

SEQ ID NO: 159842 - protein, 60 aa, Glycine max
  Coding DNA Sequence Number=SeqID_68157
MENAKGTTPKATTTNQNERNKAQKEESAVKRSVNGCPIQAHNIPRSSKLNMEAKGKFKWP

SEQ ID NO: 159843 - protein, 160 aa, Glycine max
  Coding DNA Sequence Number=SeqID_68158
  Gene Ontology: Mol. function=protein kinase activity; Biological process=protein amino acid phosphorylation
  Homolog annotation: Hit_ID=Q2A9E0; Match level="QueryCoverage=67%, HitCoverage=7%, E-value=2e-27, Identity=56%"; Hit description =Putative uncharacterized protein
  Pfam annotation: Domain name=DUF889; Domain location=34-156; Score =24.8; E_value=3.6e-13; Accession=PF05970.5; Description=Eukaryotic protein of unknown function (DUF889)
MAHKFYFEALDQSQRDVIKAKSSSDKIFDGKVMVFGGDFRQILSIIPRGSRSDIVNATINSSYLWNYCHVLTLSKNMRLEVNIDATDKEETLAFAQWILDIGDGIVGEQMEYLSADYVDKSETLESSHFRSLTTEFLNSLTTSGLPIIASKSKLDHLSCC

SEQ ID NO: 159844 - protein, 145 aa, Glycine max
  Coding DNA Sequence Number=SeqID_68159
MSRNFTDCATMPSLTSGMSRNFTNCLTMGAKYLEVVKRGLHPNNGWSPDEIRVKEEPQLLVVFVVAVAVVAALEEEHMACFDQQHYEKEGQTFVVVEDLSISNLDDSSNLDCIYCLKGHNYSVVVGFATEGVYYKCLQHKLQVTH

SEQ ID NO: 159845 - protein, 196 aa, Glycine max
  Coding DNA Sequence Number=SeqID_68160
  Homolog annotation: Hit_ID=A2Q5N6; Match level="QueryCoverage=43%, HitCoverage=33%, E-value=9e-08, Identity=37%"; Hit description =Putative uncharacterized protein
MRFKSNWAFYYFGNCSYLTNGTSSSQQCGPLVSGFLHKHDFIFIFVHVYMLWHSSCLVVLVIFENKIGGMSFKLKLHHGGFFQRDHVMQYVGTSNYVSVIDIDVDKWSFFEAIGILKEDFGYGDQPIRLWWKGGDGDYKEMTIDNHALELSNYAIANNCEVELFVKCASGNEGIVDDNFSAPMNTRFEIITGSKHK

SEQ ID NO: 159846 - protein, 51 aa, Glycine max
  Coding DNA Sequence Number=SeqID_68161
MDDSFVGERRLLYENVGSLRSRLLYGNGCGDEDGSCGCGDGRCGCGGGGCA

SEQ ID NO: 159847 - protein, 149 aa, Glycine max
  Coding DNA Sequence Number=SeqID_68162
  Homolog annotation: Hit_ID=A2Q4P8; Match level="QueryCoverage=47%, HitCoverage=31%, E-value=5e-09, Identity=40%"; Hit description=IMP dehydrogenase/GMP reductase, related
MAKRAGASVKLTWLADLYHWHGESGLCVWVDTTYLLHLIDNTIFANKSSTHIHVTYLMYIDNLDACHEYAWGVVALTYLYDHLSYGSQYTSKQCGGYMTLLMVFHPYTIPSKDGPPPRGSMASEAMQSLLDLRVVPKGTSHHQLIHQAL

SEQ ID NO: 159848 - protein, 312 aa, Glycine max
  Coding DNA Sequence Number=SeqID_68163
  Gene Ontology: Mol. function=microtubule binding; Cellular component =nuclear outer membrane; Biological process=mRNA export from nucleus
  Homolog annotation: Hit_ID=A7Q6X6; Match level="QueryCoverage=96%, HitCoverage=98%, E-value=1e-157, Identity=77%"; Hit description =Chromosome chr12 scaffold_57, whole genome shotgun sequence
  Pfam annotation: Domain name=WD40; Domain location=102-140; Score =39.7; E_value=1e-08; Accession=PF00400.23; Description=WD domain, G -beta repeat
  Pfam annotation: Domain name=WD40; Domain location=13-51; Score=25.2; E_value=0.00024; Accession=PF00400.23; Description=WD domain, G-beta repeat
  Pfam annotation: Domain name=WD40; Domain location=144-179; Score =2.8; E_value=15; Accession=PF00400.23; Description=WD domain, G-beta repeat
  Pfam annotation: Domain name=WD40; Domain location=185-229; Score =1.8; E_value=19; Accession=PF00400.23; Description=WD domain, G-beta repeat
  Pfam annotation: Domain name=WD40; Domain location=60-98; Score=22.8; E_value=0.0013; Accession=PF00400.23; Description=WD domain, G-beta repeat
  Pfam module annotation: Pfam domain module=WD40::WD40::WD40::WD40::WD4 0; Domain location=102-140::13-51::144-179::185-229::60-98
  Subcellular localization annotation: CTP_CleavageSite=48; ConfidenceScore=5.30e-01
MSTFGAAANTNPNKSYEVAQPPSDSISSICFSPKANFLVATSWDNQVRCWEITRNGTVVNSTPKASISHDQPVLCSAWKDDGTTVFSGGCDKQVKMWPLMSGGQPMTVAMHDAPVKDIAWIPEMNLLATGSWDKTLKYWDTRQSNPVHTQQLPDRCYAITVKHPLMVVGTADRNLIVFNLQNPQTEYKRIVSPLKYQTRSVAAFPDQQGFLVHHTFATAGSDGAFNFWDKDSKQRLKAMQRCSQPIPCSTFNNDGSIFAYAVCYDWSKGAENHNPATAKNYIYLHLPQESEVKGKPRAGATDFETGIKRSVI

SEQ ID NO: 159849 - protein, 204 aa, Glycine max
  Coding DNA Sequence Number=SeqID_68164
MKNSWWGQELHPYNQYEEERTPTLESVFTEFTAYHATSTTNQNSMQNHEIQVGKSYSMENYQWEQELQPYNQYEEEKNSNLDNLLMQFKEVTESTQQAFKSLEIQVEKDEEKSEEKAQQWEKYSQVEIQQESILQVNNPPHQLIVKEKRHGEHAKALSVILSLITSTSLAMMWKVLPKYMSIMASLAKRRKCKEDVFFVTFMSP

SEQ ID NO: 159850 - protein, 112 aa, Glycine max
  Coding DNA Sequence Number=SeqID_68165
MDEDTPREVGVCDDNGGWRLNRFSQYLPDDINLKVMRMTSPDSNSEGEQTSDGLFSVKTAYEVVVNPLPSHNHRLFSCLQQWRGTERIRMFLWKICHESILTNVRRMRMYGY

SEQ ID NO: 159851 - protein, 768 aa, Glycine max
  Coding DNA Sequence Number=SeqID_68166
  Gene Ontology: Mol. function=phosphotransferase activity, alcohol group as acceptor; Cellular component=cytoplasm; Biological process =protein modification process
  Homolog annotation: Hit_ID=A5B9G7; Match level="QueryCoverage=83%, HitCoverage=99%, E-value=0.0, Identity=70%"; Hit description =Putative uncharacterized protein
  Pfam annotation: Domain name=PI3_PI4_kinase; Domain location=165-423; Score=262.8; E_value=7e-76; Accession=PF00454.18; Description =Phosphatidylinositol 3- and 4-kinase
MSRKLDSPVQTQMAVAVIRSSPLGREYHGKQPAGRRRVFVQTEKGCVLGMDLDRGDNVHTVKRRLQLALNVPVDESYLTFGDMVFKNDLSAVRNDTPLLLTRGKNTHMPRSSSTPCLSPKGRDIDKSGPIEILGQSNRLDGIKHMIKDIMKAIKMGIEPIPVHSGLGGAYYFRNSKGDSVAIVKPTDEEPFAPNNPKGFVGKALGQPGLKRSVRVGETGFREVAAYLLDYDHFANVPPTALVKITHSVFNVNDGVNGNNLWRKRLFSKIASFQQFIPHDFDASDHGTSSFPVASVHRIGILDIRILNTDRHAGNLLVRKLDGIGSFGQVELIPIDHGLCLPETLEDPYFEWIHWPQASIPFSEDELAYIEDLDPYHDCEMLRRELPMIREACLRVLVLCTIFLKEAAAYGLCLAEIGEMMTREFRRGEEEPSELEVVCLEARKIVVERDREELSPRSEMRDDEFLFDIDYYDEFGSDFTPKMAIDDPLTRATFLPALGNGQSRNPLSKLDECIEEEEEEEEEAEGESPQGFVTSAAEEKIPSVSELSVSLKNTMLDGKNQNQQKYSGGKVENGHFANTSSGHKSANEQLPPSISFVDVTEMTEDEWPLFLEKFQELLYPAFAKRKSITLGQRQRQRLATIATPVLKNLDVVTEIAGTRQWRWRVGHVAAPGGLASGVGELLSTRRVPSFVLAKCFFTEFFFNFKRYEWRDPPRGQQLANSIGESTRCHHVSNSLSPLASPLQKQTSLGKSFKTTPSLGKSFKTTPFWE

SEQ ID NO: 159852 - protein, 71 aa, Glycine max
  Coding DNA Sequence Number=SeqID_68167
  Subcellular localization annotation: CTP_CleavageSite=52; ConfidenceScore=5.04e-01
PLDLEDSLNCRSKMVNKGENNSSLCSTVKSLFVSIFGGNVKTGKSAAPGGPVATMVAASKHFSSPHKVRFG

SEQ ID NO: 159853 - protein, 493 aa, Glycine max
  Coding DNA Sequence Number=SeqID_68168
  Gene Ontology: Mol. function=nucleotide binding; Cellular component =Golgi apparatus; Biological process=regulation of transcription, DNA- dependent
  Homolog annotation: Hit_ID=A7PGG5; Match level="QueryCoverage=93%, HitCoverage=93%, E-value=1e-177, Identity=63%"; Hit description =Chromosome chr17 scaffold_16, whole genome shotgun sequence
  Pfam annotation: Domain name=DUF246; Domain location=101-448; Score =690.8; E_value=1e-204; Accession=PF03138.5; Description=Plant protein family
MRYETLINLVIGGVKDEKFKGLINDGIKGDHKLRFLMLARRRSSFLKLWTLRVAFVMLLWTIVVQFKGLGDMVTPSMFKTRSSASSLPPQRIYENNNGYLIVSSNGGLNQMRAGICDMVTIARYLNVTLIVPELDNTSFWNDHSQFKDIFDVDYFINSMRDEVRILKEFPPQQKKVETESIYSMPPISWSNMTYYYDVILPRIKSYGIVHFTKSDARLANNGIPEEVQRLRCRVNYHALRFVPPIEQLAKKIVKILKERGPFLSLHLRYEMDMIAFTGCNEGCNKEEIDQLTKMRYAYPWWKEKEIDSEKKRKDGSCPLTPEETALTLRALDIDRNIQVYIAAGDIYKPEKRMASLREAFPNLVKKETLLEPSELDPFRNHSNQMAALDYYVSIESDIFVPSYKGNMAKLVEGHRRYLGFKKTILLNRKILVKLIDQYKNGTINWNQFSTSVKVAHSDRVGNPSTRSVVPGKPKEEDYFYSNPQECLSPVDGP

SEQ ID NO: 159854 - protein, 81 aa, Glycine max
  Coding DNA Sequence Number=SeqID_68169
MGGHYSREGKRRKWGGIRWVHLIRNATSTPRPLRSGFGETATVGEGVVVVAVWSWWRSWSGTGGGGLGGFGEAATVTSFFI

SEQ ID NO: 159855 - protein, 34 aa, Glycine max
  Coding DNA Sequence Number=SeqID_68170
MVESKATRRSRGGRGDVVEHEERIKVKVFASYAR

SEQ ID NO: 159856 - protein, 120 aa, Glycine max
  Coding DNA Sequence Number=SeqID_68171
  Homolog annotation: Hit_ID=A2Q4R1; Match level="QueryCoverage=74%, HitCoverage=22%, E-value=1e-14, Identity=50%"; Hit description=CBS
MIKNYRTVIYNCYYNSVVLICHLPSTASLLEALDVDVMHEGVQNLVIPIQNQFESVNSNNVHHNDNTTYCWLTQEDVFRYLLNSIGVFSPTSGNPINTLGVIDTQNLLKREKERESQERE

SEQ ID NO: 159857 - protein, 360 aa, Glycine max
  Coding DNA Sequence Number=SeqID_68172
  Gene Ontology: Mol. function=metal ion transmembrane transporter activity; Cellular component=integral to membrane; Biological process=metal ion transport
  Homolog annotation: Hit_ID=A7P1N2; Match level="QueryCoverage=90%, HitCoverage=88%, E-value=1e-109, Identity=62%"; Hit description =Chromosome chr19 scaffold_4, whole genome shotgun sequence
  Pfam annotation: Domain name=Zip; Domain location=47-357; Score =318.2; E_value=1.5e-92; Accession=PF02535.13; Description=ZIP Zinc transporter
MAFNTRGVSIIRKLLVSAATLPPLASAAAPQCELKYEGGCRDKAEALKLKIVAIFCILVTSMIGISLPLFSRAVPSLHPDRDVFVLVKAFASGVILSTGYMHVMPDSFDDLTSMCLPERPWRKYPFTTFIAMLAAVFTLMVDSFSINYFRKKLTTSTAESTTASSLEAGENKEGDMFGHGHCHGHVNGHRGDGMSVNGEQLLRYRVVAQVLEMGIVVHSVVIGLSLGASLNPCTIRPLIAALCFHQLFEGMGLGGCILQAEYGMKVKAIMVFFFSATTPFGIALGIGLSNVYSDASPTALIVEGILNAVSAGLLNYMALVELLGADFMGPKLQGRTNVMAWAFVAVLLGAGGMSVMAIWA

SEQ ID NO: 159858 - protein, 198 aa, Glycine max
  Coding DNA Sequence Number=SeqID_68173
SQEYPCITLGIHLSPLLSICQNVTWTSKDVEVLDSWLPPFPDFIQCGWSPSSKCDSVVDVACCVHGFSPEIIGKFFGMKHDPSSLLQSPVFPFNYAILLWCNGCRELMNDAFRCAVFSKLAVFKLSAMVTPDSLDDTVFFSLKPRILDSTPWELVGLGSSSSMDSFASWKINGSGMGKEEREETPLQGEDESRRSSPP

SEQ ID NO: 159859 - protein, 264 aa, Glycine max
  Coding DNA Sequence Number=SeqID_68174
  Gene Ontology: Mol. function=methionyl aminopeptidase activity; Cellular component=cytoplasm; Biological process=proteolysis
  Homolog annotation: Hit_ID=P0A1X7; Match level="QueryCoverage=100%, HitCoverage=100%, E-value=1e-141, Identity=91%"; Hit description =Methionine aminopeptidase
  Pfam annotation: Domain name=Peptidase_M24; Domain location=12-250; Score=360.3; E_value=3.1e-105; Accession=PF00557.15; Description =metallopeptidase family M24
MAISIKTPEEIEKMRVAGRLAAEVLEMIEPFVKPGVSTGELDRICNDYIVNEQHAVSACLGYHGFPKSVCISINEVVCHGIPDDEKLLKDGDIVNIDVTVIKDDYHGDTSKMFIVGKPTILGERLCKVTQESLYLALKMVKPGIRLRTIGAAIQKFVEAEGFSVVREYCGHGIGRVFHEEPQVLHYDADDGGVVLQKGMTFTIEPMVNAGDYRIRTMKDGWTVKTKDRSLSAQYEHTIVVTDNGCEIMTLRKDDTIPAILTHDE

SEQ ID NO: 159860 - protein, 198 aa, Glycine max
  Coding DNA Sequence Number=SeqID_68175
MTDLDTGDLDKCELYIEENPSHLVALEIVYEGSTVVHNILLLHGQVKVGVEEVKDADAPVLVPTDDVILVGQALNTFLAWPTHLVKRLLEQVVVSLAKPTDGLDPQVTWDVTMFGVFNQDFPLYIKHEDLSEIAHDGQCLSISVIQLWILIQNAMSTLGSFRNNWETYFNDVRPLEADRLKALRIQWAQYYLKVRNQT

SEQ ID NO: 159861 - protein, 281 aa, Glycine max
  Coding DNA Sequence Number=SeqID_68176
  Gene Ontology: Mol. function=oxidoreductase activity, acting on the aldehyde or oxo group of donors; Cellular component=mitochondrion; Biological process=electron transport
  Homolog annotation: Hit_ID=P52647; Match level="QueryCoverage=95%, HitCoverage=22%, E-value=1e-134, Identity=89%"; Hit description =Probable pyruvate-flavodoxin oxidoreductase
  Pfam annotation: Domain name=TPP_enzyme_C; Domain location=8-169; Score=5.1; E_value=1.4e-06; Accession=PF02775.12; Description =Thiamine pyrophosphate enzyme, C-termina
RLLSEFADKVLAELNAALHTEASPEARRQQVAELREALTGVEGAEELLTDADALVEKSVWLIGGDGWAYDIGFGGLDHVLSLTENVNILVLDTQCYSNTGGQASKATPLGAVTKFGEHGKRKARKDLGVSMMMYGHVYVAQISLGAQLNQTVKAIQEAEAYPGPSLIIAYSPCEEHGYDLALSHDQMRQLTATGFWPLYRFDPRRADEGKLPLALDSRPPSDALAETLLNEQRFRRLNAQQPEVAEQLWKDAAADLQKRYDFLAQLAECAPLAWPYFHPGS

SEQ ID NO: 159862 - protein, 75 aa, Glycine max
  Coding DNA Sequence Number=SeqID_68177
MECPGVFPWYVQVALGSYHFGKRGLLDLPGSYYGHLVGDEGRQEVFVRHWEWGEFWNWLRGKVPHCVGIVGRASR

SEQ ID NO: 159863 - protein, 156 aa, Glycine max
  Coding DNA Sequence Number=SeqID_68178
  Gene Ontology: Mol. function=phosphoprotein phosphatase activity
  Homolog annotation: Hit_ID=A5BZP3; Match level="QueryCoverage=93%, HitCoverage=29%, E-value=1e-19, Identity=37%"; Hit description =Putative uncharacterized protein
MASSSSCPSNIKIKSGPIDGDVLWMQAKHVSEHVWNGEEDRKLHIRRVVPTYQGEEEIPKQIFSFLRQSGLRVDGLPLIGPTNLNWADLCEELLGVRPQEGEIKGSVVKLSWLAHHFAQINNHDDKEQVRRFTRAWILRFIGGVLFVDKSSNKVSL

SEQ ID NO: 159864 - protein, 107 aa, Glycine max
  Coding DNA Sequence Number=SeqID_68179
MSSSTCRRRQCLQSLHAFKRRQCLHLHFKEDNVFTSKTSISFSDEDMIKSKGKDPLEGLGGPMTRAGARKAKEALQQVLSILFEYKPKFQGEKSKVVSCIMAQMEDD

SEQ ID NO: 159865 - protein, 151 aa, Glycine max
  Coding DNA Sequence Number=SeqID_68180
TRHPVDPKKSTGLWGFQLWLRASISPTGCPSPPARSCHRDIGIAPARHPVDPENSNRVLGFPALITGLFQFYGVPIAPNKVIKPPTNRAFIKKYCAPRQAQGETPQQSGDGRQRATDALPPPLKPLISSTKAGALPTTRGRLAGDQVQSQR

SEQ ID NO: 159866 - protein, 92 aa, Glycine max
  Coding DNA Sequence Number=SeqID_68181
MPDSTQRLTSSSAPFVIQGQRVGWWAEIPYGHPLLSSTERNEFGSIRMMSIFYSRCPETFKSNDARNSSLLGRDDWVQWQREVSWLPNFVVF

SEQ ID NO: 159867 - protein, 89 aa, Glycine max
  Coding DNA Sequence Number=SeqID_68182
MVEDARTTLGNQFLGHRTQWWRIHVWQSIHGAQNKMVEDARKALGNQFVVLEIRFDDGGCTNSGRKSIRGAPDSMVEDASITMNSWGSE

SEQ ID NO: 159868 - protein, 64 aa, Glycine max
  Coding DNA Sequence Number=SeqID_68183
  Gene Ontology: Mol. function=nucleic acid binding
  Homolog annotation: Hit_ID=Q6RZV4; Match level="QueryCoverage=65%, HitCoverage=19%, E-value=3e-10, Identity=69%"; Hit description =Retrotransposon-like protein
MCLMADSMDDSSTIEETEVCPIARDSLWYLDSGCSRHMMGDKSKLTDFLSKEEGYVTFGDNNKG

SEQ ID NO: 159869 - protein, 59 aa, Glycine max
  Coding DNA Sequence Number=SeqID_68184
MSQERTSLEEYFLEASTLKSNQGVMAGRNDRAIANALQALAQAIGNPNRGEVVGVVEYQ

SEQ ID NO: 159870 - protein, 53 aa, Glycine max
  Coding DNA Sequence Number=SeqID_68185
MGEWWRQFKSDLTSKWAFVADKDSVDGIVCEKYEISKEKWTQFYQSRRDPSWE

SEQ ID NO: 159871 - protein, 171 aa, Glycine max
  Coding DNA Sequence Number=SeqID_68186
MTTMMEAMMSMKKIMEANAVTVFATSAVAKAKIWKVRAAPHYAQIKNRHAFPPYGLPPNYTPPNVAYIPNEDVNNSAPILIESQQPQSDHAHVSQPMGETHGMPHHNLADFEPCLEYATEGQAVGGILLRNTLEGPQYHPQPHLLPTTGKIPPVMEGKGKVGSSRGKAQGH

SEQ ID NO: 159872 - protein, 55 aa, Glycine max
  Coding DNA Sequence Number=SeqID_68187
MELVQVIEVTSSEEDPEEDPKELPPEPADVMSAFEADSTEESGPGGIATSRGSSS

SEQ ID NO: 159873 - protein, 80 aa, Glycine max
  Coding DNA Sequence Number=SeqID_68188
VHPTLPEHFVPFEHPEHSVTSESVHSVVGDFEHPDFEHSDFAHSKNMAQPPPRERTLREMAAPDFTYESLCIQYPDEDVP

SEQ ID NO: 159874 - protein, 154 aa, Glycine max
  Coding DNA Sequence Number=SeqID_68189
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MEWNGMEWNGMEWNGINASAGEWNGMECNGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 159875 - protein, 87 aa, Glycine max
  Coding DNA Sequence Number=SeqID_68190
MTNRLRYLLFALTKIQRTNRLRILCPNTLKGTSFVRGYISCGSVQVEGTSTWFFKENKEGYIPCGSLACKGFYKVERNLKNRRLLGD

SEQ ID NO: 159876 - protein, 89 aa, Glycine max
  Coding DNA Sequence Number=SeqID_68191
MMSVLSGATLFCKITHAPNIFKIRVDRDSLGSNQGVPMKIKRIKIIPEWPTPPSVDEKSPIEFQEPRDLRSNPFQGRGNDAILSRKGIG

SEQ ID NO: 159877 - protein, 197 aa, Glycine max
  Coding DNA Sequence Number=SeqID_68192
  Gene Ontology: Mol. function=catalytic activity; Biological process =metabolic process
  Homolog annotation: Hit_ID=Q9SCS3; Match level="QueryCoverage=99%, HitCoverage=85%, E-value=4e-59, Identity=58%"; Hit description =Putative uncharacterized protein T20E23_120
  Pfam annotation: Domain name=PGAM; Domain location=1-139; Score =109.7; E_value=8.7e-30; Accession=PF00300.13; Description =Phosphoglycerate mutase family
GQVDIELNETGRQQAVAVANRLSREPKISAIYSSDLQRAFETAQIIAVKCGGLEVVKDLDLRERHMGDLQGHPYRELATTNPIGYEALESKNDDRELPGGGESFVQLFERCKSALLKIGRKHKGERVVVVTHGASIETLYRWANATGRYKGKIDNASIAVFRLYGEDKWTLNMKGDVSHLCHNGFLQPGFEGDTTTT

SEQ ID NO: 159878 - protein, 113 aa, Glycine max
  Coding DNA Sequence Number=SeqID_68193
MVSSVQVDLSDVNIKVLIWVTDTIVLLDSQGYVSCRTLTLVAFDISKVVKTDYPLVVVHSPSEGSLPLQRDADAYPLLALIISSPLGIGQFGPPRAILHADDSQVVMLQLCLF

SEQ ID NO: 159879 - protein, 78 aa, Glycine max
  Coding DNA Sequence Number=SeqID_68194
MADDPTQTLMDYLNPTLGETNTIQLTDLPEEVTFELEHGTSLDAAYGGNLMLKTHVDAIKSLKTCALTPTTTQQIGRL

SEQ ID NO: 159880 - protein, 57 aa, Glycine max
  Coding DNA Sequence Number=SeqID_68195
MYGDGEKNKKVKLQTLRRQYKLLYMEEKESIADYFDRIQELVNALRSCKDKISDEQV

SEQ ID NO: 159881 - protein, 107 aa, Glycine max
  Coding DNA Sequence Number=SeqID_68196
MSFFCWRERRRIAARKVEEEEEPQRGERSATQRSRRRMKETTTRRKKCNTKEEALRQNGGITIARRSVARKNDCSHIYINRVNDILALSPRMLGVPVKLLGAQSNTL

SEQ ID NO: 159882 - protein, 67 aa, Glycine max
  Coding DNA Sequence Number=SeqID_68197
MPKVGKTTSMEAGSLSFTTKMSHGVRGDAMGNKPWKREFHHQDEPWIRSLERMFQWRKRKRGGGARN

SEQ ID NO: 159883 - protein, 23 aa, Glycine max
  Coding DNA Sequence Number=SeqID_68198
MPVQVDWPRVQLPSIGGDTFSTV

SEQ ID NO: 159884 - protein, 23 aa, Glycine max
  Coding DNA Sequence Number=SeqID_68199
MTDSWTWRSLVSKVFLPDPGRQF

SEQ ID NO: 159885 - protein, 173 aa, Glycine max
  Coding DNA Sequence Number=SeqID_68200
MGSSQVPWLKKRFYQVKIKSLGVTSLKELGQLMEILECPLGGRKLYLFSGFYPSLATISKIVKISTLELDRGKQVENGVVGVPRKCLEAKARTLASQDEWALFMDVLVLLIFGVVLFPNVDGLVDLAAIDAFLAFHDRKESPVVAILADLYDTFDRRCEKNSARIACCTPALY

SEQ ID NO: 159886 - protein, 144 aa, Glycine max
  Coding DNA Sequence Number=SeqID_68201
  Gene Ontology: Mol. function=binding; Cellular component=nucleus; Biological process=activation of protein kinase C
  Homolog annotation: Hit_ID=A7R0D1; Match level="QueryCoverage=74%, HitCoverage=23%, E-value=7e-28, Identity=55%"; Hit description =Chromosome undetermined scaffold_304, whole genome shotgun sequence
  Pfam annotation: Domain name=PPR; Domain location=27-61; Score=35.3; E_value=2.2e-07; Accession=PF01535.11; Description=PPR repeat
  Pfam annotation: Domain name=PPR; Domain location=62-96; Score=1.8; E_ value=4.7; Accession=PF01535.11; Description=PPR repeat
  Pfam module annotation: Pfam domain module=PPR::PPR; Domain location =27-61::62-96
MAIMYSRCADIDEAQALFDGVRVKAVSTYNSMIGGLALHRKSIEAVVLFSEMLKERVRRNGITFVGVLNGCSHGGLVDLGGEIFESMEMIRGIEAEEEHYGCMVQILGKMRVVVIGHWKQFHTASTQLLVPFEIDYSLISKPMD

SEQ ID NO: 159887 - protein, 75 aa, Glycine max
  Coding DNA Sequence Number=SeqID_68202
MIKIEIRNNSPVSQRALRGRAKARLTGALSKGGKMRGVATNVYLWKTSEKPKETGRQKRGFCSYIPSIEEEIRPT

SEQ ID NO: 159888 - protein, 630 aa, Glycine max
  Coding DNA Sequence Number=SeqID_68203
  Gene Ontology: Mol. function=protein binding
  Homolog annotation: Hit_ID=Q4FX62; Match level="QueryCoverage=91%, HitCoverage=97%, E-value=7e-20, Identity=23%"; Hit description =Proteophosphoglycan 5
MEKAQATSNIESLVVRDAHQTEGLSLVSLASLKARQIQGSSFVSLASQKPRQTQGSPLVSLASPKAHQTQGLLNPRFTLSEHRCISTGLSNPRSTFVLPLQRLVKPNVRSRLVSLLQRLVKPKASQTQGPPMVSLIAPKAHQTQGLPFVSVAPPKANPRSTLGSSLVCLTSPKGRQTQGPSLVSFASPKACQTQGFSLVSLASPEACQTEGLSLVNLALPKACQTRGPPMASLASPKAHQTQGLSLVSLTAPKACQTQGPPLVSLAPLKARQIQGLPLVSLASSKARQTQGFSLVSLASLEACQIEGLSLVNLASPKACQTRGPTMASLASPKARQTQGLSLVSLTAPKACQTQGPPLVSLAPPTARQIQGPPLVSLASSKARLTQGLSMVRLAPPKARQTQGPSLMSLASSKAGQTQGSSNPRYAFLSLAPPKARQIQGSPMVSLATPKAHQTQNPPLASLTPSKARQTQGSSNPRSTLGESWISKGSSNSRFVLGESRFSKGSLNLRCILGESGFSKGSSNPRPIVGESHFAKGSSNPRSTLGTYSYKNLRHAFGESQLNYSQTSGEKLCKTKGSNTKMIDKSFNQVETKPEKILCHLAFYFIQRHQDPTSYTAKISLIKVAYPYYHK

SEQ ID NO: 159889 - protein, 191 aa, Glycine max
  Coding DNA Sequence Number=SeqID_68204
  Gene Ontology: Cellular component=membrane
  Homolog annotation: Hit_ID=A7QKA3; Match level="QueryCoverage=23%, HitCoverage=15%, E-value=2e-12, Identity=75%"; Hit description =Chromosome chr2 scaffold_112, whole genome shotgun sequence
MGNINLAASLKKKGRKKYRRERKVKQPLLVPSRSFAGLPLDLVVFVLREPSAFALLKHTGFEDLLLKGVDDSVLGLVLAHHDLHIEVKNVGKGECNADADVVTATAQDRYLPVSFNQAISATMSFFTAIFAFLITCKKETGVVFGIVVAGNSEEEKTSPPLSLSLSLSGAMETMEALVGTLGLLLAAFANK

SEQ ID NO: 159890 - protein, 236 aa, Glycine max
  Coding DNA Sequence Number=SeqID_68205
MEELVFLLLFVDHKVVPGDMSWGSGDLGDVRRAPGSQPIKEQSPRSKEACVAAGQLCILGGIWKLASGNRLPFGDRALVIDYQLGVIDYIALPTTALLIHDRVVMECLEGVWETLEGNERCRFYDTIRLTATSLVHSEEPARTLQQPVEWILPTPTPYRLVELVQVIKVSSSEEDLEEDPEELPPEPAMDALDLPEDDKDPLPDVDSPEDIMSASKADSTEESDPGGIANSDDPSS

SEQ ID NO: 159891 - protein, 163 aa, Glycine max
  Coding DNA Sequence Number=SeqID_68206
MPGLGRDWSSLVLGNSTLPDVPKVAVGRWCTTSFPHPQCAHKPIIPCCPPPTELTYSHVAHILVSLNTGSPLILPSFPNIKPSKTGQRQKTLPKTPTKSHLFSLKDPSNNPFVPHVETRFTTPEMPSFCDLERKWAPKVEALLGNNGGGRKEEEGCVRERESF

SEQ ID NO: 159892 - protein, 194 aa, Glycine max
  Coding DNA Sequence Number=SeqID_68207
ALNDDWKFDFSVHDARRLVCTNQADMTGRLLAGSLALESHILHYPIMHILLPRSSNLAQVSEEDLIVMWAFHTGRKIDWAHLVRYRMHKALRLNAPLPYPHLVTLFLQHFNIPLDSKPYVPIKRSFLIGAFVGAKPNDDEGHLPVGEDYSLLQSILDRFDGLQTYVGERITKVEGNVTFIRTCFDLPPPPPPSS

SEQ ID NO: 159893 - protein, 344 aa, Glycine max
  Coding DNA Sequence Number=SeqID_68208
MVEDRWRGVVSDVNFAVEVDGPHPILCAVIQGNIVAVLLDLALSGGSGKRGQVGASEGRDDANVLVEGWGETVEEEDVVVLEFAVCGVQAPAAEVHTGVRVRAVLSAGQPTAVRVRAPRVRREQRVKAAERAQRGAAGRRRQVAGVRGGGVSARPRLRLRGLHLAPAAAPPSNPDGAPQREEGVGKVLLANPGMLQHGGIVVPHLHQPVFNALSNQMVGQNVGQQEFLETQQMFLANRDHQHQQQQQQQHVMLRSYEQQEFMKFNNGVFEPSVGGGFGNQAEEFLSPSLALGNFENVESYQMQQQGEQHHPIEAQLLLSPQQESQGQHQQQQCASEDGRNVVPA

SEQ ID NO: 159894 - protein, 61 aa, Glycine max
  Coding DNA Sequence Number=SeqID_68209
FEEVTKTHGLRKTPPFNFRHITEFSRIAELLGPILGSMETWEVEVDLWSCWVSNSLDNSEA

SEQ ID NO: 159895 - protein, 50 aa, Glycine max
  Coding DNA Sequence Number=SeqID_68210
MEDLEDVVIYTPRVQGRGKILGNCICIVFVLGSIMVDVQRDLRTIGCRSS

SEQ ID NO: 159896 - protein, 103 aa, Glycine max
  Coding DNA Sequence Number=SeqID_68211
MTGMAEEETKEKKSRSLTLKSFIPSSDKRDEESAKGSESENLTLIVRKFKFLKNKNLKGRSIQHKKNFKKNDSTSSNFTYFERGKSGHIKSECSISIIMSIQI

SEQ ID NO: 159897 - protein, 469 aa, Glycine max
  Coding DNA Sequence Number=SeqID_68212
MALAHDFERSDPWNKWEPKLVFGYKRTQKWALVGAYLWAKTVANALNVWGFAQIHIDICISEEVEMAPKKLSTKRSRSDAHEDGSSAPMEFDNHRFRSAEHQQRFDTIKGWSFHRERCVQLREDKYPDFQEEIARRRWERLVTPMAKFDLEIVIEFYANAWPTEEGVRDMHSRVRGHWIPFDADALSQFLGDPLILEENQQCEFSQRRNQADGFDEEAIAWLLCILGQDFTRTPAWRRVWIMRTSMTTLTQIWMTLLLSNVLPSDHNSDLPLPKCQLVYAILTRMSVHVAQVIADAIYLFAGMAPTRHPLDPEKFNMALGFPTLITGLCQFYGVHVAPNKVIQPPITRAFIEKYCTPRQVQGDAHQAASAPPPPRQANSAGPLSTANHRGQVQLHECLYRFNLSQQRQGSAPFVCPTPEKFRDEVAWPGDWPDAQTEMEPAESPGDEDESHMDEDMTNLLSFLGGSGAT

SEQ ID NO: 159898 - protein, 133 aa, Glycine max
  Coding DNA Sequence Number=SeqID_68213
MPSSFADLVFTGERIEVGLKRGKFDYVSTAGASGRRTGTAEAKKKEGDAHTVTSTPVWPKPPQTPHGTHQYAQHHPSFAACTGGSSDLALAQPRAPTPPQRRAPQAPAPTQPHPANNAHLGAGSNTARNFSSR

SEQ ID NO: 159899 - protein, 151 aa, Glycine max
  Coding DNA Sequence Number=SeqID_68214
MRLHCYQASQRPSMTTNRPPLLVAHIDLVPSGVAICCNLPYDGRARQNAKGVSSKEKTRGSRHQPLLEENIRKTKKRYANIEKTVPSPSGPWNPSSTSLAHLFICVATYPSAEGRCEAHRCVFQVRKTRRVATNIYLRKTFGKTKKRVYEL

SEQ ID NO: 159900 - protein, 74 aa, Glycine max
  Coding DNA Sequence Number=SeqID_68215
  Subcellular localization annotation: CTP_CleavageSite=46; ConfidenceScore=5.08e-01
MAKIQGPNEGKTYSNIYKDKRAHTWFMGSKSTLRLMRTLGPSLGSLAQSTWSLLSNALAGLVESQRKELRKHWT

SEQ ID NO: 159901 - protein, 219 aa, Glycine max
  Coding DNA Sequence Number=SeqID_68216
  Homolog annotation: Hit_ID=A2Q3G1; Match level="QueryCoverage=13%, HitCoverage=5%, E-value=1e-07, Identity=80%"; Hit description=C2; von Willebrand factor, type A; Copine
MHSYEAVKVLVAALVEVLERETTMVKENATEEEKAMIGRPGAWEEGGVLRGKKDAVTALCLIVREEGTTTARYALCSMTKDNKVRAGVMRALMELMVDLGSSISYLVSLVVVAVAEGRVALVEEGGLPVLVEIVEILLVCNNCLSVQKFGTKDNPLLIECFDFNSSGNHAIMEVGEVIQFYDSDRQSFLLRTLEESYLVAVGVEGIMEAYASALHSVTL

SEQ ID NO: 159902 - protein, 104 aa, Glycine max
  Coding DNA Sequence Number=SeqID_68217
MARRLQEDWARDAGECPRVLMSLRGRHRSHLRPHSHRREKERKPQEASINLPYFYGKDNVEANLDWEIRVERQLKRKSTLKSYGPRSLLSKERPRSRHLRGDTF

SEQ ID NO: 159903 - protein, 107 aa, Glycine max
  Coding DNA Sequence Number=SeqID_68218
MEKEDTRTIENTRGRKQKEEGSTKWSPDVAEWQWEESKEFSDCVILNSLTREKGDTKEFRRLVPCSFGKERRETQKEFRRLVLGEFFLAKGEENEKMNSTSFQGLEN

SEQ ID NO: 159904 - protein, 33 aa, Glycine max
  Coding DNA Sequence Number=SeqID_68219
MKECEGRSFLHGVTGCVILDRIGIFNTRIALPA

SEQ ID NO: 159905 - protein, 66 aa, Glycine max
  Coding DNA Sequence Number=SeqID_68220
MEVEESLLGLWLPLHYRADRGAFFWKIPSLVGALVGALANFVVDLEVAFVDDYAFLADRVVGNEKG

SEQ ID NO: 159906 - protein, 182 aa, Glycine max
  Coding DNA Sequence Number=SeqID_68221
MAPTRHPLDPDKSNKALGFPALITGLCQSFGVPVAPSKVIRPPITRAFIEKYCTQRQVQGDAPQAADAPPPHQAGPSGLFDTEQYLRHLVRQQAANHQAHVQTHDCLYQMSLSLQSQGFTSFPCPTPDQFRAEVAWPGDWPEARAGESPAEAPAEAPDEADEAREDEEMTDLLDFLGGSGAT

SEQ ID NO: 159907 - protein, 332 aa, Glycine max
  Coding DNA Sequence Number=SeqID_68222
  Gene Ontology: Mol. function=DNA-directed DNA polymerase activity; Cellular component=cytoplasm; Biological process=DNA replication
  Homolog annotation: Hit_ID=A9DZR5; Match level="QueryCoverage=99%, HitCoverage=93%, E-value=9e-89, Identity=47%"; Hit description=DNA polymerase III, beta-subunit
  Pfam annotation: Domain name=DNA_pol3_beta; Domain location=1-124; Score=63.0; E_value=1e-15; Accession=PF00712.10; Description=DNA polymerase III beta subunit, N-terminal domain
  Pfam annotation: Domain name=DNA_pol3_beta_2; Domain location=125 -223; Score=16.1; E_value=7e-07; Accession=PF02767.7; Description=DNA polymerase III beta subunit, central domain
  Pfam annotation: Domain name=DNA_pol3_beta_3; Domain location=225 -332; Score=65.1; E_value=2.3e-16; Accession=PF02768.6; Description =DNA polymerase III beta subunit, C-terminal domain
  Pfam module annotation: Pfam domain module=DNA_pol3_beta::DNA_pol3 _beta_2::DNA_pol3_beta_3; Domain location=1-124::125-223::225-332
MKFIISSGELQKALQTVSGVISSSQSRPILENYLFELNETQVTITASDGETTLVTSLEVKSDDSGKFAVPAKIFQDFIKTYGEQPLTFSVKDNAEGTGSQLEILDEKDNFAVALDNADDYPELPEFDASQSVTMSAGVLFQFGENETNFVSTDSHRLVVYKRMDLMNVEPMEFIMPKKPLNIFKNILASSNEDVTIDFNENMAKFTFGKHIWICRLIDGKYPNYTAVIPKENPNVLTINRNLLLGAIKRASIMSNKSTNQVRFKLSANILHLHAEDTEYANKADMQIPCDYNGEDINIGFSSKFLTEMLTILGSDDITMKMSQPNRPGIIDL

SEQ ID NO: 159908 - protein, 116 aa, Glycine max
  Coding DNA Sequence Number=SeqID_68223
MSSSSEDYRSSPSEVCPSSPLEDYTSSPSEDYMSSHLEDYTSSPSEDYTSLPLNGYTPSSSRAARPRLKRTTRLRLDRAACPLLQRTTCPRRQRAKGPHRQRTTRPRLQRDTRPHL

SEQ ID NO: 159909 - protein, 100 aa, Glycine max
  Coding DNA Sequence Number=SeqID_68224
  Pfam annotation: Domain name=G-patch; Domain location=1-42; Score =28.0; E_value=3.4e-05; Accession=PF01585.14; Description=G-patch domain
MVARVMLGNGYEPGMGLGKDNGGITSLISAKGNRGKFGLGYKPTQTDIRKSGSQGSRLRQQDEGNSPCHISRSFISVGLGDKGQVIAICKDDAPSGSNLV

SEQ ID NO: 159910 - protein, 58 aa, Glycine max
  Coding DNA Sequence Number=SeqID_68225
MATARWALKHPVYGIVILRLGIYTDRPNVSKTTFLNEKLYTVPEFQQTLLTTTKQVPT

SEQ ID NO: 159911 - protein, 40 aa, Glycine max
  Coding DNA Sequence Number=SeqID_68226
MDKSMKVGEDKWGERGRGGERNEILRERRGRMRRIICNWA

SEQ ID NO: 159912 - protein, 89 aa, Glycine max
  Coding DNA Sequence Number=SeqID_68227
MSSWGKKTVSFSSLLEQDCSCGQGFGMRVGSCKENSKRRSGPTTEVLGRQGKGYGESRGVGPVCGHISIANLWGCPLSKRGRFGGPSRD

SEQ ID NO: 159913 - protein, 82 aa, Glycine max
  Coding DNA Sequence Number=SeqID_68228
MAGTPQLVAAEQKLDSSEPVHGLTRDIVITVIAYMLPYRLGMAGRGRDHNRDVLDRITVVLETLVQELDVEPAEYRGLMAFP

SEQ ID NO: 159914 - protein, 39 aa, Glycine max
  Coding DNA Sequence Number=SeqID_68229
MDTRLRVIGDPMNGGSTGVGVTTHSLRIHLVSVVVGPPL

SEQ ID NO: 159915 - protein, 227 aa, Glycine max
  Coding DNA Sequence Number=SeqID_68230
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7NV71; Match level="QueryCoverage=45%, HitCoverage=24%, E-value=2e-14, Identity=74%"; Hit description =Chromosome chr18 scaffold_1, whole genome shotgun sequence
  Pfam annotation: Domain name=PIP5K; Domain location=93-218; Score= -136.2; E_value=0.01; Accession=PF01504.9; Description=Phosphatidylino sitol-4-phosphate 5-Kinase
  Subcellular localization annotation: CTP_CleavageSite=57; ConfidenceScore=5.89e-01
MASESSPNLTATHTAGCGAPTKSTGKVKSVMRTGTCTRGRGSGTCRRGRGATCGRMRMSTTGSRRVASFAAVGRSFWLAGTVTRANGRTGFPRDKGWEGSFHFEKFWTRFPTEGSKITLPDQSVEFRWKDYCPMVFRQLRKLCIEEVIVMGNLFCSEYQIHKRFDLKGSSHGQTTDKTKEIDETTTLKDLDLNFVFRLQNNWFQDFINSTLRIPPLVVRRSWRSMMT

SEQ ID NO: 159916 - protein, 203 aa, Glycine max
  Coding DNA Sequence Number=SeqID_68231
MASRKRKSIGTRPTSQYDTRRFSSLDAWTKYTDNVLGRNILPERKVELYHTELDDFKAELERRNFHKRLINLADRSIDLTLVKEFYANLYSSEDRPPKQSKVRGHLVKIVTDSLNAFLETPVVLAEGETLPAYSRYCRLPIDFREIEAALCIPGRGFILNSEGHHGRILRKDLTTLAQVWSVLSYSNLAPTSHTSDLTVTELG

SEQ ID NO: 159917 - protein, 95 aa, Glycine max
  Coding DNA Sequence Number=SeqID_68232
MAPKKLSTKRSRRDTTGEGSSAASGFNSHRFQSSEHQHRFEAIRGWSFHRERRVKLREDEYTDFQEEVARRHWTPLVTPMAKFDPEIVLEFYANA

SEQ ID NO: 159918 - protein, 289 aa, Glycine max
  Coding DNA Sequence Number=SeqID_68233
  Gene Ontology: Mol. function=fructuronate reductase activity; Cellular component=cytoplasm; Biological process=metabolic process
  Homolog annotation: Hit_ID=A6TBQ2; Match level="QueryCoverage=100%, HitCoverage=59%, E-value=1e-154, Identity=91%"; Hit description =Putative mannitol dehydrogenase
  Pfam annotation: Domain name=Mannitol_dh; Domain location=1-69; Score= -4.9; E_value=8.4e-05; Accession=PF01232.14; Description=Mannitol dehydrogenase
  Pfam annotation: Domain name=Mannitol_dh_C; Domain location=97-289; Score=297.0; E_value=3.6e-86; Accession=PF08125.4; Description =Mannitol dehydrogenase C-terminal domai
  Pfam module annotation: Pfam domain module=Mannitol_dh::Mannitol_dh _C; Domain location=1-69::97-289
VAIVSLTITEKGYCIDPATGKLDPAQPRIVHDLENPTLPQSAPGILVEALNRRRERGLAPFTILSCDNIPDNGHVVKNAVLGMAEKRSQELASWIAEHVSFPGTMVDRIVPAATEESLAEIASVLGVDDPCAISCEPFIQWVVEDNFVAGRPAWETAGVQMTNDVLPWEQMKLRMLNGSHSFLAWLGYLAGHAHVSDCMQDDVFRHAARRLMLDEQAPTLSITGVDLVAYADSLITRFANPALKHRTWQIAMDGSQKLPQRMLDSIRVHLANDSRWPLLALGVAGWMRY

SEQ ID NO: 159919 - protein, 359 aa, Glycine max
  Coding DNA Sequence Number=SeqID_68234
  Homolog annotation: Hit_ID=A7PVZ1; Match level="QueryCoverage=100%, HitCoverage=37%, E-value=2e-74, Identity=53%"; Hit description =Chromosome chr8 scaffold_34, whole genome shotgun sequence
MCREPRCTSWFCVADSAFQYEVSDDSVQADWRQTFADASGTYHHFELIVGDGYVTITKGESIRRFFEHAEEAEEEEDDDSVDKDGNELDGECSRPQKHAKSPELAREFLLDAATIIFKEQACLALVEKAFREGTARQNAHSIFVCLALKLLEDRVHVACKEIITLEKQMKLLEEEEKEKREEEERKERRRTKEREKKLRRKERLKGKEKEKKCSESNDALGSPEISKKELSAVADMEQNTPISCSNLVIETDETNLLRDDSPNIEDEEFSSECSTLKPQDLSYDDCEEEISNAEDEMGQSTIEQSMFSHRKLRCRKEFQLDMPMKWSDRRRYAVVSENSVMVCRSEPRHYGESFVTSSR

SEQ ID NO: 159920 - protein, 186 aa, Glycine max
  Coding DNA Sequence Number=SeqID_68235
MGDQEETQEQMKVDMSTLKEQMASMMEAMLGMRQLMENNVATAAAVSSPAEADPTLPATAHHPLPNTVGRERSTLGHISNPHVGYNRVAYPYGLPPNYTPPVMRDDAGHVPSPILEGEPPRQSDEVHKDHREYAQVDNDFYPPVLIEGPAPNVLPQPNLPAWPIFLSTEGPPPAVEERRKLDLIEE

SEQ ID NO: 159921 - protein, 118 aa, Glycine max
  Coding DNA Sequence Number=SeqID_68236
MYPFHRPHRVGRARMSLRYRWHSPCHVPVIPQTTNGIHHAADAGALPGLTGALSINPLIYSGKASREKCLENRIDDDGGFVCKAAGQGAEPRVMDRPGTPGADSVTVQTITGGKYDYA

SEQ ID NO: 159922 - protein, 335 aa, Glycine max
  Coding DNA Sequence Number=SeqID_68237
  Gene Ontology: Mol. function=RNA methyltransferase activity; Cellular component=nucleus; Biological process=RNA processing
  Homolog annotation: Hit_ID=A4WDF0; Match level="QueryCoverage=99%, HitCoverage=89%, E-value=1e-108, Identity=60%"; Hit description =tRNA/rRNA methyltransferase
  Pfam annotation: Domain name=SpoU_methylase; Domain location=200-328; Score=112.0; E_value=1.8e-30; Accession=PF00588.10; Description=SpoU rRNA Methylase family
  Pfam annotation: Domain name=SpoU_sub_bind; Domain location=112-187; Score=55.1; E_value=2.4e-13; Accession=PF08032.3; Description=RNA 2'- O ribose methyltransferase subs
  Pfam module annotation: Pfam domain module=SpoU_methylase::SpoU_sub _bind; Domain location=200-328::112-187
GRPAARQEENRRSGPRSTRNNEESGRPRTARGDDAGRSRGPRDDAGRSRGPRDDSARGRRSDRDDRGFSDSPWRTVSRPPVAAEADAGDEAASSKPVIDPELIRRQRQEETRVYGENACQALFQSRPESIVRAWFVQSVTPRFRETLRWLAANRKAYHVVDDAELAKASGTEHHGGVCFIIKKRMGMPVAEWLQQAQSKDCVLALEDVSNPHNLGGIMRSCAHFGVKGLLSARPEGGAEHVQAISGESFAAGLEAFRKAGYTIVTTSSHAGTPLAQAALPAKMVLVLGQEREGLSDSAFQQGDISLSIGGTGNVESLNVSVATGILLAEWWRQNA

SEQ ID NO: 159923 - protein, 179 aa, Glycine max
  Coding DNA Sequence Number=SeqID_68238
MTNLTQIWMTLLLSNILPSDRNADLPLRKYQLGSRQQDTQWTRRSPTGPWVSSSGYGPLSVLQGVRPPQQGIVPARHPVDPKKSNRVLGFPTLITGLCQFYGVLVAPSKVIRPPTNQAFIKNYGAPRQAQGETPQQHGDGRQQATDAPPPPPKPLSSSTKVGAFTTRGRPAGNQVQSQR

SEQ ID NO: 159924 - protein, 73 aa, Glycine max
  Coding DNA Sequence Number=SeqID_68239
  Gene Ontology: Mol. function=protein serine/threonine kinase activity; Cellular component=integral to membrane; Biological process=recognition or rejection of self pollen
  Homolog annotation: Hit_ID=A7P184; Match level="QueryCoverage=98%, HitCoverage=9%, E-value=2e-16, Identity=57%"; Hit description =Chromosome chr19 scaffold_4, whole genome shotgun sequence
MRPDKPKKNENIERQLEDLDVPLFHLLTITTATNNFSLNNKIGQGGFGPVYKGKLVDGREIAVKRLSSSTGQE

SEQ ID NO: 159925 - protein, 123 aa, Glycine max
  Coding DNA Sequence Number=SeqID_68240
  Homolog annotation: Hit_ID=A8GH84; Match level="QueryCoverage=100%, HitCoverage=69%, E-value=1e-57, Identity=89%"; Hit description=Smr protein/MutS2
MKNKPPLSQDEQQLFRESVAGAKKLRQDTIVHRPPKPKVKQIAPQRLLQEQVDASYYFSDEYQPQLEEEGPTRYVRPGSSPYELKKLRRGDYSPELFLDLHGLTQLQAKQELGALIAACKREH

SEQ ID NO: 159926 - protein, 339 aa, Glycine max
  Coding DNA Sequence Number=SeqID_68241
  Gene Ontology: Mol. function=transferase activity; Cellular component= cytoplasm; Biological process=biosynthetic process
  Homolog annotation: Hit_ID=P0A954; Match level="QueryCoverage=99%, HitCoverage=83%, E-value=1e-168, Identity=88%"; Hit description=3 -oxoacyl-[acyl-carrier-protein] synthase 1
  Pfam annotation: Domain name=Ketoacyl-synt_C; Domain location=187 -295; Score=163.4; E_value=6e-46; Accession=PF02801.13; Description =Beta-ketoacyl synthase, C-terminal do
  Pfam annotation: Domain name=ketoacyl-synt; Domain location=1-179; Score=70.4; E_value=6.1e-18; Accession=PF00109.17; Description=Beta -ketoacyl synthase, N-terminal domain
  Pfam module annotation: Pfam domain module=Ketoacyl-synt_C::ketoacyl -synt; Domain location=187-295::1-179
MSDASIYAFLAMQEAIASSGLKEEEYQNNPRVGLIAGSGGGSPRFQVFGADAMRSPRGLKAVGPYVVTKAMASGVSACLATPFKIHGVNYSISSACATSAHCIGNAVEQIQLGKQDIVFAGGGEELCWEMACEFDAMGALSTKYNDTPEKASRTYDADRDGFVIAGGGGMVVVEELEHALARGAHIYAEIVGYGATSDGADMVAPSGEGAVRCMKMAMQDLDAPIDYINVHGTSTPVGDVKELGAIREVFGDNTPAISSTKAMTGHSLGAAGVQEAIYSLLMLEHGFIAPSINIETLDEQAAGMNIVTQPTQRELTTVMSNSFGFGGTNATLVMRKLAK

SEQ ID NO: 159927 - protein, 960 aa, Glycine max
  Coding DNA Sequence Number=SeqID_68242
  Gene Ontology: Mol. function=transketolase activity; Cellular component=cytoplasm; Biological process=metabolic process
  Homolog annotation: Hit_ID=A4WCS7; Match level="QueryCoverage=29%, HitCoverage=95%, E-value=1e-120, Identity=75%"; Hit description =Transketolase subunit B
  Pfam annotation: Domain name=TPP_enzyme_C; Domain location=28-169; Score=-36.3; E_value=0.0055; Accession=PF02775.12; Description =Thiamine pyrophosphate enzyme, C-termina
  Pfam annotation: Domain name=Transket_pyr; Domain location=212-354; Score=-51.8; E_value=0.012; Accession=PF02779.15; Description =Transketolase, pyrimidine binding dom
  Pfam annotation: Domain name=Transketolase_C; Domain location=374 -494; Score=141.9; E_value=1.8e-39; Accession=PF02780.11; Description= Transketolase, C-terminal domain
  Pfam annotation: Domain name=Transketolase_N; Domain location=1-233; Score=-29.8; E_value=4.7e-13; Accession=PF00456.12; Description =Transketolase, thiamine diphosphate b
  Pfam module annotation: Pfam domain module=TPP_enzyme_C::Transket _pyr::Transketolase_C::Transketolase_N; Domain location=28-169::212 -354::374-494::1-233
HAGPALYSTLAIKGYFPLAELKTLNQNGTRLPSHPDRLRTRGVDATTGSLGQGVSIAAGMALSHRLAGRRNRVFSILGDGELNEGQCWEAFQFIAHHNLNNLTLFIDYNKQQLDGALDEVIQPFDLAAKFRAFGFEVQTIKGDDIAALLAAAAPARGGEQRPLAIVLDSIKGQGVAYLENLSNSHHLRLTPDVQQEIEKAIAELEAAHLENDAVEMRKVYAGAVRRQIEAGAPIIALEADLMSSMAMDGVHKDHPQHVINCGIMEGQCDRRRRRAVAHRPGALFMSLDYQRNNVKVIASDAGVSACHNGGTHMSFEDMGIVRGLAHSVVLEVTDATMFADILRQLMDLRGFYWVRTIRKQATRIYQEGSRFTIGKGNLLRDGDDITLIANGIMVAEALKAAQRLAQQGVSAAVIDMFTLKPIDRELIKTYAAKTGRIVTCENHSIHNGLGSAVAEVLAEECPTQMRRVGVKERYGQVGTQAFLQQEYGLTAEHILEAAGQVSGLGGGSVSLGRLDRRQRNGVDDIVNRLPVSSAPCDLGNVGHDGGVVLQRAVDDQIRAFFLRQTGCFAHFLDVAARAGVAGGVGDHRHARLDAEGRGGIRRLDGDFRQLLGGRIRVDRAVAVDQYLVRQQHEEHGGHQRAARRGFDQLQRRADGVGGGVNRAGDQTVDFALFQHQGAEHHVVFQLLARDHFGHALALAQLNQTRHVVFTHGDRIDDFDAFAQLNALRCRDALDLFRVAEQHAFRDAAFGADGRRFHGARLVAFRQHDALAGFTRQLGGGQRVDPFGVDVAGHVVLHFLDALVVVRRHFEVEALQAQRGLPGVGVDHEHRQAGLEGAFAQLLDRLVDGVAAGQQDGADFYAVHRRQAGGDQHVRTVRGGHQQRARAEVFQHVRDAARTEGHGLHAASHDVAFVDHAGLQVASHVDGAGGDQIEAPRHAAQNRQRAVGEQLRRIDVGDAGF

SEQ ID NO: 159928 - protein, 132 aa, Glycine max
  Coding DNA Sequence Number=SeqID_68243
MGRIVLLPVVRFLVKESTLFLLFLVDRDGSAINPRSSGDGVPRGSLGDPRRQCEVPIPWHDSTHAYFIVEPVQVKEVSSSEENPEEDPEELPPEPAVDALDFLEGDEDPLPEVDSTEESSPGGIVTSGYSSS

SEQ ID NO: 159929 - protein, 33 aa, Glycine max
  Coding DNA Sequence Number=SeqID_68244
MARTCSPLKVRTCSPLKARTSSPLKVMACNPSM

SEQ ID NO: 159930 - protein, 53 aa, Glycine max
  Coding DNA Sequence Number=SeqID_68245
MRLSHEVLKRASTTKRSFNALSVTEESGRASISRSCAKREGGAKRNVRNSEPI

SEQ ID NO: 159931 - protein, 96 aa, Glycine max
  Coding DNA Sequence Number=SeqID_68246
  Homolog annotation: Hit_ID=Q2HW90; Match level="QueryCoverage=69%, HitCoverage=14%, E-value=1e-07, Identity=38%"; Hit description =Putative uncharacterized protein
MGPLQRQAFRKVYGKILDLTAAEVVTEAVVSLAQYYDKPLRCFTFGDFQMVPTIEEFEEILGCPLEGRKPYLFSGFLPSLSRLQLWLEIQQKSWIA

SEQ ID NO: 159932 - protein, 86 aa, Glycine max
  Coding DNA Sequence Number=SeqID_68247
  Homolog annotation: Hit_ID=A5BM67; Match level="QueryCoverage=47%, HitCoverage=3%, E-value=2e-07, Identity=56%"; Hit description =Putative uncharacterized protein
MEDNVAHDGDMFKLTANNYSYWKPMMEDHLYCKDLLEPIIYKDNFWIVDFGASFHVAPHGSFFSSYQSGDFGTVQMGNKIGARSLG

SEQ ID NO: 159933 - protein, 149 aa, Glycine max
  Coding DNA Sequence Number=SeqID_68248
MMEAMMSMKKIMEANAVAVAATNAIGKHAFPPYGLPPNYTPPNVVYTPNKDVNNSTPILIESRQPHHVHVSQPMGEIHEISHHNLADFEPCLGYATERQAVGDIPLQNTLEGPQYHPQPHPLHSTTGKKPSCYGRNGKVGSSRGKAQGH

SEQ ID NO: 159934 - protein, 31 aa, Glycine max
  Coding DNA Sequence Number=SeqID_68249
MGVMQFGPKVKFSLGSSQHRGVLHLLPYRAS

SEQ ID NO: 159935 - protein, 252 aa, Glycine max
  Coding DNA Sequence Number=SeqID_68250
MVAVRQQQPDVFPFGGKALQNAADAQRFLDQRLVTVFFESDVFDTGLAAPVAVLRRQQGMEQRLRFARIHSRPHHDLHQPIARQRPAFTRARRFRHRQRGRWQDADADLREPADLEHPGHAAERAELGAVDPHRHHDFHQRAGHGDAPFRKHHDRPPLLDHAHQLLDGHRLGGIERDEINVGPQPAHKPALADAGEQRQQHAVEERDVVRRNQQFLPARSAERPLRPEPETAGETARAAVKRSCPSPLAMEA

SEQ ID NO: 159936 - protein, 188 aa, Glycine max
  Coding DNA Sequence Number=SeqID_68251
MYHLFFFFPTGPSFEYDSTTPSKQKLALGKGPWPSIRYQTNFVVHFKGKFYNRKYIFLTENLHPSTLFHIHESLPSTFKLALSSMVINCTSDSSSHSLKLLLHRGFQFHQPSSQKIPFTTLLHPNLARETKNKHRNSLIKGTSASHLSLQNKLLVSNEFIDSLPSVAPSSSIILEGQLRQCKASVCQL

SEQ ID NO: 159937 - protein, 190 aa, Glycine max
  Coding DNA Sequence Number=SeqID_68252
  Homolog annotation: Hit_ID=A2Q6C8; Match level="QueryCoverage=35%, HitCoverage=19%, E-value=6e-08, Identity=34%"; Hit description =Lambda integrase-like, N-terminal
MDENQWMCDSMMSEEVYMNVENEKDVGFKVEHVDCSDAFKTSQLLVSHDEVLQWARSLAHDIGFVVVIMRSDTNIGVRGRVSFLLIACEMSASFERRMMDGEDDNVVRDLFWSHPDEQFRGLFMKVDSLPEVIVTDRDLSLINAVKTVFPDATNLLCWFHIDKNVKAKCKSPGCLKECMGLYDGGLGEFG

SEQ ID NO: 159938 - protein, 107 aa, Glycine max
  Coding DNA Sequence Number=SeqID_68253
MENHIDLALVKEFYSNLYDPKDRSPRQCKVWGKTIKFDAATLNTFLETLVMLESGERYSAYSRYCHTHLGHQAIVAKLCLLGQGFVLNAEGAPWKLLRKDLTNLAQT

SEQ ID NO: 159939 - protein, 135 aa, Glycine max
  Coding DNA Sequence Number=SeqID_68254
MLLKGLLSEPDWLSETHPLSEEVSSLSQNKTLENVEPESSVQPARPTRMLFLLELSASKPILSIGKCLKSLELGKAARSKTLAGDLAPLDLEIEATCGRNNTTTKRRELQDRTANLSGERILSSESSSSFPTKLR

SEQ ID NO: 159940 - protein, 323 aa, Glycine max
  Coding DNA Sequence Number=SeqID_68255
  Pfam annotation: Domain name=Transposase_23; Domain location=51-121; Score=-17.3; E_value=0.093; Accession=PF03017.5; Description =TNP1ENSPM transposase
  Subcellular localization annotation: CTP_CleavageSite=34; ConfidenceScore=5.19e-01
MASFGQMQSQFQSQMQSQGLALPPEPLVGPSGPRVSTKESCVDASGNDPETGDSDRCGLYIEANPACLVALGRVYEGSTVVHNTPLLSGQVKVGMEEVKDPNAPVPVPIAEVSLVGQTIHTFLAWPTHLVKSLSQQPVVSPAKPPQKPDPEVDDPLYLMTLTIPEIFLRPYQVTWDATVFEVFNPDFPLYIKHEDLSEIAHGGQCLSISVLQLWILHLTETTMRGGNSDIYGFLEPQSIQRPDNYLKGIINSALKGLDDAPQPKSKAPARWTIVKGSTECGYYVMHWMSTIILGSFRNNWEATIGAREIKGAADPVDTVLSPS

SEQ ID NO: 159941 - protein, 258 aa, Glycine max
  Coding DNA Sequence Number=SeqID_68256
  Gene Ontology: Mol. function=oxidoreductase activity; Cellular component=cytoplasm; Biological process=flavonoid biosynthetic process
  Homolog annotation: Hit_ID=A7NUS8; Match level="QueryCoverage=100%, HitCoverage=75%, E-value=1e-93, Identity=60%"; Hit description =Chromosome chr18 scaffold_1, whole genome shotgun sequence
  Pfam annotation: Domain name=2OG-FeII_Oxy; Domain location=110-209; Score=134.5; E_value=3e-37; Accession=PF03171.11; Description=2OG -Fe(II) oxygenase superfamily
MDKMLRASQRFFDLSEEEKREYAGGKVLDPIRYGTSFNLMVDKALFWRDYLKCHVHPHFNVPSKPHGFSETVDEYITKSREVVGELLKGISLSLGLEENYIHKRLNVELGSQFLILNFYPPCPKPELVMGLPAHTDHGLLTLLMENELGGLQIQHKGRWIPVHALPNSFLINTGDHLEILTNGKYKSVLHRAVVNTKATRISVATAHGAPLDTSVGPAPELVGDENPAAYRAIKYRDYIHFQQSNELDRRSCLDHIRI

SEQ ID NO: 159942 - protein, 87 aa, Glycine max
  Coding DNA Sequence Number=SeqID_68257
  Subcellular localization annotation: CTP_CleavageSite=36; ConfidenceScore=5.00e-01
MAKLRDSSKSLVRTCSNRKERRVFKKVFPGSKKYLRSTKLRQERGLRIIGRFELVYTRVEIEAARFLDLAQFPTKLHKINFDFEQDG

SEQ ID NO: 159943 - protein, 144 aa, Glycine max
  Coding DNA Sequence Number=SeqID_68258
MATEEPIIRDNVNDFSNDEQQHDFDEHGEPTNQSESSSYFETISSQFSENREYSNPYQRTTSVNTNDFYEGLTFESKQAVVNAIKQFHFMHSFNFDVVKNKSDNYLPIWFTAAQHFVPSTIVKYETSSSMEEGDDNPPRVILNH

SEQ ID NO: 159944 - protein, 159 aa, Glycine max
  Coding DNA Sequence Number=SeqID_68259
MGLHQLWTILMKFPEPPSAMPGGTHRALGRVVACVVFAARDAHAEVEEAFVSNKVHVVLDVLVPLIIVVDDAIVGVEVVEEGGDGVVNGGTGLDKDDDRSRTLEGDNEVARGVLAREREGAFIVCTIYDLHLEGDGLVGQSLHSGKRKGERRSGGSVEW

SEQ ID NO: 159945 - protein, 43 aa, Glycine max
  Coding DNA Sequence Number=SeqID_68260
MRPSPTLALSAHQALSEQRRQALSEALSSKMQNPLCALSSATS

SEQ ID NO: 159946 - protein, 62 aa, Glycine max
  Coding DNA Sequence Number=SeqID_68261
MFLIFNTSALKGLDDTPQPKSKAVARWIVVKYFNEVRPLEAERFKALRIQWAQYYLKVRNQT

SEQ ID NO: 159947 - protein, 194 aa, Glycine max
  Coding DNA Sequence Number=SeqID_68262
MSADDTSLVIKMLMQMLQDLATMKTIGWSKQCGGLYYMSPLQGTPVSHQVHLTPWIIGLQLSQPINLNNQSHPIPMNLSCLSIHMKHLPLPEPTLTNSNTSNSSTPSIPQVRKSIRERQPPTWHREFIMPKKVNRSSSQSTSRTSTRYPLSNCLSYSCVSSTHFAFLANIKAHTEPHCYDQAVQDPHWQAAMDA

SEQ ID NO: 159948 - protein, 183 aa, Glycine max
  Coding DNA Sequence Number=SeqID_68263
MRKRFLQNSNPKSLNLQNLISPSTLNQIMSHKAQNSSFLILFHFHQLKLPKTPPNGKTIEKAKGGCDFILSLWNTKPRNIQGADISNSSLHIISYVVFLRRTTYPGSLDDEWKFDFSVSDARRMVCTNQVDMTRRLLTGSLAFECRFMHYLIVILLPRSSNLAQVSEEDLIIMWVFLTGRQIH

SEQ ID NO: 159949 - protein, 104 aa, Glycine max
  Coding DNA Sequence Number=SeqID_68264
ANVISSFGYRKERDGSWVKKDAPVQAAEDRSPSPHSQRDDSSSLMHNILERFDGLQTYVGERFDALERQVDMRFDKMDSRITKVEEDVTIIRDCLDLPPPPPSV

SEQ ID NO: 159950 - protein, 185 aa, Glycine max
  Coding DNA Sequence Number=SeqID_68265
MTTLTQIWMMLLLSNILPSDHKYRSPPVEVSVGLCRHDIGIVPTRHPVDPEEPNRALGFPALVTGLCQSYMGSRPQDTQWTRRSPTGSWGFQLSSRASASSTKCPSPPARSSGPLLIEISSTSTVPPSRRKDRHHKSLGMAGSGQQTHRRHLQSLSAHLQKLKRCLQPVVDQQATKSKAKDKQKY

SEQ ID NO: 159951 - protein, 76 aa, Glycine max
  Coding DNA Sequence Number=SeqID_68266
MAAEWRRKRERRHHFKEKMSLEEAHHHRRPWIRVWRKKEMNEGRGREEHEILCSKRALKYELTNPRSIPRFSTKCP

SEQ ID NO: 159952 - protein, 51 aa, Glycine max
  Coding DNA Sequence Number=SeqID_68267
ISLGPEVAWPGDWPEDQTEEAPAVAPDDAEDAHMDEEMTDLLSFLGGSGAT

SEQ ID NO: 159953 - protein, 98 aa, Glycine max
  Coding DNA Sequence Number=SeqID_68268
MATMMEAMMSMKKIMEVNAVAVAATSAVAEVDPTPPSGLNQINHAVLDMVGKRGKELGSTGGPHFASAPIPIESQQPQADPGHVSQPMGEKYEIPHHE

SEQ ID NO: 159954 - protein, 68 aa, Glycine max
  Coding DNA Sequence Number=SeqID_68269
MLGKLGRIGGDPVLRGTRIWEYVSSVGGGQQGMSGTWRYVAGVRRPWGRQVGCYCPKPSLTNPDPTRA

SEQ ID NO: 159955 - protein, 269 aa, Glycine max
  Coding DNA Sequence Number=SeqID_68270
  Gene Ontology: Mol. function=4-alpha-glucanotransferase activity; Cellular component=cytoplasm; Biological process=carbohydrate metabolic process
  Homolog annotation: Hit_ID=A8GKT8; Match level="QueryCoverage=91%, HitCoverage=35%, E-value=7e-77, Identity=58%"; Hit description=4 -alpha-glucanotransferase
  Pfam annotation: Domain name=Glyco_hydro_77; Domain location=3-263; Score=-132.9; E_value=1.6e-06; Accession=PF02446.8; Description=4 -alpha-glucanotransferase
MCCARGAISRLSICCAPICAIAGALRIDHVMALLRLWWIPYGEGADKGAYVAYPVHDLLAILALESQRQRCMVIGEDLGTVPQEIVSLLRDRGIFSWKVLMFECGEEGQFRPPAAYPRQSIASASTHDLPTLSGFWHAADLQLREQLGLFTKRSMLKAAIADRDRQRTALLNALSEAQAIDARSKNRAGQRLTPALNQGVHRFLAFTDSALLGLQPEDWLGMETPVNVPGTVAEYPNWRRKLRVPLEKLFSYRKVQRLLAIVNEGRKKP

SEQ ID NO: 159956 - protein, 135 aa, Glycine max
  Coding DNA Sequence Number=SeqID_68271
LGFPALITGLYQSFGVPVAPSKVIRPPITRAFIEKYCTQRQVQGDAPQAADAPPPHQAGPVGSFDTEQYLRHLMSLSLQSQGFTSFPCPTPDQFRAKAGEAPAEAPAEAPDEADEARDDEEMTDLLDFLGGSGAT

SEQ ID NO: 159957 - protein, 198 aa, Glycine max
  Coding DNA Sequence Number=SeqID_68272
  Homolog annotation: Hit_ID=Q6Z8F0; Match level="QueryCoverage=32%, HitCoverage=61%, E-value=4e-14, Identity=62%"; Hit description =Putative uncharacterized protein P0459B01.18
PRGATGSGHDGALTLSGAPFQGTWARSATEDASPDYNSDAEGDRFSWWAFPGLVGSVRARKRVVDGSRTDRLARDWSRAWLIHHFITAKSAMNPDFNQPRGGCSRRFSIHPAQQHCYMFALGKRCVTPRQACPRPNGFGRNLRSKDSMVHGDSAIHTKYRISLRSSSMQEPRYPLPRVIDEEAGRTGRRGHPLPPDGR

SEQ ID NO: 159958 - protein, 133 aa, Glycine max
  Coding DNA Sequence Number=SeqID_68273
RTTRPHIQRLQALAFRGLHVLTFRGLYALAFRGLLAFAFRGLHVLTFRGQHVLAFRGLYILTFRGLHAFTFRGLHVFALRTTRPHLQRATRPHLQRTTLPYHEDYTSSPSEDYTSSPSEDYTSSPLEDYMSSP

SEQ ID NO: 159959 - protein, 160 aa, Glycine max
  Coding DNA Sequence Number=SeqID_68274
MSKHPPHLSYGKQGNQREQQLLQIGNQRDQQLVHLGESGGATTSLDGESVMIIIFGDGGTASSLGEHGFATGDYGLAGTGSTRAGVGSGGAASLGLTVEGRAPGHATCLRNCSIVLIGLCIGTKVWELWTSGPIVAAGGAGVDGEGMSSALALFLDAIYK

SEQ ID NO: 159960 - protein, 133 aa, Glycine max
  Coding DNA Sequence Number=SeqID_68275
SFVFSARTPCCRPPFVTDASLPELVAAVCAGASLPEVIAAACADAIFRHPAITATIAMAMAVAMAPPSQTRHATAIRWRFFEKPPWPSFNNTALIHCNHLGDCGSFTLGIRAMNEALQPFGKMPLTWNSSRNQ

SEQ ID NO: 159961 - protein, 57 aa, Glycine max
  Coding DNA Sequence Number=SeqID_68276
MAKFDPDIVLEFSANAWPTEEGVLDMRSWVRGQWIPFDADALSQFLGDPLVLEEGQE

SEQ ID NO: 159962 - protein, 22 aa, Glycine max
  Coding DNA Sequence Number=SeqID_68277
IQQISGPWAMYEPTYLCKYYIK

SEQ ID NO: 159963 - protein, 292 aa, Glycine max
  Coding DNA Sequence Number=SeqID_68278
  Homolog annotation: Hit_ID=UPI00006A2D9E; Match level="QueryCoverage =55%, HitCoverage=84%, E-value=1e-12, Identity=16%"; Hit description =UPI00006A2D9E related cluster
IPLRGLHVLTFRGLHVLAFRGLHALAYRGLHVLAFRGLHALTIRGLHALAFRGLHVLAFRGLHALAFRGLHALTSRGLHVLAFRGQHVLAIRGLHVLTIRGLHAFRGLHVLAFRGLHVLAFRGLHTLTIRWLHVLALVGLHALTLRGLHVLTFRGWHVLAFGGLHTPLPLEGYASFLLSVPGPPPDPGGGPTMQVQPEEEAIVQLLCIPGQDFTRAAAKRRVWIMRTNMTTITQIWMTLLLSNILPSDRNVNLPLRKYQHPVDPEKSNRALGSPALVTGLYQSYRVPVPPSK

SEQ ID NO: 159964 - protein, 97 aa, Glycine max
  Coding DNA Sequence Number=SeqID_68279
  Subcellular localization annotation: CTP_CleavageSite=44; ConfidenceScore=5.54e-01
MGLKSTLRLMRTLGPSLASLAQSSWSLLSNALAVRCRNLPFGRRATRGSRVRLPWEENAWSRHQLLFEENVGKIGKVWSTNFKRERFGSCFYARGRY

SEQ ID NO: 159965 - protein, 57 aa, Glycine max
  Coding DNA Sequence Number=SeqID_68280
MPISPCGSISWSVSSRHRDRDHKAPSGPEGAMGFPARVTGLYQSYRVSVPPNKVMPS

SEQ ID NO: 159966 - protein, 50 aa, Glycine max
  Coding DNA Sequence Number=SeqID_68281
MGFWGDMMGNLGFCDDVCDVYMLKLLMESVRDEGCKSSLNKSKQMLWTGV

SEQ ID NO: 159967 - protein, 59 aa, Glycine max
  Coding DNA Sequence Number=SeqID_68282
EPVQVIEVSSSEEDLEEDLEELPPEPIVDALDFAEDDEDPLPDVDSPEDIMSASEVDST

SEQ ID NO: 159968 - protein, 71 aa, Glycine max
  Coding DNA Sequence Number=SeqID_68283
MRVTGFGSILGRIDSLLSYPNFVWEYLRGVQIATKPAWAFLRVPKEGGAFWWKQPCSPGRAGRQPPPSFLL

SEQ ID NO: 159969 - protein, 159 aa, Glycine max
  Coding DNA Sequence Number=SeqID_68284
  Gene Ontology: Mol. function=RNA-directed DNA polymerase activity; Biological process=regulation of transcription, DNA-dependent
  Homolog annotation: Hit_ID=A7PZ00; Match level="QueryCoverage=45%, HitCoverage=8%, E-value=1e-15, Identity=49%"; Hit description =Chromosome chr4 scaffold_39, whole genome shotgun sequence
QHFIGDPSLWKYRSAKLLSNLKYRTLADYRWYKDTFLTRVFTREDSQQPFWKEKFLAGLPRSLGDKTKEEVKKLNLEPAIEEQINNLLIETSEEETETSSFVLSDENLNIIQQDDQLSSTDDDGKINTLTREEDLLFEAINSIPDQQEKKVFRKNSRKH

SEQ ID NO: 159970 - protein, 75 aa, Glycine max
  Coding DNA Sequence Number=SeqID_68285
MRDGKRSSYVIGSGVNSGIDLGGKFLVLESAPKWALSIGRVVAVRVLNWRSSRCELKSSDDVAHTDAYHERSAGA

SEQ ID NO: 159971 - protein, 90 aa, Glycine max
  Coding DNA Sequence Number=SeqID_68286
  Gene Ontology: Mol. function=protein binding; Biological process =defense response to fungus
  Homolog annotation: Hit_ID=A7PBD9; Match level="QueryCoverage=78%, HitCoverage=8%, E-value=7e-14, Identity=46%"; Hit description =Chromosome chr16 scaffold_10, whole genome shotgun sequence
  Pfam annotation: Domain name=LRRNT_2; Domain location=23-61; Score =58.5; E_value=2.4e-14; Accession=PF08263.3; Description=Leucine rich repeat N-terminal domain
MEGIIILMMFQVVVSAQDHIMCIQTEREALLQFKAALLDPYGMLSSWTTSDCCQWQGIRCTNLTAHVLMLDLHGGFNPSSTWKSLPVAAS

SEQ ID NO: 159972 - protein, 47 aa, Glycine max
  Coding DNA Sequence Number=SeqID_68287
MPVSAETNSVVLERKNLADLHRNVRSASSGDASFLNLDRSSFLTDVG

SEQ ID NO: 159973 - protein, 61 aa, Glycine max
  Coding DNA Sequence Number=SeqID_68288
MKRNVKVSLTYVLIGPTKESDRSTLKKKLPIRSSDKLGPIPRQVAPNQNQGFVIPNKDFEF

SEQ ID NO: 159974 - protein, 98 aa, Glycine max
  Coding DNA Sequence Number=SeqID_68289
MGEGDDIEELAEESGVVEVGVDDEDVGTVKEALAGALEGGVVVAVEVVEAEDVVAAMLEGEGDRESTKTAMSVTRTERLEGEELRLDLAMCFSQWEPL

SEQ ID NO: 159975 - protein, 343 aa, Glycine max
  Coding DNA Sequence Number=SeqID_68290
  Gene Ontology: Cellular component=anchored to membrane
  Homolog annotation: Hit_ID=Q40315; Match level="QueryCoverage=45%, HitCoverage=65%, E-value=2e-12, Identity=32%"; Hit description =Putative surface protein
  Pfam annotation: Domain name=Fasciclin; Domain location=38-163; Score= 1.8; E_value=0.0023; Accession=PF02469.13; Description=Fasciclin domain
MEVMGSRWTTMVLIMSVAMVQCGVMSIDIDKVMRQYPEYSRFSKYLSQTQLARAICGRPSVTVLAVDNTAMGPLEGKPVDHIKNILRVHVALQYLDLDLQDKQTIALPTLSQGVLLKINKGAVTFVSATHPNAVVRARLIKPIIVSQSHNNISVVQVNSLIIPPTNPNALIPLIPPVPLLTPVPVISPLPIITPVPVVPPALPINSPAPVVSPVLPVNPPAPVMAPTVPVLTPVPVISPLPIITPVPVVPPSLPINPPAPVVSPVLPMNPPAPVPVVPVPVDGGVSTTPGADEPNQEEEEKNHDAGNGKIKGGLSMVGPYKDPPEGKLLALMVVFYNFTFGSL

SEQ ID NO: 159976 - protein, 431 aa, Glycine max
  Coding DNA Sequence Number=SeqID_68291
  Gene Ontology: Mol. function=transferase activity; Cellular component= cytoplasm; Biological process=flavonoid biosynthetic process
  Homolog annotation: Hit_ID=A4F1S2; Match level="QueryCoverage=87%, HitCoverage=89%, E-value=1e-177, Identity=80%"; Hit description =Putative acyltransferase
  Pfam annotation: Domain name=AATase; Domain location=34-431; Score= -210.6; E_value=0.025; Accession=PF07247.3; Description=Alcohol acetyltransferase
  Pfam annotation: Domain name=Transferase; Domain location=7-430; Score=279.6; E_value=6.5e-81; Accession=PF02458.6; Description =Transferase family
  Pfam module annotation: Pfam domain module=AATase::Transferase; Domain location=34-431::7-430
MGPNPNKRVEVEQENRWTGEVKMPADVDQCEAIHHGSAGGGDAAEGVVELQRGFGGAELPHAERVMKEALSKVLVPFYPMAARLRRDDDGRVEIYCDAQGVLFVEAETTAAIEDFGDFSPTLELRQLIPSVDYSAGVSLGVGMQHHVADGASGLHFINAWSDVARGLDISLPPFIDRTLLRARDPPLPVFDHIEYKPPPATKKTTPLQPSKPLGSDSTAVAVSTFKLTRDQLSTLKGKSREDGNTISYSSYEMLAGHVWRSVCKARALPDDQETKLYIATDGRARLQPPLPHGYFGNVIFTTTRIAVAGDLMSKPTWYAASRIHDALIRMDNEYLRSALDYLELQPDLKSLVRGAHTFRCPNLGITSWARLPIHDADFGWGRPIFMGPGGIAYEGLSFIIPSSTNDGSLSLAIALPPEQMKVFQELFYDDI

SEQ ID NO: 159977 - protein, 285 aa, Glycine max
  Coding DNA Sequence Number=SeqID_68292
  Gene Ontology: Mol. function=cation transmembrane transporter activity; Cellular component=integral to membrane; Biological process=cation transport
  Homolog annotation: Hit_ID=A5B459; Match level="QueryCoverage=95%, HitCoverage=59%, E-value=1e-88, Identity=65%"; Hit description =Putative uncharacterized protein
  Pfam annotation: Domain name=Na_Ca_ex; Domain location=102-259; Score= 98.2; E_value=2.5e-26; Accession=PF01699.15; Description =Sodiumcalcium exchanger protein
  Pfam annotation: Domain name=Vps55; Domain location=154-264; Score= -56.9; E_value=0.1; Accession=PF04133.5; Description=Vacuolar protein sorting 55
  Pfam module annotation: Pfam domain module=Na_Ca_ex::Vps55; Domain location=102-259::154-264
MGSVLEDKIDRHSFHDHHDADDTPLASSSSKVLQQLHSFDFEDTSVVDLRSSSIFNTTRISRSIYVVLIKAKINLLLPFGPLAILLHYLTGHHGWVFFFTLLGITPLAERLGYATEQLAFYTGPTVGGLLNATFGNATEMIISIYALESNMIRVVQQSLLGSILSNMLLVLGCAFFTGGIVHYKKVQVFDKTSHCSPPLQQAAAVVNSGLLLMAVMGILFPAVLYFTHSEVHQGKSVLSLSRFSSCIMLLAYASYLFFQLRSQQNVYSPVDEGSFSGQDNYLILL

SEQ ID NO: 159978 - protein, 156 aa, Glycine max
  Coding DNA Sequence Number=SeqID_68293
  Gene Ontology: Mol. function=metal ion binding
  Homolog annotation: Hit_ID=A7Q4C3; Match level="QueryCoverage=69%, HitCoverage=41%, E-value=3e-31, Identity=65%"; Hit description =Chromosome chr9 scaffold_49, whole genome shotgun sequence
  Pfam annotation: Domain name=zf-C3HC4; Domain location=72-109; Score =36.2; E_value=1.2e-07; Accession=PF00097.16; Description=Zinc finger, C3HC4 type (RING finger)
MQLASNGDKEECSESEPILNHHHLHLQPTGESSFSCEIIPIPPAAATFNDDDLQNVRVDETCHLVNADQPQCRICLDIGGEDLIAPCHCKGTQKYVHRSCLDNWRSTKVFGEFMILQYLLTSHFFCCTRRVSLFLTVQSAELSSYYVQMSHQIGGG

SEQ ID NO: 159979 - protein, 63 aa, Glycine max
  Coding DNA Sequence Number=SeqID_68294
MVRIRGLGRALGRRRPTAFVRRQRVPVTVANAEPVVPAVEADVVADEPMVEADVQDIGADTGA

SEQ ID NO: 159980 - protein, 210 aa, Glycine max
  Coding DNA Sequence Number=SeqID_68295
MVGHVFKVTLYKRLLCMISRYALNQIVAEYEHVHYPDKNPSRCGFVMRTTHGLPCACELSKYVLELDVCGKAILKSKLWEIIYPDLNSMGPPPEKVNTKVKRSASSSDQGIPRRTMQMLDQFHLFFHDSIENIVNVKADGIKDLRNINLFGSIDRFEELKRSLVDELFMVTMDKWMDITDMRYVIASKYNVILGEGTSLPGRADDFRTKP

SEQ ID NO: 159981 - protein, 64 aa, Glycine max
  Coding DNA Sequence Number=SeqID_68296
METKEGKERGGSSGRKLRSLGLLRRNESSSNGDNGGGGDDSGGNDGDGGGDGDNNSCLMVVMTV

SEQ ID NO: 159982 - protein, 111 aa, Glycine max
  Coding DNA Sequence Number=SeqID_68297
MLSQLSQHTFFILLTTQQEVSLDIDDSLTHTHRNLKERKKKQRLAVGVSISEACALSENHALSETLSPLSKLVEYEKHLCAQCIISSLNETFVSSCAKRAQLAQRTFTYSR

SEQ ID NO: 159983 - protein, 82 aa, Glycine max
  Coding DNA Sequence Number=SeqID_68298
MAAEWRRKRERRRHFKEKMSLEEAHHHRRPWIRAWRKKEMNEGRGREEHEILCSKGALKSEPTKSKINYKIPPLSVLRCHEA

SEQ ID NO: 159984 - protein, 92 aa, Glycine max
  Coding DNA Sequence Number=SeqID_68299
  Gene Ontology: Mol. function=transcription regulator activity; Cellular component=nucleus; Biological process=regulation of transcription
  Homolog annotation: Hit_ID=O81348; Match level="QueryCoverage=76%, HitCoverage=21%, E-value=2e-13, Identity=52%"; Hit description =Symbiotic ammonium transporter
  Pfam annotation: Domain name=HLH; Domain location=1-44; Score=25.1; E_ value=0.00026; Accession=PF00010.17; Description=Helix-loop-helix DNA- binding domain
MSERKRRQLMAERFIALSAIIPGLKKIDKASVLSEAINYVKQLKGRIAVLEQESSNKKSMMIFTKKCLQSHPHCEKNSNHVLPQPPSRSNRS

SEQ ID NO: 159985 - protein, 209 aa, Glycine max
  Coding DNA Sequence Number=SeqID_68300
  Homolog annotation: Hit_ID=Q9M8M8; Match level="QueryCoverage=27%, HitCoverage=35%, E-value=3e-09, Identity=52%"; Hit description =Putative uncharacterized protein T21F11.6
  Subcellular localization annotation: CTP_CleavageSite=36; ConfidenceScore=5.34e-01
MADDSLVVDLLLRLHRSPPPPPCLNLHWTVRQRRSRSAHNKAESTRASPTTPLSWSGATSASGGNLDGYEESKPSQTSRSKPVPVHVVWCGLGDSCWYSRGVDSPPGELASLRLTIQKHRATNESIKRLKNSSAAATASEVSGKAVNGPFQFVKSECHPSNSVTHDDSPVCAANASPKAQDNIGNRESTFVLPDLNLPADEDINANVMH

SEQ ID NO: 159986 - protein, 214 aa, Glycine max
  Coding DNA Sequence Number=SeqID_68301
  Gene Ontology: Mol. function=transporter activity; Cellular component= integral to membrane; Biological process=transport
  Homolog annotation: Hit_ID=Q6J1S8; Match level="QueryCoverage=82%, HitCoverage=64%, E-value=3e-41, Identity=51%"; Hit description =Nodulin 26-like protein
  Pfam annotation: Domain name=MIP; Domain location=79-211; Score= -111.2; E_value=0.016; Accession=PF00230.11; Description=Major intrinsic protein
MKNTPRIGKGRTQGYIWTTTRKYPQHLLFGGFINNNNRNCKKSLLKSCRCFSVEEWSLEDGGLPAVSCSLALPPPPPGVPLARKVGAEFIGTFILMFTGTAAAIVNQKTNGSETLIGCAATTGLAVMIVIFRHRPHLRCSSQPCYHHSLSCIKALPLEACAHGVYHPFMRGGVTVPSGGYGQAFALEFIIAFNLMFVATDTRADLGFWRRYKKQ

SEQ ID NO: 159987 - protein, 178 aa, Glycine max
  Coding DNA Sequence Number=SeqID_68302
IDGADELLKVLSGDVFLHLPLCNLGEEFTSFDVFDNQEDFGLAHDGDLAFDLFDEPLFLLKPLFFYDFDGHALICAEVSAVVHLGEVALSQQFPYLVLVEEDVTGAARAPVHVGAGVGETQIEGLHPFNDEEGVGRTHHVLEKAFGGIENLHGCMQGETRKRKGLPLILCLTRKGASE

SEQ ID NO: 159988 - protein, 28 aa, Glycine max
  Coding DNA Sequence Number=SeqID_68303
MIHEDDDKGDDKKLKGQSKNEFKIQEES

SEQ ID NO: 159989 - protein, 246 aa, Glycine max
  Coding DNA Sequence Number=SeqID_68304
MSLIPHVNIFSMPEVHTPQKISMQQGQADILISRFPDPNYGVKMVNFIITPLTYRELSISSYLRHLEVSLSFELVGPTQVSIMPKRMEFSIGFKNKIKGNIQGQIPLSKHKGLRGIHKGLRGILGSTEKKHLFEIPITPMRPGFSECRKNNLKDVFITFNFHIAGLLGTQRTSSRLEMGLAQLWAAQRNSPRLELRLVRPLAYRENKSYYLQDPNGQTVETYLRDNQTKFEDYPMVNESDIMISLN

SEQ ID NO: 159990 - protein, 114 aa, Glycine max
  Coding DNA Sequence Number=SeqID_68305
  Homolog annotation: Hit_ID=A6NQ44; Match level="QueryCoverage=77%, HitCoverage=91%, E-value=6e-45, Identity=100%"; Hit description =Putative uncharacterized protein
  Subcellular localization annotation: CTP_CleavageSite=80; ConfidenceScore=5.05e-01
MDERIRQIAEIGASLIKHCVRPRRKDQRIFLRSFFSARNLLLANKKTTATSGGLFAGSRATNSFSEGNWLQQSADTKYCSSSVAVVRPPLQELCSTAYIPRSANPVTSGCCQWR

SEQ ID NO: 159991 - protein, 112 aa, Glycine max
  Coding DNA Sequence Number=SeqID_68306
MARQWLLMTHDRGKEWYLSYPNFVRGPLLGGMQLLFDHFEVEGGCFKGPINRSFLTGDIPLVESPTVATCPLRATEGEAHGCAFQRRKDAQSRHQRLFVENVGKTEGNRSKR

SEQ ID NO: 159992 - protein, 78 aa, Glycine max
  Coding DNA Sequence Number=SeqID_68307
MTRSKRFVVAEDEDSVVHKKKIVDKKDTDGKKSEVIGESVEVPYHVVPSKKEKDRHLARFLDIFRKLEITMPFGEALQ

SEQ ID NO: 159993 - protein, 124 aa, Glycine max
  Coding DNA Sequence Number=SeqID_68308
MVGYTPSSFADLVFAGERVEADLKRGKFNHSALMNEKTGANKEDEKEGETHAVTAIPIRPSSPPAQHQHYSANISHSHYPPPIYPQRPSLNQPQNPPTTQPMLNTTFSTNQNTNQEMNFAGKSL

SEQ ID NO: 159994 - protein, 106 aa, Glycine max
  Coding DNA Sequence Number=SeqID_68309
MVGYTPSSFTDLVFANKRIEVGLKRVKFNHPALRNEKTGANEEDEKEGETHVVTAIPIRPSFPPTQQCHYLANNSPSPSPPPSYPQRPSLNQPQSPPTTTNAKHHL

SEQ ID NO: 159995 - protein, 127 aa, Glycine max
  Coding DNA Sequence Number=SeqID_68310
  Subcellular localization annotation: CTP_CleavageSite=32; ConfidenceScore=5.07e-01
MAEPSQKRKDTSSRSQRHSGSQEPPIPSSIPSRSLFSSEEQRIRYTNLFSSHSIIDPKFIDMDFFSNESFECFQAFENSNLIPFMSLKFPVYSDLVKTFYSNLEIQEGTLMSQVYGIKMVIDQSLFF

SEQ ID NO: 159996 - protein, 106 aa, Glycine max
  Coding DNA Sequence Number=SeqID_68311
  Homolog annotation: Hit_ID=A3B774; Match level="QueryCoverage=42%, HitCoverage=9%, E-value=5e-07, Identity=55%"; Hit description =Putative uncharacterized protein
MAPHRAEDLVFVHSNLRLLSRNTPQYHQEKTKMWDVAGDDFGSLDDCGILEIASLSLDELELEAMSVSYIFNISGVHMSMSVSYPVSVSVSVLHSMRQTHHKGRKQ

SEQ ID NO: 159997 - protein, 269 aa, Glycine max
  Coding DNA Sequence Number=SeqID_68312
MRGSRNCAPFSDSSCSEYTAVTIAGERDDQHGQQGNRLRNSKAQRRRGDQQAGEGAERAVLNAHARGAVAVLADKHDGHQNPVGLGNIEEQRQRAAEHQHHAQSAPPSAARQILATGSCAAPATAAGGAGDRPSGRNYRPDYPGAAGQFSPARRAASPCGSVPAAGDREWHRPARAAADRDMLLQIERDLESARQAFMAVITAGGQHMHLVGVLGVAVIGQLAVQQAEGLAHRLLFPQPEPEPVKQPVPQRPADIQQRRDPHRHTADEA

SEQ ID NO: 159998 - protein, 416 aa, Glycine max
  Coding DNA Sequence Number=SeqID_68313
MHKKSCNGKRKLRIEEIRQQLMPLLAENALRMELHALERQRTMAEAHDLIGNAVAQAPGGCGTRPGRCAAPQRFCHASPCARAPPAHRRPGRWPDGPGIPREPATVRQSGEWLRAKCRTDPACRGPARSPDDSAAAPSSLPASSHRCAPRAPARPVHRSTGRYSSKTAAILRILTRRTHHFRKLRIERREIAANASDDGLVPAFRLQLIPVQQIARVQRQLFEKDALCPPVTGTERMQDVDFTVVMRDACHEGLRVEVAQALFLLQCAHQRIALVLDILAMAIGRVVAPDVDGTQFAGPAVDILKQRAVNMAQVRQARRGRSERQRGQPRRAECQLGFTQLRHVVNFQQVFQHVIVVPQIGIAHRQAVIRHIASSARPDDRPPGRSRRQVHSACNRPVCSWPDNWPHGASGKQDVP

SEQ ID NO: 159999 - protein, 392 aa, Glycine max
  Coding DNA Sequence Number=SeqID_68314
  Gene Ontology: Mol. function=transporter activity; Cellular component= integral to membrane; Biological process=transport
  Homolog annotation: Hit_ID=A8GKP6; Match level="QueryCoverage=99%, HitCoverage=99%, E-value=1e-175, Identity=76%"; Hit description =Protein tsgA homolog
  Pfam annotation: Domain name=DUF125; Domain location=72-221; Score= -43.9; E_value=0.074; Accession=PF01988.10; Description=Integral membrane protein DUF125
  Pfam annotation: Domain name=DUF606; Domain location=101-215; Score= -54.7; E_value=0.093; Accession=PF04657.4; Description=Protein of unknown function, DUF606
  Pfam annotation: Domain name=MFS_1; Domain location=13-345; Score =59.3; E_value=1.3e-14; Accession=PF07690.7; Description=Major Facilitator Superfamily
  Pfam annotation: Domain name=Sugar_tr; Domain location=9-392; Score= -183.2; E_value=0.08; Accession=PF00083.15; Description=Sugar (and other) transporter
  Pfam module annotation: Pfam domain module=DUF125::DUF606::MFS _1::Sugar_tr; Domain location=72-221::101-215::13-345::9-392
MTNRNRIGLTWISFFSYALTGALVIVTGMVLDNIAQYFQLPISEMSNTFTFLNAGILAAVFLNAWLMVIVPLKRQLIFGFVLMILAVAGLMTSHNLTVFSLCMFVLGVVSGITMSIGTFLITHLYDGRQRGSRLLFTDSFFSMAGTIFPIIAGILLARALPWYWVYACIGVIYVAIFILTLMVEFPVLKSEAAVQGGEKEKWGIGVLFLSIAALCYILGQLGFISWVPEYATKSMGMDIAAAGQLVGNFWTAYMVGMWAFSFLLRFFDLQRILVVLALLATGLMFWFVKTTDASMLHWIIMSLGFFSSAIYTTIITLGSLQTKASSPKLVNFILTCGTVGTMLTFVVTGPIVAKGGAHAALSTANALYAVVFVMCVLLGFVTKHRQHAHQTA

SEQ ID NO: 160000 - protein, 94 aa, Glycine max
  Coding DNA Sequence Number=SeqID_68315
MGARVAFKPNAISWTRGTAERGINPATDNCQGKPRLSAASGAGQDRDFSFRYGFNVHCGNQAWGPAPGAVLSVLADGNARLFWDGAELTLHRVK

SEQ ID NO: 160001 - protein, 65 aa, Glycine max
  Coding DNA Sequence Number=SeqID_68316
MSRNFMDCATMLSFDFRHVTELHELPNDGRQVPRSGVEEKSLEFQEPWDLRSNPFQRGGNDAILP

SEQ ID NO: 160002 - protein, 71 aa, Glycine max
  Coding DNA Sequence Number=SeqID_68317
MPISPCGCISWSVSSRHRDRARKTPNGPGEVQQGPRVSSSDYEPLKVIKPPINRTFIKKYYAPRQAQGETP

SEQ ID NO: 160003 - protein, 78 aa, Glycine max
  Coding DNA Sequence Number=SeqID_68318
  Subcellular localization annotation: CTP_CleavageSite=31; ConfidenceScore=5.28e-01
MVIDYSFVKTSLKTILVTSNRLLPNGNRLPESKNSVSLLSLVINQEANSASCNEPKKRWSLVFSVQPRRSSLENNHQE

SEQ ID NO: 160004 - protein, 66 aa, Glycine max
  Coding DNA Sequence Number=SeqID_68319
MSLCLIRRAFAKRDTQWLSARKNPEEDELAVSLSTTLQVIKRTASAHSLSQNPLMRAKRFRFVLRA

SEQ ID NO: 160005 - protein, 60 aa, Glycine max
  Coding DNA Sequence Number=SeqID_68320
MREEELTDLWSNPLQGEGDDAILPRKGLVTRAMSKRLQEDWARVVEEGPRVLMNLKGSIM

SEQ ID NO: 160006 - protein, 73 aa, Glycine max
  Coding DNA Sequence Number=SeqID_68321
YALNQIVAEFEHVSYAGIDSSYYGRVMRTTHGLPCAYQGLFEPKVIITKEMEIISKRFEEFDVCGKVTLQSKL

SEQ ID NO: 160007 - protein, 119 aa, Glycine max
  Coding DNA Sequence Number=SeqID_68322
MFRHEYQENGGNVACPITSKCTLGLRPSLTTPQFNKNKQQFKDKSLTLLSKYMQLRAPKYINGKLESPRMRCRGARPGELSSPKRANLHFFFRGDDTRLPCNDAFHLSRARQGTTTHRS

SEQ ID NO: 160008 - protein, 40 aa, Glycine max
  Coding DNA Sequence Number=SeqID_68323
MVKAREKREVVAAQLAQASRFASTRRHRLLVEPPGRPKLA

SEQ ID NO: 160009 - protein, 181 aa, Glycine max
  Coding DNA Sequence Number=SeqID_68324
  Subcellular localization annotation: CTP_CleavageSite=43; ConfidenceScore=5.25e-01
ADLWLVSRMDMNIGALISGQITSIAQSNTSRLRFPALITALCRARGVVSDSLTFERLSPVINLAYTRKNYWNPEDLTVVAPPGSIPSVEKFKEMVAWPGTQPSLRREDEGSTTQVPQHVEDESSEATIPEPFVIGEEAGETQVRQVAAATPEISLRPLQSLLLQWWTYPHLNVQQTLPLLF

SEQ ID NO: 160010 - protein, 216 aa, Glycine max
  Coding DNA Sequence Number=SeqID_68325
  Gene Ontology: Mol. function=L-ribulose-phosphate 4-epimerase activity; Cellular component=cytoplasm; Biological process =carbohydrate metabolic process
  Homolog annotation: Hit_ID=A8AMK2; Match level="QueryCoverage=100%, HitCoverage=94%, E-value=3e-93, Identity=75%"; Hit description =Putative uncharacterized protein
  Pfam annotation: Domain name=Aldolase_II; Domain location=1-202; Score=300.1; E_value=4.4e-87; Accession=PF00596.12; Description =Class II Aldolase and Adducin N-terminal domain
MALPEHGLVTYTWGNVSGIDRASGLVVIKPSGVPYETMRAEDMVVVNARGEVVEGQLRPSSDTPTHLALYRAFPQLGGVVHTHSTHATAWAQAGEAIPALGTTHADYFSGDIPCTRGLTAEEVAREYELNTGRVIIETLKGREPLHIPGILAYQHGPFSWGRTPDEAVHNAVVLEEVAKMAWISRDINPGLKRIDDYLLEKHFSRKHGAGAYYGQR

SEQ ID NO: 160011 - protein, 152 aa, Glycine max
  Coding DNA Sequence Number=SeqID_68326
  Gene Ontology: Mol. function=hydrolase activity
  Homolog annotation: Hit_ID=A7P6M1; Match level="QueryCoverage=51%, HitCoverage=20%, E-value=8e-29, Identity=74%"; Hit description =Chromosome chr9 scaffold_7, whole genome shotgun sequence
MTNANCPQESLHSVLNGNLRKKDESQENNFKDVVSVCLLLINTTIRDVEKGTFPKSCLLNVEISTSPLSNKGFKLTKQSMWRSTPNWLAVSTSHYPTGHFLANQGGLGLQFAQLGQDASVAVTVTPLSISPHIETVIQMAASDWISVVLLGE

SEQ ID NO: 160012 - protein, 78 aa, Glycine max
  Coding DNA Sequence Number=SeqID_68327
MKKRKKPATRPSPDASLSVQLTLSEPGDTGAKRGVKHESWYLRLKQNVLSERSSLSARSNRTECAKREVPAKRTIYTC

SEQ ID NO: 160013 - protein, 101 aa, Glycine max
  Coding DNA Sequence Number=SeqID_68328
  Subcellular localization annotation: CTP_CleavageSite=64; ConfidenceScore=5.42e-01
MLKVIFWLSILISRLPFSITTTQLAVSMKGLPRIRGISASSSMFMMTKSTEKGIKLMLAPKSMRAFPIESFPMVQGIVTLPGSLNFLAASSVSLHYSCLPP

SEQ ID NO: 160014 - protein, 472 aa, Glycine max
  Coding DNA Sequence Number=SeqID_68329
  Homolog annotation: Hit_ID=A7P346; Match level="QueryCoverage=42%, HitCoverage=30%, E-value=8e-21, Identity=33%"; Hit description =Chromosome chr1 scaffold_5, whole genome shotgun sequence
MATRKLLNIVVDGNSALGPYWPKIVSDYLEKIVRSLIGNPRGEGVNPSCEVGLILYNFNSTLGLDYVQCFNWTKDVDQFLGFLAYLPFNGDNLNQHTIVKGLAEALVMFPKDDYFKCERHCILVATGEPVTRSMLVSLPVVKEGKFISGQFITLDATFLRVAKMFGPGNYLKEDTPITNYGNGQITVLLSRNFKEAHYAVLIPQETALEEDRLTRLLEQDHQIYLDEILEEMLRSSTSTTGEGSLPQNNSDSGRLEELNAWYSPGVGASSFVPTARVDVGASSGGIAGPSASTDAGVVAGAIASSSLYYGSHHQQFPKHHHFEMTEINPTAMGANTWASPALVMHEYNQAILWPKPPTDFIDYVQAWEGCLVGKIHSGTSLNQAKAFRRLTSSVILSHQWSNRLNIALFFSKTAVTYTMTINGGPIDYLFFQVTQFDNLELYEHLMSNDLLFHCHRIWYLFNVPISESKCKS

SEQ ID NO: 160015 - protein, 132 aa, Glycine max
  Coding DNA Sequence Number=SeqID_68330
  Gene Ontology: Mol. function=amino acid transmembrane transporter activity; Cellular component=integral to membrane; Biological process=amino acid transport
  Homolog annotation: Hit_ID=Q9C6S5; Match level="QueryCoverage=53%, HitCoverage=13%, E-value=9e-14, Identity=50%"; Hit description=Amino acid permease, putative
  Subcellular localization annotation: CTP_CleavageSite=50; ConfidenceScore=5.81e-01
MYAAMDMSLDGIIKNNKKSGSGSSRGRTLPFGSRPTRRFPNRAANRTAPYATARVVTARRFVLASCKVLKVVTFSPLVFTSGVPLNRELWTDEYFSIIADIVGGVWLRWWLQATVSLSNMEMFVAEMRSDSF

SEQ ID NO: 160016 - protein, 118 aa, Glycine max
  Coding DNA Sequence Number=SeqID_68331
  Gene Ontology: Mol. function=calcium ion binding; Cellular component =cytoskeleton
  Homolog annotation: Hit_ID=Q7G188; Match level="QueryCoverage=59%, HitCoverage=10%, E-value=5e-25, Identity=77%"; Hit description =Fimbrin-1
  Pfam annotation: Domain name=CH; Domain location=23-116; Score=20.5; E_value=0.002; Accession=PF00307.22; Description=Calponin homology (CH) domain
MELFPKEEDSTLLSHEFCISCLATARLLMILARYCLCAKDCKLRRWILLQVLEKIFPRSVNSKHATRPPIRMPFRKVENCNQVMKIGKQRRFSLVNLAGNDIVQGNKKLTLGNLFISL

SEQ ID NO: 160017 - protein, 211 aa, Glycine max
  Coding DNA Sequence Number=SeqID_68332
MNVLTAHDQGWEQELSPYNQYEEERTPNLESVSEEFMVYHASSKANQNSKKNHEIHFGKSYSIENFQGGPELQPYYQNEAERGSNLDKLLMQFKETTKSTQRALQSVEIQVGELAEEVTQFMSRREKYFEEVEAQKESLVKEHESREKDKEQAQQQWEKYSTVENHQESILQINNHPHQQIDKKRRKGEHEETLSAILSLIINTSLEMIWN

SEQ ID NO: 160018 - protein, 112 aa, Glycine max
  Coding DNA Sequence Number=SeqID_68333
  Gene Ontology: Mol. function=nucleoside-triphosphatase activity; Cellular component=signal recognition particle; Biological process =SRP-dependent cotranslational protein targeting to membrane
  Homolog annotation: Hit_ID=A2WZA2; Match level="QueryCoverage=89%, HitCoverage=25%, E-value=6e-24, Identity=58%"; Hit description =Putative uncharacterized protein
  Pfam annotation: Domain name=SRP54; Domain location=1-109; Score= -52.8; E_value=2.3e-07; Accession=PF00448.13; Description=SRP54-type protein, GTPase domain
MMVGVNGEGKTTSLGKLAYRLKNEGAKILMAAGDTFRAATSDQLEIWGERTPLCICKGKAAYNIPPPYLRIAKSLRAMGLMEEFISCKRPVAKVVPGVPNLVNVRELLSTRS

SEQ ID NO: 160019 - protein, 53 aa, Glycine max
  Coding DNA Sequence Number=SeqID_68334
MVLLAVVEQSKHHALSDSTSIENDVNGDGIMVNGGDGARVDGGGKYSVSKNDI

SEQ ID NO: 160020 - protein, 89 aa, Glycine max
  Coding DNA Sequence Number=SeqID_68335
MQIQLNQVYMEGMMWQQFKYMEAFEVLMAQVSPLLEEQYTGFLLDDLHKDICMEILALEPPNCHCLGSVACLIECKLDRSGWRASTPQR

SEQ ID NO: 160021 - protein, 292 aa, Glycine max
  Coding DNA Sequence Number=SeqID_68336
MGVMIKMNANWTGIGLEMDVVGDEAWRRWGGGDWVGLGMWVRWNIAKTPLGKIEKLRNLSLYEIMSTPIIHQYRDLAMGGLSTTVFGRVVGKSWEARGGGSSKSSLAMNKCNLGGPVVGLGARTIGEEVGAGGGGIRGDYRRSRSLSSWSLASVIVCNKDNGCNACTSRQRSGRRPDRSISGERHEFEQGFMRAIIKGRRPPCKMMPPLSICCPTPLALGSEGDCEGGKMLQNGINLVIHVLALSKAKNNLVEVFDRGLSSVMLRHGSKPKGRVEFRHSPGGVLVVCAPSWV

SEQ ID NO: 160022 - protein, 79 aa, Glycine max
  Coding DNA Sequence Number=SeqID_68337
MASKYTCGTGEFFRMVAVKGDRPLAQYVPGCRKDHRNALKVSSKGLEILFKDTIEYLGLAISFWVILSAHSQLSSAETK

SEQ ID NO: 160023 - protein, 61 aa, Glycine max
  Coding DNA Sequence Number=SeqID_68338
MSNDPLHGIRGCMIRSKTKRMKQALQGLILKIKEERDQCELRVAPNWDTPLQIDEDALGPT

SEQ ID NO: 160024 - protein, 290 aa, Glycine max
  Coding DNA Sequence Number=SeqID_68339
  Gene Ontology: Mol. function=protein binding
  Homolog annotation: Hit_ID=A7QCD4; Match level="QueryCoverage=63%, HitCoverage=15%, E-value=1e-66, Identity=74%"; Hit description =Chromosome undetermined scaffold_77, whole genome shotgun sequence
MEEGCLVGNLELRGNAKVIGPEQVVKLSQKVVARILLGVGFEGAMEGSVEDFSEVLSGRICKTRTNLRVLADSYKKQCSAIELLKMLLKTVGFRLCSTWWVQRCRLLTKANHALRQATLGTLNSLIVAYGDKIVLFAYEVIIVELSRLISDSNLHMIALALELCCTLMGDKRSNQSIGLAVRNKVLPQALTLIKSSLLQGQALSALQNVFAALVYSANTSIDYVLESLFASAKPSPQSGGIAKQALHSIAQCVTILCLVAGDQKCSSTVKMLTDILKDDNSSNSVSFSLQ

SEQ ID NO: 160025 - protein, 134 aa, Glycine max
  Coding DNA Sequence Number=SeqID_68340
MDCSARISGFRLSACFSRSVDGLKRHKEYHQSEALPAMHQYQMPPGEAHRCAFQRRKRCAESPPTFICGKRWKNRRKPVKMKILSSGVVFTLEEGINTSHVDKSGAFAPTYPPLERKSDLRSSFFRVNQAILFT

SEQ ID NO: 160026 - protein, 116 aa, Glycine max
  Coding DNA Sequence Number=SeqID_68341
MVCEHRRIFNLHFTPPLEQQACSKPLLAARMHVWTLELTQALLDASTSCSNTSSFLRFSYDNFKKVRPSIAMAYPSGWPWLSWQASNHGTGFLLKVILFMETSFHSTTGLVTIFGK

SEQ ID NO: 160027 - protein, 187 aa, Glycine max
  Coding DNA Sequence Number=SeqID_68342
MEDKVSKPIDQKPLKESLLLVVLKPQCLMTQSKKLNLHVSSLKFDLVVDMPTSGPVTTFDESMKENSQVYMMIASLKLESGVTVSDVPIVRDFPKLAKLEELSYPNFVRGSSIVGMQPSFDHFEMFLQKAVASRGSNLARLGELGGKLLLPFPINRGRREEQKCSTLLIFNRSSSFVVRRSFFGLQP

SEQ ID NO: 160028 - protein, 103 aa, Glycine max
  Coding DNA Sequence Number=SeqID_68343
MITKDDDKGDDKKLKDRIKNTSRFKRKVDFKNQDSIDQDFKTQDSRDQDSRLKIQESREGLIKISMKRFSQKLSSTWIFLKTCLPKSFYSLVIDYQIVVIDYQ

SEQ ID NO: 160029 - protein, 183 aa, Glycine max
  Coding DNA Sequence Number=SeqID_68344
  Homolog annotation: Hit_ID=A7PXV4; Match level="QueryCoverage=37%, HitCoverage=3%, E-value=8e-09, Identity=53%"; Hit description =Chromosome chr15 scaffold_37, whole genome shotgun sequence
MGVGFRQEMTRLTGWIHILDSIKNGVGLPLNHVAAIEPPNNVTIATSGGSEVCFPSNATPEDLFDHFCDGALSNGSSKLSNGNKTRVLVNYSQERGAPTLNEGRDFDGEERCSKRAQLGGYNNDRPYYGRGNYQGKERERCFSNNRKRPRGDRDEIDRRDKDGGGWKREHYGGDGGESWNDLV

SEQ ID NO: 160030 - protein, 223 aa, Glycine max
  Coding DNA Sequence Number=SeqID_68345
  Homolog annotation: Hit_ID=A7P0Z0; Match level="QueryCoverage=46%, HitCoverage=12%, E-value=3e-30, Identity=53%"; Hit description =Chromosome chr19 scaffold_4, whole genome shotgun sequence
VEPIHRSNPTGGIDPLGDLIKNSYDLYEKPLELLWDGTKFGILNVEASFFITYSDKLEWECLSIDLLPHSDMFTDANLDRSEEGANLRDEDAAKQVQLHVTEAVFPALSEPGLYVCLNRGNVDFKAQQRSTKAAGRSLVSTVVDHIFLCIKDAVAPRRKMGDADAEGPLSTSPNQLDGDKVTGATNHKSVNLEGSLLESSGGKIHSKGANLMDRSNDRMAESD

SEQ ID NO: 160031 - protein, 96 aa, Glycine max
  Coding DNA Sequence Number=SeqID_68346
MNDLVYVMYNLKLKKGCNDEDEQPQGEGDGGNVELVGDVRGSSNDLVIDAFDLDNLSLVEPNNDAQFEKDLDDDGDGDESDDILGDDPIRGLDMLL

SEQ ID NO: 160032 - protein, 42 aa, Glycine max
  Coding DNA Sequence Number=SeqID_68347
SEDAPMTTLVPIVASMCTWSCLDKINAPVFSWDAWTGSPTLS

SEQ ID NO: 160033 - protein, 50 aa, Glycine max
  Coding DNA Sequence Number=SeqID_68348
MVVAANFGGHGHGRVNGTRLMALKSKIVFKKGRGNLQIKDGFIKTIVNTF

SEQ ID NO: 160034 - protein, 124 aa, Glycine max
  Coding DNA Sequence Number=SeqID_68349
  Homolog annotation: Hit_ID=A7QYT0; Match level="QueryCoverage=51%, HitCoverage=11%, E-value=6e-13, Identity=47%"; Hit description =Chromosome undetermined scaffold_254, whole genome shotgun sequence
MPFLVPSSPTNHNHRKRTSTSTYDTPPLKVVDPSRFYGELTYAPPHQQQHLVLSGGKDDLGALAMLEDNGGCVVVVDEKKGGGVDVEKKDDDDGGVGVWTVEAVVEKMKTMVFGEGERLEKEKD

SEQ ID NO: 160035 - protein, 91 aa, Glycine max
  Coding DNA Sequence Number=SeqID_68350
MGVAKVTYYQAFEEKYLALKKVNVKAWEWLEGCTSLTINPKEQLRKKKPNKGTMNTKAENVPIVGNDNWKTVGDNNVGHTDAAKKIVVDDN

SEQ ID NO: 160036 - protein, 85 aa, Glycine max
  Coding DNA Sequence Number=SeqID_68351
MGMEEEEGWLMEEKGRMAKDGGFPLLEMLRLWMYSIESSESQCLSPLLPTPFIGLSARKTLEEDELYRFAKRTASVHPLREKGTR

SEQ ID NO: 160037 - protein, 91 aa, Glycine max
  Coding DNA Sequence Number=SeqID_68352
VDSRGSPNSLSQHIGGYILCGTSRGYIYLRIVILRTRKGTSLVDQFKWRVHPLGFSKRTREGTSLVDLWLAKDFTRLKEISRIGWLLGDWT

SEQ ID NO: 160038 - protein, 113 aa, Glycine max
  Coding DNA Sequence Number=SeqID_68353
MYPPLFSLNLVDVPSTRTDPQEMYPLLFSVKPKEKGDTKELRQLVLCSFGKGRRETQKEFRRLVLGEFFLAKGEENEKMNSTSFQGLENQKTLESFWHKEEEEVQRDSGLVKD

SEQ ID NO: 160039 - protein, 72 aa, Glycine max
  Coding DNA Sequence Number=SeqID_68354
MVIFHHGDAAEDKEKEESNYPLLGGDTSNAGNDYAANAGADGDYVADIATAQRAWDPRPTQDRGPLLIKTLI

SEQ ID NO: 160040 - protein, 426 aa, Glycine max
  Coding DNA Sequence Number=SeqID_68355
  Gene Ontology: Mol. function=nucleotide binding; Cellular component =intrinsic to membrane; Biological process=defense response
  Homolog annotation: Hit_ID=Q6R271; Match level="QueryCoverage=93%, HitCoverage=39%, E-value=0.0, Identity=75%"; Hit description=Disease resistance protein
  Pfam annotation: Domain name=NB-ARC; Domain location=165-411; Score =123.8; E_value=5.2e-34; Accession=PF00931.13; Description=NB-ARC domain
MALELVGGALLSAFLQAAFQKLASHQIRDFFRGRKLDQKLLNNLEIKLNSIQALADDAELKQFRDPRVRNWLLKVKDAVFDAEDLLDEIQHEISKCQVDAEAEAESQTCTCKVPNFFKSSPVSSFYKEIKSRMEQVLEDLENLASQSGYLGLKNASGVGSGFGGAVSQQSQSTSLLVERVIYGRDDDKEMIFNWLTSDIDNCNKPSIFSIVGMGGLDEFDVFNVTRTILEAVTKSTDDSRNREMVQGRNQKEWEALQTPLNDGAPGSKIVVTTRDKKVASIVGSNKTHCLELLQDDHCWQLLAKHAFQDDSHQPNADFKEIGTKIVAKCKGLPLALTTIGSLLHQKSSISEWEGILKSEIWEFSEEDSSIVPALALSYHHLPSRLKRCFAYCALFPKDYRVGVQKKSVNNTSTIFCQGPSFNNQAT

SEQ ID NO: 160041 - protein, 105 aa, Glycine max
  Coding DNA Sequence Number=SeqID_68356
MANKVSELNVEGPEETGAEARAGKDEATANGVAVEVEGAKVGRAEDGGASDLLPLALRGPQKVTVGSSRLSKDNKSEVTPLALHRAVMRAAKPSRQESCCAIIEI

SEQ ID NO: 160042 - protein, 96 aa, Glycine max
  Coding DNA Sequence Number=SeqID_68357
MICPLRCHEEMYDAIKEHARVSLLCAPQFRNLMERIQKSTSSNNSQGWFHGLSSTMHHQKKKTLDEASLSSSESKTQHDHRSTSTPYGSHRPGHRA

SEQ ID NO: 160043 - protein, 330 aa, Glycine max
  Coding DNA Sequence Number=SeqID_68358
  Gene Ontology: Mol. function=exodeoxyribonuclease I activity; Biological process=response to DNA damage stimulus
  Homolog annotation: Hit_ID=A7MJN8; Match level="QueryCoverage=97%, HitCoverage=65%, E-value=1e-151, Identity=78%"; Hit description =Putative uncharacterized protein
  Pfam annotation: Domain name=Exonuc_X-T; Domain location=15-198; Score=90.7; E_value=4.6e-24; Accession=PF00929.15; Description =Exonuclease
  Pfam annotation: Domain name=Exonuc_X-T_C; Domain location=216-330; Score=45.9; E_value=3e-14; Accession=PF08411.1; Description =Exonuclease C-terminal
  Pfam module annotation: Pfam domain module=Exonuc_X-T::Exonuc_X-T_C; Domain location=15-198::216-330
MAIEDNAVPASEFTFLFHDYETFGKSPSLDRPAQFAGLRTDKAFNAVGEPQVFYCQLADDYLPQPEAVMITGITPQVANARGVPEVEFAQRIHALFSEPQTCVIGYNNVRFDDEVTRNIFYRNFIDPYGWSWQNGNSRWDLLDVMRACYALRPEGIVWPENDDGFPSFKLEHLTQANGVAHEQAHDAMSDVYATLAMAKLVQEKQPKLFEFLFTHRNKQKLMTLIDIPQMKPLVHVSGMFGAARGNTSWIVPLAWHPDNKNALIVADLAGDMTPLLTLSPDELRERLYTRHSDLGDLPAVPIKLVHINKCPVLAPANTLRPEDAERLGID

SEQ ID NO: 160044 - protein, 138 aa, Glycine max
  Coding DNA Sequence Number=SeqID_68359
  Homolog annotation: Hit_ID=UPI00006A2D9E; Match level="QueryCoverage =80%, HitCoverage=56%, E-value=6e-08, Identity=18%"; Hit description =UPI00006A2D9E related cluster
MTDPLDESISCFLMRVNPWVLVPITFKGLHAFTFRGLHVLVIKGLHAPAFVGLHTLTFRGLHVLTFRGLHALTFIGLHALTFRGLHVLIFRGLHVLTFRGLHALTFRGLHVLALEGYKSFPSEEYTSSPSEGYTPSPS

SEQ ID NO: 160045 - protein, 73 aa, Glycine max
  Coding DNA Sequence Number=SeqID_68360
  Subcellular localization annotation: CTP_CleavageSite=31; ConfidenceScore=5.33e-01
MTTPPSPHPLNDASSHSPPNLKWTRKSTRLRSLATRPVGAERLLVHVDPTIGKDDGSHKKKLKTYLGIVARDK

SEQ ID NO: 160046 - protein, 77 aa, Glycine max
  Coding DNA Sequence Number=SeqID_68361
MGASQHRTPELGNGSHNMGSFLILILFICPSFLIHQSRMIEFASFLTRFGPFPDEDQIRKLEVASYPEPYQNYTDIA

SEQ ID NO: 160047 - protein, 126 aa, Glycine max
  Coding DNA Sequence Number=SeqID_68362
  Gene Ontology: Biological process=transposition, DNA-mediated
  Homolog annotation: Hit_ID=Q1J7G7; Match level="QueryCoverage=26%, HitCoverage=48%, E-value=7e-12, Identity=97%"; Hit description =Transposase
MPQNVLYDAIGIYQRCGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 160048 - protein, 46 aa, Glycine max
  Coding DNA Sequence Number=SeqID_68363
MEKLANSFSVLELDADDSHVPTTAVCLISCKLVVQCTAPMLECITE

SEQ ID NO: 160049 - protein, 121 aa, Glycine max
  Coding DNA Sequence Number=SeqID_68364
  Subcellular localization annotation: CTP_CleavageSite=56; ConfidenceScore=5.03e-01
VVHVSSTFEFGAEFHDCLSADPQGNPPYSTFVGAPCMSLPSAVHVSPLSSAKLLVTRKHKKKEGMETRVIITERVGRTKSVSYLCFPLISDERSTWALQKILQKVVASGGSNLARLGELDG

SEQ ID NO: 160050 - protein, 52 aa, Glycine max
  Coding DNA Sequence Number=SeqID_68365
MDNHSGISARQRDSNVSMTDLVSEEDDAFCLTDSNRMFMKVRTTTWVSPHVT

SEQ ID NO: 160051 - protein, 178 aa, Glycine max
  Coding DNA Sequence Number=SeqID_68366
MMRCVGVQADPAILARIVTGQRIPLGGWRTVQRRQAVLKPARGQADVDADRGRRPQQIAQRLAGEADAGGGEFANGKSRGEAVGLKKVDRRRVFRTPQSLPQLLPQCGSALRIHAKPPENTQASSIAEWISGGAGAESGHACAGYAAARTTACRRLLTRRGRCTGCQTSRASRRGSAR

SEQ ID NO: 160052 - protein, 558 aa, Glycine max
  Coding DNA Sequence Number=SeqID_68367
  Gene Ontology: Mol. function=DNA-directed DNA polymerase activity; Cellular component=intracellular; Biological process=DNA replication
  Homolog annotation: Hit_ID=Q6D465; Match level="QueryCoverage=39%, HitCoverage=91%, E-value=1e-104, Identity=78%"; Hit description =Putative hydrolase ECA2529
  Pfam annotation: Domain name=2-Hacid_dh_C; Domain location=104-277; Score=168.2; E_value=2.2e-47; Accession=PF02826.10; Description=D -isomer specific 2-hydroxyacid dehydr
  Pfam annotation: Domain name=NAD_binding_2; Domain location=136-257; Score=-82.1; E_value=0.023; Accession=PF03446.6; Description=NAD binding domain of 6-phosphogluconate dehydrogenase
  Pfam annotation: Domain name=PHP; Domain location=311-504; Score =140.3; E_value=5.4e-39; Accession=PF02811.10; Description=PHP domain
  Pfam module annotation: Pfam domain module=2-Hacid_dh_C::NAD_binding _2::PHP; Domain location=104-277::136-257::311-504
MEIIWYHPSLNPQPWLDGMRQRLPSVRIRQWQPGDSAPADYAIVRSPPVEMLAGRALRGVFAMGAGVDEILRQLRTHPEMLADAVPLYRLEDTGMARQMQEYANWCVLGWFRRFADYHQQQRQALWQSLPDRERANFTIGVLGAGVLGRSVLESLRQWGFPLRCWSRSPKQIAGVTTFHGRDQLTEFLAGTQILIDLLPATPETSNLIDGAFLSALPRGACFLNLARGAHVVEADLLAALESGQLAAAALDVFQVEPLPAASPLWSHPRVMITPHNAATTLPHEAMDYIAGAITALEQGQQPREEKRMYPVDLHMHTVASTHAYSTLHDYVAQAKQNGLKLFAITDHGPDMADAPHYWHFVNMRIWPRVIDGVGVLRGIEANIKNQQGEIDCSGPMLDALDLIVAGFHEPVYAPRDKAHHTEAMIATMASGLVHIISHPGNPKFPVDIRAIAEAAAHYDVALEINNSSFTHSRPGSEPNCRAIAEAVRDAGGRLAFGSDSHTAFTLGDFEHCLRITREVDFPQDRVLNVTPPAGPAAGAAVHPAARRQTERSVAAGAG

SEQ ID NO: 160053 - protein, 158 aa, Glycine max
  Coding DNA Sequence Number=SeqID_68368
  Homolog annotation: Hit_ID=Q6WAY6; Match level="QueryCoverage=54%, HitCoverage=15%, E-value=4e-07, Identity=34%"; Hit description =Putative uncharacterized protein
MGTRGCISYNPVHAIRQLGYPMRGAPLEEELAPIIARGFNNTNMEATQKVRKAWEMVQKKDKELRGSNNGPIGGYHRWLKAHMQGLDWLPSLRTTKGVEVEAPEEDEEVQALRAELEKAQTVKQRFKSAALKIRKENAKLRDVNIATTKALEQETKGL

SEQ ID NO: 160054 - protein, 73 aa, Glycine max
  Coding DNA Sequence Number=SeqID_68369
MLLSSNVIHICVRVVMLVRMIRTRLFVEARVKSCPGMHSSCMIASSSSCARTVGPLPGSGGGPGTGKRKLLAP

SEQ ID NO: 160055 - protein, 224 aa, Glycine max
  Coding DNA Sequence Number=SeqID_68370
SLGFRKECDVLRDVKMTMVKALERATKRARKEEWSRNKFRGALWGSSNELKLRRAERDESRLESMVLEDKLKACQRAKRSKGWRMNEHAKVSTLQMEREAKERVIESLHREAMKWMDRFALTLNGNQELPRLLARAKAMADLYSAPDEVHGLFDYCQHMEVQRQMKTDMEAMKDQMTSMIEAMLSMRRMMEDNAAAVATTSIAVEADPTHPSGINQTSRPIPDV

SEQ ID NO: 160056 - protein, 267 aa, Glycine max
  Coding DNA Sequence Number=SeqID_68371
  Homolog annotation: Hit_ID=Q6WAY6; Match level="QueryCoverage=29%, HitCoverage=13%, E-value=6e-12, Identity=47%"; Hit description =Putative uncharacterized protein
VGTVNGTPPKVILPQSVRKDFRFDHNGGIYGSHCIPRPILWPAIEMLHQDCSCDRRFGERVGSYEANSKRRSRPTAEILGRQGEGKEQRTDCLLLARSLCVVGFAPIPMRHKAPVSASKLSLEGKEGVLFSCGDYPNVPLIGTRGCINYNPVLAIRQLGYPMRGAPTEESLSPFLVRDFDVQSFKIVQRVHMAWKSPLRKDKELRGIRNGIIGGYHERLRVHTRGLDWLSKLKIVNEENFEAPEEDEEVQALKSELGKARLTKEKFK

SEQ ID NO: 160057 - protein, 196 aa, Glycine max
  Coding DNA Sequence Number=SeqID_68372
  Subcellular localization annotation: CTP_CleavageSite=50; ConfidenceScore=5.13e-01
MSFLGETSSQSITNSILAFILPNGSISYNQTGVYFQSLIPTPMRVPNNCSFDTLKRRMHNTLQLTNDQLLDEIYYRQPFIDAGQQYFFQSLQLKDDDDVYTMLMCNEQYSCIGPIELLCTIIRTPDAILNLLQSTITPTHDTIMYCNGKWNIPRQGEFLGYSFTGTNPIRFGISSGCGMEKLKDLIKQVAPYRCSP

SEQ ID NO: 160058 - protein, 173 aa, Glycine max
  Coding DNA Sequence Number=SeqID_68373
VVPSMVRLMKQANVFPLKKTLKKFIIWEINSDKGILKEDFQASSRVLLVASAKHNTHGLRARKNPKEDGLYRFAKHTAPVHPLSEKGVLSQKSLTDSELCMSRVSRERKVQVPESVERFCCEKICRDHNSKQEPASWYGKLNPLLDLPCSGNWSDSKVLDSAGLSSRAFTRNW

SEQ ID NO: 160059 - protein, 175 aa, Glycine max
  Coding DNA Sequence Number=SeqID_68374
MTFPSTLKRTRKATRLRSLATRPVGEERPLVHMDLAMGKADGPHRKKLRTYLGIVSRDKVDVTYENWKQVSTTQKDLIWEDIQVFNLNVASDKDGVDDTICEKYDISQEKWTRFYQSRRDPSWKDEQKKAQAIQKQNTAPHVLSRGGYELLEKKVMDEKKKKQLKEDAQSRSTDT

SEQ ID NO: 160060 - protein, 178 aa, Glycine max
  Coding DNA Sequence Number=SeqID_68375
MVEPSKKQKGSSSRTQRHSETQETQIPSSISSSSLFSSEEQRIQYTNLFSSRSIIDPKFIDMDFFSNESYECIQAFENSNLIPFMSLKLLVYSELVKVFYSNLKIQEGTLISEVYGIKMVIDQSLFYDLTQLSSEGVPFEGTLNDDWKFDFSVHDARRLVCTNQANMTGRLLAGSLAS

SEQ ID NO: 160061 - protein, 119 aa, Glycine max
  Coding DNA Sequence Number=SeqID_68376
MKVYATFLVTCVRYHDDGYESTITVIIVIKRNERVLRCLRMRARARVMSEVEEVQERMKADIEAMKEQMATMMEAMMSMKKIIEVNATAVAATSVIAEVDLIPPYGLNQINHPTSDMVG

SEQ ID NO: 160062 - protein, 91 aa, Glycine max
  Coding DNA Sequence Number=SeqID_68377
  Subcellular localization annotation: CTP_CleavageSite=48; ConfidenceScore=5.21e-01
MNIQGKRRVKLKLGIKSLIVYNNSHRLHARSRINRIFSRVVFLERKLGVSVFSSLFMWGGTSPVGSDLEWQSQRKNHFEMGFPFVGGHLPR

SEQ ID NO: 160063 - protein, 49 aa, Glycine max
  Coding DNA Sequence Number=SeqID_68378
MTVKTSDTCSSRRRSQLVCCATVGKGDRCGPLRYYASWRKGDVLQGDFG

SEQ ID NO: 160064 - protein, 104 aa, Glycine max
  Coding DNA Sequence Number=SeqID_68379
MVLKFHDDPTVNDSEIIVFLRQVWWAAGKRKDFERRRRKMKMRERRGTNYQKTAGGVFSKNGGANSNQAHLGPPEDSSRRLLLLEEATLVAWASWVASFSPNFL

SEQ ID NO: 160065 - protein, 266 aa, Glycine max
  Coding DNA Sequence Number=SeqID_68380
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLGKHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160066 - protein, 84 aa, Glycine max
  Coding DNA Sequence Number=SeqID_68381
MERNDDKGDDKKLKDQSKNNSSESKINQRTTQVNQEEFKTQEESLESRIKIQGSRSQESRFKVQDLKNQDQDSRIKRRLNQDKY

SEQ ID NO: 160067 - protein, 185 aa, Glycine max
  Coding DNA Sequence Number=SeqID_68382
ALADDWKFDFSVHDAARLVCTNQADMTERLLAGSLALESRILHYLIARIAINAPLPYPHLVTLFLQHFNIPLDFEPYVPIKRSFLISAAVVASFGYRKERNGSWAKKGAQPNDDEGQIPVEGDSSLLQSILDRFDGLQTYVGERFDALEQQVDMRFDAMDSRITKVEEEVTIIRDCLDLLPPPSS

SEQ ID NO: 160068 - protein, 100 aa, Glycine max
  Coding DNA Sequence Number=SeqID_68383
MSRWHDLAGGYGHPVGLIEARNQSWKPQGPVGLLRVHWESLVILVRMIHTRLFAAAQVKSCPGMHSSCVIASLSGCARIVGPSLGSGGGPGVDKRKLLAP

SEQ ID NO: 160069 - protein, 86 aa, Glycine max
  Coding DNA Sequence Number=SeqID_68384
MTGFLRFFRRFPQINVGGDSAHFPPLENAPITIQIFVLLCSNLESMSNLKLMLPTLIIDPLSSKTNNNRIIMIFQATDTIQVGEII

SEQ ID NO: 160070 - protein, 211 aa, Glycine max
  Coding DNA Sequence Number=SeqID_68385
MTEGCGEGFCLANLPGDAFSLWGNFFEAKKQMMADAKFAGLLWFSHCLSFSMCPVVGFGPWLGLGKPLVEILPPGQLRGFCPLLAWLGSAVLGYGPVLSFGLVGPLLPPVISFVARILPTLACAPLAKSGLLGDLEGRDESKRQGLNLSGIVAARPLCHLQYPVAYLSRLQRILPAARWELRFKASRRANPPHGGSPTARGLWGAGGPLLA

SEQ ID NO: 160071 - protein, 730 aa, Glycine max
  Coding DNA Sequence Number=SeqID_68386
  Gene Ontology: Mol. function=binding; Biological process=cellular iron ion homeostasis
  Homolog annotation: Hit_ID=A7Q1P5; Match level="QueryCoverage=98%, HitCoverage=97%, E-value=0.0, Identity=60%"; Hit description =Chromosome chr7 scaffold_44, whole genome shotgun sequence
  Pfam annotation: Domain name=TPR_1; Domain location=153-186; Score =6.1; E_value=1; Accession=PF00515.19; Description=Tetratricopeptide repeat
  Pfam annotation: Domain name=TPR_1; Domain location=587-620; Score =8.2; E_value=0.55; Accession=PF00515.19; Description=Tetratricopeptid e repeat
  Pfam annotation: Domain name=TPR_1; Domain location=621-654; Score =28.2; E_value=3.1e-05; Accession=PF00515.19; Description =Tetratricopeptide repeat
  Pfam annotation: Domain name=TPR_1; Domain location=691-724; Score =4.5; E_value=1.5; Accession=PF00515.19; Description=Tetratricopeptide repeat
  Pfam annotation: Domain name=TPR_2; Domain location=153-186; Score =10.6; E_value=1.4; Accession=PF07719.8; Description=Tetratricopeptide repeat
  Pfam annotation: Domain name=TPR_2; Domain location=338-371; Score =9.6; E_value=1.9; Accession=PF07719.8; Description=Tetratricopeptide repeat
  Pfam annotation: Domain name=TPR_2; Domain location=495-528; Score =6.9; E_value=4.2; Accession=PF07719.8; Description=Tetratricopeptide repeat
  Pfam annotation: Domain name=TPR_2; Domain location=531-564; Score =5.9; E_value=5.5; Accession=PF07719.8; Description=Tetratricopeptide repeat
  Pfam annotation: Domain name=TPR_2; Domain location=587-620; Score =6.6; E_value=4.5; Accession=PF07719.8; Description=Tetratricopeptide repeat
  Pfam annotation: Domain name=TPR_2; Domain location=621-654; Score =29.0; E_value=1.8e-05; Accession=PF07719.8; Description =Tetratricopeptide repeat
  Pfam annotation: Domain name=TPR_2; Domain location=691-724; Score =7.6; E_value=3.3; Accession=PF07719.8; Description=Tetratricopeptide repeat
  Pfam annotation: Domain name=TPR_2; Domain location=86-119; Score =1.6; E_value=19; Accession=PF07719.8; Description=Tetratricopeptide repeat
  Pfam module annotation: Pfam domain module=TPR_1::TPR_1::TPR_1::TPR _1::TPR_2::TPR_2::TPR_2::TPR_2::TPR_2::TPR_2::TPR_2::TPR_2; Domain location=153-186::587-620::621-654::691-724::153-186::338-371::495 -528::531-564::...
  Pfam module annotation: Domain location=587-620::621-654::691-724::86- 119
MGSRARQGRRLQTMMKCMCLREPLKGEDETVPSSDSLAIREFYSSTASGRSGPDGEIEMMGSGSGNMDEAELSLRESGIMDIMDNEEARALLGKDEYQEGNIEAALHVYERINISAVTSKMKISLAKSREHRKKHYHYYATPPMSIYTAGLLLEAIFLKAKCLQVLGRFKEAAQTCKVILDIVESSLPEGLPQNFGDEGKLQETLSKVVELLPELWKLADSPRDVILSYRRALLHRRNLDAKTIAKIQKEFVVFLLYSGGEAILSNLRSHMDSSFVPRNNLEEAILLLMILLRKISLNKIEWDPSILDHLSFALSVSGDLTALAHQWEELLPGTINRRERYHALSLCYYGAGNDLVALNLLRKLLSSREDPKHVPSLLMASKICSMNPDLAKDGASLACKVLENLDGRCDQLESLSSCLLGVSLSAHSKIAISNSERVEKQSEALHSLETASKVTRMRNPPVIYYLSLECAEQRKLDVALHYAKCFLNLEAGSNIKGWLLLARILSAQKQFLDAESIVDEALNQTGIWDQGELLRTKAKLQIAQGQLKSAIETYTQLLAILLVQRKTFGSKKKLYKDYIDHARNMEVEIWHDLAYVYISLSRWHDAEVCLSKSKAIKLYSASRCHAIGTMYEAKGLYKEAIKAFRDALSIDPGHVPSLISTAVVLRRCSNQSNPAIRSFLMDALRHDRFNASAWYNLGIFNKDEGTILEAADCFETANFLEESAPVEPFR

SEQ ID NO: 160072 - protein, 294 aa, Glycine max
  Coding DNA Sequence Number=SeqID_68387
  Gene Ontology: Mol. function=phosphatidylcholine-sterol O -acyltransferase activity; Cellular component=endoplasmic reticulum membrane; Biological process=lipid metabolic process
  Homolog annotation: Hit_ID=Q8GZM5; Match level="QueryCoverage=99%, HitCoverage=39%, E-value=1e-125, Identity=76%"; Hit description =Lecithine cholesterol acyltransferase-like protein
  Pfam annotation: Domain name=LACT; Domain location=111-293; Score =13.9; E_value=3.3e-13; Accession=PF02450.6; Description =Lecithin:cholesterol acyltransferase
MAKNPLLCSIVLLAVLAGATSDDGAELDYSKLSGIIIPGFASTQLRAWSILDCPYSPLDFNPLDLVWLDTTKWGTRTRILSLPPFSLHHQANLISPAVYEISSNELRFKELRVWYLLSAVNCWLKCMVLDPYNQTDHPDCKSRPDSGLSGITELDPGYITGPLSSVWKEWIKWCIEFGIEANAIIAVPYDWRLSPSKLEERDLYFHKLKITFETAYKLRGGPSLVFAHSLGNHVFRYFLEWLKLEIAPKHYIQWLDQHIHAYFAVGAPLLGAMETIEATLTGFTFGLPISEVTF

SEQ ID NO: 160073 - protein, 391 aa, Glycine max
  Coding DNA Sequence Number=SeqID_68388
  Gene Ontology: Mol. function=DNA binding; Cellular component=nucleus; Biological process=regulation of transcription
  Homolog annotation: Hit_ID=A7Q825; Match level="QueryCoverage=89%, HitCoverage=74%, E-value=2e-76, Identity=50%"; Hit description =Chromosome undetermined scaffold_62, whole genome shotgun sequence
  Pfam annotation: Domain name=Myb_DNA-binding; Domain location=264 -315; Score=46.3; E_value=1e-10; Accession=PF00249.22; Description =Myb-like DNA-binding domain
MEARSAFSIDRSNAKQLNNMGMSEAFPSSLPALPSPLEETYPKLSDSKPVFMEKELKTKPYTHSSHLTSSGAVGHMFSSSPGYSTDLHHSSFSSHEKQPRNTHFISQSLSNMASLPLSYSSNSEPIPSTTSTPYSNGNSVSWHTDSLPSFLDFPANTSIGNSQVESSDCNIMATEEYSKRNDWQEWADQLISDVDPLTSNWNDLLADNIQDLEPKAMYQVAKSSSQLPIGHQSQSHQQLPASSGENRVGVAPTSSTNSAPAKPRMRWTPELHEAFVEAVNQLGGSERATPKGVLKLMKVDGLTIYHVKSHLQKYRTARYRPESSEGAAEKKLSPIEEMSSLDLKTGIEITEALRLQMEVQKRLHEQLEAKPPKGLQLRRAKEFPQLRWLFQ

SEQ ID NO: 160074 - protein, 133 aa, Glycine max
  Coding DNA Sequence Number=SeqID_68389
  Gene Ontology: Mol. function=transporter activity; Cellular component= membrane; Biological process=oligopeptide transport
  Homolog annotation: Hit_ID=A7Q1N5; Match level="QueryCoverage=100%, HitCoverage=24%, E-value=1e-46, Identity=63%"; Hit description =Chromosome chr7 scaffold_44, whole genome shotgun sequence
MAVVEEKGLASGREDYTQDGTVDLKGRPVLRSNTGRWRACSFIVASNLVQYLTKKLHEGTVTSSNNVTNWSGTVWIMPVAGAYIADAYLGRYWTFVTASTIYLLGTCFLTQAVSLAALRQPPCAPGVADKECQ

SEQ ID NO: 160075 - protein, 751 aa, Glycine max
  Coding DNA Sequence Number=SeqID_68390
  Gene Ontology: Mol. function=histone-lysine N-methyltransferase activity; Cellular component=nucleus; Biological process=chromatin modification
  Homolog annotation: Hit_ID=A7NXH5; Match level="QueryCoverage=60%, HitCoverage=81%, E-value=1e-133, Identity=52%"; Hit description =Chromosome chr5 scaffold_2, whole genome shotgun sequence
  Pfam annotation: Domain name=Pre-SET; Domain location=452-598; Score =0.9; E_value=0.00045; Accession=PF05033.7; Description=Pre-SET motif
  Pfam annotation: Domain name=SET; Domain location=600-751; Score =86.3; E_value=9.5e-23; Accession=PF00856.19; Description=SET domain
  Pfam module annotation: Pfam domain module=Pre-SET::SET; Domain location=452-598::600-751
MAPNPRVVAAFMAMSNLGIHESKVKPVLKKLLKLYDKNWALIEEESYRALADAIFEEEENKVNEPDQNIKNKPMTAEMCSGFSNIQDGVVDDVEAHTHEEPVRPLKRLRLRGQEGQSLRPLTSSGPSSAAFPLKMPKLEDGTVPESSSRLQPQSLAALSDGNARIGAHHVPPQDAVVDKGKKPISPQVTPRRRRSLSEPLKESTVEGRAALLANNKMPHPFILIKPKDEPVDDIPDYEIPLAVIPPDSPMGAVEKQDVHDTVVSQCRDEDVEHEDVFPSSNEEATSNVYVALSSMGEDKCDQSYRTTLTLISVLKLLRDTCDCMLEFATDSSNNSQEQSVKITQTDDVSKESETNDSSIVRGNKDSVIANGSISVKSSSAVAELQVPSSIPSPSDPDDAVLAPKKVAMNGFLQSDGGKELEDPISPNSCTLVVVQKHQLTTDDVRAVHDVNDLTKGEERVKISWVNNTTNDFPPLFHYIPRNLVFRDAYVNISLSRIGNEDCCSTCMGNCVLSSNPCSCTNKTGGEFAYTAKGLLKEEFLDECIALSHDPQNYFYCKACPLERSKNDDCLEPCKGHLKRKFIKECWSKCGCGKHCGNRVVQRGITCKLQVFLTSDGKGWGLRTLEDLPKGAFVCEFVGEILTLKELHERNLKYPKNGKYTYPILLDADWGSGTVKDREALCLYAASYGNAARFINHRYWNFSCFTRCLDANLVEIPVEVEGPTHHYYHFAFFTSRKVAAQEELTWVCEFGL

SEQ ID NO: 160076 - protein, 574 aa, Glycine max
  Coding DNA Sequence Number=SeqID_68391
  Gene Ontology: Mol. function=nucleic acid binding; Cellular component= intracellular; Biological process=transport
  Homolog annotation: Hit_ID=Q2PEQ3; Match level="QueryCoverage=76%, HitCoverage=82%, E-value=1e-97, Identity=48%"; Hit description =Putative uncharacterized protein
  Pfam annotation: Domain name=NTF2; Domain location=112-286; Score =52.8; E_value=1.2e-12; Accession=PF02136.11; Description=Nuclear transport factor 2 (NTF2) domain
  Pfam annotation: Domain name=RRM_1; Domain location=481-545; Score =17.4; E_value=0.0037; Accession=PF00076.13; Description=RNA recognition motif. (a.k.a. RRM, RB
  Pfam module annotation: Pfam domain module=NTF2::RRM_1; Domain location=112-286::481-545
MGVVDATCADCNTGPESLVHANRDCTKSAEVWRFAWGSTSLPSFVGLATGFEVLQRASALVQDIKRSAVWGFRALSLPSPGSARRSAECSELQRCLLEMASSYPGSVSAAQVGSYFVGQYYQILRQQPNLVHQFYSDSSSMIRVDGDSVETAHDVLCPADIGFSTSERPCYSWDASSSLMLPLPRDSGCVSWGVVARLWLGVSWLDQCMFSGSFLSVRTELVAPSSIGRLMSDERLTLNAFGLGVLVMASGFVKIKDIGGKRKFVQTFFLAPQEKGYFVMNDMFHFIDDGVMYPNLVPVASETIDTQPHLSASLAEPPVSDLAVSDYGLEEEAREYANSVHIDDDPVDKYSLPEHQQQLQEELETEIVVEETSVQEASPPIHTVAHTIQEPPVALVEESFEEPPKKTYASILRVSKGLPVLSAAPKHAPHSFKSAPPPPELNHVAQPAVQQSSSASMYAPESGTEAAEEGYALEEDEVTSVYVRNLPANVTEVEIDQEFKNFGRIKPDGIFIRVRKEIGVCYAFVEFEDIIGVQNALQEGEEAEAAIKQMLREGVLVVGAWEGEVIRMVQTTPD

SEQ ID NO: 160077 - protein, 389 aa, Glycine max
  Coding DNA Sequence Number=SeqID_68392
  Gene Ontology: Mol. function=nucleoside-triphosphatase activity; Cellular component=integral to membrane; Biological process=transport
  Homolog annotation: Hit_ID=Q1M2R7; Match level="QueryCoverage=98%, HitCoverage=28%, E-value=0.0, Identity=84%"; Hit description=PDR -like ABC-transporter
  Pfam annotation: Domain name=ABC_tran; Domain location=24-171; Score=- 6.9; E_value=2.7e-06; Accession=PF00005.18; Description=ABC transporter
MRNRGVVEDKLVLLKGVSGAFRPGVLTALMGVTGAGKTTLMDVLAGRKTGGYIGGNITISGYPKKQETFARISGYCEQNDIHSPHVTVYESLLYSAWLRLSPEINAQSRKMFIEEVMELVELKPLRHALVGLPAAAIVMRTVRNTVDTGRTVVCTIHQPSIDIFESFDEQGGQEIYVGPLGHHSSHLISYFEGIKGVNRIKDGYNPATWMLEVSTSAKEMELGVDFAEVYKNSELYRMFADIWSLACCLRRNKALIKELSTPAPGSKDLYFPSQYSTSFLTQCMACLWKQHWSYWRNPLYTAIRFLYSTAVAAVLGSMFWNLGSKIDKQQDLFNAMGSMYAAVLLIGIKNANAVQPVVAVERTVFYREKAAGMYSALPYAFAQASKSSF

SEQ ID NO: 160078 - protein, 122 aa, Glycine max
  Coding DNA Sequence Number=SeqID_68393
MGEKKILSLVMFVIMAYGLAVTPFTACDQFHIPKTCYGYEALLSICGTYFAVIKYNPSSFCCDAATIAFPKASRSSESRRGFCNCLRVIGPQLDFVKSKLTSLPGACGIKPSFSMQSCIYGA

SEQ ID NO: 160079 - protein, 703 aa, Glycine max
  Coding DNA Sequence Number=SeqID_68394
  Gene Ontology: Mol. function=protein binding; Cellular component =nucleus; Biological process=regulation of transcription, DNA -dependent
  Homolog annotation: Hit_ID=A7QYP4; Match level="QueryCoverage=82%, HitCoverage=61%, E-value=1e-169, Identity=58%"; Hit description =Chromosome undetermined scaffold_252, whole genome shotgun sequence
  Pfam annotation: Domain name=Plus-3; Domain location=319-428; Score =144.0; E_value=4.2e-40; Accession=PF03126.9; Description=Plus-3 domain
MASHDCGHLVVPDTPKSLKVRGPFFKTLVNGYLHAKFMISNLGLEVISRFKGEGNRVMADLENLLLEAAGRTRHSRQTSRRGHGDGGSDSRDDDSENEHDYPGRKASGLQVPQKKWFDPMERDDGERSKDEGDDDVGGRSYHEGDSSDESDFGDDLYKNEDDRHKLSEMTELQREMILSERATKKHDKDLLGKIASKREKGKTTVAGKLTSPLTPSHVRSSARSANRSTAKDGALNELRAKRLKQQDSEANRRPSKASRSSGPGLVSPKHRPFPSLGSSSDSETESKSLSDNEGSSDDDRIIDSNDDRIMLGSEGLLFEHIKEITIRRSKLAKWFMEPFFEELIAGCFVRVGIGRSMSGPIYGLCMVKNVDATDCDQQYKLEDKTTHKYLNVVWGNETSATRWQMAMVSDSPPEEEEFIQWVKDVERRGGRMPTKQEVAEKKEAIQKTNLFVYSAATVKQMLQEKKSAKTRPLNIAAEKDRLRTELEIAHSKNNKAEVKRIMTRLLELEESRQAKTMDARALKLAEMNRKNRFENFKNASELKPVNKELKAGEAGYDPFSRRWTRSMNYYAGKPAEEAAGEINSASGAVADTGSYHTGASETVTAGMAATTAALKAAAGAGKLVDTSAPVDQGTESNSLHNFQLPISLAILQKFGGAKGVQAGFMAKKQRIEATVGFQVLKNDRQKHALTLTVSDYKRRRGLL

SEQ ID NO: 160080 - protein, 819 aa, Glycine max
  Coding DNA Sequence Number=SeqID_68395
  Gene Ontology: Mol. function=metal ion binding; Cellular component =integral to membrane; Biological process=intracellular signaling cascade
  Homolog annotation: Hit_ID=Q10RU8; Match level="QueryCoverage=94%, HitCoverage=83%, E-value=0.0, Identity=50%"; Hit description=DENN domain containing protein, expressed
  Pfam annotation: Domain name=DENN; Domain location=509-691; Score =13.5; E_value=1.1e-07; Accession=PF02141.12; Description=DENN (AEX -3) domain
  Pfam annotation: Domain name=dDENN; Domain location=733-810; Score =7.0; E_value=0.023; Accession=PF03455.10; Description=dDENN domain
  Pfam module annotation: Pfam domain module=DENN::dDENN; Domain location=509-691::733-810
MDSKEEAEPHEDRPTSPMRVLQQLSEGAFRVAGEAFHNMYSGGGSSKSQMGPGAHRRSQSELVTRGVERTNSFQKLRSHVHKAWRWGGRFRQEVSPASFNPEVMANQKRQWYQLHPRSLVSLCTIHIFVRNGCVHYKEPTSLFEHFLIVGLHPDANLEDVEHAFVRRKKWEKEKPEFLDYKMLQQQRPPEPTLEPQLLFKYPPAKKLTMRMKDLAPFCFPEGVKAWLLERTPSLSELNELVYGQEHLGKDDLSFVFTIKAADNTTLYGVCLHVPEIVQRPPGILGISSPFSHPSGACSRFLVSAPRCYCLLTRVPFFELHFEMLNSLIAQERLNRITQFINEVTITGSTPSTPKLGDQMSSNANSPDRESFSDWMDCAIPLDGAAIITAAAAGIISDDEIIQLSPKIWDSRCQSPVRDVDKDGRKNLQDHDNCAFEAPENLGSIERMHGICENDQVSPKVGTPFSARSRVLERLGSSESLFSPVRSMASDNEEDFFSNNERDYGDELLMEWAMENKNDLLQIVCRYHAEPIPPRGSELVFHPLEHLQAIQYIRHSVASLDFSNDCSNCSEPAQDNAKLAAAEEALSLSVWTMATTCRVLSLDSVLALITGVLLEKQVVIVCPNLGVLSATVLSLIPMIRPFQWQSLLLPVLPGKMIDFLDAPVPYIVGIQHKPDDLNMKTTNLVLVNIPKDQITMCHLPRLPQHRELLSQLTPIHAKLSNERSIARKHPVHRCNEVQAEAATQFLNIMWHYLESLCSDLKSHTITSVQSNNDRVSLLLKDSFIDSFPARDQPFIKLFVDTQLFTVLSDSRLSSFESGES

SEQ ID NO: 160081 - protein, 1580 aa, Glycine max
  Coding DNA Sequence Number=SeqID_68396
  Gene Ontology: Mol. function=nucleotide binding; Cellular component =myosin complex; Biological process=signal transduction
  Homolog annotation: Hit_ID=A7Q1H2; Match level="QueryCoverage=97%, HitCoverage=98%, E-value=0.0, Identity=67%"; Hit description =Chromosome chr7 scaffold_44, whole genome shotgun sequence
  Pfam annotation: Domain name=DIL; Domain location=1376-1503; Score =73.0; E_value=1e-18; Accession=PF01843.10; Description=DIL domain
  Pfam annotation: Domain name=IQ; Domain location=776-796; Score=17.0; E_value=0.072; Accession=PF00612.18; Description=IQ calmodulin -binding motif
  Pfam annotation: Domain name=IQ; Domain location=799-819; Score=25.8; E_value=0.00016; Accession=PF00612.18; Description=IQ calmodulin -binding motif
  Pfam annotation: Domain name=IQ; Domain location=824-844; Score=18.1; E_value=0.033; Accession=PF00612.18; Description=IQ calmodulin -binding motif
  Pfam annotation: Domain name=IQ; Domain location=847-867; Score=7.8; E_value=6.3; Accession=PF00612.18; Description=IQ calmodulin-binding motif
  Pfam annotation: Domain name=IQ; Domain location=872-892; Score=24.6; E_value=0.00037; Accession=PF00612.18; Description=IQ calmodulin -binding motif
  Pfam annotation: Domain name=IQ; Domain location=895-915; Score=26.9; E_value=7.3e-05; Accession=PF00612.18; Description=IQ calmodulin -binding motif
  Pfam annotation: Domain name=Myosin_N; Domain location=33-70; Score =24.9; E_value=0.0003; Accession=PF02736.10; Description=Myosin N -terminal SH3-like domain
  Pfam annotation: Domain name=Myosin_head; Domain location=113-760; Score=849.0; E_value=2.4e-252; Accession=PF00063.12; Description =Myosin head (motor domain)
  Pfam module annotation: Pfam domain module=DIL::IQ::IQ::IQ::IQ::IQ::IQ ::Myosin_N::Myosin_head; Domain location=1376-1503::776-796::799 -819::824-844::847-867::872-892::895-915::33-70::113-760
MEELDFRWSSQIHFLKTLNVSNNGAAAANPVVGSHIWVEDPDVAWIDGEVLEVKGEEIKVLCTSGKTYFDFLNMNDWWESFKYSIMKICVLFKVVVKASSIYHKDTEVPPSGVDDMRKLAYLHEPGVLDNLRSRYDINEIYTYTGNILIAVNPFIKLPHLYDSHMMAQYKGAAFGELSPHPFAVADAAYRLMINEGISQSILVSGESGAGKTESTKLLMRYLAYMGGRAAAAEGRTVEQKVLESNPVLEAFGNAKTVRNNNSSRFGKFVEIQFDQSGRISGAAIRTYLLERSRVCQVSDPERNYHCFYMLCAAPPEDVKKYKLGDPRMFHYLNQSNCFELEGVDESKEYRDTRRAMDIVGISSEEQDAIFKVVAAILHLGNIEFAKGKEIDSSMPKDEKSRFHLQTAAELFMCDAKALEDSLCKRVIVTRDETITKWLDPEAAALSRDALAKIVYTRLFDWLVDKINNSIGQDPESKSLIGVLDIYGFESFKTNRQYNGNSESRATPSQRMNSGFPILTNFLLHASAQCLTGDYSNGQKLFEQFCINLTNEKLQQHFNQHVFKMEQEEYKKEEIDWSYIEFVDNQDILDLIEKVTYQTELFLDKNKDYVVAEHQALLYASKCPFVSGLFPPSPEESSKQSKFSSIGSRFKQQLQSLLETLSATEPHYIRCVKPNNLLKPAIFENKNVLLQLRCGGVMEAIRISCAGYPTRKTFDEFVDRFSLLAPEALAGSSDEVTACKRILKNVGLEGYQIGKTKVFLRAGQMAELDTRRTEILGRSASIIQRKVRSYLACQSFILLRLSAVQIQAACRGQLARQVYEGMRQEASSLVIQRCFRMHIAWKAYKDLYTSAISIQTGMRGMAAHCELHFRRQTKAAIAIQSHCRKYLAQLHFAKLKKAAITTQCACRGKVARRELRKLKMAARETGALQAAKSKLEEQVEDLTLRLQLEKRLRVDIEEAKAQENQRLQSALQEMQLQFKETKLLLEKEREATKKAAERAAVIQEVPVVDNALLEKLRSENEKLKNMVSSLEKKIDETEKRYEEANKIGEERLKQALDAESKVIHLKTAMQRLEEKFIDMESANHILQKQSLLNSSVKTIAEHLSSPLDEKLENGHHAAEEQEAVDTFVTPVKQFGTESDSKLRRSYNERQHESVDSLVNCVMKNIGFNHGKPIAAFTIYKCLLHWKSFEAERTSVFDRLIQMIGSEIENQDDNDHMAYWLSNTSALLFLLEQSLKSGSSAKATPARKLPNPTSLFGRMTMGKLQSFLSSPSSANLAAPPADVVRKVEAKYPALLFKQQLTAYFEKIYGIIRDNLKKDLTPVLALCIQAPRISKGGLRSNRSLAKDSPVVHWQSIIESLNTLLCTLKENFVPPVLIQKIFSQTFSYINVQLFNSNGEYVKAGLAELELWCCQAKEELQLIAWSTNLQYAGSSWDELKHIRQAVGFLGWIRRRLGILIYAWSLQLTASQCFPFHFSSPHLLVLLLQILSVQQLYRICTLYWDANYNTRSVSPDVLSSMRMLMAEDSNNAQSDSFLLDDSSSIPFSVDDLSTSLQEKDFSDMKPADELLENPAFQFLKELAQEA

SEQ ID NO: 160082 - protein, 110 aa, Glycine max
  Coding DNA Sequence Number=SeqID_68397
MSHGPRRMRRKAIKKEDPRRRILLGTTMTHPIVRRRRSTFYTRTMKVMSTSLKKFKQEKQNQRSARVLRVEANGTPRLRILQFLPPFPPPHCSHRKNNLFILTLKFKKVP

SEQ ID NO: 160083 - protein, 164 aa, Glycine max
  Coding DNA Sequence Number=SeqID_68398
KRSSWLNTEHKGPTFLGFIARSRICSLVKHWTQKTNRFWVHYKKRICFLVDYWTQKTNRFWVHCKKWEGIPLWFIACKGFYKDSGNLKQVAWGLDVGMGCGRTKEHEMELQRLNQNEKEQANICLMTKNHESDEEDPLKKKWYIDSRCSKHMTRDVSKFTTISP

SEQ ID NO: 160084 - protein, 141 aa, Glycine max
  Coding DNA Sequence Number=SeqID_68399
  Subcellular localization annotation: CTP_CleavageSite=64; ConfidenceScore=5.19e-01
MNIALPSNTSSPRFRYSGHTVLYYLRDLVHLPGSNKFLASLSGNFFLFGKSPTGNLVPLDLEIEATLRRNRAERRRKLLQDRTIASILEEETHFSDSSSSESPSSRASASNLPEAVTMADEHQQRVTLEDYSSRETIPRIT

SEQ ID NO: 160085 - protein, 103 aa, Glycine max
  Coding DNA Sequence Number=SeqID_68400
MKLLSWETLLFFLLRAYGRRVEVLAQKAYGRPDMTYVRVFVWTLLPPRKSNRSAMSSSPWASSPPLESVSVEVCVGLRDRTGTLFSGALPGLLRGELLQNYFR

SEQ ID NO: 160086 - protein, 116 aa, Glycine max
  Coding DNA Sequence Number=SeqID_68401
MDEDQWAYDNTMSEEVDMNFEDEQYCGVNEGHVDCSNAFNTFQWARTVAHENGFVIVIMRSDTYTGSRGRTSFVLIGYGRSGQYKCRKKEFFRRDTSTKKCGCPFKLCGKSVHGKE

SEQ ID NO: 160087 - protein, 110 aa, Glycine max
  Coding DNA Sequence Number=SeqID_68402
MVKVGTSYVRSTSHFRQKLGPGLPRYQQGHQDLFILRSDLPSQAVPPVQLLTGWCVTAKSAAGHQRWQAAQLLGRAIGAGLFAITPAGERGMCCKAIKLGNASVFPVTTL

SEQ ID NO: 160088 - protein, 80 aa, Glycine max
  Coding DNA Sequence Number=SeqID_68403
  Homolog annotation: Hit_ID=A5C4I1; Match level="QueryCoverage=75%, HitCoverage=38%, E-value=6e-11, Identity=43%"; Hit description =Putative uncharacterized protein
MYLFKNLWHHQNNLGSFASTLISDGGSHFCNAQLQNMLGHYNVKYKMVYGKACHPPIEMKNKAYWALKFLNFDESLSGEK

SEQ ID NO: 160089 - protein, 223 aa, Glycine max
  Coding DNA Sequence Number=SeqID_68404
  Homolog annotation: Hit_ID=Q2HW90; Match level="QueryCoverage=86%, HitCoverage=38%, E-value=5e-16, Identity=30%"; Hit description =Putative uncharacterized protein
MGSDQASSFKKRFYHVKVKNLEVASLRKLGQQMDRVQHQAFSKVYGKIWDLAMKEVSAEAIASLTQYYDQSLRCFTFEDFQLAPTIEEFKGILGCPIGGRKPCLFSGYYPSMVRTIGVVKILEQKLDRVKQSRNGVGGIPRKCLEEKVETLASQGEWASFIGVLALLVFRTVLFSNVDGLVDLATIDAFLAYHHDKESPIIAVLANAYDTFDLRCEKSSVRIV

SEQ ID NO: 160090 - protein, 135 aa, Glycine max
  Coding DNA Sequence Number=SeqID_68405
  Homolog annotation: Hit_ID=A7R463; Match level="QueryCoverage=35%, HitCoverage=26%, E-value=1e-09, Identity=60%"; Hit description =Chromosome undetermined scaffold_621, whole genome shotgun sequence
MVYRVRPSVDEYDKLIEFVCLEGLDWEMEKKLHEEMKRSGFCLKGITRGLIRVVKETEKEVVEAENIAAVDEPVVAADVHASGADAGDEAKGFPGGSRDPSVLTEYVDHVVVSVWNREERPELKLSSHRRKVLKF

SEQ ID NO: 160091 - protein, 73 aa, Glycine max
  Coding DNA Sequence Number=SeqID_68406
MSCFSLPLLSFISFFLQALIHDLLWCGVSSLSLPFSIPLPFIFQEAKESIDEEDPRPTSSNGATPCGIKSIFI

SEQ ID NO: 160092 - protein, 130 aa, Glycine max
  Coding DNA Sequence Number=SeqID_68407
MLKIGNSGKVVIKQDMKGRRHKYGFNNNKREKAEKKRVVDDEAGDKHELYEIMGSPPASTPRPRPPFPPSPPPPPPPPPPSDASALPSAVKRTRKASRLRSLSTRPPSAERPVMHVDLATGKADGPHRKK

SEQ ID NO: 160093 - protein, 274 aa, Glycine max
  Coding DNA Sequence Number=SeqID_68408
MTTLAQTWSVISFSKLIPTSHTSDVTLDRAKFICGIIVKMDMNLGYLISHQISLIAQHDTSRLGLLAFIITLCKAREVQSDSRSLENLSPAINLAYIKKNCLNLDDPTVTFRRPRKARGKRSEVPTTSAAPETPTPSSSIAPVPLIQTPAIPPASTQIPLPTPLSVGLSDFSFTPQMLHSMLQSLHRGQSIIMQSLQGLGLPSVMSMDEFDAQVAWPGAQPSPFGGGGASAAQEPEPEEPAVAATEGEDELTPPEPFYFDAGVHMAQEEETSID

SEQ ID NO: 160094 - protein, 113 aa, Glycine max
  Coding DNA Sequence Number=SeqID_68409
MCVLVHLLQNREEEKAMIGRGRVIMHLVKLLDGRELRGKKNVATVQYVLCSTTKENKVKAQFSNLGPSKTFWKLGILRRKQPSSPGRAGRQPPPLFLLKNGFQGIRNASVKFP

SEQ ID NO: 160095 - protein, 165 aa, Glycine max
  Coding DNA Sequence Number=SeqID_68410
  Gene Ontology: Mol. function=aspartic-type endopeptidase activity; Biological process=RNA-dependent DNA replication
  Homolog annotation: Hit_ID=Q6WAY3; Match level="QueryCoverage=94%, HitCoverage=7%, E-value=2e-12, Identity=30%"; Hit description =Gag/pol polyprotein
MGLGKNNGGRTSLVSTRGNREKFGLGYKPTQADIRKSISERKNKGQSPWLGQQAGGALPYHINRSFISAGLRYEGQVAAICEDDSPRRSDLVRPCPPDTNTRDPAINFEQEAGRIESEEDEDVGLPPELERIIAQEDREMRPHQEETELVDLGTGSGKKEVKIGT

SEQ ID NO: 160096 - protein, 90 aa, Glycine max
  Coding DNA Sequence Number=SeqID_68411
MVKRIMNVHMCRNVPFAGERGRGSWVRFPKEERCAESPPTFICGKRRENRRKPVKMKILSSGVVFTFEEGRQKRDFCSYVPSFVEEIRLT

SEQ ID NO: 160097 - protein, 216 aa, Glycine max
  Coding DNA Sequence Number=SeqID_68412
MAPRKLASKRSRKDKAAEGTSSAPEYDSHRFWSAEHQQRFEAINGWSFLRVRRVQLRDDEYTDFQEEIVHRQCASLVTPMAKFDPDIVLEFYANAWPTEEGVRDMRSWVRGQWILFDADALSQFLGYPLVLEEGHECEYGQRRNRADGFDKEAIAQLLCIPGQDFARTAAGRRLRIMRTNMTTLTQIWMTLLLSNIQPSDHNSDLPCRSVSWCTPS

SEQ ID NO: 160098 - protein, 262 aa, Glycine max
  Coding DNA Sequence Number=SeqID_68413
  Homolog annotation: Hit_ID=A5BSR3; Match level="QueryCoverage=24%, HitCoverage=20%, E-value=8e-09, Identity=50%"; Hit description =Putative uncharacterized protein
  Pfam annotation: Domain name=Transposase_23; Domain location=143-213; Score=5.7; E_value=0.00028; Accession=PF03017.5; Description =TNP1ENSPM transposase
MTRTKKIGEMTTEAAKEIAEKIDSFEEQATQGSFIPHGRQDVLTTAIGRPEHPGRVRATGAGVTIKQYFGSAPRTSCGSSSLPPEELQQLTQQIKDQLEESITEKVTRQLMASFSQMQSQMQSQGLALPPEPPLGPSGNDPETGDSDRCGLYIEANPARLVALGRVYEGSTVVHNTPLLPGQVKVGVEEVKDPDAPILVPTNEVSLVGHAIHTFLVWPTHLVKFLSQQLCLWQNHLKSRIRKVDDPLYLMTLTIPELFLRPY

SEQ ID NO: 160099 - protein, 97 aa, Glycine max
  Coding DNA Sequence Number=SeqID_68414
MTKARQKGVLKKNGGDACHPVRPGEQGDFLQKQPPSGGIFWRVQVGLNLVDYIIIPFLTYGMLRNLPNCATMLPFEFRHVTELHKLPDDGCQVPQNG

SEQ ID NO: 160100 - protein, 616 aa, Glycine max
  Coding DNA Sequence Number=SeqID_68415
  Homolog annotation: Hit_ID=A7ZVH7; Match level="QueryCoverage=34%, HitCoverage=46%, E-value=1e-92, Identity=76%"; Hit description =Putative uncharacterized protein
MTLLRCHVRVAYLILIAGAISASDALLRSSNKRNVFDVLHAKGFIKFACAHVLAHHFQPQIAFLLIARGVDNAFEHAPAIVFTGFLRIEVELIQLGTAHAGVRYRRIPGHFGKADGFVGFGNQPAFVGGYQAAAQFGQAVLFVDEFIQLGFGDPHMFEVGAVGHAPQLMQQFGIIRLRVAYGEFHASLPSVFMFYPALRQSGGVSGHPARTGDPSLCANQTGCHPFCVADGLIAEVQRMPDLSHAARTRQPAQQRELALGQHIGVAVRCGDGGNVFRRQHRTDQRRQRAFFTQDQRFLQVAGDVIQHGFIADVGENHQLDARCFELHQQQATQRLFQAAYHLPGKVEAQTFRNPAVAIHSEDVQHCFLLCSRLTHLNGNRAEPISDGLRQGDNRQAGCQLLCMDMNNMKRKTLPLVLGCTLSLSTLAAQPPAEHYSVTFPQGTRVSYSGAFASAFPEGLPVGIGSGLLFTGRQGDTLNFVTVTDRGPNADSPDMGKQESKIFVTPDFAPLLMNIQVKNGKAQATDARPLHDAKGNINGLPLQNGVIGSTNEIALSDKLHVLQGDNRGLDTEGITLDGKGGYWLCDEYGPFLINVDKQGRILAIHGPQAMDGEKSIA

SEQ ID NO: 160101 - protein, 127 aa, Glycine max
  Coding DNA Sequence Number=SeqID_68416
MNKGFIAVKQPVSSGEQIALQPALTLMLAENFHHPTVTRQLLIIRFDVCHPAAAGDVKDRRQAIRGGLIWPEQTEVIGVALKNRAEVVAELLSGFAALAARRAGVERKLADVRRVERAAQPSAVGIG

SEQ ID NO: 160102 - protein, 91 aa, Glycine max
  Coding DNA Sequence Number=SeqID_68417
MSENHSLYSALPDTELAAHFRDAGVALSEEAAVLNDVIRSVLASEGRRHRTKRRQVCCAERWKLWWVIRQTTPEVVVPAQAGIGSVHKICQ

SEQ ID NO: 160103 - protein, 135 aa, Glycine max
  Coding DNA Sequence Number=SeqID_68418
  Gene Ontology: Mol. function=structural constituent of ribosome; Cellular component=ribonucleoprotein complex; Biological process =translation
  Homolog annotation: Hit_ID=A9P8K6; Match level="QueryCoverage=25%, HitCoverage=22%, E-value=1e-09, Identity=85%"; Hit description =Putative uncharacterized protein
  Subcellular localization annotation: CTP_CleavageSite=36; ConfidenceScore=5.62e-01
MEFVSTTYRLRSKKTRKGKSPGKGTPGRCSSFSFCLSSSLSQTGLRFRDCNDIVEFVFVEFVSATYRLRSKKTRKGKSPGKGGNRFWKSIVLGFKTPREAIEVACKCYETCWRHFKMGPILLSSVVPCLIKSVVV

SEQ ID NO: 160104 - protein, 97 aa, Glycine max
  Coding DNA Sequence Number=SeqID_68419
  Homolog annotation: Hit_ID=A5C5B7; Match level="QueryCoverage=65%, HitCoverage=9%, E-value=5e-09, Identity=43%"; Hit description =Putative uncharacterized protein
MVKCNSAATPTEAGLVLEREGKEDKVDEIEFKQIVGSLRYTKRPRIRHLLAVKRILRFIKGTVNTRILFPNKDNSKREESFVYGKGKNQNNSQTVSF

SEQ ID NO: 160105 - protein, 158 aa, Glycine max
  Coding DNA Sequence Number=SeqID_68420
MHYIIVCILLPCSSNLAQASKEDLILMWAFLTDRQIEWAHLVRYHMHKALWTNAPLPYPQLVTLFLRHFQIPLDDEPFVQVKRSFAIGVGARDASSTLMHEVLYELRGLRAFVADCFDGMDSRLDAMHACFEGMATRITQLEDDMGFILHCFDPPAAP

SEQ ID NO: 160106 - protein, 136 aa, Glycine max
  Coding DNA Sequence Number=SeqID_68421
  Homolog annotation: Hit_ID=Q84VI1; Match level="QueryCoverage=70%, HitCoverage=14%, E-value=5e-34, Identity=79%"; Hit description =Envelope-like protein
MLSQHPNMLNYTDSVIKRESPLSLHYKLFEGTHVPDIVSTSVSTSGKAAASGAVSKDALIAELKDTCKMLEATIKATTEKKMELELLIKRLSESGIDDEDAAEEEGEAAEEEEEAAEEEEDAAEETESDDDSEATP

SEQ ID NO: 160107 - protein, 54 aa, Glycine max
  Coding DNA Sequence Number=SeqID_68422
MGHSILSAKSKSVQPRTISTASFQTWKFVPFNIGIEFTWATFAALDMQINGNDP

SEQ ID NO: 160108 - protein, 652 aa, Glycine max
  Coding DNA Sequence Number=SeqID_68423
  Gene Ontology: Mol. function=small conjugating protein ligase activity; Cellular component=intracellular; Biological process =regulation of protein metabolic process
  Homolog annotation: Hit_ID=A7P1M3; Match level="QueryCoverage=31%, HitCoverage=56%, E-value=7e-90, Identity=76%"; Hit description =Chromosome chr19 scaffold_4, whole genome shotgun sequence
  Pfam annotation: Domain name=UQ_con; Domain location=425-574; Score =103.5; E_value=6.5e-28; Accession=PF00179.17; Description=Ubiquitin -conjugating enzyme
MAIKVILHDVIDIDDDSEDVVIIGEKVNNSNKGKTIDAIHDDHQVVKTADYTYSLPAVENFGSVSGIASSNNFPSVSNNLINIDGHGSDLSYDDDDYFDILSEDYMDVDEYALLQKHFDNVDIPTGIEAPFTWLPPDYVVGSKKTGNNTLYPWHHMQSNANKSPMTPSSQPSLSLEPTNSEIQASSWGAINIPIKMGNVDHSSGVELSSQYISEPAPSKKSATSKLRGRTSNASLGVESSKSHWSSGPFHSKKKPASTYHGFNYHAEAAKMPHAGELPYWGQFKSAKKEAGSSISSLSTFIEHHGSLYPPGIESGKHWWEISHNAKPFSTHLNNIPNHIYYPFDPLVAHPEHVFDNNWVHDSARDGFNGKTVDGPIVTITDEAKEEILRKFRSFKQFDTVEDISDHHFFRSNSSMHQPPKNWAKKIQEEWRILEKDLPASIFVRVFESRMDLLRAVIIGAEGTPYHDGLFFFDVFFPSAYPNVPPKVHYHSGGLRLNPNLYACGKVCLSLLNTWSGSKNEKWLPGVSTILQVLVSIQGLILNTKPYFNEPGYAHMSGSANGEKMSFQYNEDTFILSLRTMMYMIRKPPKGWRCRGVRKSHITSLHSWGATYISVGQLHLMSISFKLKSNMKEGVGGQLKKQCQGMLVPFAGR

SEQ ID NO: 160109 - protein, 1516 aa, Glycine max
  Coding DNA Sequence Number=SeqID_68424
  Homolog annotation: Hit_ID=A7P1M1; Match level="QueryCoverage=97%, HitCoverage=95%, E-value=0.0, Identity=42%"; Hit description =Chromosome chr19 scaffold_4, whole genome shotgun sequence
  Subcellular localization annotation: CTP_CleavageSite=23; ConfidenceScore=5.22e-01
MVMNFLLSILFSLFTFFSFNPVSSFASQPSYKDHCASTVPDSTPTTKLSLKHFPLGDHHTGSYTGGDSIIDVGASWNRFSFYLSKRNTRATQTPNLFKLEGTVSFRSTNTFNDGGGSYYGGQRRYRKGYVTFKLEGFWHASSGKACMVGIGSGYSKKGNSLNVNAVFKLNNVFNASNITSLVSGSLESLSPQKDENYFEPISVLMFPKGNYSYTLDSIEVANEFSHGSDAEQGLALNLNSLSFCKPPLSWGIRRLQLEYSLDCRSSKNCTSISGSFGKLPSLMSLTSTGCSLTTEKHRLRVQVEFSDIGSYWINQSFDPKAMLVGEGWWDEKNNMLCVVVCHVMGNSSSLSGTHVGDCSIRLRLRFPSIWSIKNTISIVGQIWSNKRPNDSGHFKMVTFRNDEESGVGGHGLKYEYSQLEKVNKSCPKHKPNDKGKRYPEAYSDDMRFDMSIRESNKRVAWGYSAPLAVDDEFYESGMYASSYSFSSFSTEVPDGTLNINDNNGSLFNMSYKISLSVISYSKIGDNTSVFNLSSERVKISAEGVYDAGAGTLCMVGCRDLLSNTNTEIPIAHSVDCEILLKFQFPSLDTYDGGYIKGSIESTRHESDPLYFKRLDISAVAYYREAARRNVWRMDVEVMMALISTTLSCVFVGLQLNKVKKEPNLLPFISLIMMSILTLGFMIPLVLNFEALLTQNPNNTMRVFRNNGWLEVNEISVRLITMVAFLLQFRLLYLTWSARKSGESKKGLWIAERNSAYVTSLLYAAGLLIAWLLKLKNGDNKDSVYVPMYQPSPWENIKSYGGLVLDGFLLPQIILNLFLNMRDNVLSFSFYFGTTFVRLLPHAYDLYRTHSDAALDSRSYYYADPSEDFYSTAWDIAIPLGGSKVYEKVPEKVPVVTESEAETGKYLNLDAVFKLDNVFDASNITRLVSGSLESLSSEKEIANEFSSGSDAMKGEFWSTAISSVFERHFSNTGNYWISESFNPKTMLVGEGWWDEKKNILCVVACHIIGNTSSLAGTHVGDCSIRLRLRFPSTWSINSTSSIVVQIWSNKSTNDSGYFNMIKFRNEEDGRVGIQATKYEYSLLNRVKMSCLKHKPVKNKGKRYPDAYSSDMRFDMAIRESNKRVAWGYSSPLAVGDEISTFDQNVSSSIVEAPEVVLNSGGLFNISYKILLWYNSTSNDKNSLLNQSSWSVRISAEGIYDSGAGSLCMVGCRDIHLNSLKPTAHSVDCEIVVKFQLPPLDAKSGIFIKGSIESTCKKSDSLYFKPLELSSAAFYTEAAEKAVWRMDMETIMVLISTTLACVFVGLQLYHVKRHPNVLPLLSLVMMTMLTLGYMIPLVLNFEALLAQNPNNKNCVCKCWSDESNKGLWIAERKATCVTLPLYAAGLLVALLLKLKKDGDGVPVITPLNQNHSSWENLKSYGGLVLDGFLLPQIILNLTHNYARVDSGSYFYADPSADFYSTAWDIVIPLGGILFAIIIYLQQRFGAHCILPQRLKGSKLYEKVPVVAESEAEVETTNL

SEQ ID NO: 160110 - protein, 71 aa, Glycine max
  Coding DNA Sequence Number=SeqID_68425
MAGDPWPRQIAIAIGDLALTDATRSALHCHGRHPQLLELASLTGGSQWLLQIAITASGLGSYRHWVWRVAH

SEQ ID NO: 160111 - protein, 92 aa, Glycine max
  Coding DNA Sequence Number=SeqID_68426
MSRPSERIVPQTARTSKLASNFLHIYHTAPSENSNPSLQRKLSVTQRTCRKIHSDSNQQLPLWITASNFETKSQAIEAAYEEHLRGEKNMGN

SEQ ID NO: 160112 - protein, 158 aa, Glycine max
  Coding DNA Sequence Number=SeqID_68427
  Homolog annotation: Hit_ID=Q9FLQ0; Match level="QueryCoverage=71%, HitCoverage=80%, E-value=1e-17, Identity=34%"; Hit description =Arabidopsis thaliana genomic DNA, chromosome 5, P1 clone:MCO15
  Pfam annotation: Domain name=Stig1; Domain location=26-158; Score =121.5; E_value=2.5e-33; Accession=PF04885.4; Description=Stigma -specific protein, Stig1
MANTILNLTTIIILLISLALHNSHFVVSSTDIDQDHDFNEEEEEEYVLDTPIPHLGPRSRFLATIIKKGRQCDRETNNICNGVRANKGRDLLFCCKKHCRNVLSDKNNCSVCGNKCKQGERCCNGVCTNVLSNVRHCGKCNKQCSPGDSCGNGVCGYA

SEQ ID NO: 160113 - protein, 348 aa, Glycine max
  Coding DNA Sequence Number=SeqID_68428
  Gene Ontology: Mol. function=protein phosphatase type 2A regulator activity; Cellular component=protein phosphatase type 2A complex; Biological process=signal transduction
  Homolog annotation: Hit_ID=Q9LDG7; Match level="QueryCoverage=56%, HitCoverage=23%, E-value=5e-67, Identity=64%"; Hit description=WD-40 repeat protein-like
  Pfam annotation: Domain name=WD40; Domain location=278-316; Score =37.9; E_value=3.7e-08; Accession=PF00400.23; Description=WD domain, G-beta repeat
MSKALGATTEEDEEDDQQHPQQDCFYDSHDRLLSLSSSCSCSNSNSDNENDTQDHQNDTSLPNFTNYDIWISQPSSVSERRTRLLLSLGLSSLTRSNPRDRASPLRSVSDTTANPNKPPNPKPPPPPPPPPIEELCTIRDLDNGKEFVVNELENLREVATGRQLTMEEFEMTVGHSPIVQELMRRQNVEEASVDSNAGGSKVKKKGTGWLKSIKSVASSVAGYRDRRSSDERDTSSEKGGRRSSSATDDSQEGGGAFHGPERVRVKQYGKSCKEVTALYKSQEIQAHSGSIWSIKFSLDGKYLASAGEDCVIHVWQVVEGERKGELLLLDREKGEDGNGNVDMFLVVN

SEQ ID NO: 160114 - protein, 102 aa, Glycine max
  Coding DNA Sequence Number=SeqID_68429
  Gene Ontology: Mol. function=nucleoside-triphosphatase activity; Cellular component=integral to membrane; Biological process=transport
  Homolog annotation: Hit_ID=A7P1I0; Match level="QueryCoverage=84%, HitCoverage=15%, E-value=3e-19, Identity=52%"; Hit description =Chromosome chr19 scaffold_4, whole genome shotgun sequence
MYRLSSYFMSRVHVLVFISWVKYISISYYNYQLFIASQYSNGETYPCSTGQCQVAEFPSIKQTGFHFNLQEQVMAASALVIMMIDYRLIAYVALMRIGVTKK

SEQ ID NO: 160115 - protein, 48 aa, Glycine max
  Coding DNA Sequence Number=SeqID_68430
MSAIYATASELKLVNSSESIDWEQLGPASKGREDLARNNNLPLITSSV

SEQ ID NO: 160116 - protein, 139 aa, Glycine max
  Coding DNA Sequence Number=SeqID_68431
  Subcellular localization annotation: CTP_CleavageSite=67; ConfidenceScore=5.31e-01
MANCRKKICKEPLSPKPIRATGPPSKPPNTTLAPPSNHQTQNVDVRVRNFTSGEVQRLREVRVHDLREELVGEVEIIHGDTLRTLEEKSEEFETGRLAAVRFGIEGLLLRGFRGGYFAGEVGWLEGRLGRGFWLPRWEI

SEQ ID NO: 160117 - protein, 561 aa, Glycine max
  Coding DNA Sequence Number=SeqID_68432
  Gene Ontology: Mol. function=RNA binding
  Homolog annotation: Hit_ID=A7P1N8; Match level="QueryCoverage=51%, HitCoverage=68%, E-value=4e-96, Identity=63%"; Hit description =Chromosome chr19 scaffold_4, whole genome shotgun sequence
MERNLHFRKGMMFQTCMPRKMLLKIGLHLSRFILFIFKKNQARFQITEALKAKRAERVELISQVKSLRGDSRQFQSIVDEKLKEIGPLQQALGKLRTTNNAGRGGLCSSEDELNSVIYSLQYRIQHESIPLTEEKQILREIKQLEGTREKVIANAAMRAKLQESMGQKEAIQDQVKLIGGDLDGVKKEREAIRSKIKQIDDALKAIDKDIQSLQEELTAVSQKRDKAFESIQQLRKQREEGAEKVENGENTYFYQSRTVLNKARELAAKKDINALDEVSQTEVEKFMALWNKDKAFRNDYEKRILASLDMRQLSRDGRMRNPDEKPILEEPKPAEAEALPKMAAKQPKEEPKPSPQETLPAQKESKTTQKDSKNKGRDLKSKLESKDVAETDEYEFESPEKEAPAKEPEIDPAKLKEMKREEEIVKAKQALERKKKLAEKAAAKAAIRAQKEAEKKLKDREKKAKKKSGTAAVANPEDEPKDEVVEVTEPEKINDDVQAPAPVKEKVQKESGIRSRGRARGPDSIPKAIIKRKKSNNYLIWAAAATLLVLLLAVLGYIYLF

SEQ ID NO: 160118 - protein, 79 aa, Glycine max
  Coding DNA Sequence Number=SeqID_68433
  Subcellular localization annotation: CTP_CleavageSite=19; ConfidenceScore=5.09e-01
MSDGPRKSPRKSNVEGPSRAQQARKSNNIQCSTCKKTNYDAATNARSGNGNVVETHSIAHVHAENIEPSSTRAIASSML

SEQ ID NO: 160119 - protein, 81 aa, Glycine max
  Coding DNA Sequence Number=SeqID_68434
  Gene Ontology: Mol. function=catalytic activity; Biological process =metabolic process
  Homolog annotation: Hit_ID=A2Q5Z6; Match level="QueryCoverage=97%, HitCoverage=32%, E-value=5e-15, Identity=43%"; Hit description =Phosphoglycerate/bisphosphoglycerate mutase
MVGVLPKRRTLMRHRKLQGNQDTMVYSITPDHNIQSTAQDMTQFYVSPYAHTRSMLHELRRYFLKKKIIGVREELRVQERD

SEQ ID NO: 160120 - protein, 43 aa, Glycine max
  Coding DNA Sequence Number=SeqID_68435
MVGAGLKKDLKVSRVVPGGCDDLPYGQGLWFKSRMAKLHQGKE

SEQ ID NO: 160121 - protein, 162 aa, Glycine max
  Coding DNA Sequence Number=SeqID_68436
MGYIQTVPPPPVRDSLTGTDIDDRWVQFADHVAPTGELCVVPRQVAPDYMEWFFQISHPFVTLTDNTAEPRPAPSLPTHDDDFVEPPVGQIPVTSDPPAHSVVDCTACVRMGRIVEHLERVINLRMVTAGTDLYDIMDLCLRIARDDDPDDSLRPRQRPRID

SEQ ID NO: 160122 - protein, 126 aa, Glycine max
  Coding DNA Sequence Number=SeqID_68437
MASSIIHNKDNGEITLEISLIKTMVVHQIGHLNKGLVSMIKQQSWKRLLLSSCKYQYCPSSSFGANTEKNPKEECKAVMTRSRLATMNEREKGIGAEKQQLVTDPTIDPVVEPLNEYEEEMEVEDG

SEQ ID NO: 160123 - protein, 380 aa, Glycine max
  Coding DNA Sequence Number=SeqID_68438
  Homolog annotation: Hit_ID=Q2HW90; Match level="QueryCoverage=98%, HitCoverage=87%, E-value=3e-32, Identity=28%"; Hit description =Putative uncharacterized protein
MVEVSTEATASLAQYYDQPLRCFTFGDFQLTPTVEEFEEILGCPLGGRKPKCLEAKGRTLASQDEWAPFMDVLALLIFGVVLFPNMDGLVDLAVIDSFLAFHDCKESPVAAILPDLYDTFDRRCETNRARIICCTPTLYVWLVSHLFRQEVRHVCPLEGHCFMHREEGGKLGPTLSKQRRTVCQLVPRWKEGRIGILILCGGFPNVPLMGTRGCINYNPVLTIRQLGYPMRGAPLEEGLTPFIAQGFNSTNTGVLQGVRKAWEMVQKKDKELRGSSNGPISGYHKWLKAYAQGLDWLPNLRATKEVEGEAPKEDKELQALKIKLEKAQAVKEKFKSAAVRIRKENAELRDVNIATTKALEQKTKRARKEEHGWNKFQGAL

SEQ ID NO: 160124 - protein, 145 aa, Glycine max
  Coding DNA Sequence Number=SeqID_68439
TKLVRRNWHRTLTNLIEGSIDVALVKEFYANLYVLRGKPLKQVRVRGHLIKFDVDSLNTFLETPVVLELGVTLPAYSQFCSLRPNPQELAARLCIPGRGFVLNVEVLPWKLLRKDLTTLAQTWSILSYFNLAPTSHTSDLNLDRA

SEQ ID NO: 160125 - protein, 81 aa, Glycine max
  Coding DNA Sequence Number=SeqID_68440
  Gene Ontology: Mol. function=serine-type endopeptidase activity; Cellular component=chloroplast; Biological process=proteolysis
  Homolog annotation: Hit_ID=A4GGD0; Match level="QueryCoverage=69%, HitCoverage=28%, E-value=1e-22, Identity=98%"; Hit description=ATP -dependent Clp protease proteolytic subunit
  Pfam annotation: Domain name=CLP_protease; Domain location=5-81; Score=-49.0; E_value=5.5e-05; Accession=PF00574.14; Description=Clp protease
MNCRDGKAVCINTQKMLVRHKRENLILEAEELLKMRETITRVYVQRTGKPLWVISEDMERDVFMSAAEAQAHGIVDLVAVE

SEQ ID NO: 160126 - protein, 61 aa, Glycine max
  Coding DNA Sequence Number=SeqID_68441
MESGFYSSRPETCKPDDAQDSSLLGGGRSTSTAWGSVVVVPLYRFQDTEVLLTLLMPFLSF

SEQ ID NO: 160127 - protein, 79 aa, Glycine max
  Coding DNA Sequence Number=SeqID_68442
MMTKVMTKSSKINQRTTQENPRSIKNNSRVQDKNQEEFKTQEESLESRIKNQDSRFKISRIKIKIQDSRFKNQEKAQSR

SEQ ID NO: 160128 - protein, 69 aa, Glycine max
  Coding DNA Sequence Number=SeqID_68443
MDSFASWKMNGSGMEKGERRCHFKEKMSVEEAHHHRRPWIRAWKKMEMNKGRGREEHEILCIKRALKSE

SEQ ID NO: 160129 - protein, 98 aa, Glycine max
  Coding DNA Sequence Number=SeqID_68444
MLFWRCWLIVRCSFLISILVVVVMACSKIDPSNVDCNDATHAECQFVSVTADHDPVAGLPLTPRKRMSSNEADDGLGSSQISPAQLSSNKLTRHSHRS

SEQ ID NO: 160130 - protein, 268 aa, Glycine max
  Coding DNA Sequence Number=SeqID_68445
MDTSEPYTGAMRGIVHEPQVNLGVMTKDNDWYLKALRWGNEGHHACASRLHALTFKGLHILAIKGLHVLTFKGLHALTFRGLHVLTFRGLHILAFGGLHAPPLEGYASWATPNIGGRPTVRAQPEREAITQLLCISGQDFTHATAKRRVWIMRTNMTTLTLIWMTLLLSNISSSGHNTDLPLWRNRTHKDTQWTRRSPTGPWGFQLWLQASVSPTGCPFPPARSRHHDIGIAPARHPVDPKKSNRVLGFPALITGLCQFYRVHVAPSK

SEQ ID NO: 160131 - protein, 191 aa, Glycine max
  Coding DNA Sequence Number=SeqID_68446
TRKASRLRSLSARPPGADRPVVHVDPTADKADGPHRKKLRTYLGIVARDKVDVTYENWKEVEFEIPEASDSRTKTKLLQTVNESGGSLNQTSQGNGPLDPSWEDVHKKAQAIQKQNTAPHVLSREGYEYLEQKLLAEKTKKKLYSQEALMASSTLHPRGVQIAIWPTWAFQILPPEGCCFWRKQPCSPGRA

SEQ ID NO: 160132 - protein, 97 aa, Glycine max
  Coding DNA Sequence Number=SeqID_68447
MLWKLGGIDGNPVLRETRIRATWEYVSLVEGGQLEMMDLCVICGCGESTCTIARLPPSTTYDGVVPGDMSRGQETLGTSVGCYFPKLSLTNPDPTRA

SEQ ID NO: 160133 - protein, 215 aa, Glycine max
  Coding DNA Sequence Number=SeqID_68448
VLAFKGLHALAFIGLYVLIFKGLLVLTFRGLHALIFRGLHVLAFRGLHAFAFRGLYILTFRGLHVLAFRGLHALAFRGLHVLTIRGLHVLTFRGLHLWLRAYISPTVCPSPQQGITPTRHPVDLEKSNRVLGFPALVMGLYQSYRVLVPLARSCHHDIGIAPARHLVDPKKSNRVLGFPVLITGLCQLYGVPVAPNMVIRPPTNRAFIKKYCASR

SEQ ID NO: 160134 - protein, 79 aa, Glycine max
  Coding DNA Sequence Number=SeqID_68449
MDMLVDAETSSKMDIPVSDSNHSAQHESQSLSVTVEHDPLLGLPLTPTKRQAFQDCDDEPGISQISLAQLSSNKLKKHA

SEQ ID NO: 160135 - protein, 69 aa, Glycine max
  Coding DNA Sequence Number=SeqID_68450
MRGYRMVTHNIRQPGGNEPVDMQRLTSSSAPFAIQGQRVRWLVEIPYGHPHLSSTEGNEFDDIRMMLVV

SEQ ID NO: 160136 - protein, 96 aa, Glycine max
  Coding DNA Sequence Number=SeqID_68451
MVHPPDENVNNSTLILIQSQHTQSYHPHVSQPMGETHEIPHHNLADFKPCLGYATQGQAVGGVPCSNPTSAPDCASSMKWYVNKLLKRKNHVSNDV

SEQ ID NO: 160137 - protein, 115 aa, Glycine max
  Coding DNA Sequence Number=SeqID_68452
  Homolog annotation: Hit_ID=A5BP71; Match level="QueryCoverage=65%, HitCoverage=19%, E-value=4e-11, Identity=45%"; Hit description =Putative uncharacterized protein
  Pfam annotation: Domain name=zf-CCHC; Domain location=88-105; Score =12.8; E_value=0.017; Accession=PF00098.14; Description=Zinc knuckle
MVVIVNAEACGYVSMNYDQYIDVVYTNEHILKAYSAQWWPLGNEAAIPPSDDAWTLIPDPTTIRAKGRPKSTRIRNEMDWVEPSEHRTKCSRCGAEGHNRHRCPMQSERGSCSNR

SEQ ID NO: 160138 - protein, 55 aa, Glycine max
  Coding DNA Sequence Number=SeqID_68453
MGRFLPPRGFLRKISERTPITKNFTEALWKSWMPRMPFFNEMEVVAAQRLLEEDS

SEQ ID NO: 160139 - protein, 49 aa, Glycine max
  Coding DNA Sequence Number=SeqID_68454
VVIIKKGEIVEAMPSKVILMMPKNQESSKFQRFKNEVFKNQVSRIKIQE

SEQ ID NO: 160140 - protein, 43 aa, Glycine max
  Coding DNA Sequence Number=SeqID_68455
MFLHGKMPSVEGRSPEYEEPQDLRSNPFQGGGNDAILPRKGIG

SEQ ID NO: 160141 - protein, 25 aa, Glycine max
  Coding DNA Sequence Number=SeqID_68456
MGLSSSFFRNLLKEASQGGELSYER

SEQ ID NO: 160142 - protein, 56 aa, Glycine max
  Coding DNA Sequence Number=SeqID_68457
  Subcellular localization annotation: CTP_CleavageSite=28; ConfidenceScore=5.61e-01
MAKPSSSTNLASTIICFFASKKFPNRLKASSGRFARQNPSPQWRTGPKSPGRGRQR

SEQ ID NO: 160143 - protein, 15 aa, Glycine max
  Coding DNA Sequence Number=SeqID_68458
MELTLADFLAKRARE

SEQ ID NO: 160144 - protein, 210 aa, Glycine max
  Coding DNA Sequence Number=SeqID_68459
  Homolog annotation: Hit_ID=Q0ZCD0; Match level="QueryCoverage=62%, HitCoverage=11%, E-value=3e-08, Identity=31%"; Hit description =Integrase
  Subcellular localization annotation: CTP_CleavageSite=75; ConfidenceScore=5.10e-01
MTFQATDTIPGWRNHPNLRWKSPPTQQQHVPPFQNATGPSWPYVPPPMQQQQQYSKQRQQATEAPPQTSLEELVRQMTIQNMQFQQETRASIQSLTNQMGQMATQLNQAQSQNSDKLPSQTVQNLKNVSVITLRSSNQIQVPSPVAAPAPEPVKLHSTPEKEDEIIAQKRKLPNKNFHAGGPSSTNSDLPQPLIPLPFPPRAIPNKKNWK

SEQ ID NO: 160145 - protein, 141 aa, Glycine max
  Coding DNA Sequence Number=SeqID_68460
MDHAADKVHEEFHKPVTDHEGADTKGFPGRPQDTSVLTSYVDYVASRERTKLKLASHGMKVKKVGRLALRLKCAVGYMECFYKIFHPFMSPPHLREPPRHPLTVHHDTYIIPNPPVLPVHTATMLQPTVVVDTDMPRHAVI

SEQ ID NO: 160146 - protein, 89 aa, Glycine max
  Coding DNA Sequence Number=SeqID_68461
MDREKNMFIQQGRERTEDAFVLCRVLDHIHTHSHSEREVVCVRHAEFLSGVYLTHGRDYRDVFGGGDCLIMRRGLPLLVPASSHFPPSL

SEQ ID NO: 160147 - protein, 91 aa, Glycine max
  Coding DNA Sequence Number=SeqID_68462
MASRKRRAVPTLGEASNWDSSRFTFKIAWHRYQDNIQLRNIFPERNVELGPGMFDEFLQELRRRRWDQVLTHLPEKRIDVALVKEFYSNTL

SEQ ID NO: 160148 - protein, 239 aa, Glycine max
  Coding DNA Sequence Number=SeqID_68463
  Gene Ontology: Mol. function=transition metal ion binding
  Homolog annotation: Hit_ID=A5B3H3; Match level="QueryCoverage=46%, HitCoverage=16%, E-value=2e-09, Identity=31%"; Hit description =Putative uncharacterized protein
MTILAKTLKLLAVGPNLSVPTWKGYDINNYSFYTKSQDDKSTMQNNGNKPDRCFTSKIIQDFQWFYKEDPAVSMFMGTPPRSPLQLDGHSKAMSRKTRQSTRLRRLTLRTLDQPRPTINIDAGTGRGSGPHKEKFHNYLGVITREKIPIVHSNWKDVPESLKDLVWDDILTKFDIPEVQNAKKMVMSTVATRWRQFKSSFTMKFVYANYEGQHSRDPSIKYGLDPQTWEKFAATRKTPN

SEQ ID NO: 160149 - protein, 90 aa, Glycine max
  Coding DNA Sequence Number=SeqID_68464
MHCTKNLTLAAATANYGIPSEETDSNFDFDFSPCPFALDANTDRKTFLEDVPAGDNIELCANTPHMLLSLRARSAGSRKGAKFRELEKKS

SEQ ID NO: 160150 - protein, 73 aa, Glycine max
  Coding DNA Sequence Number=SeqID_68465
MEAKKQKMRGNVSTVQMNANDEQDGLAQCNAIPEGFRLSGYDLLGPIDMGVQAKSYLRLARLCVALSELARLV

SEQ ID NO: 160151 - protein, 166 aa, Glycine max
  Coding DNA Sequence Number=SeqID_68466
  Gene Ontology: Mol. function=[ribulose-bisphosphate carboxylase] -lysine N-methyltransferase activity; Cellular component=chloroplast
  Homolog annotation: Hit_ID=Q43088; Match level="QueryCoverage=84%, HitCoverage=28%, E-value=4e-57, Identity=76%"; Hit description =Ribulose-1,5 bisphosphate carboxylase/oxygenase large subunit N- methyltransferase, chloroplast precursor
  Pfam annotation: Domain name=SET; Domain location=53-166; Score=6.4; E_value=0.00053; Accession=PF00856.19; Description=SET domain
  Subcellular localization annotation: CTP_CleavageSite=39; ConfidenceScore=5.65e-01
MASVFSACSSSAVLFYRRNSFPSKGSFFHLKRPLSANCVASLGTEVSVSPAVDTFWQWLKEEGVVSAKTPVKPSVVPEGLGLVALKDISRNEVVLQVPKRLWINPDAVDASEIGKVCIGLKPWLAVALFLIRERSRSNSVWKHYFSILPKETDSTIYWWENNHIGT

SEQ ID NO: 160152 - protein, 329 aa, Glycine max
  Coding DNA Sequence Number=SeqID_68467
  Pfam annotation: Domain name=Transposase_23; Domain location=37-107; Score=-2.7; E_value=0.0024; Accession=PF03017.5; Description =TNP1ENSPM transposase
MQSQGLTLPPEPLVGPSGPRVSTKGSCVDPSGNDPETGDSDRCSLYIEADPTRLVALRRVYEGSTVVHNIHLLPGQVKVGVEEVTDADAPVPVPTDEVSLVGQALHTFLAWPTHLVKSLSQQVVVSPAKPPPKPDPEVDDPLYLMTLTIPELFLRPYQVTWDATMFGAFNPDFPLYIKHEDLSEIAHGGQCLSISVLQLWIMHLTDTSMRAGNYDIYGFLEPQSIQRFGQSQFESESYIKTWMQSSKRDVYLGAYLNGLDNYLQGIINSLNQRLLLGGLSSRQKGSTECGYYVMHWMSTIILGTFRNNWEAYFNDPRPLELERLKALQI

SEQ ID NO: 160153 - protein, 373 aa, Glycine max
  Coding DNA Sequence Number=SeqID_68468
MASRKRKATTSRPQPHYDTHIFTSEDAWNRYDDNVLGRNILPERNVKLFVTEFDENFMLIFMSRGDMPPKQVRVKGHLIKFDADSLNTFLETLVVLESGETLPAYSRFCRLRPNPQELAARLCIPGRGFVLNAKGLPWKLLRKDLTTLAQTWSILSYFNLAPTSHTSDLNLGRARFVYGLVMKMDMNVGALISGHTSDFQPSSLPYAWPEDPAINLSYIKKNCWNLDDPTVSFLGTRKTRARGSEGLSSATPQTSTAPALIPSEPVPATSNPSAQSTDLMMAMFEASSAQEPQLDLETTPAAQEDDSEVTPPESFVLETDPEADLVIAEASPQVSLISTPVLELSTSQGSPACMPVLHLTDDEAMDQDPPQDQ

SEQ ID NO: 160154 - protein, 125 aa, Glycine max
  Coding DNA Sequence Number=SeqID_68469
MASRKRKATTSRPQPHYDTHIFTSEDAWNRYDDNVLGRNILPERNVKLFVTEFDENFMLIFMSRGDMPPKQVRVKGHLIKFDADSLNTFLETLVVLESGETLPAYSRFCRLRPNPQELAARLCIP

SEQ ID NO: 160155 - protein, 108 aa, Glycine max
  Coding DNA Sequence Number=SeqID_68470
MSCRLGNNDNSGPISTGFLYVPGWPCLKLGHLCPHRFHFLDLLEAMARRRDCFNVSDGQVAADLCCLKMEVFNVSEVCSTVESILHLPNIPVNNFPSPFQSRVKNIKL

SEQ ID NO: 160156 - protein, 105 aa, Glycine max
  Coding DNA Sequence Number=SeqID_68471
  Homolog annotation: Hit_ID=A3ABX3; Match level="QueryCoverage=50%, HitCoverage=3%, E-value=4e-16, Identity=75%"; Hit description =Putative uncharacterized protein
MDLHHNRYYDGRLSDQQMALLQYQLENLHFLSEEILRLQECLSKYEGTDDRSAPQCINSNNNISISNNSIRKLLLRMILKAQEDSSRVLLWIWMKRKKHHCADTG

SEQ ID NO: 160157 - protein, 287 aa, Glycine max
  Coding DNA Sequence Number=SeqID_68472
  Subcellular localization annotation: CTP_CleavageSite=38; ConfidenceScore=5.03e-01
MAESSKKREGASTSTTATGTRLHGASEAQPAPIPPSISSSTLFSSEEQCIRYTSLFSSRSIIDLKFIDLEFFDDEMFDCHHAIHNSGLIQFMSLKLPYYPDLVRAFYSNLEIQDGTLISKVYGIKMVIDESLFFELTQLSSEGVPFEGTIDDDWKFEFSSHDARRMVCTNQADMTVKRSLSIGAGVVTSFGYRKKRDGSWVKKDAQPQAADDRSPSPPPQMDDSSSLMQNILDKLDGLQTYVGERFDSFDNHIDAIDARFAGMDTRITQLEEDMSFICQCFDLPPTT

SEQ ID NO: 160158 - protein, 295 aa, Glycine max
  Coding DNA Sequence Number=SeqID_68473
MRFRSQRNLETSPRARANYYCSKSINIQIPINISRKELQELISLQWVINYKKHKENTKLFSTSQPTFRRSIDGLVTTTFKRLDEASSSNSPEVFHSLMIKPKVKEDSRMPIFAVKADGRVVYTNKVNGHFIWDIAPEMCDSDCSCHEHDGDTNDEADDNDKSEGRWKPEPRPCKPPPPPQRKSVPKNVPQTGIKKKYPEDPFWKEKRMAEILGWNHPSLKILETLIPCMMFSSTSYEQEFSFLDRKTNPVTKVGPEGKLKSPSQVEEVLNWQTDNARAQNHLLKKIDEKIDKIYT

SEQ ID NO: 160159 - protein, 92 aa, Glycine max
  Coding DNA Sequence Number=SeqID_68474
  Homolog annotation: Hit_ID=Q1SL03; Match level="QueryCoverage=100%, HitCoverage=29%, E-value=3e-08, Identity=30%"; Hit description =Ribosomal protein S2; Nucleic acid-binding, OB-fold
MSRKVNSIADIDDSKETWKLGVRITHLWTKQRSPKPFIETIFLDNKGGKIEACVKNPLSDKWEAMLIEGKTYFVQNFEAEMNSCHYRATNHR

SEQ ID NO: 160160 - protein, 523 aa, Glycine max
  Coding DNA Sequence Number=SeqID_68475
  Gene Ontology: Mol. function=transferase activity; Cellular component= membrane; Biological process=megagametogenesis
  Homolog annotation: Hit_ID=A7QA17; Match level="QueryCoverage=95%, HitCoverage=95%, E-value=0.0, Identity=66%"; Hit description =Chromosome chr8 scaffold_68, whole genome shotgun sequence
  Pfam annotation: Domain name=Exostosin; Domain location=121-459; Score=349.0; E_value=8.1e-102; Accession=PF03016.6; Description =Exostosin family
  Subcellular localization annotation: CTP_CleavageSite=6; ConfidenceScore=5.28e-01
MAERIGASSLKVVSRKSLLFFFIMTSVLFIMSWFFVLRSTSRPHFIDHNLLPNSKLFSTLDGSKSHMQKQNVESSFGNRAILVDSEDVEEASETKARNGKEKLVKHDGKKCNRNDEVVLKVFMYDLPPEFHFGLLDWKPSGNSVWPDVRTNIPGYPGGLNLQHSIEFWLTLDILASEFPQASKARTVIRVQNSSEADIIFVPFFSSLSYNRYSKSKPHVKKSKNKILQEKLVTYLMAQEEWKRSGGKDHLILAHHPNSMLDARMKLWPATFILSDFGRYPPNIANVEKDVIAPYKHLISSYVNDNSNFDSRPTLLYFQGAIYRKDGVRNGTNQPIVLEMGGLARQELFYLLKDEKDVHFSFGSIGKDGIKKATEGMRASKFCLNIAGDTPSSNRLFDAIASHCVPVIISDKIELPYEDVIDYSEFCIFVRTSDAIKEKFLINFIRGIAKEEWTRMWNKLKEVEHFFEFHFPSKENDAVQMIWQAVARKVPAMRLKLNRFERFSRSPPSTDEGLRSIPVPKNFW

SEQ ID NO: 160161 - protein, 91 aa, Glycine max
  Coding DNA Sequence Number=SeqID_68476
  Homolog annotation: Hit_ID=A7PD81; Match level="QueryCoverage=80%, HitCoverage=29%, E-value=5e-14, Identity=56%"; Hit description =Chromosome chr17 scaffold_12, whole genome shotgun sequence
MEEEKAVPNYDELTCKGERAVWFRQGLGFSSSAPKDDVPKPSASFLSKFVKASFESKKQVQLQSIHDNLKKKPSFESRVSSRDRDSDRSRR

SEQ ID NO: 160162 - protein, 102 aa, Glycine max
  Coding DNA Sequence Number=SeqID_68477
VVVIIKKGENVNHEDFHDVKKIKPWIMRRHHQKGGECGSCIVLMMSKRNHLIVIIKKGENVNVCIHDFDDAKDKRFSSLIQVKNSKIQKITPKSHNSSENNS

SEQ ID NO: 160163 - protein, 87 aa, Glycine max
  Coding DNA Sequence Number=SeqID_68478
MDPIHPASFNQVNCPVSDVVGQGGEAVKNSKHSFPPYGLSPNYTPPTVIYAYGENINNSAPVLIQNQQPQSNHAHVSQPMGETHEVP

SEQ ID NO: 160164 - protein, 70 aa, Glycine max
  Coding DNA Sequence Number=SeqID_68479
  Homolog annotation: Hit_ID=A5C956; Match level="QueryCoverage=50%, HitCoverage=5%, E-value=2e-08, Identity=77%"; Hit description =Putative uncharacterized protein
MTDIVLACCILHNFLMGVDVDETLIAEVDRELLQQEIDRSQPQQQRDDDYRLGTILRDDVAIRMWNVYPI

SEQ ID NO: 160165 - protein, 132 aa, Glycine max
  Coding DNA Sequence Number=SeqID_68480
MASSRSGNGRGIRGYDFEWRLLSLAQIAYCGWSFSLLTLLRKVEEEPQLLVVFVVTTAVLEEEHMACLDQQHYGKEGHAVVVVEDLSISDLDDSSNLDYISCLKGHNYFVVVGFSAKGVYYKCLQHKLQVAH

SEQ ID NO: 160166 - protein, 91 aa, Glycine max
  Coding DNA Sequence Number=SeqID_68481
METCPTVEELLQQMMDHGQLEGCCSRKTLGPYDVVSVTHIGHIFATPDLLARPTNDKGKAKVVEEPTSEASPTPEEDDGSLLVELLWRLDL

SEQ ID NO: 160167 - protein, 70 aa, Glycine max
  Coding DNA Sequence Number=SeqID_68482
MERFEELRMSLHVDGLTKVTTDKWIDITDMGHVIASRYNAKPWPTPYISRMQYGKSFVMFKRDYVDINDD

SEQ ID NO: 160168 - protein, 63 aa, Glycine max
  Coding DNA Sequence Number=SeqID_68483
MSVKNHVGRLGVHDKTNHTLTGSNCFARMLQPCGIGIGLKEHSNQVTPKAYTPKSPSGPLPPD

SEQ ID NO: 160169 - protein, 101 aa, Glycine max
  Coding DNA Sequence Number=SeqID_68484
MPSTRHPLDPDKSNRALGFLALITGLCQSFGVPVTPSKGQGFAPFACPTPEQFGAEVAWLRDWPKAQAGEEPAGSPGEAKEARMDEEMTDLLGFLGGSGAT

SEQ ID NO: 160170 - protein, 138 aa, Glycine max
  Coding DNA Sequence Number=SeqID_68485
  Subcellular localization annotation: CTP_CleavageSite=61; ConfidenceScore=5.28e-01
MVKVGTSYVPINVSFSPKVGPGLSRDPSVTGIYSAQSASAVPPVQLLTGWCVTAKAPPDISAGKCSGHAARRVPFAIQAAQLLGRAIGAGLFAITPAGERGMCCKAIKLADIGREIAATDIFQPTIKLIDTVDLEGGP

SEQ ID NO: 160171 - protein, 112 aa, Glycine max
  Coding DNA Sequence Number=SeqID_68486
ESHTHTKTPSGPGEVQQGPRGSRPQDTQWTRRGLTGSWSCQALITGLCQFYGVPVAPNMVIRPPTNRAFIKKYCIPRQALGETPQQPGDGRQRATDAPPSPLEFTSSHPQKG

SEQ ID NO: 160172 - protein, 26 aa, Glycine max
  Coding DNA Sequence Number=SeqID_68487
MGLRDATFKVSDFDKYKGTTCPKNHL

SEQ ID NO: 160173 - protein, 1214 aa, Glycine max
  Coding DNA Sequence Number=SeqID_68488
  Gene Ontology: Mol. function=transferase activity, transferring glycosyl groups; Cellular component=intracellular; Biological process=carbohydrate metabolic process
  Homolog annotation: Hit_ID=A8GKU6; Match level="QueryCoverage=60%, HitCoverage=90%, E-value=0.0, Identity=88%"; Hit description =Glycogen/starch/alpha-glucan phosphorylase
  Pfam annotation: Domain name=Phosphorylase; Domain location=25-736; Score=1742.4; E_value=0; Accession=PF00343.11; Description =Carbohydrate phosphorylase
MEFVIGRTLSNALLSMGIYQDIDNALNEMGLSLGELLEEENDPGLGNGGLGRLAACFLDSLATLALPGRGYGIRYEYGMFKQNIVNGQQMESPDYWLEYGNPWEFPRHNTRYKVRFGGRVQQEGAKARWLETEEVVAIAYDQVIPGFDTDATNTLRLWGAQASNEINLGKFNQGDYFAAVEDKNHSENVSRVLYPDDSTSSGRELRLRQEYFLVSATVQDILNRHWLMHKTFDNLADKIAIHLNDTHPVLSIPELMHRLIDEHKFKWLDAWEVVEQVFSYTNHTLMSEALETWPLDMIGRILPRHLQLIFEINDHFLKMVQEVAPGDNDLLARVSIIDETNGRRVRMAWLAVVASHKVNGVSALHSELMVQSLFADFARLFPNRFCNKTNGVTPRRWLALANPPLAAVLDDCIGQTWRTDLSQLSEIKANVDYPSFLQAVQRAKRQNKERLALYIAKTLNVVVNPDALFDVQIKRIHEYKRQLLNVLHVITLYNRLLDDPEIDRVPRVVIFAGKAASAYYAAKQIIRLINDVAKVINNDPRVHTQLKVVFIPNYGVSLAQIIIPAADLSEQISLAGTEASGTSNMKFALNGALTIGTLDGANVEMREHVGEENIFIFGNTAEQVEELRRNGYNPRQYYEQDPELHQALTQIATGVFSPEEPKRYGNLFDSLVNLGDHYQLLADYRSYVDTQDKVDEVYLNQDEWTRRAVLNIANMGYFSSDRTIQEYADEIWHIQPPGFHSRLLRFVQPHAELGAAPDGVGQLYDPLFLGQVAQFGFIQTVAEIFAQIGEAVGAGQDQLALATVGAGIAARQRFRQPAVGAAQFGRVAVAIAAEVTARQRGVFGPRRAAAWVVVGQFFHRVLGQLAVGGQLAAEDRQQRRLALFVVHVQRVIAGDRLRRIGFVVAQRTHAGVSPDDVVAAQLLLEVIVVHFQQISDFVLVDLHVLRIAFVLHVGGADDGELVIPRDHEHDAVVFVLQNVRLRLIVYARHHDVAAFDQADAVRRFQLQAVVEEVFHPRAGGVHQAFGAPGEGFAAVDIDRFHHPHAVFTPCAGHFGAGAHFAAAFFHFLRVQHHQASIVDPAVGIFETALQFRLQHRLWSKAQALAARQAGAFAQVIVQEQADTDHPGRAQVRLVRQAETHWERDVRRQLQQHFAPPWISLELAEDVAQAKSCASSSSTDSPRPAASAAMPAPLMPPPITIKSLVSTSSSSRCSK

SEQ ID NO: 160174 - protein, 633 aa, Glycine max
  Coding DNA Sequence Number=SeqID_68489
  Gene Ontology: Mol. function=protein-N(PI)-phosphohistidine-sugar phosphotransferase activity; Cellular component=1-2nm peptidoglycan -based cell wall; Biological process=phosphoenolpyruvate-dependent sugar phosphotransferase system
  Homolog annotation: Hit_ID=Q8FAJ3; Match level="QueryCoverage=63%, HitCoverage=86%, E-value=0.0, Identity=79%"; Hit description =Ascorbate-specific permease IIC component ulaA
  Pfam annotation: Domain name=PTS_IIB; Domain location=549-624; Score =20.2; E_value=0.00021; Accession=PF02302.8; Description=PTS system, LactoseCellobiose specific IIB subunit
  Pfam annotation: Domain name=SgaT_UlaA; Domain location=99-517; Score= 724.8; E_value=6.2e-215; Accession=PF04215.3; Description=Putative sugar-specific permease, SgaTUlaA
  Pfam module annotation: Pfam domain module=PTS_IIB::SgaT_UlaA; Domain location=549-624::99-517
RQHGRRDVHIDMVVVIVRGQHGVELGDGERVEYEWGGAQVRLQFPHPGHALHLVPGFHQRVAVALLAGATPKIDAQVGAFFRLEPDAGAAQPPHGEGAGRDFLLLYLFVQPSAPFGKGVQYPGLAGDVVDFTHGSFLVGGDDQCTAAAGAGYTAGLHAGSGILTGTFKPVVAKLSEVYGINGAISDTYASMMATIERMGDAYSWVGYAVLLALALNILYVLLRRITGIRTIMLTGHIMFQQVGLIAVFFYILGYGMWTTVLCSALLASLYWGITSNMMFKPTQAVTENSGFSIGHQQQFASWLAYKAAPYLGKKEDSVEDLKLPGWLNIFHDNIVSTAIVMTLFFGIILCSFGLDTLQAMAGKTHWSIYILQTGLMFAVAIFIIVQGVRMFVAELTEAFNGISQRLIPGAVLAIDCAAIYSFAPNAVVWGFMWGTIGQLIAVGILLALGSSIMIIPGFIPMFFSNATIGVFANHFGGWRAAMKICLVMGMIEIFGCVWAIKLTGLSAWMGMADWSILAPPLMQGLSLGLWFMGVVIVIALLYMFFAGRTLRAEEDAEKQSQGVNHSVNSCAVGEYKSELNGADIIIASTHVADEIVVSGNKYVVGVRNMLSAADFGPKLMEVIGTHFPQDLKQ

SEQ ID NO: 160175 - protein, 112 aa, Glycine max
  Coding DNA Sequence Number=SeqID_68490
MQRRSTEGDLIPIDLEINATCRRRNVERIRIFLQDLEAAATPEEEPRSSEASSSFPIPGQSHTDLIEKVIMAEDPRRVTLEDYSSSSVPQFFTSIAQLEVQAQTITYPPSLI

SEQ ID NO: 160176 - protein, 108 aa, Glycine max
  Coding DNA Sequence Number=SeqID_68491
IAPARHPVDPKKSNRVLGLPSSNYEPLSIYGVPVAPSKGIRPPTNRAFIKKYCVSRQAQGETPQQPGDGQQQATDAPPSPLEFTSANPQKAIKRPAQDVKEALIGGNL

SEQ ID NO: 160177 - protein, 40 aa, Glycine max
  Coding DNA Sequence Number=SeqID_68492
MEDCAASAPLRANTLPVVLGHPLWLFRLPLIFFLLRCGQL

SEQ ID NO: 160178 - protein, 217 aa, Glycine max
  Coding DNA Sequence Number=SeqID_68493
  Gene Ontology: Mol. function=binding; Cellular component =mitochondrion; Biological process=cell division
  Homolog annotation: Hit_ID=A7R037; Match level="QueryCoverage=36%, HitCoverage=4%, E-value=2e-28, Identity=78%"; Hit description =Chromosome undetermined scaffold_296, whole genome shotgun sequence
MAWVYAIGGDDGYLGIGMGGFGVAETVMVGSRGGGICSGGGYLGFGLGRRMFEKKTTSKTKKKKRKTKWKRNRRVRISHPHRRAYGFRSVSRLSFSSINYSVLMLIMLLLMKIGGPEVKLLVAMCACEITRISAPEAPYNDESLKDIFQLIVGSFRGLSDTNGSSFGRRVFILETLAKYRSCGVMLDLECHDLVNPDVIGTLEEDGLKFVGKDESGK

SEQ ID NO: 160179 - protein, 361 aa, Glycine max
  Coding DNA Sequence Number=SeqID_68494
  Gene Ontology: Mol. function=nucleotide binding; Cellular component =cytoplasm; Biological process=response to stress
  Homolog annotation: Hit_ID=A2Q405; Match level="QueryCoverage=70%, HitCoverage=46%, E-value=8e-84, Identity=58%"; Hit description=Heat shock protein Hsp70
  Pfam annotation: Domain name=HSP70; Domain location=50-361; Score= -89.5; E_value=6.4e-11; Accession=PF00012.11; Description=Hsp70 protein
MRASRGAAVKLCLGDLLVMSSNPETASLHMQGQGCVQYPSPIPSHSEEPLGNGYSFTSNSMAKEGHRNQSGNNLLMCCSMAGASPSRQAVMAFKVVAGTNDKPMIILNYKEAFLEKHAKNEVVTVPAYFNDSQYKATIDAGKIAGLNILRIINEPVAAAIMHGLDMRTNNCVGERNIFIFDLGGGTFDASLLTLKGKIFKVKATAGNGHLGGEDIDNRMLDHFVKEIKRKKKVDISGNLKVLRRLKTTCERAKRTLSHAVTTNIEVDALSDAIDFCSSITRAKFEEINMELFKECMETVDKCLTDSKMNKSSVHDVILVVVLQGFPKCKSYCRTFPTERICERASTLMKLLLMVQLCMLLC

SEQ ID NO: 160180 - protein, 147 aa, Glycine max
  Coding DNA Sequence Number=SeqID_68495
  Gene Ontology: Mol. function=hydrolase activity; Cellular component =cellular_component; Biological process=nucleobase, nucleoside, nucleotide and nucleic acid metabolic process
  Homolog annotation: Hit_ID=A9PH59; Match level="QueryCoverage=96%, HitCoverage=95%, E-value=8e-37, Identity=53%"; Hit description =Putative uncharacterized protein
  Pfam annotation: Domain name=HIT; Domain location=14-98; Score=62.7; E_value=1.2e-15; Accession=PF01230.14; Description=HIT domain
MAVEYYDFGPHKIHHSSVFYTSNLSFAFVNLRPAVTVKRVADLTDDETVDLWLIAKKLGRQLESYHKASSLTFCIQDGPQAGQSVPHVHIHILPRKSGDYENNDDIYDDINEKEKELNRALKVDIERKDRSIQEMALEADEYRKFVF

SEQ ID NO: 160181 - protein, 119 aa, Glycine max
  Coding DNA Sequence Number=SeqID_68496
MAPSGRRVLPKVIKRIPEEQIFRKAPETPLPDDLSSGSGSTSRKTLSSGMFPEELLLPEIMARTRGLGHAIGRLVGRDRPDDQDDVDVPERRRPTASARRLRVHQMTMEGRDMAKDVLT

SEQ ID NO: 160182 - protein, 76 aa, Glycine max
  Coding DNA Sequence Number=SeqID_68497
MECITIVFFKDAIEKDIFNIKLLKTPLTHLQPTGERLEGRSVRDQVPLFIKASYSAFLAANHVGLERADFVALGSA

SEQ ID NO: 160183 - protein, 395 aa, Glycine max
  Coding DNA Sequence Number=SeqID_68498
  Gene Ontology: Mol. function=ATP-dependent helicase activity; Cellular component=intracellular; Biological process=DNA recombination
  Homolog annotation: Hit_ID=A7NXX5; Match level="QueryCoverage=100%, HitCoverage=82%, E-value=1e-107, Identity=50%"; Hit description =Chromosome chr6 scaffold_3, whole genome shotgun sequence
  Pfam annotation: Domain name=HRDC; Domain location=70-139; Score =75.3; E_value=1.9e-19; Accession=PF00570.14; Description=HRDC domain
YLKEILSGIYRTISVSSKGEQFLASSRPDYKPPLVLTLTAEMLGVEDNGNTKEEFKTLSTSESEGFSEAEGQLYQMLLEERLKLARSVGTAPYAICGDQTIKKIALPRPSTKARLANIDGVNQHLVTKYGDHFLQVIQKLSQGLNLSLDGEARVATASLQTNEVRKVSLVTNKSNKLTPAKFEAWKMWHEDGCSIHEIANFPGRSAPIKEQIVAEYLLEAAQEGLPFDWARFSEMIGLTQEIISEIQGAISKVGSTDKLKPIKNELPKEITYQHIKTYLTMRNCGISLEAIQSGSIQTEKDGEPAHNASNLSGPTLETCHVERHCEDGISAISSTEKCNLEINEVPTLPVNGSEATLSDVLEHFNGSSEDSVVELLNCLDCNFSIYRKGGIYRIM

SEQ ID NO: 160184 - protein, 398 aa, Glycine max
  Coding DNA Sequence Number=SeqID_68499
  Gene Ontology: Cellular component=integral to membrane
  Homolog annotation: Hit_ID=A2ZHL1; Match level="QueryCoverage=72%, HitCoverage=81%, E-value=1e-65, Identity=49%"; Hit description =Putative uncharacterized protein
  Pfam annotation: Domain name=DUF607; Domain location=126-379; Score =236.0; E_value=8.2e-68; Accession=PF04678.4; Description=Protein of unknown function, DUF607
MWGRWWWRAGGGFLRQRVSSIGSVSHGYGEKLHPLDPPLLGLRGVVEVMCGGRRTPLSVVLNQIKRGVSTSTGNGGVSNGNNGTTEDSISFSEAKKLMRLVNVESLKMKLGMEGKEVICYSELLEACESVGIARSPEEAAAFARVLDEAGVVLLFRDKVYLHPDKLKYVLMRHFRAVFMKTSNVVKYSQLVIFQVHCLTWLIMPQPVLMRDYSFCLNWLLCFKLKPQQNLVIQFSMVVDLVRRAVPLVLTADNDPMREELKKLQDKKEEIDVLAHTQARRILWSGLGFGVITVGFFFRLTFWEFSWDVMEPIAFFTTTTGLVIGYAYFLFTSRDPTYQDFMKRLFLSRQRKLFKRQNFDIERFKELQCKCKTPLHASTVLKNRIGVELDLEDALHRDH

SEQ ID NO: 160185 - protein, 63 aa, Glycine max
  Coding DNA Sequence Number=SeqID_68500
MEMKKKNNSVNYKKKDKGKGKVAIEVGDDLSDFNEDEEGPSKKGHKRKELYQLISSIKLLELV

SEQ ID NO: 160186 - protein, 53 aa, Glycine max
  Coding DNA Sequence Number=SeqID_68501
MENGKHEKNDEQCPPMVKFEKAQSHNGKRKSKKANNKLSLGNMKNMCIRCCTY

SEQ ID NO: 160187 - protein, 502 aa, Glycine max
  Coding DNA Sequence Number=SeqID_68502
  Homolog annotation: Hit_ID=Q2HTA0; Match level="QueryCoverage=90%, HitCoverage=78%, E-value=2e-19, Identity=24%"; Hit description=IMP dehydrogenase/GMP reductase, related
  Pfam annotation: Domain name=DUF1723; Domain location=154-202; Score =42.9; E_value=1.1e-09; Accession=PF08330.1; Description=Protein of unknown function (DUF1723)
MVRTRGLDRALGSGRGRDMSQDAHQPEVPRRRRPTTSVCRQQVHFPHMTEDVTQTPEDVPQLNEDVPHVFDATPKMTGIVDAADAEGVATNGSEGSPAADEGFPGGPHDPLERPELKLVSYGRKVDKFGRPAPEIEGMIAATRLSPLIRCSVITTDLGLISAFVERWHRETSTFHLPEGELTITLDDLTITLDDVSSLLHLPIIGALHSFEPLVTSDAVMLLTKLLEVNSEEAKAETRQASEPHVRLSWLREVYQSRCRAKRWVVAACAYLLHLVGCTLFANKSATHVHCWIYEHFPMVHQCVVDDAYAEASPRASRWLTSKAHMTRIKGAPSRAHIEALTITDVCWMPYAEHRRFGYIQTVLPPPIRESLTGPNIDDRWLHFADHLVIAGEICVVPDQVALDYMDWFFQILHPFVTLIEDDAEPRHSPTPHDEEFVEPPIPEVLVASDLLTHLVVDCQGCQAITESLERVINLRMVTEGTELYDIMAHCLKIVRGDVVDGS

SEQ ID NO: 160188 - protein, 81 aa, Glycine max
  Coding DNA Sequence Number=SeqID_68503
MVCDGGGEGCMTVIAVEEDKESKEVRDLKTNKEINDSDGRCKSSKTLGIEAPYLDLKKAGPRSPCNSDVIYLLPDLKALRV

SEQ ID NO: 160189 - protein, 868 aa, Glycine max
  Coding DNA Sequence Number=SeqID_68504
  Gene Ontology: Mol. function=protein dimerization activity; Cellular component=nucleus; Biological process=regulation of transcription, DNA-dependent
  Homolog annotation: Hit_ID=A7L5C4; Match level="QueryCoverage=97%, HitCoverage=100%, E-value=0.0, Identity=67%"; Hit description=Auxin response factor 8
  Pfam annotation: Domain name=Auxin_resp; Domain location=278-361; Score=201.0; E_value=2.9e-57; Accession=PF06507.4; Description=Auxin response factor
  Pfam annotation: Domain name=B3; Domain location=151-256; Score =108.7; E_value=1.8e-29; Accession=PF02362.12; Description=B3 DNA binding domain
  Pfam module annotation: Pfam domain module=Auxin_resp::B3; Domain location=278-361::151-256
MAISGNVPPLLVQGEKQKKVKLDDMKLSTSGLGQQGHEGGEKKCLNSELWHACAGPLVSLPTAGTRVVYFPQGHSEQVAATTNREIDGHIPNYPSLPPQLICQLHNITMHADVETDEVYAQMTLQPLTPQEQKDTFLPMELGIPSKQPSNYFCKTLTASDTSTHGGFSVPRRAAEKVFPPLDFSQQPPAQELIARDLHDVEWKFRHIFRGQPKRHLLTTGWSIFVSAKRLVAGDSVLFIWNEKNQLLLGIRRANRPQTVMPSSVLSSDSMHIGLLAAAAHAAATNSCFTVFYNPRASPSEFVIPLSKYIKAVYHTRISVGMRFRMLFETEESSVRRYMGTITGISDLDSVRWPNSHWRSVKVGWDESTAGERQPRVSLWEIEPLTTFPMYPSLFPLRLKRPWHPGTSSLHDGRDEATNGLMWLRGGPVDQGLNSLNFQGAGGMLPWMQQRLDPTLLGNDQNQQYQAMLAAGLQNLGSGYLMKQQLMNFQQPYHYLQQSGNSNSPLQLQQQQPIQQSVSSNMLQPQTHVLTENLSQHLLQKPHNNQEVQAQQQQHTYQDSLSILGDQLHQRQHSGIPSSSYSKPDFLDSSMKFPASVSPGQNMLSSLCPEGSGSLLNLSRSGQSLLTEQLPQQQWTQKYAPVQVNAYGSTVSHPQYSGKDSVMVLPHCNSDAQNSTLFGVNIDSSGLLLPTTVPGYTTSSADTNSSTMPLAESGFQGSLYGCMQDSSELLQSAGHTDPENQTQTFVKVYKSGSVGRSLDISRFSSYHELREELAQMFGIEGKLEDPLRSGWQLVFVDRENDVLLLGDDPWESFVNNVWYIKILSPEDIQKMGDQAVESLALGSGQRLNGTGAESQDIVSGPPSIGSLEY

SEQ ID NO: 160190 - protein, 60 aa, Glycine max
  Coding DNA Sequence Number=SeqID_68505
MARRGETRNESLLTRAVVAVFAFVRHAEFEILFFLFFFIAYLLFKDIAQILIPCPGISIS

SEQ ID NO: 160191 - protein, 369 aa, Glycine max
  Coding DNA Sequence Number=SeqID_68506
  Homolog annotation: Hit_ID=A5B5V0; Match level="QueryCoverage=86%, HitCoverage=65%, E-value=1e-09, Identity=21%"; Hit description =Putative uncharacterized protein
MVEPSKKRKGSSSRSQRHSETQETQIPSFISSSSLFSTEEQRIRYTNLFFSCSIIDPKFIDMDFFSNESFECIQAFDNSNLIPFMSLKLHVYTELVKAFYSNLEIQEGTLISEVYGIKMVIDQSLFYDLTQLSSEGVPIEGTLNDDGKFDFSVHDARWLVCTNQADMTGRLLVGSLAFEIRILHYLIVRILIPRSSNLAQVSEEDLIVMWAFHKGRQIDWAHLVRYRMHKALRLNASLPYPHLVTLFLQHFNIPLDSGPYVPIKRSFLIGVVVIASFGYRKEHDGSWVKKGAQPIDEEGHVPVGEDSSLLQRIFDKFDSLQTFVGERFDALELQVDMRFDEMDTRITKVEGDVSHIRTCFDLPPPPPSS

SEQ ID NO: 160192 - protein, 129 aa, Glycine max
  Coding DNA Sequence Number=SeqID_68507
MSNNSPRRRHNNLLHLRRLRQRHEQAGVLVEKGLSFELKAHTFVAFFEVAQKDDMAWLVEDFFDNASTLLITLVLDAFSSDDRIKIHSRKMNVHPDVHFEELARSTDDFNRADASGMAESLKYDFLLVP

SEQ ID NO: 160193 - protein, 250 aa, Glycine max
  Coding DNA Sequence Number=SeqID_68508
  Pfam annotation: Domain name=zf-CCHC; Domain location=89-106; Score =12.3; E_value=0.021; Accession=PF00098.14; Description=Zinc knuckle
MAARKVKLSGKPGPLCPVQYKRLEKEFHFANQWTPIWCGDNMGLRYEVHMWGNKVEVNLGEWTCTCGVWQLTDEDNVTGHKLKRKLAEFTCGRCGQTNHNIRSCKNIGVPVRPKKYVAPSTSNEDDHLLSQDEQALNEAEEAAAHVQQDPVEINLSQPHLSQDSDMELMVAEFEVRIAARLPWWHCRMKLPENAQQLPLADMDKSREQAAATEPQSRRRRSNSAWEEEEEEATSSFVNPNFFGEEEATLR

SEQ ID NO: 160194 - protein, 629 aa, Glycine max
  Coding DNA Sequence Number=SeqID_68509
  Homolog annotation: Hit_ID=Q2HW90; Match level="QueryCoverage=26%, HitCoverage=39%, E-value=4e-18, Identity=34%"; Hit description =Putative uncharacterized protein
FSKAYGKIWDLAMIEVFAEAITSLTQYYDQSLRCFTFGDFQLAPTIEEFEEILGCPLGGKEDIPLWIPWKRLEEKVEALANQGEWTSFINMLALLVFGTILFPNVDGLVDLAAMDAFLAYHHDKESLVIAVLADAYDTFDLRCKKSSARIVCCTPALYVWLASHIFYHEGRSVCPLQSHCMCSEKGKANWGELLAGIPKCPFDRDEGSLGEVEDVISGYHKWLKSRTQGITWLPKKKSLSGKKAEIPEKSEEVQALKEELKKTRMEKEKLKMTVIRVKKECDELKDINMTTVEALESNELKLRRAGRDKSRMESMVLEDEQAKVSALQIEREARERVIELLHGEAMKWMDRFALTLNESQELPRLLARAKAMVDTYSSLDEVHNLFNYCHHMTDMEAMKDQMVAMLSMRKIMEGNAVAVATTSAATEIDPSHPSSMNQVQSKHPFPPYGLPPNYAPPNVVHVPKENVDHSAPIPFESQQPQSEHARVAQPMGESHEVPQDHALADLEAYLGYATKGIAHNRNYNPYIFRWEDPAMMEREKFDHLEEKLRAIEGGGTTLLPTWDLAAQVAHPMMEREMITMIVDTLPMLYYEKMDQGRPEKGKFDYAASTSVGNRRTGTGGAKKKERDAD

SEQ ID NO: 160195 - protein, 510 aa, Glycine max
  Coding DNA Sequence Number=SeqID_68510
  Gene Ontology: Mol. function=metal ion binding; Cellular component =intracellular; Biological process=biological_process
  Homolog annotation: Hit_ID=A5C8Y6; Match level="QueryCoverage=55%, HitCoverage=44%, E-value=8e-32, Identity=32%"; Hit description =Putative uncharacterized protein
  Pfam annotation: Domain name=Bromodomain; Domain location=59-146; Score=58.9; E_value=1.7e-14; Accession=PF00439.16; Description =Bromodomain
MEVRHDSNDFNKDEESPIKKEHKSKELDQLISLIKELGKHDKNASASRTNDSSQNCMPLKSILENIIDFLQRKDTSGLFAAPTNLDVVENYHKIVKQPMDFGTMRAKLHEDMYTNFNQFKRDIFLICSNAMHASPKTSKYHEVAKHINRYAKGIFEALNADLGLFHSELSLNKRGPSTKQQKEKLIRTPRRVATKCAGMDTCSSFNLHSLIQKVSRPYIKVVRWRNNATHSTVPETEKRDKYWPPSKPLVAEVLNAKKPIIQLNENVSKYKESLLRFVKDLGPTAQKVAAKRLEVVSLSPVENVSSFHGPIQEPTNQLHLGSSRTSNTRLWNTSAGIQNMLAAGISSNAFACVCPTSMISGPPQPRLSGNRNNLPGSSRNPNPCLLSQSMADYSVSCMPSNNLTELLPLMHQPRPRESMYAMPSNNLTGLSPFPHRANSASRLNPLRLSPHGPVSQQEQNSSFLQMLLGGETNNYGGGGAQIGQPEEAPPQLPLDNDNDHDEVPDLELHL

SEQ ID NO: 160196 - protein, 157 aa, Glycine max
  Coding DNA Sequence Number=SeqID_68511
  Gene Ontology: Mol. function=sucrose transmembrane transporter activity; Cellular component=integral to plasma membrane; Biological process=sucrose transport
  Homolog annotation: Hit_ID=Q84RQ3; Match level="QueryCoverage=62%, HitCoverage=26%, E-value=2e-22, Identity=44%"; Hit description =Sucrose transporter 4 protein
MTPWTFVVVNLTLIDLPGLTKRANQIVDLATSDAIKISREVDPTGSGELVLFGESQISSMTICFLAMLVVTYVANNMGYIGKDLSPTGIVIVVLIICTILGFPLAIIVSLGSGPWDQLFGGGNSLTFVVAAISALISGLITVLAIPRSGAQKARSHV

SEQ ID NO: 160197 - protein, 92 aa, Glycine max
  Coding DNA Sequence Number=SeqID_68512
MFVFNSALKGLDDTQQSKFKPPARWIVVKCNRQKGNIECGYYVMHWMSTIILGNFKNNWEMYFTDARPLEPERLKALHIQWAKYYLKVKNET

SEQ ID NO: 160198 - protein, 509 aa, Glycine max
  Coding DNA Sequence Number=SeqID_68513
  Gene Ontology: Mol. function=adenylosuccinate lyase activity; Cellular component=intracellular; Biological process=purine ribonucleotide biosynthetic process
  Homolog annotation: Hit_ID=Q6D4E7; Match level="QueryCoverage=53%, HitCoverage=59%, E-value=1e-144, Identity=92%"; Hit description =Adenylosuccinate lyase
  Pfam annotation: Domain name=ASL_C; Domain location=148-262; Score =299.4; E_value=6.9e-87; Accession=PF08328.2; Description =Adenylosuccinate lyase C-terminal
  Pfam annotation: Domain name=Lyase_1; Domain location=1-138; Score= -80.3; E_value=1.1e-05; Accession=PF00206.11; Description=Lyase
  Pfam annotation: Domain name=Response_reg; Domain location=289-400; Score=75.7; E_value=1.6e-19; Accession=PF00072.15; Description =Response regulator receiver domain
  Pfam annotation: Domain name=Trans_reg_C; Domain location=432-507; Score=59.2; E_value=1.4e-14; Accession=PF00486.19; Description =Transcriptional regulatory protein, C t
  Pfam module annotation: Pfam domain module=ASL_C::Lyase_1::Response _reg::Trans_reg_C; Domain location=148-262::1-138::289-400::432-507
MANVAYRMERQLRQLSKVEVLGKINGAVGNYNAHIAAYPEVDWHQLSEQFVTSLGISWNPYTTQIEPHDYIAELFDCIARFNTILIDFDRDIWGYIALNHFKQKTIAGEIGSSTMPHKVNPIDFENSEGNLGLANAVMQHLASKLPVSRWQRDLTDSTVLRNLGVGVGYALIAYQATLKGISKLEVNRDRLLDELDHNWEVLAEPIQTVMRRYGIEKPYEKLKELTRGKRVDAAGMQAFIDSLELPEAEKVRLKQMTPANYLGRAIQMVDDLNHARHVVAEVPLPVHHSGVLICDNALLRHHLAVQLRDMGHQVDAAEDAKEADYFLQEHIPDIALVDLGLPDEDGMSLIRRWRGDAIRQPILVLTAREGWQAKVEALEAGADDYVTKPFHIEEVAARLQALMRRNSGHASQIISMPPFQVDLSRRELTVNDAPVKLTAFEYTIVETLIRNAGKVVSKDSLMLQLYPDAELRESHTIDVLMGRLRKKILALHPTEVINTVRGQGYRFDL

SEQ ID NO: 160199 - protein, 141 aa, Glycine max
  Coding DNA Sequence Number=SeqID_68514
  Gene Ontology: Mol. function=pseudouridylate synthase activity; Biological process=pseudouridine synthesis
  Homolog annotation: Hit_ID=Q8ZPZ1; Match level="QueryCoverage=81%, HitCoverage=50%, E-value=3e-34, Identity=65%"; Hit description =Ribosomal large subunit pseudouridine synthase E
  Pfam annotation: Domain name=PseudoU_synth_2; Domain location=43-134; Score=-30.2; E_value=0.016; Accession=PF00849.13; Description=RNA pseudouridylate synthase
  Subcellular localization annotation: CTP_CleavageSite=29; ConfidenceScore=5.23e-01
MRRLLPTAKPMRKTSQRIHQHKRPAAPARQPARRDTRPKGPRRVILFNKPFDVLPQFSDEAGRRTLKDFVPVSEVYAAGRLDRDSEGLMILTNDGALQAQLTQPGKRTGKIYYVQKWCLNPRGCGRAPRRFASAKLSPPAG

SEQ ID NO: 160200 - protein, 410 aa, Glycine max
  Coding DNA Sequence Number=SeqID_68515
  Gene Ontology: Cellular component=membrane
  Homolog annotation: Hit_ID=A6T617; Match level="QueryCoverage=98%, HitCoverage=96%, E-value=1e-156, Identity=66%"; Hit description =Putative transport
  Pfam annotation: Domain name=MS_channel; Domain location=138-391; Score=81.7; E_value=2.4e-21; Accession=PF00924.9; Description =Mechanosensitive ion channel
MNYLRDIQTFIEGNTVLSATFSLLLLLVAGMVTHLICKFFVVKVVRRVFFSTHKNQVPLDKDVRLSEKLSNFIPVITVYYLLQFMPDLPEHLLIAVKTICGILFFVYLSLFFNEVLEIVNNSYSRKSKRKNHSIKGYIQIGKILVHIISAIMILAIMSNKSPVIIISSLGAVAAVLMLVFQHTLLSLVANIQVSSNDVLQLGDWIEMPDNGISGEVIDIALHTITIRNWDNTLSRIPTKNFLTETYTNWQAMFSSGARRIMRSFHLDQTSIRFLDQQMVQQMSQIRGVSEQLSILMDGRDSSVVGDRWFAENGITNLTVFRHYLTAWLAQRDDIKKDMYIVVRAMKPSPEGLPVEVYCFTSSVLWVDYENSQSAIFEFIYAIVGQFSLRIYQHPAGNDFWRLSQARDSQI

SEQ ID NO: 160201 - protein, 225 aa, Glycine max
  Coding DNA Sequence Number=SeqID_68516
  Subcellular localization annotation: CTP_CleavageSite=11; ConfidenceScore=5.22e-01
MKPDGRRLPVCCSVRATIAPTTNAMNSGVTRTPSLLAAIRRVPAHQEVAQMIKTPFGIVRLLAVIANGDLLIAAMALLQRRPAPVQHRARIVDQRVARHAVLLLLAAQIHLKELIETLCLFAATVQRGAERHIEKAAHAVCALLPVTGQRHKQAILQINLFQQTTQIFRMFTGGDLINAIGFQRQVKTARVDRAIRVSGGRKGEIDITVIVQTLFHNAGPQHDKR

SEQ ID NO: 160202 - protein, 91 aa, Glycine max
  Coding DNA Sequence Number=SeqID_68517
MKQKEKRKKDLEGRHIMVIKKHKSFVESKHIFWKQEIDAKSLFSKITEIRMDGFVEPMKEHNLETWEKEEGETGVTYFKSFWVGTIVIEIN

SEQ ID NO: 160203 - protein, 59 aa, Glycine max
  Coding DNA Sequence Number=SeqID_68518
MADNRQQMHRRHLQSPSTHLQKLERCLRPMVDQQATKSEAKEIMWDIPFIPEPLAKPTP

SEQ ID NO: 160204 - protein, 109 aa, Glycine max
  Coding DNA Sequence Number=SeqID_68519
QSGAIEQALKLMLQTSTIDLLNLSSKINHNRIIMTSLATDTIPDAGITLISDGLALNNNNNSLLLPSKMLLVQVDHTFLFHCNNNNNNSSINRDNNPLLRPLLNLHWKN

SEQ ID NO: 160205 - protein, 51 aa, Glycine max
  Coding DNA Sequence Number=SeqID_68520
ESGRASASKLGAKREISALSVADARAQNSIAATGLFGEKSPRSRKEEQLVH

SEQ ID NO: 160206 - protein, 256 aa, Glycine max
  Coding DNA Sequence Number=SeqID_68521
  Gene Ontology: Mol. function=motor activity; Cellular component=cell projection
  Homolog annotation: Hit_ID=UPI00016621D1; Match level="QueryCoverage =97%, HitCoverage=40%, E-value=4e-19, Identity=31%"; Hit description =UPI00016621D1 related cluster
MFLCSMLKPKVLNLEPLRLHAFNFRGLHVLAIRGLHALPFRGLHVLAFRGLHVLTFRGLHALTFRGLQALAFRGLHVLVFRGLLALTVRGLRVLAIRGLHALAIRGLHALTFRGLHIVAFRGLHALAFRGLPDLTFIMLHALAFRGLHALAFKGRHILNFRGLHALIFRGLHALTFRGLHALTFRGLHVLTFRGLHALTFRGLHVLTFRGLHALAFKGRYILNFRGLHALAFSGLRVLTFSGLHIHTLREFKVLCP

SEQ ID NO: 160207 - protein, 104 aa, Glycine max
  Coding DNA Sequence Number=SeqID_68522
MSQSLLSHKGGPLGTSTLTFRRLHALAIRGLHVLALKGLHALAFRGLHAVTFRGLHILAFRGLHALAFRGLHVLAFKGLHALAFRRLLVLAFRGLHVFPFRGLH

SEQ ID NO: 160208 - protein, 93 aa, Glycine max
  Coding DNA Sequence Number=SeqID_68523
MATKGWSFVGASMVEEEEENGNPQEEEKNLTFETLKSCLGLRVISLVPVPRVSLHPSGPVFESKQYVYQNAQNETTNMVQRLVLLNFKLHVKR

SEQ ID NO: 160209 - protein, 58 aa, Glycine max
  Coding DNA Sequence Number=SeqID_68524
VDSRGSHCRARALLLFRALLRTSSGQRSHGLEIDLRPGQERHQQRLPTRQMRPARTRR

SEQ ID NO: 160210 - protein, 109 aa, Glycine max
  Coding DNA Sequence Number=SeqID_68525
MSEIGRFGSLGMEVRRKEEGAVQEILKTRRQPTGNRLHEYCNRLQAICFGVIDYNIHVYDQEGYHSQIIVASSIKFVHNNCRQKYIPLQLWTKQHCFISYYAMRQERIQ

SEQ ID NO: 160211 - protein, 435 aa, Glycine max
  Coding DNA Sequence Number=SeqID_68526
  Gene Ontology: Mol. function=inorganic phosphate transmembrane transporter activity; Cellular component=membrane; Biological process=phosphate transport
  Homolog annotation: Hit_ID=A8GEX0; Match level="QueryCoverage=18%, HitCoverage=14%, E-value=2e-31, Identity=86%"; Hit description =Phosphate transporter
  Pfam annotation: Domain name=PHO4; Domain location=1-90; Score= -193.3; E_value=0.097; Accession=PF01384.11; Description=Phosphate transporter family
MVDWRRIVVTVAERIGKTHLTYAQGASAELVAMATIGAADAFGLPVSTTHVLSSGVAGTMAANRSGLQLATLRNLVLAWVLTLPVSVLLSGLLRSVIRNAPSTISAAARYTDCMPQWPINSPATGPRREHQRETAAGEEGANIHQPAAVRLPDQQQTGALQHEGDQRDLQPAEARDIAPARQPHQHEAEAEQCQRERRAAPVAAGEIKGNEGGDHAKADGAKSQRQAKQPDAADHAMKRNAHAGADADRRFAGGHPEADRPHQRDQTGKAADAKNLVQQHAQRRTNRHGKVSRHAVPRNDPRGLPRADNVHAPQRRAGTAETFPDAEKQPPQRQQRQAQQRRTAAQRGNDRQHAAHAAAHQPHHHHAFRAVAIGQPARVRATEQRGEILQTDDQPGDKRAEAQLVMHKPRQHRQRQPDGQVAKEGENDDGEDAFI

SEQ ID NO: 160212 - protein, 169 aa, Glycine max
  Coding DNA Sequence Number=SeqID_68527
  Subcellular localization annotation: CTP_CleavageSite=23; ConfidenceScore=5.21e-01
MTSIAQSNTSRLGFPTMITALCRARRVVSYSLTFERLSPFLERVAWPGTQPSLHREDEGPTAQVPQHVEDESSEATIPEPFMVEEEAGKAQVRQEAAATPERSREVTSDPPTLVVDLSSPQHAADPSTPILEIPEDPTTPVLTLNTSPPATPALHLTDDEDVQTQDTQD

SEQ ID NO: 160213 - protein, 99 aa, Glycine max
  Coding DNA Sequence Number=SeqID_68528
MHSEAEALEHMKKRDTSHQSVSLENKTGDSTMLKIGDSTKVVIKQDMKGGEHKYGFNNNKCEKPEKVRVVDDETGDKHKLYEVLRMPSRTKNRCLKFFT

SEQ ID NO: 160214 - protein, 53 aa, Glycine max
  Coding DNA Sequence Number=SeqID_68529
MRAKEAEDAMYCEHNVDVSTVSLSASDSLSEHSVNFEFSDFKFTRLAGQTRLA

SEQ ID NO: 160215 - protein, 161 aa, Glycine max
  Coding DNA Sequence Number=SeqID_68530
MAPKKLSAKRSRRGAAAEGTCAAPEFDGHRFKSTEHQQRFEAIKGWSFHRERCVQLRDDEYTDFQEEIARRHWTSLVTPMAKFDPDIVLEFYANAWPTVEGVRDMRSWVRGPWIPFDADALSQFLGDPLVLEEGQECEFSQRRNMTDGFDEQAIAQLLCIP

SEQ ID NO: 160216 - protein, 130 aa, Glycine max
  Coding DNA Sequence Number=SeqID_68531
KAKCQKASNRVGNKKKKVDLWMNALLESKLLHPRKTMNYLQPNLITCLRKVLLIQFITRGKSLEVLKGAVVLSGTYGLSSHLSLTSTTTCLALCENLEEHKNRGHAQSKTFVSYQAQRTTGTKPKSTYSR

SEQ ID NO: 160217 - protein, 245 aa, Glycine max
  Coding DNA Sequence Number=SeqID_68532
  Gene Ontology: Mol. function=binding; Cellular component=plasma membrane; Biological process=establishment of competence for transformation
  Homolog annotation: Hit_ID=P0AC04; Match level="QueryCoverage=100%, HitCoverage=100%, E-value=1e-122, Identity=88%"; Hit description =UPF0169 lipoprotein yfiO precursor
MTRMKYLVAAATLSLALVGCSGSKEEVPDNPPNEIYATAQQKLQDGNWKQAITQLEALDNRYPFGPYSQQVQLDLIYAYYKNADLPLAQAAIDRFARLNPTHPNIDYVIYMRGLTNMALDDSALQGFFGVDRSDRDPQHARDAFNDFSKLVRGYPNSQYATDAYKRLVFLKDRLAKYELSVVDYYTDRGAWVAVVNRVDGMLRNYPDTQATRDALPKMENAYRQMQMNAQADKVAKIIAANGKNT

SEQ ID NO: 160218 - protein, 108 aa, Glycine max
  Coding DNA Sequence Number=SeqID_68533
MTKLANFNEFAEHVAKFVAERVYLPLRERIEYLEAELADAQAISSDMEADFLRSFKQQSRAILNQLKRDSVSAGHVALVEEALADLRRVGITRIRVSALVALAAHNAR

SEQ ID NO: 160219 - protein, 87 aa, Glycine max
  Coding DNA Sequence Number=SeqID_68534
MTRIMKLAKYRLKAQVEKDKAPEWRRMKAQVEKDEGPEAETLSRLLIVAEGPNLSSFTGSGVYPDLSSFTGSGVIQISVTCIKRSAP

SEQ ID NO: 160220 - protein, 29 aa, Glycine max
  Coding DNA Sequence Number=SeqID_68535
MVIFSHGVTTKDKGGEYLGSDPWSFPNEQ

SEQ ID NO: 160221 - protein, 151 aa, Glycine max
  Coding DNA Sequence Number=SeqID_68536
SFGVPVAPTKVIQPPITRAFIEKYCTQRQAQGDAPQAVGAPPPPYQAGPAGSFDMEQYLRHLVRQQAANHRAHVQTHDCLYQMSLSMQSQGFASFSCPTPDQFRAEVAWPGDWPEAQAEEAPPEAPGDGEEAHEDEEMADLLDFLGGSGAT

SEQ ID NO: 160222 - protein, 178 aa, Glycine max
  Coding DNA Sequence Number=SeqID_68537
MGDVSTSRRFILEALREADDKNPSKPKPLVIHFTRDVTTQKPQGFQPVTVKKPAPFPYKSDRAVPWKYAAQGPNRRKDASIVHVKDDLSSTKVTNISGTSRMTHSGWIFTEPELLVRSKDPKGKVKADMGESDKAGMTLDDEVLVGKIAEEGNDFRKKGISAEEAIEFPRIIRQSEFK

SEQ ID NO: 160223 - protein, 81 aa, Glycine max
  Coding DNA Sequence Number=SeqID_68538
MSRNFTDFLSMGVKYLKVVKRGSHPNKQMMHATFILECERFDAILPRKGPVTRALSKRLQEDWARAAEEGPRILMNLRVDL

SEQ ID NO: 160224 - protein, 112 aa, Glycine max
  Coding DNA Sequence Number=SeqID_68539
MDISKDTDIPVILGRPFMLTASCIVDMGKRRLELAFEDQKIDFDLFVEDKPAREHNVCLQVMEGGQEVLKRESQALSAQPLHLRLIWSAKLAKDELSQLQFDLNSAKLQPDR

SEQ ID NO: 160225 - protein, 245 aa, Glycine max
  Coding DNA Sequence Number=SeqID_68540
  Gene Ontology: Mol. function=chloramphenicol O-acetyltransferase activity; Biological process=response to antibiotic
  Homolog annotation: Hit_ID=P62577; Match level="QueryCoverage=88%, HitCoverage=99%, E-value=1e-129, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWPGRGLQLGANCLPGTECQAWNETNAAITAE

SEQ ID NO: 160226 - protein, 181 aa, Glycine max
  Coding DNA Sequence Number=SeqID_68541
  Homolog annotation: Hit_ID=Q5XM22; Match level="QueryCoverage=53%, HitCoverage=71%, E-value=1e-17, Identity=44%"; Hit description =Resistance-like protein HAAS-2
RAYLLHPLGCTLFANKSATHVHVVFLDALRDLTQSEGYTWGAAALVHMYDNLNDASKSTARQLAGYITLLQHFPSVGSAVPAKDYDERRPCACRWTSGKTLPVSMYRRHKDRLTPDVVCWIPYDNHHSFREFEFGEHIAPVGQLCAVPGHCSPDYMDWFYMISHSFMSPAQLEDPLRVPPV

SEQ ID NO: 160227 - protein, 174 aa, Glycine max
  Coding DNA Sequence Number=SeqID_68542
MGTVGRQRFAPAPAVPARNKGSIPEREPEKRLPHPRKAAGAQITQSRHGEGKSGASSRVKKLVVEPWVWLAGPPHREYWSGWTFPSGEPHGLHWLWGEPGLLLTAVMINRDSRGRQYSAGTKVRGSKTIRYRRSLNHKLCRLGIGRCFYDDPLGTLREIKVFGFWGEYGRKAET

SEQ ID NO: 160228 - protein, 75 aa, Glycine max
  Coding DNA Sequence Number=SeqID_68543
MAINIHGKVESKPMGINIPCLKKQIAGAGSLDIQTFPKFQLAITVKTSAKARACLFVSLFVGCHIGNWKEDWCHP

SEQ ID NO: 160229 - protein, 985 aa, Glycine max
  Coding DNA Sequence Number=SeqID_68544
  Gene Ontology: Mol. function=catalytic activity; Biological process =metabolic process
  Homolog annotation: Hit_ID=A7P086; Match level="QueryCoverage=99%, HitCoverage=89%, E-value=0.0, Identity=61%"; Hit description =Chromosome chr6 scaffold_3, whole genome shotgun sequence
GSMHQISWFQFLPHEPDLNPLPDKSVKVDQKDAAMLLVLSSHLQLQKEGFLSTWTNSFVGPWDPSQGLHNPDEKIKLWLFLRGRHSSVVETAQTAVSGLRVVASGLWLAPGDSEEVAAALSQALRNCIERALLGLYYMRFGDVFSKFHQFQREEIFRRGQPAVEFVFAATEEAIFIHVIVSSKHIRMLSTADLEKVLKHSMESTYRLPVIVSPHGIRGSLTGCSPSDLVKQSYFSSTKFRVSNGIIGLPYHVSQGVGCQLRGQNCYVEVSLGFPRSGTDNTLQPNKNSVRNLPKLHVAESPVVGRSDHKGPPDHLLDYDKTFLYPAEAVLVPVLQTSLARSSLRSAGNVDCTEDPWTEINGTRTQSSYDSSSNSNNSSISSLSASSSDSDYKTTGPSELEADADSLTCRQSMVSSADQLDSDGPKLGSKRSRTGVTELLSTATNIPVQDAYMSDFGSMEVNNSAITGVGNEPIGSYWDWDDDDRGMEMDIQALLSEFGDFGDFFENDVLPFGEPPGTAESQALMLSAPDCGDVNSSPGGVIDVPDQILLPVGFASFESFNPPPSTSIEECLNKSQDNLNNSMSLGPTNQNQLLYTREFDHIMKAEAMMTFAPEFGAVDTPTCEFSTTLFRSPYFPKSRKAKSSTSSSSNYLYGAAPPTSTCTEGSEGKNGKSVNTKTGSGKHDASTMSLHSKYYYTFVESRKEKNDKNPATCNDNSITKSEGMPPLSNIGSNAIVKSAIRKTTDCTHEAEQFLLSAKTLLATDITCIMLQASMCRLRHILLSSGNLMPAGLSRSTGVSFLNQLPSDPSMTTDNISGKYDVKKKENIPIRIAGDIDGGMLDGHLNAPVGVWRTLGASKVVKPSNSPNMEVVPSFPHNSFNEEGILSYGQRKPLQELLDGIALLVQQAISFVDLALDVDCGDGPYGLLAMQEQWRRGFCCGPSMVHAGCGGSLASSHSLDIAGLELVDPLSADGYGFRIWSLIIEVK

SEQ ID NO: 160230 - protein, 600 aa, Glycine max
  Coding DNA Sequence Number=SeqID_68545
  Homolog annotation: Hit_ID=A7Q9J7; Match level="QueryCoverage=98%, HitCoverage=96%, E-value=0.0, Identity=69%"; Hit description =Chromosome chr5 scaffold_67, whole genome shotgun sequence
  Pfam annotation: Domain name=MACPF; Domain location=121-318; Score =70.0; E_value=7.9e-18; Accession=PF01823.10; Description=MACPerforin domain
MEGTVFPNNPIECLGKGFDLTSDFRLKFAKGYGKRLVVVDEVNKRDITVPVPGGVATIPNVSEDIRCDKGDRLRFKSDVLQFNQMSELLNQKSAIQGKIPSGYFNALFDLGGDWFRDAHDIKCLAFDGYFISLYYLHLTASHLILQEEIKKSVPAQWDPASLTRFIQTYGTHIIIGMAVGGQDVICVKQKHSSKVPPGDLRRHLEDLGDILFSDLRSPSQQQRNTPEGKQKVPEVFKSVMQSSTTQYTSISETSSKDGLTIICSKRGGDVFKQSHSNWLQTVASNPEAILFKFVPISSLLTGIPGSGYLSHAINLYLRYKPPPDDLQCFLEFQIPRQWAPMFYDLPLRHQRKKCSSPSLQFGFMFPKLHVSCAQVVSEQKPVVGLRLYLEGRKSDRLAIHVHHLSSLPNTMIYSSGTSSWRGSDDNESSDIFLEPIRWKGFANVCTAVVKHDPTWLQETSGGVYIVTGAQLISKGTWPKNVLHLRLLYTHIPNCSIRKSEWGGAPEASRKSSFLTNLSTTFSFTQQSPPQKQAPTVLDSGVYPDGPPVPVRSGKMLKYVDTSEFVRGPHDAPGHWLVTAAKLVTEGGKIGLQVKFALLDY

SEQ ID NO: 160231 - protein, 553 aa, Glycine max
  Coding DNA Sequence Number=SeqID_68546
  Gene Ontology: Mol. function=metal ion binding; Cellular component =nucleus; Biological process=regulation of transcription, DNA -dependent
  Homolog annotation: Hit_ID=A7QP49; Match level="QueryCoverage=36%, HitCoverage=73%, E-value=3e-37, Identity=44%"; Hit description =Chromosome chr1 scaffold_136, whole genome shotgun sequence
  Pfam annotation: Domain name=SBP; Domain location=170-236; Score =37.2; E_value=5.8e-08; Accession=PF03110.5; Description=SBP domain
MEWNAKSLGQWDWEHLFFNTKAAENPRLQPTDCSSEADPEINVGLLYPSGGSACSGSELIHASSSRSSKSASNNSSSNGDSRESILTLEGSQDDSTGKKELCNGEPVETSPAAVPSPVSGEPLLTLKLGKRLYFEDVCTGSDSKKPSSFEVPILSGKKYKTSSQTVQHPSCQVEGCGLDLSSAKDYHRKHRVCEAHSKSPKVVIADGRQIMSPFAFSRTATNLAWQDMHSSKHPQTKEFLPKPAKAFNKIPSIVSMLSDDSSGLLTSRGIATKSIVPGMEVPNGTQDVNRALSLLSTNSSWCPYETKSLSLEHSTRTTHSITQHRLPLPSSEYWHTDQQNSSMCISFSDCDSSNRFQDFQLLSSPYESDAMKLFTPDLFSLSYELLPPLVIGDEDHRDVSGGERHRISIGTDIIHDPITLFLNKPTSGLDFTSTFMVSHRRHHCRWGKDIGEECIEVEVFRLLEEAELPSGQRGEDGAQAAAEATAMVVGEFLMDLGLKNDKVSAKVCDEGVATVFDSDVIGDINLFGGEGGEEEAAAGAEVIGNGGSKGRRK

SEQ ID NO: 160232 - protein, 318 aa, Glycine max
  Coding DNA Sequence Number=SeqID_68547
  Gene Ontology: Mol. function=protein methyltransferase activity; Cellular component=cytoplasm; Biological process=protein amino acid methylation
  Homolog annotation: Hit_ID=Q8LCI2; Match level="QueryCoverage=95%, HitCoverage=99%, E-value=3e-82, Identity=54%"; Hit description =Putative uncharacterized protein
MAAAANSEGNAQKPSSETFQLFSSSASAFGIFDDAAQQVPPIPPPPCVEVLASEVPSSLKHNVDSVNLDGVILLKFPGNMKVLPFSVYSPIPISFMTKSVAATLVSFGLGGLKLWEGSLDLIKALRSDIKNGLISFAGKRVLEVGCGHGLPGIFAFLEGAAAVHFQDFNAEVLRCLTIPNLKANLSGESQPSSSNSTICDEAEVRFFAGDWSGIDKLLPHVTTDAKHNQGDGYDFILMAETVYSINSLQNLYNLIKKCLQHPDGVVYMAAKKYYFGVGGGTRRFLSVVEKDGVMTSSLVAEITDGSSNVREVWKLAYK

SEQ ID NO: 160233 - protein, 433 aa, Glycine max
  Coding DNA Sequence Number=SeqID_68548
  Gene Ontology: Mol. function=oxidoreductase activity; Cellular component=cytoplasm; Biological process=DNA dealkylation
  Homolog annotation: Hit_ID=A7QP58; Match level="QueryCoverage=82%, HitCoverage=100%, E-value=1e-129, Identity=64%"; Hit description =Chromosome chr1 scaffold_136, whole genome shotgun sequence
  Pfam annotation: Domain name=2OG-FeII_Oxy; Domain location=313-433; Score=12.4; E_value=0.0092; Accession=PF03171.11; Description=2OG -Fe(II) oxygenase superfamily
MDRTERSSTPFTDGKSRLLWRTCVTAAVAGLFVTRPLSTTTHEVFPLTEEKWKGVKRPGVTDETLTSSVSSDPFPMYGTENDRDDSERTAFRRAEKKYKLYYDNNASSKNKRKKLPKPVDLTEVLDFRSILECYLQNDVLPPGVIVLHDNFTSPVFSLQNRPGFYFIPGALSIERQCSLIRESLTDFPQPPNRTNHNAMYGPIQDVFVAAKEGKVLVEDNSPITSSETDTDIDHKDGKEWKFTTEKDALSRKCRSASASVLLRKLRWSTLGLQFDWSKRNYDVSLPHNKIPEALCELAKQLAKPALPTGVEFRPEAAIVNYFGLGDTLGGHLDDMEADWSKPIVSLSLGCKAIFLLGGKSREDTPLAMFLQSGDVVLMAGDARECFHGVPRIFTDKENAEIGHLETQLTREDDLCFLQYIQTSRININIRQVF

SEQ ID NO: 160234 - protein, 549 aa, Glycine max
  Coding DNA Sequence Number=SeqID_68549
  Gene Ontology: Mol. function=microtubule binding; Cellular component =phragmoplast; Biological process=positive regulation of microtubule polymerization
  Homolog annotation: Hit_ID=Q9C7G0; Match level="QueryCoverage=92%, HitCoverage=86%, E-value=1e-176, Identity=62%"; Hit description =Putative uncharacterized protein F13K9.3
  Pfam annotation: Domain name=MAP65_ASE1; Domain location=38-549; Score=-33.3; E_value=3e-07; Accession=PF03999.3; Description =Microtubule associated protein (MAP65ASE1 family)
MWIPVTGTPGKRLIYFILYICLLITPIIWDEVGEDKFEREKVLLDLEQECLEVYRRKVDRANISRARLHQELAEAEAEFTHLLLSLGERSLPGRPEKRAGSLKEQLDSITPALREMRLRKEERLNQFRTVQGQIQKISAEIAGNSDNEPSTIVVNENDLSLKRLEEYQNELHRLYNEKNERLQQVEKYIDIIHSLSTILGKDSSAIIMEVHPSLNDLCGITKNISDTILDKLNITVESLFEEKQTRLDKLHHLGKALSNLWNLMDTSYSERQSFSHVINLLSLSSAEVTDPGSLTLEIVQQTEAEVKRLDQLKASKMKELFQKKQEELELICKKSHVEIPSREEMNNIINLINSGEIDHSDLLLSMDEQISRAKEEASSRKAIMEKVEKWMLACDEEHWLEEYSRDENRYSVSRGAHKNLRRAERARIMVSRMPALVDLLIKMTRSWEEERNKVFLYDQVPLMAILEEYNILRREKEEDTKRQQPWEKKRIQSQVVERDNTYASRPGTSSRRLPSRSLNGALDSSVVLNRRLSMGIQQHKFRKSRHVLH

SEQ ID NO: 160235 - protein, 123 aa, Glycine max
  Coding DNA Sequence Number=SeqID_68550
  Gene Ontology: Mol. function=transferase activity
  Homolog annotation: Hit_ID=Q9LFB5; Match level="QueryCoverage=44%, HitCoverage=15%, E-value=1e-09, Identity=46%"; Hit description =Anthranilate N-benzoyltransferase-like protein
MPPFGTSSPPSWESLEELPPLPPASPISAANPSSAAMSCSTCQKNWECEPKSFELGNHDDATVQIGSSLSGGANKFDGKMSAFLGRNGGAAINLEVVLVPTCLMTRHDGVACRLSRHYLTDAD

SEQ ID NO: 160236 - protein, 727 aa, Glycine max
  Coding DNA Sequence Number=SeqID_68551
  Gene Ontology: Mol. function=phosphoric monoester hydrolase activity; Cellular component=chromosome, pericentric region; Biological process= protein import into mitochondrial outer membrane
  Homolog annotation: Hit_ID=A7QP65; Match level="QueryCoverage=42%, HitCoverage=98%, E-value=1e-114, Identity=69%"; Hit description =Chromosome chr1 scaffold_136, whole genome shotgun sequence
  Pfam annotation: Domain name=NIF; Domain location=527-702; Score =243.7; E_value=4.1e-70; Accession=PF03031.9; Description=NLI interacting factor-like phosphatase
  Pfam annotation: Domain name=TOM20_plant; Domain location=8-211; Score=137.7; E_value=3.3e-38; Accession=PF06552.3; Description=Plant specific mitochondrial import recep
  Pfam module annotation: Pfam domain module=NIF::TOM20_plant; Domain location=527-702::8-211
MEFSQDDFDRLLLFEHTRKSAEANYAENPLDADVRIVLHLHSMSYFAHTAGQNLYNTIVIELGFHLGSAHNKGLRYWIMWIIENLTKWGGALIELSSFQAPKDAKAMIDDALSKLEEALLINPTKHDTLWCLGNANTSYAFLIPDITEAKGYFDKALDYFQKAVDEDPENDLYRKSLQVAIKVMELLWPLVLGDFNVKVRFYLFLVLFDAQILDTDIAIDAGNMRKALLSIEFWIWQGSSLLVITKVSVSYGQGSFKKAVPGCTVSGPKVLRAPRKVSENGRATEKKVKDLITSSARKNKSFSTLENKAREPIPPTDLNNGYEFMDSGNSNACLENDAVDGISLDSMGCNNQAVHLESGTIFSPGFHLSKNSGGVDKVDFIKIFQNEDHERVSPCQEIESPQEDAVDGHVSQDSDTAMEVDINNSSNYSNSGRCGNQMLALSTTNVNGCNSDYDGNGLSMEVSAIYLAVKNSKLECVDEHSQNPMSSEICTEEDEFEDFDDFDPYLFIKTLPDLSTVVPTFRRLLLPKQTRSCPSTTLVLDLDETLVHSTLEHCEDVDFTFPVNFNSEEHIVYVRCRPHLKDFLERVSGLFEIIIFTASQSIYAEQLLNVLDPKRKIFRHRVYRESCVYVEGNYLKDLTVLGRDLAHVIIIDNSPQAFGFQVDNGIPIESWFDDRSDQELFLLLPFLESLVGVDDVRPLIAKKFNLREKIAAAALPLNTNRRDFLSE

SEQ ID NO: 160237 - protein, 525 aa, Glycine max
  Coding DNA Sequence Number=SeqID_68552
  Gene Ontology: Mol. function=oxidoreductase activity; Cellular component=mitochondrial envelope; Biological process=aromatic compound metabolic process
  Homolog annotation: Hit_ID=A7QBS1; Match level="QueryCoverage=99%, HitCoverage=72%, E-value=0.0, Identity=69%"; Hit description =Chromosome chr1 scaffold_75, whole genome shotgun sequence
  Pfam annotation: Domain name=FAD_binding_3; Domain location=45-424; Score=221.9; E_value=1.5e-63; Accession=PF01494.10; Description=FAD binding domain
MGFLSFIRRYSYPFKDKTQNRAYALQHMQSRGFSRDGVLNGNDVVHPVLIIGPGPVGLVLTILLTKLGINCTVLERNKAFSKYPQAHFINNRSMEIFHKIDGLVEEIQRSQPPVDLWRKFIYCTSLSGSILGSVDHIQPQDLEHVVSPVSVAHFSQYKLTMLLLKRLENLGFQICAPESLEGNEQSCDKKIMMGHECVSIEASSEFVTVTASSIIKGKRVEQNIHCNILIGTDGAGSIVRKLVGIEMRGEKDLQKLVSVHFFSKDLGQFLLKENPGMLFFIFNTEAIEVLVAHDLRQGEFVLQIPFYPPQQTIEDFSPKACEKLISKLVGQEFGDADVIDIKPWVMHAEVAENFICSGNRILLAGDAAHQFPPAGGFGMNTGIQDAHNLAWKIASVIKGIAPTSVLNTYEIKRKPIALFNARLSLENYKAAMFVPAALGLDPTVANTVHQFFVNGIGSILPSGLQKVALDGIFGIGRAQVSEFVLNESNPLGSSRLAKLRHIFEEGKSLQLQFPAEDLGFRYHCE

SEQ ID NO: 160238 - protein, 1187 aa, Glycine max
  Coding DNA Sequence Number=SeqID_68553
  Gene Ontology: Mol. function=protein binding; Cellular component =basolateral plasma membrane; Biological process=signal transduction
  Homolog annotation: Hit_ID=A7QBP5; Match level="QueryCoverage=60%, HitCoverage=95%, E-value=0.0, Identity=64%"; Hit description =Chromosome chr1 scaffold_75, whole genome shotgun sequence
  Pfam annotation: Domain name=Ank; Domain location=176-208; Score =16.7; E_value=0.091; Accession=PF00023.21; Description=Ankyrin repeat
  Pfam annotation: Domain name=Ank; Domain location=222-254; Score=7.2; E_value=3; Accession=PF00023.21; Description=Ankyrin repeat
  Pfam annotation: Domain name=Ank; Domain location=309-341; Score =21.9; E_value=0.0023; Accession=PF00023.21; Description=Ankyrin repeat
  Pfam annotation: Domain name=Ank; Domain location=346-378; Score =24.8; E_value=0.00032; Accession=PF00023.21; Description=Ankyrin repeat
  Pfam annotation: Domain name=Ank; Domain location=379-411; Score =29.4; E_value=1.3e-05; Accession=PF00023.21; Description=Ankyrin repeat
  Pfam annotation: Domain name=Ank; Domain location=449-482; Score=3.2; E_value=11; Accession=PF00023.21; Description=Ankyrin repeat
  Pfam annotation: Domain name=Ank; Domain location=483-515; Score =25.5; E_value=0.0002; Accession=PF00023.21; Description=Ankyrin repeat
  Pfam annotation: Domain name=Ank; Domain location=551-583; Score =24.2; E_value=0.00049; Accession=PF00023.21; Description=Ankyrin repeat
  Pfam annotation: Domain name=Ank; Domain location=584-616; Score =35.3; E_value=2.3e-07; Accession=PF00023.21; Description=Ankyrin repeat
  Pfam annotation: Domain name=Ank; Domain location=617-658; Score=3.4; E_value=11; Accession=PF00023.21; Description=Ankyrin repeat
  Pfam annotation: Domain name=Ank; Domain location=85-117; Score=21.6; E_value=0.0029; Accession=PF00023.21; Description=Ankyrin repeat
  Pfam module annotation: Pfam domain module=Ank::Ank::Ank::Ank::Ank::An k::Ank::Ank::Ank::Ank::Ank; Domain location=176-208::222-254::309 -341::346-378::379-411::449-482::483-515::551-583::584-616::617 -658::85-117
MMVLANSGTGLRKQVFPVDYETEISQRLVDAAHYGDTDAAFECIANPLVDVNFVGTVSFKSKTTEIVLQDESPHRVNSAYEEFKTELTALFLAAHTGNLSLLRKLLNVGANVNMRLFRGYATTASVREGHLKILEVLINAGASQLACEEALMEASYLGRARFAELLMQSNMVRPQVAVHALVSACCRGFVEVIDVLIKHGVDANAIDRILLQSSKPFLHASVDCNALFAAVVSRQINVVGLLLQVGVRLDIKVKLGAWLWDTDTGEEFRVGVGLAEPYPITWCAVEYFESTGAILHMLLCQLSPNSLHTGRSLLHHAIICNNEKAVNILLKNGADAEVVVQTTEETNEHPIHMAARLGSCNILQCLINGGCNLDSQTKCGDTALMICARYKHEKCLGVLVSAGADLGMVNSSGHCATSIANCVQWTKVFQRAILDVIRAGKVVKSSNTSRFSALLFVTRANDIEGLKKLIENNNIDLDEQNANGFSAAMIAAVGGNVEAFKLLLYAGADVTNLKNKYGLTALNLIDISQNGEVFHKVMLEYALKKGGNGSIEVNPLHRAACYGDINIAHNLLKEGYDVNAFDGQGYTPLMLAARGCRGEMCELLISYGAKCDIQNERHETALLLARENGARNDAERVILDEVARKLVLHGGRVKKHTKCGKGSPHGKLLVMIGAAGILRWGKSSKRNVICKEAEVGPSAKFRWNRRRKFDVDEPGMFHVNVRKLTKLDMKLNDTLPQITVDPETYTVAADGEGMPGCGQMQNALLHYSTFFHTTSQNSLMVFHFPLKIDNFHTMPFFGSLDFIKKVMAIQTEQPLPTHTPFLTSNTNQDHQHLPQENNDNDEETQTPLDDVLARLEALLTLLGFNQSSLLSFTVSWTTFAAVGVVVPLLALQVYDTDKNQIKSFEIGIVAFQTCLASVSLICLSHNLRKYGLTRFLFVDRHAAHMPCFHHDYVKQISTAREITRLSLVEHGSLWLSIAVLLALIVSWTYVSAISLSACVLFHLVCSLQLIHFDDYGKLLQRENDVLVFMEEHIRLRFHLSKISHRFRIYLLLQFLVVTASQFVTLLQVTGFGGALTFISGGDFAVSTLVQVVGIIIVLHAATKISHRAQGIVSLASRWHALVTCTSDSSKLRYCASTGSLEVAKHLNSMFLDYSESDLESSDYIGVPSHTQLASYMSSHNKRQAFGT

SEQ ID NO: 160239 - protein, 606 aa, Glycine max
  Coding DNA Sequence Number=SeqID_68554
  Homolog annotation: Hit_ID=A7PLW2; Match level="QueryCoverage=99%, HitCoverage=99%, E-value=2e-36, Identity=28%"; Hit description =Chromosome chr14 scaffold_21, whole genome shotgun sequence
MAESSACLVRSFSTPAEATCCDDSNHAWVSMSLGNPIRALGESISFGRFMTEGLDWEKWSTFSHNRYVEEAEKYSKPGSVAAKKAYFEAHYKRAAAERAAALIPEANAQANGTFEAQVHEGNCADSSFGTSSNVANVVAANEQLDNETANYQVVECADTDQHKCDAGQSHLDISNVKGAEDVPHPRTDTDLNVESCTFVANSYSNQLHHVEDNTYIAVPAEEKTPDHGAVGQEVLTLSVKGREANSSPKLSTKTVVAKHSRSPDERKAAVLPRSGINSGPKGKKSVGDSVEKKRLIAQSVRMSINLPSGTGETRKRTATASQSRNGTNNFSTSKKSVRGLVEKKRITAPSLRMSINLPSGAGMTSKTDTVAAKPRNGINFAAKSMKSVGNSVEKRPTKRSLHMSINLPSGAGETSKTASVLEQNGIKKNHSNISKNNPGVLRTSTKAPPKATPNQLPYLHLLDSEVKKEQLNAKRQFLQRMDETKSKEEEKVKLQRTLKGKTEHDHKKLRQRSGSISKLNEDKPGGSQSPSNQTRKISLTLPQSPKLGRKASSSSSTVQDRSLGNSWKPPISTSKRTAEKNYRTAWRPVTSSSNTTRENASPNIQQ

SEQ ID NO: 160240 - protein, 228 aa, Glycine max
  Coding DNA Sequence Number=SeqID_68555
  Gene Ontology: Mol. function=metal ion binding
  Homolog annotation: Hit_ID=A7QBV4; Match level="QueryCoverage=100%, HitCoverage=100%, E-value=5e-86, Identity=62%"; Hit description =Chromosome chr1 scaffold_75, whole genome shotgun sequence
  Pfam annotation: Domain name=zf-C3HC4; Domain location=132-169; Score= 16.3; E_value=0.0013; Accession=PF00097.16; Description=Zinc finger, C3HC4 type (RING finger)
MAMIPYHLCRLPYQDSLKALEADIQHANALAAAIPRAKGFLHRYLDLFHILIYKVHNDGRSIMPTHGRKATIGDFYAVILPSLQRLHGSLEKLEVVKEEGQSSIEGPSYGKKVIEEGVKLTANVDLQREDECGICLEPCTKMVLPGCCHAMCIKCYRKWNRKSESCPFCRGSLRRVNSEDLWVLTCNDDVVDAETVSKEDLLRFYLYVSKLPKDHPDALFLMYYEYLI

SEQ ID NO: 160241 - protein, 1287 aa, Glycine max
  Coding DNA Sequence Number=SeqID_68556
  Gene Ontology: Mol. function=metal ion binding; Biological process =macromolecule biosynthetic process
  Homolog annotation: Hit_ID=A7P452; Match level="QueryCoverage=40%, HitCoverage=92%, E-value=4e-34, Identity=27%"; Hit description =Chromosome chr1 scaffold_5, whole genome shotgun sequence
MATPNPNVVFIDTNLDTHLALVVSDLDTVSDLKKSILSEHPLCFPKIGQVQIHGIKVERKGYFYHLTDSMPVRSAFRGINGSWFLSVDVSVLRECSQNEQLFSHGSPNQVATLGIANNALIVGSPSKRVSTFDHFKLPQLENRQNEEIHVASPCVSKHTGKGVKSSADNDMETPLPGSVHETEDHCFVNRELPSLNIECEVDGSGKGIKDDHNVCEETPVSSAKKKRKNKRKKEDTAQDDTAVDNALSFPSKRASGANNELPGSRIEHEVDGTIEGIKDACIVHEEGNCKSVSNVKKKLKGKRKKLGTLQHDTSKVNDASVVGSGDYTIQQDIEVIANPSEDADKEVTKETEILKEHQHTDCNNNNTKNDIDVAASANKKHRKRKRSLAVDSKEMFKVETAIQQDEVHKSNEAHKEKKESKEQFELKNEKSRDDVEYKQDQVTEDILNTGPPAKKKRNGKEKSVEVILSKAKLINHFNGDNASHHILEDQQKIKNSNADQSAKHFDDTDPPRTSVQGRRKKGKINSSNPHETPVVTSSRKGEEADCSSIQRGVQEEISEDALSSKDNSMSKATIDNMETGTDACKEGFQYTERATGYYKNHSDIETNAHIADVDEPMELTENSENVVLDQCHKNEAGQIEGAEEGRELSPQNDSKLALLEKSTSSSQDKTDANIRELNVTSKGVDANGMTEPIKSEKEKRRMRKAKSSGGGSALREGIGLVDASESETVIMKSLSAKNCDPMSGNTETEDNPLNQTEGEKIHQEKVQGTSDKEDDFGVDNAGSLEQITTKSNERMDKRQRKKSNDKQTSTSKIISSMLTKDKVLDSKKPSPSSDSGTHGKPSVAVTKKSKSTSTKSTNKSSKTNLELVEESVRLELSDSRFNTGGKDAAQQSTRSGEKDDDNLEAINGQAHAEDLSSSQQLLSKEELDVRSHPCKKVPNVHRAGQDSKLSGRSDRAMSLFGENRKAHVNASGKSMDLEKRRKHVPVSNSKPEGSIKMVQNKAGKASGNNIHGVASKIQQKKSLLSGAIFKDDSSGTSVDEVDNSDASTRTPSYNPLLSDFSDGDSSSGLDSQVDDLEIFFMIIFIKVENVVIPKVEMKSLLVPLANFETILCFQGEYDLSLIGTTLIISLADEGSQHTPSHPGLDIWSVDKSSAITAISLADASEPKSMPDAPSPSPSPMMTPLLLRMRFSWFSAGCRMLNSTHTMAGINGNSSASPRLSPSAISAICDAAKAASQFASGSLGLFDLGDDPVIGFKHLEFIIAIVAAMVAAIAEHERAECRVPRQRQ

SEQ ID NO: 160242 - protein, 704 aa, Glycine max
  Coding DNA Sequence Number=SeqID_68557
  Gene Ontology: Mol. function=catalytic activity; Cellular component =mediator complex; Biological process=metabolic process
  Homolog annotation: Hit_ID=A7P090; Match level="QueryCoverage=90%, HitCoverage=77%, E-value=0.0, Identity=62%"; Hit description =Chromosome chr6 scaffold_3, whole genome shotgun sequence
  Pfam annotation: Domain name=TRAP_240kDa; Domain location=1-460; Score=-256.2; E_value=0.00015; Accession=PF06333.3; Description =TRAP240
MSNRYQDDWLKTSANSLQHWEKAPLEPYALQKPITYHVVCPDIDPLTSAAADFFQQLGTVYETCKLGTHSPQGLGNQIEIESAKLSSCGFVLLDCPQSMKIESSNASLVGSVIYVVCPFPDPTAILQTVIESSVAIGSVVQQSDRERRSSLHSQVVKALSGLATVDEASASNILVLSGFSIPKLVLQIVTVDAIFRVTSPSVSELVILKETSFTVYSKARRISRGISSDFAQSAFSSRSHSGLTQMPSPISGMWKDCVGPRMAGHSLPREGDIDASLRPGTWDNSWQPTRTGGLSCDPSRTGDNFLHDEIRYMFEPLFILAEPGSLENGISVIGSPTSESSKALADDSSGNYVQSTSTAGSVESASSTDASGSDPKTPPSLHCCYGWTEDWRWLVCIWTDSRGELLDCNIFPFGGISSRQDTKGLQCLFVQILQQGCLILQSCDPGLAKPRDFVIARIGGFYELEYLDMADDIDYDIRCNLLVVEKHLYSPKDNDRYKQWQKAIYSVGVSEMKRWPLQLRKSMSDGMSATSNGSSLQQSDMSLIPERTLPSSPSPLYSPHTKSPGFMKGSLGQPTARKQLIGGHSMVDNSRGLLHWAQSISFVAVSMDHTLQLVLPADSSTPGPLPLSPACHFTQFCEGFGAAVNHSRRNLLIFQGKSFDSSKVMDDALFLAWSWLKAKEKDFNISFNQWAAHWCTVISIYGTT

SEQ ID NO: 160243 - protein, 204 aa, Glycine max
  Coding DNA Sequence Number=SeqID_68558
MNILSQRKVLLMKLGQSLEIDALPLNCSAKKVVKAIPTDSTENGIEDMDVDDAKGVDKGGSDAKIEVVGVETVPDVQDVETEVAGVNKTWCIRCKKLKLELKPNLIMVQMMMKLKNMMRMLTFLIILKVTQNMYMSLQKMMDNQVTQVMIVTTLKNFSLFPTVMMNGTPILKSCILNTILEVVLDKCIWRLGWSLILLKCFLKL

SEQ ID NO: 160244 - protein, 408 aa, Glycine max
  Coding DNA Sequence Number=SeqID_68559
  Homolog annotation: Hit_ID=Q6Z7V1; Match level="QueryCoverage=95%, HitCoverage=73%, E-value=1e-101, Identity=61%"; Hit description =LMBR1 integral membrane protein-like
MACSNTFGLVTGAFLLGFGLSEIPKSIWRNADWTIRQKVLTHKIAQMAVKLDDAHQELSNAIVVAQATSKQMSKRDSLRPYMNVIDDMLTQMFREDPSFKPQGGRLGENDMDYDTDEKSMATLRRHLRGAREEYYRYKSEYMTYVLEALELEDTIKNYERRNSTGWEYNSSIRPARTGKLGSLCDTLGNNENYRKQVEKGLAVILGIMSVAILLAEATLLPSIDLSLFSILIKSVGTQEVLVQRSWLEQGCKVGEQVVPLARNFNNIDIESSNNFMERNGAEMKPTSNLITDEINGRLSKTSKEDTSRSREAITKKYAVVREQGRPASKLKSEEKNAASADSLSDEGNTNSSNSSGGSSSGLTSTWQSMKTGFQSFKGKIVCYTETPIRLQINLTQNLDVPVDGVTDV

SEQ ID NO: 160245 - protein, 318 aa, Glycine max
  Coding DNA Sequence Number=SeqID_68560
  Gene Ontology: Mol. function=cysteine-type peptidase activity; Cellular component=nucleus; Biological process=ubiquitin-dependent protein catabolic process
  Homolog annotation: Hit_ID=A7QA78; Match level="QueryCoverage=99%, HitCoverage=78%, E-value=1e-141, Identity=78%"; Hit description =Ubiquitin carboxyl-terminal hydrolase
  Pfam annotation: Domain name=UCH; Domain location=1-309; Score=179.4; E_value=9.5e-51; Accession=PF00443.20; Description=Ubiquitin carboxyl- terminal hydrolase
MISSQKKKTGVIAPKRFVQRLKKQNELFRSYMHQDAHEFLNFLLNELVDILEKEAQAAKNDQETSPPSEKAANGPKNSLANGAKKEPLVTWVHKNFQVTLTYQFKVFILACCVKVKNLDAKYKGILTNETRCLRCETVTARDETFFDLSLDIEQNSSITSCLKNFSSTETLNAEDKFFCDKCCSLQEAQKRMKIKKPPHVLVIHLKRFKYIEQLGRYKKLSYRVVFPLELKLSDTAEDADIEYSLFAVVVHVGSGPNHGHYVSLVKSHNHWLFFDDENVEMIDESAVQTFFGSSQEYSSNTDHGYILFYESIGSGNRN

SEQ ID NO: 160246 - protein, 538 aa, Glycine max
  Coding DNA Sequence Number=SeqID_68561
  Gene Ontology: Mol. function=asparagine synthase (glutamine -hydrolyzing) activity; Cellular component=phagocytic vesicle; Biological process=asparagine biosynthetic process
  Homolog annotation: Hit_ID=Q14SM9; Match level="QueryCoverage=99%, HitCoverage=100%, E-value=0.0, Identity=92%"; Hit description =Asparagine synthetase, type III
  Pfam annotation: Domain name=Asn_synthase; Domain location=178-419; Score=345.7; E_value=8e-101; Accession=PF00733.12; Description =Asparagine synthase
  Pfam annotation: Domain name=GATase_2; Domain location=3-130; Score= -0.3; E_value=3.2e-09; Accession=PF00310.12; Description=Glutamine amidotransferases class-II
  Pfam module annotation: Pfam domain module=Asn_synthase::GATase_2; Domain location=178-419::3-130
AMCGILAVLGCVDNSQTKRARIIELSRRLRHRGPDWSGIHCYEDCYLAHQRLAIVDPTSGDQPLYNEDKTVIVTYEEHGEEFVNMLDGMFAFILLDTRDKSFIAARDAIGITPLYLGWGHDGSTWFASEMKALSDDCERFISFPPGHIYSSKQGGLRRWYNPPWFSEDIPSTPYDPTLLRETFERAVVKRMMTDVPFGVLLSGGLDSSLVAAVVNRYLAESESARQWGSQLHTFCIGLKGSPDLKAAKEVADYLGTRHHELYFTVQEGIDALEEVIYHIETYDVTTIRASTAMFLMSRKIKALGVKMVLSGEGSDEIFGGYLYFHKAPNKKEFHEETCRKIKALHLYDCLRANKSTAAWGVEARVPFLDKEFINVAMSIDPEWKMIRPDLGRIEKWVLRNAFDDDKNPYLPKHILYRQKEQFSDGVGYSWIDGLKDHANKQVTDATMMAANFIYPENTPTTKEGYLYRTIFEKFFPKNAAKATVPGGPSVACSTAKAVEWDAAWSKNLDPSGRAALGIHDAAYDAVDTKIDEPKNGTL

SEQ ID NO: 160247 - protein, 59 aa, Glycine max
  Coding DNA Sequence Number=SeqID_68562
  Gene Ontology: Mol. function=Rho GDP-dissociation inhibitor activity; Cellular component=cytoplasm
  Homolog annotation: Hit_ID=A7PX23; Match level="QueryCoverage=71%, HitCoverage=18%, E-value=9e-11, Identity=71%"; Hit description =Chromosome chr12 scaffold_36, whole genome shotgun sequence
MAWKHSSDGNFTCLTIISPDRDDIVLPIPENENPKGLWFTTKEGSHYRLKFTFNVQTER

SEQ ID NO: 160248 - protein, 207 aa, Glycine max
  Coding DNA Sequence Number=SeqID_68563
  Gene Ontology: Mol. function=catalytic activity; Biological process =metabolic process
  Homolog annotation: Hit_ID=A7P090; Match level="QueryCoverage=88%, HitCoverage=21%, E-value=1e-77, Identity=76%"; Hit description =Chromosome chr6 scaffold_3, whole genome shotgun sequence
  Subcellular localization annotation: CTP_CleavageSite=58; ConfidenceScore=5.11e-01
KTFGRGTESGGGGGLSISGYIEGFTPVKSLGSTSSAYILIPSPSMRFLPTTVLQLPTCLTAESPPLAHLLHSKGSALPLSTGFVVSKAVPSMRKDYRANQKEEWPSVLSVSLIDYYGGTNIPQEKIVRGINKQGGRSLSWEAKDFEIETHLVLESLAAELHALSWMTVSPTYLERRTALPFHCDMVLRLRRLLHFADKELSKQSEKS

SEQ ID NO: 160249 - protein, 375 aa, Glycine max
  Coding DNA Sequence Number=SeqID_68564
  Gene Ontology: Mol. function=metal ion binding; Cellular component =cytoplasm; Biological process=cell redox homeostasis
  Homolog annotation: Hit_ID=A7P0C3; Match level="QueryCoverage=90%, HitCoverage=92%, E-value=1e-106, Identity=56%"; Hit description =Chromosome chr6 scaffold_3, whole genome shotgun sequence
  Pfam annotation: Domain name=zf-C3HC4; Domain location=268-308; Score= 43.6; E_value=7.2e-10; Accession=PF00097.16; Description=Zinc finger, C3HC4 type (RING finger)
MARFDHFWNLDEFIVSTLTTDRLKRNIVEETMAARYWCHMCSQMVNPIMDMEIRCPFCQSGFVEEMGNTPSSSSIPNTSESDFESDRALSLWAPILLGMMGNPRHPRRLRQIANDNGNRDYVDGVADHGRETEYDQEFESILRRRRNSATILQLLQGIRTGLASESYENTDGHDHDREREREREREHMILINPLNQTIIVQGSYESNRDQSDNHSSVGSLGDYFTGPGFDILLQHLAENDPNRYGTPPAQKEAIEALPTVIINENSQCSVCLDDFEVGSEAKEMPCKHRFHSGCILPWLELHSSCPVCRLQLPLDESKQDSDLSRDSRSQREDESIEHDNDEERDGEGRNASGGRRFSFPWPFNGLFSSSNSSSS

SEQ ID NO: 160250 - protein, 358 aa, Glycine max
  Coding DNA Sequence Number=SeqID_68565
  Gene Ontology: Mol. function=hydrolase activity; Biological process =DNA repair
  Homolog annotation: Hit_ID=A7P071; Match level="QueryCoverage=76%, HitCoverage=88%, E-value=1e-132, Identity=79%"; Hit description =Chromosome chr6 scaffold_3, whole genome shotgun sequence
  Pfam annotation: Domain name=Abhydrolase_1; Domain location=103-336; Score=29.7; E_value=1.1e-05; Accession=PF00561.11; Description =alphabeta hydrolase fold
  Subcellular localization annotation: CTP_CleavageSite=42; ConfidenceScore=5.49e-01
MAMSVGVALPSTTTSLSFLRYRSRSPIQNKIRFPRQIVSKLNSAEVQVQTCLQALYCSVWDWRGYSIRYQHSGNIGPALVLVHGFGANSDHWRNNISVLAQSHRVYSIDLIGYGYSDKPNPRQIGDHSFYTFETWATQLNEFCLDVIKDEAFFICNSIGGVVGLQAAVLAPHICQGIILLNISLRMLHIKKQPWYGKPFIRSLQRLLRDTDVGKFFFKTIATKESVRNILCQCYHDTSKVTDELVQIILGPGLEPGAAEVFLEFICYSGGPLPEELLPQVKCPILIAWGDKDPWEPIDIGRNYENFDSVEDFIVLPNVGHCPQGSFFTTCLTSFMSGSHYLLEGLAKCNYICPGTSKL

SEQ ID NO: 160251 - protein, 38 aa, Glycine max
  Coding DNA Sequence Number=SeqID_68566
MGLLDMQEWSCPLRPFWANISPACSGPFATMDWPSSRR

SEQ ID NO: 160252 - protein, 157 aa, Glycine max
  Coding DNA Sequence Number=SeqID_68567
  Gene Ontology: Mol. function=metal ion binding; Biological process =metal ion transport
  Homolog annotation: Hit_ID=A7PL53; Match level="QueryCoverage=100%, HitCoverage=100%, E-value=3e-51, Identity=68%"; Hit description =Chromosome chr7 scaffold_20, whole genome shotgun sequence
  Pfam annotation: Domain name=HMA; Domain location=34-94; Score=59.6; E_value=1e-14; Accession=PF00403.17; Description=Heavy-metal -associated domain
MGVGDYWSDLMGSGNGNHQHNNKNKNKKQLQTVELKVMMDCDGCVLKVRKTLSSLDGVESVEINRKQQKVTVTGYVEPNKVLKKAKSTGKKAEIWPYVPFNMVANPYTVQAYDKKAPPGYVRRVDNSAATIGTVTTAYADSYTTMFSDENPNACSIM

SEQ ID NO: 160253 - protein, 102 aa, Glycine max
  Coding DNA Sequence Number=SeqID_68568
  Subcellular localization annotation: CTP_CleavageSite=51; ConfidenceScore=5.56e-01
MDFTTFANSISSSHAIPPIHTYRLQPSPFPLHLPFSNLKRSGLVKNRLIARCTSMSDEFGSVNGLQFSPNKLFVEERKLNHLMGKWLNEPSLMKLIVEALFL

SEQ ID NO: 160254 - protein, 515 aa, Glycine max
  Coding DNA Sequence Number=SeqID_68569
  Gene Ontology: Mol. function=nucleic acid binding
  Homolog annotation: Hit_ID=A7Q3R9; Match level="QueryCoverage=99%, HitCoverage=98%, E-value=1e-172, Identity=56%"; Hit description =Chromosome chr13 scaffold_48, whole genome shotgun sequence
  Pfam annotation: Domain name=PLAC8; Domain location=285-417; Score =126.8; E_value=6.3e-35; Accession=PF04749.8; Description=PLAC8 family
MVSVDDGIVNPNDEIEKSNGSKVNEFASMDISATQKSYLNSEDPQRRLQGTLISSSVTNRINFLKFGSASAKFKRLATERDQVSISVPSPRSKSLRSRFSGMFAQKLDWASVKKMCMEWIRNPVNMALFVWIICVAVSGAILFLVMTGMLNGVLPRKSKRNACLRKVYCKNVTYKPHEWTHMMVVVILLHVNCFAQYALCGLNLGYKRSERPAIGVGICISFAIAGLYTILSPLGKDYDCEMDEEAQVQITASQGKEQLREKPTEKKYSFASKDQQRVVENRPKWSGGILDIWNDISLAYLSLFCTFCVLGWNMKRLGFGNMYVHIAIFMLFCMAPFWIFLLASVNIDDDNVRQALAAVGIILCFLGLLYGGFWRIQMRKRFNLPAYDFCFGKPSASDCTLWLPCCWCSLAQEARTRNNYDLVEDKFSRKETDTSDQPSISPLAREDVVSTRSGTSSPMGSTSNSSPYMMKTSSSPNSSNVLKGYYSPDKMLSTLNEDNCERGQDGTMNPLYAQK

SEQ ID NO: 160255 - protein, 199 aa, Glycine max
  Coding DNA Sequence Number=SeqID_68570
  Gene Ontology: Mol. function=binding
  Homolog annotation: Hit_ID=A7Q3S2; Match level="QueryCoverage=85%, HitCoverage=64%, E-value=1e-54, Identity=65%"; Hit description =Chromosome chr13 scaffold_48, whole genome shotgun sequence
  Pfam annotation: Domain name=Arm; Domain location=88-129; Score=16.6; E_value=0.084; Accession=PF00514.14; Description=Armadillobeta -catenin-like repeat
MTNFVRLWNHSVENEKNEIDELTIEEEAERKVGWLLKTIFFVTAGVAGYHFFPYMGENLMQQSVSLLRVKDPLFKRMGASRLARFAVDDERRKKIVEMGGAQELLNMLSTAKDDRTRKEALHALDALSQSVLASTSLFCSLSIEISYFNVIDEALASLHHAGAISVIRSAPNSLEDAEVEGFKLSLMKRFQDLRYDVPS

SEQ ID NO: 160256 - protein, 254 aa, Glycine max
  Coding DNA Sequence Number=SeqID_68571
  Homolog annotation: Hit_ID=A7Q3Q5; Match level="QueryCoverage=85%, HitCoverage=52%, E-value=3e-72, Identity=53%"; Hit description =Chromosome chr13 scaffold_48, whole genome shotgun sequence
  Subcellular localization annotation: CTP_CleavageSite=50; ConfidenceScore=5.71e-01
MAPTKTALPSSDFQTLTPLLPTTFQTFSTFQTFFLHPLSRQASHMIMKLLGSNLEELWMRSLNLALYCHLMVMDVENSKSSPASERLQFSLRYHHVEGVLQFNHKVLIKDEWAEIMVDIDNVRCDVIELVNEFLMKQRGAGAAEKHFPSRISLQLTPTIQDQVLSLSVGKSSENPRKEIGVDKSVEASFEASNPLALKVSAGESPQPLVYGYSANLNWFLHDSVDGKEVLSSKPSKFAMLNPKSWFKNRYSSAY

SEQ ID NO: 160257 - protein, 122 aa, Glycine max
  Coding DNA Sequence Number=SeqID_68572
MYTRVGKEIFVFDSQRNIGENLGYLVNPWTRFSDLIRHPTDHRLPLSEAILTSMFTQTSQVAGNPFPHHKSKKICAPSLRRGQGRWGPWQELDDEGDDNGLKVDKLTTHRPHCRLKHRSPMR

SEQ ID NO: 160258 - protein, 76 aa, Glycine max
  Coding DNA Sequence Number=SeqID_68573
MYKSVEAIRMGSLHGSKNNLDELLSAKAVAESLLHALTWIKNQNFQNIDIEMNAKVIEDRLYNNFTGSSYLQVLIN

SEQ ID NO: 160259 - protein, 115 aa, Glycine max
  Coding DNA Sequence Number=SeqID_68574
  Gene Ontology: Mol. function=phosphoinositide phospholipase C activity; Biological process=intracellular signaling cascade
  Homolog annotation: Hit_ID=P93620; Match level="QueryCoverage=88%, HitCoverage=18%, E-value=3e-35, Identity=70%"; Hit description =Phosphoinositide-specific phospholipase C
  Pfam annotation: Domain name=efhand_like; Domain location=26-103; Score=13.1; E_value=0.0014; Accession=PF09279.2; Description =Phosphoinositide-specific phospholipas
MASHNYKVFSCFNRKFTVTEPGPPPDVQKAFSEFADGASSLSGDHLLRFLAKHQGEVDCTAVDSERILQQSRKEDRESGLDLHDFFRFLLHDDFNSPIKSQVGEASLSCLSCFES

SEQ ID NO: 160260 - protein, 154 aa, Glycine max
  Coding DNA Sequence Number=SeqID_68575
  Subcellular localization annotation: CTP_CleavageSite=55; ConfidenceScore=5.23e-01
MQEHGTHAEGLVSATSVVQAYVLSAARHGLVGVAAPTTVTSNAGLRKVQLMEPVTCSRSPAFAPRAPCQAPALNWHHKFEFVIALYIPRMNFFVYGYVKHGSQNCELNAFLSQIEKMINNFWWWCSSKKERKIRWLNWEKMFKLKSVGGIRFGT

SEQ ID NO: 160261 - protein, 552 aa, Glycine max
  Coding DNA Sequence Number=SeqID_68576
  Homolog annotation: Hit_ID=A7Q719; Match level="QueryCoverage=57%, HitCoverage=93%, E-value=3e-45, Identity=38%"; Hit description =Chromosome chr5 scaffold_58, whole genome shotgun sequence
MSRCFPFPPPGYEKKATAQDVDVLTKGKGSKHNLLLELNKQLVIVINLLVLQMGKEKHREKKHKKEKRDKEKKESKEKRDKEGRDGKHKEKRDKKEKHREKKKDKDKDRDKDKSKTSAAIEKDFPGQAQGPNAGKLHQKEIKPNDKKAILLEDKLTKQFASNNGEKVRENNHLAEENKDSKFLLELDKRIRDNDGGAENQLAQKFTTAGHRKNDGAVRLVTKGSDTWPDGKERLQDKGIDTRKVDRRGIWGESRPVGNATVQNNAGKFHPRVDEMPKSLENNIYKPLEATVEGKERRVKGKKDDKHGDKKKNKEKGKKGHGKDKDRSKEKKKEEKAKENVEHENREQQNKLKESSKAGTIGSNSFTQVSRHSCEKSAVGENLKKRKDIESNGIMHANDSWPSKLPKPSPSLSHLTENGRILEPCQISLQNTSDRLAAASNIKVDNKERKINGIIEALPSTVSSKTPTPIATMPAPVSEASAKPPHPDSKYISQVYSVPKVDEWSDFDDQEWLFGSSHWQGRTPAVKSSEVEDTLQVAHDTSKIPDLLKEPSI

SEQ ID NO: 160262 - protein, 730 aa, Glycine max
  Coding DNA Sequence Number=SeqID_68577
  Gene Ontology: Mol. function=zinc ion binding; Cellular component =COPII vesicle coat; Biological process=ER to Golgi vesicle-mediated transport
  Homolog annotation: Hit_ID=A7NX00; Match level="QueryCoverage=99%, HitCoverage=99%, E-value=0.0, Identity=64%"; Hit description =Chromosome chr5 scaffold_2, whole genome shotgun sequence
  Pfam annotation: Domain name=Gelsolin; Domain location=598-688; Score= 62.5; E_value=1.4e-15; Accession=PF00626.13; Description=Gelsolin repeat
  Pfam annotation: Domain name=Sec23_BS; Domain location=374-476; Score= 101.1; E_value=3.4e-27; Accession=PF08033.3; Description=Sec23Sec24 beta-sandwich domain
  Pfam annotation: Domain name=Sec23_helical; Domain location=489-589; Score=159.2; E_value=1.1e-44; Accession=PF04815.6; Description =Sec23Sec24 helical domain
  Pfam annotation: Domain name=Sec23_trunk; Domain location=116-363; Score=230.6; E_value=3.5e-66; Accession=PF04811.6; Description =Sec23Sec24 trunk domain
  Pfam annotation: Domain name=zf-Sec23_Sec24; Domain location=50-89; Score=67.3; E_value=5.3e-17; Accession=PF04810.6; Description =Sec23Sec24 zinc finger
  Pfam module annotation: Pfam domain module=Gelsolin::Sec23_BS::Sec23 _helical::Sec23_trunk::zf-Sec23_Sec24; Domain location=598-688::374 -476::489-589::116-363::50-89
MDLVELEAVEGLRWAWNSWAADGTNMIIPLSIMCTPLMLLNSEVPLLPYDPLLCSRCGAVLNPYARLDYQSRIWHCPFCSLRNPFPRPIADTNLPAELFPTYSTVEYSSPSPSPPPPPPAFVFLLDLSTPQDELPPLKNQLLHLLHHLPDHSLVSLITFDSMVYLHHLSSSHFSSLLVFHGNRHLSSNQIRHFLNPHRHQAFLLPISECQFSITTAIEEIHSTSNSTISASRPPRCTGSAISVALGLLESCPINTGSRILVFTSGPATLGPGIVVDSDRRQPIRTHHHIFNAQATHYAKSSAFYNQLSKRLSGASVVLDLFACSLDQVGAAELRGPVEHSGGFIVLSESFDSDQFKNCLRQMFRCDDQGHLRMNFDATIEIVTTKDVKICGALGPCVSLERNNCLVSEAEVGEGGTSVWKLNTLTHKTCIAFFFQVNQEQKMKIQPGSAFLIQFITRYRQGNMIRKRVTTAARRWVASHSADIGAGFDQEAAAAVMARLAILRAETCHARDVIRWLDDTLIRFTSKFGDYVPEDPSSFRLSSNFSLYPQFMYHLRRSQFIDVSNTTPDETAFFRLVLNREGVVGSLIMIQPTLFQYSFDGPPVPVLLDIRSISPDFILLFDSFFCVVIHYGSKIAQWRKLGYDKDPNHESLRKLLEAPELDAEQLVADRLPVPRIIRCDQHSSQARFLLAKLNPSVTQNSTYTEGSDIIFTDDLSLEVFLDQLQVLAVQS

SEQ ID NO: 160263 - protein, 986 aa, Glycine max
  Coding DNA Sequence Number=SeqID_68578
  Gene Ontology: Mol. function=solute:hydrogen antiporter activity; Cellular component=integral to membrane; Biological process =regulation of pH
  Homolog annotation: Hit_ID=A7NY62; Match level="QueryCoverage=77%, HitCoverage=95%, E-value=1e-157, Identity=36%"; Hit description =Chromosome chr6 scaffold_3, whole genome shotgun sequence
  Pfam annotation: Domain name=Na_H_Exchanger; Domain location=28-413; Score=74.0; E_value=4.9e-19; Accession=PF00999.12; Description =Sodiumhydrogen exchanger family
MFLSITPVDEATHRYTVCLAAPPHIVSDGLWGSAAANRKPMKSFLPLFELQMLAGLILQACFALDPFASYMRLLFPYGTHDTITTISSIGFVLFIFINGVQMDFGLITRMGKRAWTIAISGLLVPIFCAISILSLFPFGHSGNYDDLVVALVSHTVISFAVISSFLNELQIQNSELGKLALSSALISDVLCTIVTSTGTAVMVTEDSNVKEVTRNILSLICMGILIPLVCRPAMLWIIKHTPEGRAVKDGYVYVIIVLLFILGWLSVKINQEFVLGAFILGLSVPEGPPLGSALVKKLNFFGTTFLLPIFVSISVLKADFSATHSSTSVMTMTFVVIFTHLVKIIACLVPSLYCNMPWRDALSLALILNTKGVVEIGLFCFLYDTKVIDGLGFGVMILSIMVVACIVQWSVKFLYDPSRKFAGYQKRNMMNLKPWSELRMLVCIHKPSHISSMIDVLDLCCPTTESPIIVEVLHLIELVGRALPIFIPHRLRRQASGLQHKSYSDDVILTFDIYEHDNPHAVSAYPCTAIAPPNLMHEDVCNLAFDKVASIIILPFHQRWSSDGEVQFDDKNIRTLNNRVLEISPCSVGILVTRASHQIRGSTTRLALIYLGGHDDEEALCIARRAIRNPEVNLVVYHLVFKEDDEWGQEVDDELEDVKHAHEHNIRYQQIIAKEGAQTAAFLSDIVKEHDFFLVGRRHGIESPQTDGLTDWSEFPELGVIGDFLASPDLESRASILVVQQQLSSKAHSGWVYFFVLMLQQFELDNKIDEMKLVLKSLQNLQFTVKWFEVVEQIEYAFMELKVLAFGENCIRLSLQTYMPTFVGISYLPRVEATVDTAELNHELLIEVFEGTMRSKNVQVFPNDIYVNDIVDTAKFVSKSSLQWFIQKVQDRIILSTLRHLVVKDANKSRYSLEYLDKDKTIVVHMAGGIDAYIKLSLGWPIFVSPLKLICIKGSDDLKRTSLSFRCKVEAFSVWHQGFKLKNVHT

SEQ ID NO: 160264 - protein, 495 aa, Glycine max
  Coding DNA Sequence Number=SeqID_68579
  Gene Ontology: Mol. function=solute:hydrogen antiporter activity; Cellular component=integral to membrane; Biological process =regulation of pH
  Homolog annotation: Hit_ID=A7R3F8; Match level="QueryCoverage=94%, HitCoverage=52%, E-value=1e-76, Identity=32%"; Hit description =Chromosome chr4 scaffold_519, whole genome shotgun sequence
  Pfam annotation: Domain name=DUF939; Domain location=22-270; Score= -176.3; E_value=0.094; Accession=PF06081.2; Description=Bacterial protein of unknown function (DUF939)
MYKEPGFPMVSHILADLKLLYPGLGKVALATAMISDFYNWVMFALLVPFAINGGSIIYSVLSTLAFVLFCFIVGTHPVVGALVYGMMIPRVLLLSFIPKILSTVIASQFYGMSVLDGVSIGLLMNTKGILPILMLNNAWDKQILSVESFSILTVAVVMMTMTVPLIINAIYKLRKLYKQSKLKTIQNLKAEIELRILACVHNPRQATGMINILDACHTTKLSPLRVFALQLVELSGNTTSLFNQQRSGGAQALTKAQEDLESITNIFQTYTGANENTSVETFAAASTYSNIHEDIYNVSQEKQASLMRDAPCSVGIIVDRGLGSLFKVNLRVLVLFIGGPDDREALAVAWRMSKHQGVQLSVMRILIEKQKKLDEEYVSAFRLKAVSNEDSIKYSEKEVRCRDDIPQDKEQVGTRNSLILSELIQWAHCPELGVIGDMVASNNFGSSSSVLVGQKYGYGGVVFDNSNAATQQQPREVMPADDDNDDSGALAVKIE

SEQ ID NO: 160265 - protein, 574 aa, Glycine max
  Coding DNA Sequence Number=SeqID_68580
  Gene Ontology: Mol. function=arginyltransferase activity; Cellular component=cytoplasm; Biological process=regulation of protein catabolic process
  Homolog annotation: Hit_ID=Q9ZT48; Match level="QueryCoverage=99%, HitCoverage=92%, E-value=1e-163, Identity=52%"; Hit description =Arginyl-tRNA--protein transferase 1
  Pfam annotation: Domain name=ATE_C; Domain location=278-434; Score =329.0; E_value=8.8e-96; Accession=PF04377.6; Description=Arginine -tRNA-protein transferase, C terminus
  Pfam annotation: Domain name=ATE_N; Domain location=1-64; Score=90.9; E_value=4e-24; Accession=PF04376.4; Description=Arginine-tRNA-protein transferase, N terminus
  Pfam annotation: Domain name=Arg_tRNA_synt_N; Domain location=162 -232; Score=-1.8; E_value=0.089; Accession=PF03485.7; Description =Arginyl tRNA synthetase N terminal do
  Pfam module annotation: Pfam domain module=ATE_C::ATE_N::Arg_tRNA _synt_N; Domain location=278-434::1-64::162-232
MWAHSLTVDDYQDLLDRGWRRSGCFLYKPEMERTCCPSYTIRLKASDFVPSKEQLRVSRRMQRFLDGTLDVKKVDVMEDPTKSGIFTRPMSEESLAAGSENKDEVEKSLHYLSNQIDNVIHILIEKGEFPSGIQLPNASVKRVSQGKRKLLVNGSEDLLYSSNIAFQIAASIKRAQSCDKVVDDSKPARVCEKENDSSPKIIAEKLVASLDPTVKNSDLSIRACNGHINFYASSKQVSLNRSVQNAPVPKISRMKHDSGGNCLIGQVKRQKLEIRLNRSSFDPEEFALYRRYQLKVHNDKPQNVTENSYRRFLVDTPLIQVSPTGDSTVPPCGFGSFHQQYLIDGQLVAVGVIDILPKCLSSKYLFWDPDFAFLSLGKYSAFQEIGWVKENQVYCPSLQYYYLGYYIHSCSKMRYKAAYRPSELLCPLRYQWVPFDIARPLLDRKPYVVLSDSSILQNGESSLPQTTEDVMRRGFDDVGQEDANDVPMLDDEEMVESESECSDDEPDLETTSDDDPEIADVSKVLLGIKGSHVKYKDLRVVFGPEQQSYLESQLRRYRKVVGPLLSERIVYSLG

SEQ ID NO: 160266 - protein, 316 aa, Glycine max
  Coding DNA Sequence Number=SeqID_68581
  Gene Ontology: Mol. function=structural constituent of ribosome; Cellular component=ribonucleoprotein complex; Biological process =ribosome biogenesis and assembly
  Homolog annotation: Hit_ID=Q307Z8; Match level="QueryCoverage=87%, HitCoverage=86%, E-value=1e-120, Identity=78%"; Hit description=60S acidic ribosomal protein P0
  Pfam annotation: Domain name=Ribosomal_60s; Domain location=234-315; Score=56.6; E_value=8.8e-14; Accession=PF00428.10; Description=60s Acidic ribosomal protein
  Pfam annotation: Domain name=Ribosomal_L10; Domain location=6-110; Score=155.2; E_value=1.8e-43; Accession=PF00466.11; Description =Ribosomal protein L10
  Pfam module annotation: Pfam domain module=Ribosomal_60s::Ribosomal _L10; Domain location=234-315::6-110
MARKLTKAQKKIAYDAKLCKLLDNYTQILVVAADNVGSNQLQNIRHGLRGDSVILMGKNTMMKRTIKIHAQNTGNTTILNLIPLLVGNVGLIFTKGDVKEVKEVVSKYKVAAPARVGLVAPIDVVVPPGNTGLDPSQTSFFQVLNIPTKINKGTVEIITPVELIMKGDKVGSSEAALLSKLAIRPFSYGLAVVSVYENGSVFSPEVLDLTEDDLVVKFAEGVCMVSSLSLAISYPSIAAAPHMFVNSYKNILAVAVATEYSFPEADKVKEYLKDPTVVAAPATKSGAAPAAASKVEDKKEEAADESDDDMGFSLFD

SEQ ID NO: 160267 - protein, 163 aa, Glycine max
  Coding DNA Sequence Number=SeqID_68582
MPQLVSWHPPRQDFVALNTNGNVSREECKAGTGGLIREGSSNWLLGFSGRVYHNASPIFLWEGDAFDGGCGDGMAAMYSKNEMNLKEVLDGYDKAVEALGNVSNIKDVYVEDQELEMELGFWEVSMDEAPYLKDINMWLYGGFTQLKPLQNMFKLVDHRREMQ

SEQ ID NO: 160268 - protein, 449 aa, Glycine max
  Coding DNA Sequence Number=SeqID_68583
  Gene Ontology: Mol. function=racemase and epimerase activity, acting on carbohydrates and derivatives; Cellular component=integral to membrane; Biological process=carbohydrate metabolic process
  Homolog annotation: Hit_ID=A7Q721; Match level="QueryCoverage=97%, HitCoverage=97%, E-value=0.0, Identity=82%"; Hit description =Chromosome chr5 scaffold_58, whole genome shotgun sequence
  Pfam annotation: Domain name=3Beta_HSD; Domain location=105-392; Score=-78.8; E_value=3.5e-05; Accession=PF01073.10; Description=3 -beta hydroxysteroid dehydrogenaseisomerase family
  Pfam annotation: Domain name=Epimerase; Domain location=104-361; Score=203.0; E_value=7.2e-58; Accession=PF01370.12; Description=NAD dependent epimerasedehydratase family
  Pfam annotation: Domain name=NAD_binding_4; Domain location=106-332; Score=-68.6; E_value=0.00024; Accession=PF07993.3; Description=Male sterility protein
  Pfam annotation: Domain name=RmlD_sub_bind; Domain location=102-412; Score=-186.5; E_value=0.07; Accession=PF04321.8; Description=RmlD substrate binding domain
  Pfam annotation: Domain name=adh_short; Domain location=102-272; Score=-33.3; E_value=0.0019; Accession=PF00106.16; Description=short chain dehydrogenase
  Pfam module annotation: Pfam domain module=3Beta_HSD::Epimerase::NAD _binding_4::RmlD_sub_bind::adh_short; Domain location=105-392::104 -361::106-332::102-412::102-272
  Subcellular localization annotation: CTP_CleavageSite=40; ConfidenceScore=5.00e-01
MGSSSPPDTSKSIKLERYNSYIRRLNSTKLLNASSKLLFRATLLVALILVFLFTFNYPPLSATDSTHRHLHAHSHYFLSSSSFGAWEKQVRHSASPRRPNGLTVLVTGAAGFVGSHCSLALKKRGDGVLGLDNFNNYYDPSLKRARQAMLWKHQVFIVEGDLNDTPLLQKLFDLVPFTHILHLAAQAGVRYAMQNPQSYVTANIAGFVNLLEAAKSANPQPAIVWASSSSVYGLNTQNPFSELHRTDQPASLYAATKKAGEEIAHTYNHIYGLSLTGLRFFTVYGPWGRPDMAYFFFTKDILHGKTIDVYQTPEGKQVARDFTYIDDIVKGCLGALDSAQKSTGSGGKKRGPAQLRVYNLGNTSPVPVGTLVSILEGLLKTKAKKHVIKMPSNGDVPFTHANVSLAFRDFAYKPTTDLSTGLSKFVKWYLGYYGLQPSLKKDNHLHNIE

SEQ ID NO: 160269 - protein, 258 aa, Glycine max
  Coding DNA Sequence Number=SeqID_68584
  Gene Ontology: Cellular component=extracellular region; Biological process=cellulose and pectin-containing cell wall organization and biogenesis
  Homolog annotation: Hit_ID=A5BPE2; Match level="QueryCoverage=100%, HitCoverage=100%, E-value=1e-134, Identity=83%"; Hit description =Putative uncharacterized protein
  Pfam annotation: Domain name=DPBB_1; Domain location=67-154; Score =166.6; E_value=6.4e-47; Accession=PF03330.9; Description=Rare lipoprotein A (RlpA)-like double-psi be
  Pfam annotation: Domain name=Pollen_allerg_1; Domain location=165 -242; Score=161.6; E_value=2.1e-45; Accession=PF01357.12; Description= Pollen allergen
  Pfam module annotation: Pfam domain module=DPBB_1::Pollen_allerg_1; Domain location=67-154::165-242
MAMLNIIAIVSLLLLMIPSQAKIPGVYSGGPWQSAHATFYGGSDASGTMGGACGYGNLYSQGYGVNTAALSTALFNNGFSCGACFEIKCTDDPKWCHPGNPSIFVTATNFCPPNYALPSDNGGWCNPPRPHFDLAMPMFLKIAQYRAGIVPVSYRRVPCRKEGGMRFTINGFRYFNLVLITNVAGAGDIMRASVKGSKTEWMSMSRNWGQNWQSNAVLVGQSLSFRVTGGDRRTSTSWNIVPRNWQFGQTFAGKNFRI

SEQ ID NO: 160270 - protein, 40 aa, Glycine max
  Coding DNA Sequence Number=SeqID_68585
MEGHNTNDEGKSEGCGGGCKMGDSEDGGGCRGGATMRVEG

SEQ ID NO: 160271 - protein, 30 aa, Glycine max
  Coding DNA Sequence Number=SeqID_68586
MCERQELVWDKELVHDRQELTLDTMCDDKS

SEQ ID NO: 160272 - protein, 486 aa, Glycine max
  Coding DNA Sequence Number=SeqID_68587
  Gene Ontology: Mol. function=RNA-directed DNA polymerase activity; Cellular component=intracellular; Biological process=RNA-dependent DNA replication
  Homolog annotation: Hit_ID=A7PR97; Match level="QueryCoverage=94%, HitCoverage=63%, E-value=1e-149, Identity=56%"; Hit description =Chromosome chr14 scaffold_26, whole genome shotgun sequence
  Pfam annotation: Domain name=PPR; Domain location=106-139; Score=5.8; E_value=1.6; Accession=PF01535.11; Description=PPR repeat
  Pfam annotation: Domain name=PPR; Domain location=140-174; Score =18.3; E_value=0.029; Accession=PF01535.11; Description=PPR repeat
  Pfam annotation: Domain name=PPR; Domain location=175-208; Score=7.6; E_value=0.98; Accession=PF01535.11; Description=PPR repeat
  Pfam annotation: Domain name=PPR; Domain location=318-352; Score =30.6; E_value=5.8e-06; Accession=PF01535.11; Description=PPR repeat
  Pfam annotation: Domain name=PPR; Domain location=353-387; Score =27.0; E_value=7.2e-05; Accession=PF01535.11; Description=PPR repeat
  Pfam annotation: Domain name=PPR; Domain location=423-457; Score =11.4; E_value=0.35; Accession=PF01535.11; Description=PPR repeat
  Pfam module annotation: Pfam domain module=PPR::PPR::PPR::PPR::PPR::PP R; Domain location=106-139::140-174::175-208::318-352::353-387::423 -457
  Subcellular localization annotation: CTP_CleavageSite=6; ConfidenceScore=5.15e-01
MEESPRGRRKRAHPSSPSPPSPISKKPQTFPSFQDIPNLPSNIKSLCHLIATTSAATVEHSLQSAAISVIPHDVEEVLKLSYGFPGQSVKFFRWSGRHLNDNHTPYSWNLVVDILGRNRFFDPMWDAVKSMNKEGLLSLATFASVFSSYVAADRIREAIMAFEIMDNYGCVRDAFALNSLLSAICSNGRTLDACDYLQVAKKFVRPDTDTYAILMEGWEGEKSMVSAKETFAEMVIEIGWDPANVPAYDSFLCTLVRGHDGLLEAIKFVDSMRDRRCYPGVRFLKAALDECVKCHDVRTAEFFWEVLVVGKVLQPTSEMYNLMIGLCCYRGDTDAARRMLHEMVYQGAFPDVVTYNLLFKFLLKGRKLREASSVFAEMVQNECVPEQDNCDLAVKAYVDCGEPVMAIKVWKCLVENYKKGLEQTANFLVVGLCNLNRPQVAVKYAEDMIGRGISLSSSTLSKLRQSLVKERREYVYEDLLRKWKSH

SEQ ID NO: 160273 - protein, 100 aa, Glycine max
  Coding DNA Sequence Number=SeqID_68588
MDGTAKDSPGVAGCGGIFRNHCVWIMGCFALSVSIKHTLYAELFAAIEAIEIAHEKGLSHIYCKDNTCADRLVSHRLLLFGQVVVGVGSNLVGITATSLS

SEQ ID NO: 160274 - protein, 228 aa, Glycine max
  Coding DNA Sequence Number=SeqID_68589
  Homolog annotation: Hit_ID=A7PRC0; Match level="QueryCoverage=67%, HitCoverage=45%, E-value=2e-15, Identity=36%"; Hit description =Chromosome chr14 scaffold_26, whole genome shotgun sequence
MGGLMLYSLKKVLEWKHNAKGEQYHPVVAMWASLAFVLSHTVLTPDVLLCFLFDKENNNLFLMEISIARSHLETQGIFFSNVSRTIGWESTKKLPCNVASQSSRWDFHRLASSHQAFTAVYPRRPFICRANSMPISLQESASYGDNSIEDEDPSTDLEEETLAKPPTSEQIMALLADTQGAKLTKKLSEANRQNRFLKRQMDHWEEDVWDVNNTWDGFSQFNLDVPSS

SEQ ID NO: 160275 - protein, 63 aa, Glycine max
  Coding DNA Sequence Number=SeqID_68590
MSIPHGWSIFAKQHDPDWSSYDFTYVIEVAVDIQKKKKNNNNNKAFDATTFKVEWLVLDAEAQ

SEQ ID NO: 160276 - protein, 108 aa, Glycine max
  Coding DNA Sequence Number=SeqID_68591
MPLPLPAPNARPKPRPAEEGSAGSSAGPRKTTFFHWITRKILQNLLPLDHAEDPAEASSAGIRGRTFHSSYSHLRHSNSYEEVRRLTLMAEDTNNNFNGGHEGLGGRK

SEQ ID NO: 160277 - protein, 164 aa, Glycine max
  Coding DNA Sequence Number=SeqID_68592
MGKKGRRKEGMRKGKRKERKRGWWEGVCFGINLAKDPWWVLGFTVVVGFLLPLASALVSSPCTQQSPFVLLLPRYWPSSSAPSFPSSEPSCPPLKLLFVSSAIKVEDEGSSTHRKGASGNSRGRTVEGSSANSCGRSFCRIFRVIQRKKVLQVVEPSSLTSSTT

SEQ ID NO: 160278 - protein, 243 aa, Glycine max
  Coding DNA Sequence Number=SeqID_68593
MNNIFRGSRYRIVTVAPLLIMLQLQQLRSELGDSGDDSVPGNVLERVLEASADLHKIVPDSDQSLRGGEITGGGGGRRRRRRRRRKRRGRGRRRRQSEGVGDTAKNMRYVVLDAMAIDGGLRRRRRVDNGAVVEIIRFWVGVVGLEELRHFSFNFKDLAAWAWSKVARSEEVRVERERSVWKLLGHEGAKKENKKSKSLSIPKTIPTHMHLFPCDLKGHVWVRGPNVVHKKLICRSSSRITLT

SEQ ID NO: 160279 - protein, 318 aa, Glycine max
  Coding DNA Sequence Number=SeqID_68594
  Gene Ontology: Mol. function=glutathione dehydrogenase (ascorbate) activity; Cellular component=cytoplasm; Biological process=tRNA aminoacylation for protein translation
  Homolog annotation: Hit_ID=Q4JR86; Match level="QueryCoverage=88%, HitCoverage=88%, E-value=1e-106, Identity=74%"; Hit description =Dehydroascorbate reductase
  Pfam annotation: Domain name=GST_N; Domain location=91-158; Score =26.3; E_value=0.00011; Accession=PF02798.11; Description=Glutathione S-transferase, N-terminal domain
  Subcellular localization annotation: CTP_CleavageSite=84; ConfidenceScore=5.76e-01
MMLWKRCIVPRKHRGNQKHNNATSSSASAMSTVRVQVSACVFSATVNNLCLRQNAVVSFRKKKLLRLVSMSSVPPSQPFEIAVKASVTTPNRLGDCPFCQRVLLTLEEKHLPYDPKLVDLTNKPEWFLKVNPDGKVPVIKFDEKWVPDSDIITQTLEEKYPSPPLLTPPEKATAGSKIFSTFIGFLKSKDPNDGTEQALLSELSSFSDYIKENVGVLYVGEKALFKGLGAVCKRFGVDLVKFEVLVGFGLETCDLEASFNLARLAAWGPFINGSEISAADLSLGPKLYHLEIALGHYKKWTVPDSLTSLKSYMKVCSR

SEQ ID NO: 160280 - protein, 439 aa, Glycine max
  Coding DNA Sequence Number=SeqID_68595
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A2Q370; Match level="QueryCoverage=99%, HitCoverage=88%, E-value=0.0, Identity=79%"; Hit description =Glycoside hydrolase, family 17; Virulence factor, pectin lyase fold; X8
  Pfam annotation: Domain name=Glyco_hydro_17; Domain location=23-344; Score=325.8; E_value=7.7e-95; Accession=PF00332.9; Description =Glycosyl hydrolases family 17
  Pfam annotation: Domain name=X8; Domain location=359-439; Score =139.2; E_value=1.1e-38; Accession=PF07983.4; Description=X8 domain
  Pfam module annotation: Pfam domain module=Glyco_hydro_17::X8; Domain location=23-344::359-439
MAKHFLLLLFAVCVAAIDEEPFIGVNIGRDLSDMPHPTQVVALLKAQQIRHVRLYDADQAMLIALANTRIQVAVSVPNQEILAIGQSNTTAAKWVSHNVIAHYPATNITTICVGSEVLTTLPYAAKVLVSALKFLHSALVASNLDHQIKVSTPLSSSMILDSFPPSQAFFNRSLNPVLVPMLDFLQTTDSYLMLNIYPYYDYMQSNGVIPLDYALFKPLPPNKEAIDSNTLLHYSNVFDAVIDAAYFAMAFLNYTNIPVVVTETGWPSKGDSNEPDATVENANTYNSNLIKHVLNITGTPKHPGIGVSTFIYELYNEDAKAGPLSEKNWGLFDANGKPVYVLHLTESGGVLANDTTNQTYCVAKDGADPKMLQAGIDWACGPGKVDCSPLLQGQPCYEPDNVVAHANYAFDTYYHQMGKSTQSCDFNDMATISTTNPSK

SEQ ID NO: 160281 - protein, 99 aa, Glycine max
  Coding DNA Sequence Number=SeqID_68596
MVAMQLLLRDTSSTIGATIFANGATRYDLLSKICTSMVDITKPIRQGQSFEARMEGIFGMLGGEKGMEIQRKKEDIRRLRASFEQKTKRLGSQMAIPNE

SEQ ID NO: 160282 - protein, 66 aa, Glycine max
  Coding DNA Sequence Number=SeqID_68597
MASSNRNFPASMPVLIGKNYEDWCAQMKVARPDLMKRDAKALFIIHQCVDADNFQKIRSADTAKKA

SEQ ID NO: 160283 - protein, 142 aa, Glycine max
  Coding DNA Sequence Number=SeqID_68598
  Gene Ontology: Mol. function=pyridoxal kinase activity; Cellular component=cytoplasm; Biological process=pyridoxine biosynthetic process
  Homolog annotation: Hit_ID=Q4JR83; Match level="QueryCoverage=100%, HitCoverage=59%, E-value=8e-66, Identity=75%"; Hit description =Pyridoxal kinase
MGDEGKLYVPQELVSVYREKVVPVASVLTPNQFEAELLTGFRIQSEGHGREACRLLHAAGPSKGTGDLMTALLLGWSNKYPDNLEIAAELAVSSLQAVLHRTLSDYKSAGHDSESTSLEIRLIQSQDDIRTPQVKLKAEIYS

SEQ ID NO: 160284 - protein, 159 aa, Glycine max
  Coding DNA Sequence Number=SeqID_68599
MEIRRERECESKPGWWFVGGLIRDLWCWVRILGIPTASTCTHQLRAVLLLVLPDPRVRLEHLLERVGLLLMLACAAAVCWHIAQTAELSIRALHQHAEGHRRPQYVPTKCCHPRLGQPYPIRTRTWRVCSCKDNSPQWEATSPNIEARFALLANVGIEI

SEQ ID NO: 160285 - protein, 135 aa, Glycine max
  Coding DNA Sequence Number=SeqID_68600
  Homolog annotation: Hit_ID=Q9FY61; Match level="QueryCoverage=66%, HitCoverage=7%, E-value=1e-30, Identity=71%"; Hit description =Putative uncharacterized protein T5K6_30
MKWPFFLPLIPSLRKTIPTLFHYLILEVSIEGSAMIQVVVVPIGTVPSNVLRDYYSMLLPLHTIPLSAISSFYIEHQKSPFTVQPWDFGSLLFKFVLGGEQPSPWEDFQSHRKTFAGEGADTRVMEATEALTVRA

SEQ ID NO: 160286 - protein, 478 aa, Glycine max
  Coding DNA Sequence Number=SeqID_68601
  Gene Ontology: Mol. function=serine-type endopeptidase activity; Cellular component=cytoplasm; Biological process=proteolysis
  Homolog annotation: Hit_ID=A7PR87; Match level="QueryCoverage=96%, HitCoverage=38%, E-value=1e-161, Identity=66%"; Hit description =Chromosome chr14 scaffold_26, whole genome shotgun sequence
  Pfam annotation: Domain name=PDZ; Domain location=74-161; Score=27.3; E_value=5.6e-05; Accession=PF00595.15; Description=PDZ domain (Also known as DHR or GLGF)
  Subcellular localization annotation: CTP_CleavageSite=46; ConfidenceScore=5.47e-01
MAASGTKGGSSGSPVIDWQGRAVALNAGSKSSSASAFFLPLERVVRALRFLQKESETYVDKWKAVSIPRGTLQMTFLHKGFDETRRLGLRSETEQIVRHASPAGETGMLVVDSVVPGGPGYKHLEPGDVLVRVNGEVITQFLKLETLLDDSVNKNIELQIERGGTSKSLTLLVQDLHSITPDYFLEVSGAVIHPLSYQQARNFRFHCGLVYVAEPGYMLFRAGVPRHAIIKKFAGEEISCLDELISVLSKLSRGARVPLEYISYMDRHRRKILFITSCHNFQMKRIDFLIRHESHDNVFMLEAVSVLVTVDRHEWYAPPQIYTRDDSTGLWNAKPAFKLDSPFLSLGAKDVENLSRQSVSLTGEHACGGHVCGDNSQELVDGVTSMETNCEDPSECVSHHNASDGVVKKRKVDEDLSADGNVVADFSLNDSRETKLEKSSIIQDDMLMDYQGATAATANASVAERVIEPTLVMFEVLL

SEQ ID NO: 160287 - protein, 114 aa, Glycine max
  Coding DNA Sequence Number=SeqID_68602
  Homolog annotation: Hit_ID=Q0WVI8; Match level="QueryCoverage=43%, HitCoverage=5%, E-value=8e-07, Identity=55%"; Hit description =Putative pre-mRNA splicing factor RNA helicase
MVLLTACDLFSPNAILQSEEESLKDQREKEELEQHMRERDAAGTRKKFYWRETRNNAIRDSLMTKGPSRNKDIQTFSFKLATNLSILFTYKIVLSPLTDHSCSTKERAYTKPAP

SEQ ID NO: 160288 - protein, 586 aa, Glycine max
  Coding DNA Sequence Number=SeqID_68603
  Gene Ontology: Mol. function=protein dimerization activity; Biological process=DNA integration
  Homolog annotation: Hit_ID=A2Q1A3; Match level="QueryCoverage=50%, HitCoverage=81%, E-value=1e-19, Identity=27%"; Hit description=RNA -directed DNA polymerase
MELFDVLLIGRSFTWISPANTTADYVYKENLKKLKFELKRWNYDAFGDLEEAKRRSAMQIGTLDDIDEVRDISTQQALDRSKLLEELALVSNEQESLMVNGIRGVNVNDTWVEDQLRLKQEVKNFFEQRKRLGVQYGSEDILKVVNEFHHNGTLPRGVNATFVSLIPKGNPLAPFLFLMVADGLGGLMRMATDKDLFVRPKVVVLKCFKPASSLKDNFFKSKLAEVAVASDLQQRLAAILNFWVMVIPFIYLGIPVDPSRVPPHQDVKLTNERKKCFKRYFDDVDVRRQVNLEFANFSNGREAFHNVDSLRDKGELDAKSWWLAHGAYAPTLLKIALKLLGKPSSYSCDGRRMYWVNWKKVCSSKDLGCLGIKDLETFNNALLYKWMWRFLVDNNSTWARTIRERAKVYKDILLSPSTSLGGRMLAREIDGFSVGKAYSIMKNVVDLEENGFYKQLWAVKAPSKVVALTWIIALNSVLTRENLRRRGISLANNDVTCVRKMIRPNPVSFVETRRPDRHFSSSRSSSRSMPPLHCEGSCRANLVANNVDEDVNDLGGVELRRHCEAVMIEEEEEKVQQEERVIYIGD

SEQ ID NO: 160289 - protein, 67 aa, Glycine max
  Coding DNA Sequence Number=SeqID_68604
MLLSSNVIYICLRVVMLVRMIHTRLFPVARVKACPGMHNSCAIAFLWLCLHSWPSFEIKGWPGKKNG

SEQ ID NO: 160290 - protein, 110 aa, Glycine max
  Coding DNA Sequence Number=SeqID_68605
MAPTKTPSGPGEVQQGPRGSRLQDTQWTRRSPTGSWSCQALITGLYQFYGVLVTSGKGIRPLTNRAFIKKYCAPRQAQGETPQQPGDGQQRATDAPPSPLEFTSAHPQKG

SEQ ID NO: 160291 - protein, 190 aa, Glycine max
  Coding DNA Sequence Number=SeqID_68606
MPRLPAVPGTARHPRRRPARAGAGPGDGPGPGRTGPGRPEMGRADGAVQPARLRSGLCLDGDANERPRERVVPCRRQPAARPAAGGTVGRVVPKQPDLPGHPGLARRPAAMAAVAHRCRRAGPDRAGAGRCCAGPATRAGTGTGGPPSAAAACAAAVHALCHPGGSRVLPPPKKKLSGCALTAIIGGGLL

SEQ ID NO: 160292 - protein, 170 aa, Glycine max
  Coding DNA Sequence Number=SeqID_68607
  Gene Ontology: Mol. function=peptide deformylase activity; Cellular component=chloroplast; Biological process=translation
  Homolog annotation: Hit_ID=A1G0M2; Match level="QueryCoverage=100%, HitCoverage=89%, E-value=1e-89, Identity=95%"; Hit description =Peptide deformylase
  Pfam annotation: Domain name=Pep_deformylase; Domain location=3-156; Score=220.9; E_value=2.9e-63; Accession=PF01327.12; Description =Polypeptide deformylase
MALLPILEFPDPRLRTKAALIEAAEVTTPAFQELIDNMFLTMYDAPGIGLAATQVDVHKRFMVIDVSEEKNEPHVFINPEIVAKDGGRVYQEGCLSVPGIFADVTRADTITVKYLDRNGQEQQMEAGEVLATCIQHEMDHLDGKLFIDYLSPLKREMVRKKLAKQRKHVA

SEQ ID NO: 160293 - protein, 247 aa, Glycine max
  Coding DNA Sequence Number=SeqID_68608
IARQAFADLAGDVHHLALARLEPFALEVAQDIVHFGALYAALDAAEVIKALVAFGGLRRFVRRQRLMNAGGQRQRVDHHALGAAGVHAVAEDFDRHRGGVEVLALQLADAAAVHGISPFGIEGRHVEQLRPLAYLLVRGEGYADVAVRDFARTQAHHGGEDLGDAGLVVGAQQRFAVGGDQGLPQHLVQDREHHRRQHFIADAERDVAAAIVLDDLRIDVFAAEIRRGIQMGDKTDRRHRPGDVARP

SEQ ID NO: 160294 - protein, 137 aa, Glycine max
  Coding DNA Sequence Number=SeqID_68609
  Gene Ontology: Mol. function=endonuclease activity; Cellular component=extrachromosomal circular DNA; Biological process=defense response to bacterium
  Homolog annotation: Hit_ID=P17998; Match level="QueryCoverage=39%, HitCoverage=7%, E-value=4e-19, Identity=75%"; Hit description =Colicin-D
  Pfam annotation: Domain name=ColicinD; Domain location=46-133; Score =46.5; E_value=9.2e-11; Accession=PF09204.1; Description=Colicin D
MVSDPLDSGRFTRQQLDKKYKHASDFGVADTRKNRETLTQYRDALEAHLNDKDTALLDSKLTADEYESQYLNVWRKERDDGTLRKDSNDVGYCAAELFSLADCYTSSPNRDGSDLDENELKIEVKKTLEKYNFLKKE

SEQ ID NO: 160295 - protein, 373 aa, Glycine max
  Coding DNA Sequence Number=SeqID_68610
  Gene Ontology: Mol. function=transferase activity, transferring phosphorus-containing groups; Cellular component=integral to membrane; Biological process=two-component signal transduction system (phosphorelay)
  Homolog annotation: Hit_ID=A8GDC5; Match level="QueryCoverage=100%, HitCoverage=77%, E-value=1e-178, Identity=84%"; Hit description =Integral membrane sensor signal transduction histidine kinase precursor
  Pfam annotation: Domain name=HAMP; Domain location=176-244; Score =42.5; E_value=1.5e-09; Accession=PF00672.16; Description=HAMP domain
  Pfam annotation: Domain name=HisKA; Domain location=248-311; Score =25.9; E_value=0.00015; Accession=PF00512.16; Description=His Kinase A (phosphoacceptor) domain
  Pfam annotation: Domain name=PhoQ_Sensor; Domain location=1-171; Score=413.9; E_value=2.4e-121; Accession=PF08918.1; Description=PhoQ Sensor
  Pfam module annotation: Pfam domain module=HAMP::HisKA::PhoQ_Sensor; Domain location=176-244::248-311::1-171
MATAGVILALSLSYGLVAVVGYIVSFDKTAFRLLRGESNLFFSLAQWKDNKLTIAIPPDIDLNFPTLVFIYDDKGNLLWSQRKVPELEKLINKEWLEESGFYEIDTDTRVSSEVLGDNPKAQDQLKNYDDTDQNALTHSVAVNTYAATPRLPALTIVVVDSIPQELQRSDVVWEWFSYVLLANLLLVVPLLWLAAYWSLRPIKALVNQVGELENGERDQLDENPPSELRGLVRNLNILVRNERQRYTKYRTTLSDLTHSLKTPLAVLQSTLRSLRGEKISVSEAEPVMLEQISRISQQIGYYLHRASMRSGNALLSRELHPIAPLLDSLTSALNKVYQRKGVNITLDISPEISFVGEQNDFMEVMGNVLDNAC

SEQ ID NO: 160296 - protein, 158 aa, Glycine max
  Coding DNA Sequence Number=SeqID_68611
MVAITLAKVRQPPFLREYDSNATCACHGEAPGRSIEHCRALKRKVQGLIDAGWLKFEENRVIFNFHRKWVQAIGLFAQATCAPEFGLLRPFNQRLFVLRVGGAAGQPFPYVQESSTTRDPRSLNPFSEIRRREEDISLKRDRLYNEDQSKFLIEYASG

SEQ ID NO: 160297 - protein, 73 aa, Glycine max
  Coding DNA Sequence Number=SeqID_68612
MDKFDGLQTFVGDKFDAMELQVDMRYCHHQKGGDCRQRIKLNVLMMPKDYLNHMLLKDLFKTKIFKMNDQDSL

SEQ ID NO: 160298 - protein, 120 aa, Glycine max
  Coding DNA Sequence Number=SeqID_68613
MSQKNDDLRLIHCWIIVKFKHQVQNPIPSILTVGNFKIIQILICCSKFKCGNFHRWDLQDNIRGGRKSIRVKIVQMEASIPSLSLYRLGTLSEQPEESQELVRDVSIAVGRHMSLLRGKG

SEQ ID NO: 160299 - protein, 27 aa, Glycine max
  Coding DNA Sequence Number=SeqID_68614
MIHLDPLFIVAGVDLGLHTRAKPALLA

SEQ ID NO: 160300 - protein, 244 aa, Glycine max
  Coding DNA Sequence Number=SeqID_68615
MPVSAPTDSLLVTSPCYRLRRGVITCVSVDCDEEDCEEGIYNNVQAVPGSSEDRRCLLDAICGAPTCVGLSSDFVLLGTAPLGHVARYRPERVMHQFSYVQCIPAHPIHSWVSYDDMDDTWTHYSDHLAAVGDLCVVPGQCAPDYIDWFFVISHSFMTTPQTDPPRDAYATQPNHIPHEEAPTSTYADPDVDEPRHAMEACHAIAEALEQHLNAPGTSTHEEAIQKCLRIARDSLIGVCDSCVM

SEQ ID NO: 160301 - protein, 89 aa, Glycine max
  Coding DNA Sequence Number=SeqID_68616
MRSWVRGQWILFDADALSQFRGDPQVSEEGPGVRVQSEEEQGRWVRQGGHCPAVMHTGAGFLPDRCREAGADHAHQHDHLDPDVDDIVA

SEQ ID NO: 160302 - protein, 153 aa, Glycine max
  Coding DNA Sequence Number=SeqID_68617
MAPTRHPMDPDKSNRALGFPALIIGLCQSFEVPVAPSKAVGAPPPPHQADPAGSFDTERYLRHSMHQHAANHRGLGQVHECLYQLSLSMQSQGFTPFPCPTPDQFRAEVAWPGDWPEAQAGEAPAKALDDGEEAGMDEEMSDLLDFLGGSGAT

SEQ ID NO: 160303 - protein, 156 aa, Glycine max
  Coding DNA Sequence Number=SeqID_68618
  Homolog annotation: Hit_ID=A5AK77; Match level="QueryCoverage=39%, HitCoverage=7%, E-value=2e-07, Identity=44%"; Hit description =Putative uncharacterized protein
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLAGEDPHKHLKEFHIVCSTMNPQMSKRITYF

SEQ ID NO: 160304 - protein, 151 aa, Glycine max
  Coding DNA Sequence Number=SeqID_68619
MESSQMPSLKKRFYQVKVKSLGITSLKELGQLMGQLQRQAFRKAYGKIWDLAMVEVSTEVIASLAQYYDQSLRKPYLFTGFYPSLARISKIVQISAQELDHKKQVKNGVVGIPRKYLEEKARILAGKGEWAPFIDILALLIFGGVLFLNVD

SEQ ID NO: 160305 - protein, 344 aa, Glycine max
  Coding DNA Sequence Number=SeqID_68620
  Gene Ontology: Mol. function=nucleoside-triphosphatase activity; Cellular component=chloroplast; Biological process=cell division
  Homolog annotation: Hit_ID=Q2PMM5; Match level="QueryCoverage=100%, HitCoverage=21%, E-value=1e-103, Identity=82%"; Hit description =Protein ycf2
  Pfam annotation: Domain name=AAA; Domain location=92-319; Score=-1.2; E_value=2.3e-05; Accession=PF00004.20; Description=ATPase family associated with various cellular activities (AAA)
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPSSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRDLVALTNEALSISIIQKKSIIDTNIIRSVLHRQTWDFRSQ

SEQ ID NO: 160306 - protein, 89 aa, Glycine max
  Coding DNA Sequence Number=SeqID_68621
TQPSLERTTYTELRDIQRELRESATLPEGRKTDRYPERGRVGTGERTRELPGGNAWGTEPMEKRQQRGLFTVPGLLLAFCSHVLSCVIP

SEQ ID NO: 160307 - protein, 82 aa, Glycine max
  Coding DNA Sequence Number=SeqID_68622
MKVGYVLRNAIAHTFTVGICEIIFVEGEKESHEDSTSGGFNPFSVSLTFGNSIGAVGGKLEESQESARDAAIAIGRHVSSLR

SEQ ID NO: 160308 - protein, 125 aa, Glycine max
  Coding DNA Sequence Number=SeqID_68623
  Gene Ontology: Mol. function=chitin binding; Cellular component =extracellular region; Biological process=chitin metabolic process
  Homolog annotation: Hit_ID=UPI00006A17C9; Match level="QueryCoverage =71%, HitCoverage=100%, E-value=4e-11, Identity=36%"; Hit description= UPI00006A17C9 related cluster
  Subcellular localization annotation: CTP_CleavageSite=65; ConfidenceScore=5.74e-01
MVRTCSPLKVKACSPLKVRSCSPLKVRTCSPLMVRTCKPLKVGTCSPLMARTCSPLKGRTCSPLKARTCSPLKVRVCSPLMVRTCSPLKIDCPFERGDNSCNLILSFANLIGNSLRVYVLFDLVT

SEQ ID NO: 160309 - protein, 89 aa, Glycine max
  Coding DNA Sequence Number=SeqID_68624
MGILRRLKTVVVCDDDRRSKVHNSNTAVNSPVVEVTTDYDGHGDPTVVEVTTDYDGCLPRTVVEGSYHYNGVLLRTTVVRDGVNTTTVT

SEQ ID NO: 160310 - protein, 74 aa, Glycine max
  Coding DNA Sequence Number=SeqID_68625
MKGNQQRTESPTVATYPSTGGRRVTREMRVPRKEYTRSCHQRLFEENVGKTGKDAIYELLSERLGSCIYARGRY

SEQ ID NO: 160311 - protein, 82 aa, Glycine max
  Coding DNA Sequence Number=SeqID_68626
MTKLGLCLSSGPPPLDDKRVRITVRLTKLGLCVPSDTTVSEWQRGADNRKGQYDKDYGAADKSKALAPTYPPMRNSDLRSSG

SEQ ID NO: 160312 - protein, 220 aa, Glycine max
  Coding DNA Sequence Number=SeqID_68627
MCSEKGKANQEALLAGIMGAFVSWFPRWKEGGAGVLCSCKGFPNVPLIGMRGYPMRGASSKEIITPFITQGFIDAKAKILQKIRKAWNRVERKDKDLRGSSNSVIGGYHKWLKSRTQGITWLPKLKSLSGKEAEISEESEEVQALKVELEESRVVNEKLRVVVTRVRKKCDELKDINMTTVEAKELKLRKAERDKSRMESMGSERKGDRVIARGRYEMDG

SEQ ID NO: 160313 - protein, 183 aa, Glycine max
  Coding DNA Sequence Number=SeqID_68628
  Gene Ontology: Mol. function=transferase activity, transferring glycosyl groups; Biological process=metabolic process
  Homolog annotation: Hit_ID=Q2HT79; Match level="QueryCoverage=30%, HitCoverage=12%, E-value=2e-20, Identity=82%"; Hit description=UDP -glucuronosyl/UDP-glucosyltransferase
  Subcellular localization annotation: CTP_CleavageSite=18; ConfidenceScore=5.17e-01
MVLMMSSMHISTELLHLSTSSTTSTRSLDHVTLITSTKQRMELSLRHVKFDQFKRQQSGSGNADGENFSQQGEEENVDEGEMHKKKKKKKQEVESLHDIHSTVKFGVREADGKHVSSRNPTVEKYQPTNCRYICNEWEIGIEIDTNVKREEVEKLVNDLMAGEKGKKMRQKIVELKMKAEEGK

SEQ ID NO: 160314 - protein, 84 aa, Glycine max
  Coding DNA Sequence Number=SeqID_68629
  Subcellular localization annotation: CTP_CleavageSite=31; ConfidenceScore=5.12e-01
MPLLQTSSGQRSHGPGIGPRPKQERRPQKLPAMERRPTRTRRWPICLTSWEGEELHDWEIPRFMVNAVKFPRTPKMDSDECTNG

SEQ ID NO: 160315 - protein, 52 aa, Glycine max
  Coding DNA Sequence Number=SeqID_68630
VLPYYLSLELQTSEQPCNIVMQSYPTRALDRRLQEDWARDAREGPRILMSLK

SEQ ID NO: 160316 - protein, 91 aa, Glycine max
  Coding DNA Sequence Number=SeqID_68631
  Subcellular localization annotation: CTP_CleavageSite=82; ConfidenceScore=5.71e-01
MGNYAKIFNRSSSFIVHSSLFFGLQPTNARGANTFLKRKYNSRTWNILFDRFPSVFPTFSTNKRWWRLRAFSSFRKCTREPRLARPQKGML

SEQ ID NO: 160317 - protein, 73 aa, Glycine max
  Coding DNA Sequence Number=SeqID_68632
MMDKRLSLWMKHTMYPKKGQMVTLSKMKSTVQVVLFEDERVTHVSCRACVTVYASYTFGGKHKMESHVADYGL

SEQ ID NO: 160318 - protein, 1357 aa, Glycine max
  Coding DNA Sequence Number=SeqID_68633
  Gene Ontology: Mol. function=microtubule motor activity; Cellular component=microtubule associated complex; Biological process =microtubule-based movement
  Homolog annotation: Hit_ID=A7PGB6; Match level="QueryCoverage=99%, HitCoverage=99%, E-value=0.0, Identity=56%"; Hit description =Chromosome chr6 scaffold_15, whole genome shotgun sequence
  Pfam annotation: Domain name=Kinesin; Domain location=93-425; Score =552.8; E_value=3.7e-163; Accession=PF00225.14; Description=Kinesin motor domain
MPFLSEAASAIKSRFGFHDHPSESLSLVQNTPDLFKSAVKDTLSQSSIVRNLSDWDDETVVGPSSAAVSSSQSFEFAEDPSFWKDHNVQVIIRMRPLSNSEISVQGYGKCVRQESGQAITWTGHPESRFTFDLVADENVSQENLFKVAGLPMVENCMGGYNSCMFAYGQTGSGKTHTMLGDIEGGTRRHSVNCGMTPRIFEHLFTRIQKEKEARRDEKIKFTCKCSFLEIYNEQILDLLDPSSNNLQIREDSKKGVYVENLTETEVTYAREVIQLLIQGAANRKVAATNMNRASSRSHSVFTCIIESQWESQGVTHFRYARLNLVDLAGSERQKSSGAEGERLKEATNINKSLSTLGLVIMNLVSISNGKSQHVPYRDSKLTFLLQDSLGGNSKTIIIANISPSICCSLETLSTLKFAQRAKFIKNNAIVNEDASGDVIAMRIQIQQLKKEVSRLRGLVGGGEIQDNDISVVSFPGSPGSFKWEGVQGSFSPLTSIKRISQKKDYDVALVGAFRRAKDKEMELQALRDEIEASMKLVKQREDEIQSLKMRLRFREAGIKRLETVASEKISAETHLLKEKEEHLKEIEVLRAQARTQPHGIVKLKRNKSTNQSKLKSFCMEGEREQMNEQIMVLENKLLEALDWKFMHETDLKINSDSMMEDVHNDGNLISKQESSPKSHWQSLLREENEFLKIQAIQNQAEMDTIRKKLEVCLEEKEKLKRHVDDLMEKFEQEKCRTINEGKEQMDLPSTTDMPVINSNDQLELKAMVDAIASASQREAEAHETAIMLAKENDELKMKLKALIEDNSKLIELYEQAAAEKNNRNVNKGEGAQEIGSEIDNGCYSLETTKEETELKGVVENLQHQLMEMNEENEKLLSLYERAMQEKDEIKRTLACFGHERVETKGDMDCPEKLVEVDGGERDSRVQTVSQEVQGRDESKCESSTSGSDVDFECDAHEQEHLLKDDNEADILVNSEKKYEVSDLSEAELSEELNCATKKLERVDERISDAVKTIASLGCAEKAMVQVDELSREIEVTEHDIQVKRRQFESLKLQFSEAQERRTIVNKKFSALKYSLSNFSSTFSYFEQREARARAVVNDLTSHLAQNKGELAALQASKQGLENAQKRNQECEVEIMKNVASIKSKLEEENRKCEGEKVLFAVENTQNIDSALKILHRSCKATELLKLEEDKTKLQAEMKLSQEKLGVIRKELGNLKKKEANVESQIQAVQLEVKKLLRNTEEKELALQRVMKEKEMLLEFRDNGMLEIEHMIIELQQYVFDYELKEAEINILGEELQIDLIRAEELQTARVIAANNKNNVLSSISYSGMFGKLKEEMQNLRASILETKLLLEGISHAN

SEQ ID NO: 160319 - protein, 306 aa, Glycine max
  Coding DNA Sequence Number=SeqID_68634
  Gene Ontology: Mol. function=strictosidine synthase activity; Cellular component=endoplasmic reticulum; Biological process =biosynthetic process
  Homolog annotation: Hit_ID=A7PGB4; Match level="QueryCoverage=96%, HitCoverage=90%, E-value=1e-122, Identity=66%"; Hit description =Chromosome chr6 scaffold_15, whole genome shotgun sequence
  Pfam annotation: Domain name=SGL; Domain location=75-304; Score= -68.4; E_value=8.2e-06; Accession=PF08450.3; Description=SMP -30GluconolaconaseLRE-like region
  Pfam annotation: Domain name=Str_synth; Domain location=170-243; Score=81.1; E_value=3.6e-21; Accession=PF03088.7; Description =Strictosidine synthase
  Pfam module annotation: Pfam domain module=SGL::Str_synth; Domain location=75-304::170-243
MMLPRGFSIEFLLLALYCALDPFGHSPIAGFPHFEVHKIDMPAWSEVPTDRDKDNSLQKSEVLIVNQVQGPESIAFDPLGRGPYTGVADGRILFWNGQSELCNPKESASPMSYVETEHICGRPLGLRFDKNTGDLYIADAYYGLMKVGPQGGLATSLATEAEGVPLRFTNDVDIDTEGNLYFTDSSTNFQRRVLKYNLATKETTVLMRNVQFPNGISLSKDASLFVFSEGMNGRLRKYWLKGVKAGTSEILAILPGFPDNVRVNGNGDFWVAIHCRRFHAVVVKYSPEGKLLRILEDSEGKVVRTV

SEQ ID NO: 160320 - protein, 593 aa, Glycine max
  Coding DNA Sequence Number=SeqID_68635
  Gene Ontology: Mol. function=sequence-specific DNA binding; Cellular component=nucleus; Biological process=regulation of transcription, DNA-dependent
  Homolog annotation: Hit_ID=A7LHH6; Match level="QueryCoverage=53%, HitCoverage=96%, E-value=1e-168, Identity=93%"; Hit description =WRKY36
  Pfam annotation: Domain name=WRKY; Domain location=337-397; Score =143.5; E_value=5.7e-40; Accession=PF03106.6; Description=WRKY DNA -binding domain
MARGGGLSIDSDPIGSFLPHEPIVLNSFPEDNKDNNNSRQQHKWKLGTNMDATVSRKSSPSSTSNTNTTIPFQDHLTSDDKMPHLDEMNFFPNKSNKDDDDDNNLASASTSAPPSLDHLHHTHDHSSAILGLKVNTGLNLLTTNASSDQSMVVDDDISPNSGDKRAKSEMVVLQVELERMKTHLVSLMKDQMDKEDDKQQPHQVFDGKLEEKQAGNGGGALVPRQFMDLGLATNADTNETSHSHSSSVIRSQDSPPTNNTEVASKKNGGASDEGLVFDQDKKEFGRGIEREDSPSDQGVAANNNVPKFSPPRNVDQAEATMRKARVSVRARSEAPMITDGCQWRKYGQKMAKGNPCPRAYYRCTMAAGCPVRKQVQRCAEDRTILITTYEGNHNHPLPPAAMAMAQTTSSAARMLLSGSMSSADGLMNASFLTRTLLPCSSSMATISASAPFPTVTLDLTQSPNPLQFPKQPSQFQIPFPGVPQNFANSQASLLPQIFGQALYNQSKFSGLQMSQDSDPSQLSNQSQRPPPHLADTVSAAIAADPNFTAALAAAITSIIGGAQPNNNSTTSTNYNGTTSTNTSNGNITSSNNK

SEQ ID NO: 160321 - protein, 315 aa, Glycine max
  Coding DNA Sequence Number=SeqID_68636
  Gene Ontology: Mol. function=prephenate dehydratase activity; Cellular component=cytoplasm; Biological process=L-phenylalanine biosynthetic process
  Homolog annotation: Hit_ID=A2Q4I2; Match level="QueryCoverage=74%, HitCoverage=76%, E-value=3e-87, Identity=61%"; Hit description =Prephenate dehydratase with ACT region
  Pfam annotation: Domain name=PDT; Domain location=46-229; Score=98.9; E_value=1.6e-26; Accession=PF00800.9; Description=Prephenate dehydratase
MVGYILVLELDVIVANNAILLSVLGQEPLSISDIVAALDDGAKVQISYKGIPGSYSEDAALKAYPNCETVSCNDFEEAFKAVEIWWADKVILPIENTSGGSIQRNYDLLLCHRLHIVGEVQLATNLSLLALPGIRTEYLKRVLSHSQAKLHVAGTFLDVAFELSDDFLTKLGVARENVDDTAGAAQIIASNGLYDAGAIASIRAAEICGLNIESRPQRNRPLRVVDDSNTPTAKYFDYLFYIDFEASMTEPRAQTALGHLQHMIKWDKFAYKNSNDNWQKHFLQAMNGAVPKVSEETFFLKFSVRCSNFFLFGQL

SEQ ID NO: 160322 - protein, 27 aa, Glycine max
  Coding DNA Sequence Number=SeqID_68637
MNKRSFKETSNIPYWYFVVLVRFAMKI

SEQ ID NO: 160323 - protein, 315 aa, Glycine max
  Coding DNA Sequence Number=SeqID_68638
  Gene Ontology: Mol. function=nucleic acid binding; Cellular component= nucleus; Biological process=metabolic process
  Homolog annotation: Hit_ID=Q2HSI7; Match level="QueryCoverage=99%, HitCoverage=99%, E-value=1e-127, Identity=71%"; Hit description =Tetratricopeptide-like helical
  Pfam annotation: Domain name=PPR; Domain location=176-210; Score =41.9; E_value=2.3e-09; Accession=PF01535.11; Description=PPR repeat
  Pfam annotation: Domain name=PPR; Domain location=211-245; Score =13.9; E_value=0.17; Accession=PF01535.11; Description=PPR repeat
  Pfam annotation: Domain name=PPR; Domain location=247-281; Score =17.9; E_value=0.039; Accession=PF01535.11; Description=PPR repeat
  Pfam annotation: Domain name=PPR; Domain location=75-109; Score=16.4; E_value=0.089; Accession=PF01535.11; Description=PPR repeat
  Pfam module annotation: Pfam domain module=PPR::PPR::PPR::PPR; Domain location=176-210::211-245::247-281::75-109
MAKPHKLVPFYATLLDACSSSKHLKNLKRIHALTITLGISRNDFIRSKLVSSYACCAQLHEANILFSFTIRQPTFLFNSLIRAYSSLNLFSQSLCIFRQMLLARKPFDRHTLPVVLKSCAGLSALRLGQQVHGAVLVNGFGLDLANSNALINMYSKCGHLVYARKLFDRMWQRNEITFSTMMAGYGMHGKCGEVFELFDKMVEAGERPDGVTFTAVLSACSHGGFIDKGREYLKMMEVRFGVKPGLHHYTCMVDMLGRVGQVEEAEKLILRMEVKPDEALWGALLGACKTHGKLEVTERVEERVYGRELSFASSV

SEQ ID NO: 160324 - protein, 77 aa, Glycine max
  Coding DNA Sequence Number=SeqID_68639
MEVVDVLCGVLSERGKLLGYITGRATGLRVRTENLEEGRRHSVGSQIQIESRERDREMCVVLFAESESERGCETVAV

SEQ ID NO: 160325 - protein, 521 aa, Glycine max
  Coding DNA Sequence Number=SeqID_68640
  Gene Ontology: Mol. function=binding; Cellular component=nucleus; Biological process=activation of protein kinase C
  Homolog annotation: Hit_ID=Q2HSJ6; Match level="QueryCoverage=91%, HitCoverage=92%, E-value=0.0, Identity=74%"; Hit description =Tetratricopeptide-like helical
  Pfam annotation: Domain name=PPR; Domain location=131-165; Score=8.3; E_value=0.81; Accession=PF01535.11; Description=PPR repeat
  Pfam annotation: Domain name=PPR; Domain location=193-227; Score =41.6; E_value=2.8e-09; Accession=PF01535.11; Description=PPR repeat
  Pfam annotation: Domain name=PPR; Domain location=294-328; Score =47.1; E_value=6.3e-11; Accession=PF01535.11; Description=PPR repeat
  Pfam annotation: Domain name=PPR; Domain location=329-363; Score =16.3; E_value=0.092; Accession=PF01535.11; Description=PPR repeat
  Pfam annotation: Domain name=PPR; Domain location=365-399; Score =20.7; E_value=0.0056; Accession=PF01535.11; Description=PPR repeat
  Pfam annotation: Domain name=PPR; Domain location=431-465; Score =12.7; E_value=0.24; Accession=PF01535.11; Description=PPR repeat
  Pfam annotation: Domain name=PPR; Domain location=57-91; Score=22.6; E_value=0.0015; Accession=PF01535.11; Description=PPR repeat
  Pfam module annotation: Pfam domain module=PPR::PPR::PPR::PPR::PPR::PP R::PPR; Domain location=131-165::193-227::294-328::329-363::365 -399::431-465::57-91
  Subcellular localization annotation: CTP_CleavageSite=68; ConfidenceScore=5.81e-01
MILPACNATPTQLPHPPKSPSSNSLPNQTHSTFSNTNTNTNQGLSLRHTTKYNDPIVSWTTSIADYCKSGHLVKAASKFVQMREAAIEPNHITFITLLSACAHYPSRSSISFGTAIHAHVRKLGLDINDVMVGTALIDMYAKCGRVESARLAFDQMGVRNLVSWNTMIDGYMRNGKFEDALQVFDGLPVKNAISWTALIGGFVKKDYHEEALECFREMQLSGVAPDYVTVIAVIAACANLGTLGLGLWVHRLVMTQDFRNNVKVSNSLIDMYSRCGCIDLARQVFDRMPQRTLVSWNSIIVGFAVNGLADEALSYFNSMQEEGFKPDGVSYTGALMACSHAGLIGEGLRIFEHMKRVRRILPRIEHYGCLVDLYSRAGRLEEALNVLKNMPMKPNEVILGSLLAACRTQGNIGLAENVMNYLIELDSGGDSNYVLLSNIYAAVGKWDGANKVRRRMKERGIQKKPGFSSIEIDSSIHKFVSGDKSHEEKDHIYAALEFLSFELQLCGYIPDFSGKESYEDG

SEQ ID NO: 160326 - protein, 63 aa, Glycine max
  Coding DNA Sequence Number=SeqID_68641
MTNKRPVLPDCHLKIFESHDAGHDSRVHEKERADATQILMSSMPDWSIREVTNDIALNWTIPN

SEQ ID NO: 160327 - protein, 269 aa, Glycine max
  Coding DNA Sequence Number=SeqID_68642
  Gene Ontology: Mol. function=phosphoprotein phosphatase activity; Cellular component=nucleus; Biological process=response to stress
  Homolog annotation: Hit_ID=A7QVR2; Match level="QueryCoverage=92%, HitCoverage=25%, E-value=1e-140, Identity=96%"; Hit description =Serine/threonine protein phosphatase
  Pfam annotation: Domain name=Metallophos; Domain location=1-181; Score=74.6; E_value=3.3e-19; Accession=PF00149.19; Description =Calcineurin-like phosphoesterase
MTIRYIDYLFLGDYVDRGQHSLETITLLLALKVEYPNNVHLIRGNHEAADINALFGFRIECIERMGERDGIWTWHRINKLFNWLPLAALIEKKIICMHGGIGRSINHVEQIENIQRPIPMEAGSIVLMDLLWSDPTENDSVEGLRPNARGPGLVTFGPDRVMEFCNNNDLQLIVRAHECVMDGFERFAQGHLITLFSATNYCGTANNAGAILVLGRDLVVVPKLIHPLPPAISSPETSPERHIEDTWMQLSNIYDSVACIFDSCNDAFS

SEQ ID NO: 160328 - protein, 94 aa, Glycine max
  Coding DNA Sequence Number=SeqID_68643
MRILCPNTLEGTSFVIQVEVQVEGTSTWLFKENKEGYIPCGSLACKGFYKVERNLKNRLVAWGLDVGTGCGRTSINLVFVFFFSTFFNFRFTFV

SEQ ID NO: 160329 - protein, 197 aa, Glycine max; identical to SEQ ID NO: 111955
  Coding DNA Sequence Number=SeqID_68644
  Homolog annotation: Hit_ID=Q2HW90; Match level="QueryCoverage=91%, HitCoverage=36%, E-value=2e-19, Identity=34%"; Hit description =Putative uncharacterized protein

SEQ ID NO: 160330 - protein, 208 aa, Glycine max
  Coding DNA Sequence Number=SeqID_68645
  Homolog annotation: Hit_ID=A5ZYK7; Match level="QueryCoverage=31%, HitCoverage=97%, E-value=1e-22, Identity=78%"; Hit description =Putative uncharacterized protein
VEGKEGLLLGGPEPSVRYHSGRARILTLCQDLRAEGQSQAEGSLTARPTRRAGTKVGLSDPTVPSGRAVAQRIKVTLGITGLIFPKSSHRREGLAPRCRLFATWGCSMFQGLGCSPIKAVRELGSERRETVRSISGVGVRALRGPFPSTRGPGRTHLWCASYRAHGKRWVAKASGSTAETAMGSLPQRGWSERSFENSREGHGETSRF

SEQ ID NO: 160331 - protein, 132 aa, Glycine max
  Coding DNA Sequence Number=SeqID_68646
  Homolog annotation: Hit_ID=A5AK77; Match level="QueryCoverage=50%, HitCoverage=8%, E-value=7e-09, Identity=43%"; Hit description =Putative uncharacterized protein
MTRGNPSNLQPFDPEIDRTFHKLVRHHLVPFEHSDYSVSGDFEHPDLEHYNFEHFENMTQPPHCERTLREMAAPDFTYESLCIQYPNENVPYVLKTGLIHLLPKFHGLAGEDPHKHLKEFHIVCSTMKPPDV

SEQ ID NO: 160332 - protein, 513 aa, Glycine max
  Coding DNA Sequence Number=SeqID_68647
  Gene Ontology: Mol. function=hydrolase activity, acting on carbon -nitrogen (but not peptide) bonds, in linear amidines; Cellular component=mitochondrion; Biological process=putrescine biosynthetic process
  Homolog annotation: Hit_ID=A8GIX7; Match level="QueryCoverage=58%, HitCoverage=98%, E-value=1e-167, Identity=95%"; Hit description =Agmatinase
  Pfam annotation: Domain name=Arginase; Domain location=238-508; Score= 432.5; E_value=5.9e-127; Accession=PF00491.12; Description=Arginase family
  Pfam annotation: Domain name=Orn_DAP_Arg_deC; Domain location=3-138; Score=96.1; E_value=1.1e-25; Accession=PF00278.13; Description =Pyridoxal-dependent decarboxylase, C-terminal sheet domain
  Pfam module annotation: Pfam domain module=Arginase::Orn_DAP_Arg_deC; Domain location=238-508::3-138
QLYLNICNKIQQQLDPSNRAHRPIIDELQERMADKFYVNFSLFQSMPDAWGIDQLFPVLPLEGLDKPPEGRAVLLDITCDSDGTIDHYVDGDGVATTMPMPPYDPENPPVLGFFMVGAYQEILGNMHNLFGDTASVDVYVFPDGSVETELSDEGDTVADMLEYVQLDPGALLAKFRDQVKETDLDSELQAQFLEEFEAGLYGYTYLEDDTLGHQSDNSLVSNAFGFLRFPLNFMPYDSDAEWVITGIPFDMATSGRAGGRHGPAAIRQVSTNLAWEGNRWPWSFDLRDRLNVVDCGDIVFNFGDAQDMSDKLQAHAEKLLKAGKRMLSFGGDHFVTLPLLRAHAKHFGKLALVHFDAHTDTYANGSKFDHGTMFYHAPNEGLIDPHHSVQIGIRTEFDHDNGFTVLDAAQVNDRSVDDLLTQIKGIVGDMPVYLTFDIDCLDPAFAPGTGTPVIGGLTSDRALKLVRGMQSLNIVGMDVVEVAPAYDQSEITALAAATLGLEMLYLQAAKKHA

SEQ ID NO: 160333 - protein, 960 aa, Glycine max
  Coding DNA Sequence Number=SeqID_68648
  Gene Ontology: Mol. function=iron ion transmembrane transporter activity; Cellular component=periplasmic space; Biological process =high-affinity iron ion transport
  Homolog annotation: Hit_ID=A8GIY2; Match level="QueryCoverage=26%, HitCoverage=85%, E-value=1e-106, Identity=74%"; Hit description =Periplasmic binding protein precursor
  Pfam annotation: Domain name=FecCD; Domain location=579-895; Score= -201.6; E_value=0.034; Accession=PF01032.9; Description=FecCD transport family
  Pfam annotation: Domain name=Peripla_BP_2; Domain location=23-261; Score=32.2; E_value=1.3e-06; Accession=PF01497.9; Description =Periplasmic binding protein
  Pfam module annotation: Pfam domain module=FecCD::Peripla_BP_2; Domain location=579-895::23-261
MALALSPLLGSLPGRAADAPPDIARVAALEWLPIELLLALGVTPLAVADVHNYNLWVAEPKLPATVVDVGQRTEPNLELLQQLQPSLVLLSQGYGPTPQKIQPIAPTMSFGFNDGSGKPLTVARQSLLALGQRLGIESRAVQHLAQFDRFMQDARQRLQSYTRQPLLLFSLIDTRHALIIGQKSLFQEAMDQLGIRNAWQEETNFWGTAVVGIERLATVRNARVIYLDHGNQAMMDKVSATPLWQSLPFVRQNQLRQVPAVWFYGATLSTMRLRRVRHEFGHPEIAADADPTVAGGGRWPDDIQSGAAAAAGAMGAGAQRAGHRRRAANAVPLQPVAAVDGVAVGRRRSGVGRRAVPAGVAQSVGGAVDARRRRRRAAWPDHRHAVVGRYGGRDCGGRAGVRRRLGQTDVAGHADSGRAGAGAVLRRGHVPVGHRRVEPTGLERRAVPPAAFAGGWPVSGAVAAPADAAGAGRRCGAQPGVRAVDGALLCFGVGHHLQRHVGERGGRYRLYRPVCTADGEDAGGSPPGAPHDVGAAAGGAVAVADRSGDARGNAGVARDPDRRGHRAVRRAAAAVAAAAFAQRRHAAADEPRRQGACRTRESAWLDPGGRPRAADRPGAGADAGLGAELDALLPWRWPRVLSALAAGMMLAVAGTLIQKLTGNPMASPEVLGISSGAAFGVVMMLFMPGGGRYVADHHDRRRPRRFLDRTHAAGRYRAQHRLYHRHLPAVGQRRSAYGGLADLALRFDLFGGAGAGAAHRADRRRIAGIGTAVPPLADHPAARRRHRPFGGHCADADAVDHSVAGCHPDRHGDPDRRAAELCRADGAAYGAHAGLPPRAAANGDRRAAGRLADGVCRLVRTDAAVPVSDPRRVIGDLYRCTVLRAANGCAKTILRAKRNARRGGEMNILRAGALDLCLWSFCERYKEKSPESISINPRPTLTRHNVKLASYPPRGKEKKA

SEQ ID NO: 160334 - protein, 288 aa, Glycine max
  Coding DNA Sequence Number=SeqID_68649
  Gene Ontology: Mol. function=transferase activity, transferring glycosyl groups; Cellular component=peptidoglycan-based cell wall; Biological process=peptidoglycan-based cell wall biogenesis
  Homolog annotation: Hit_ID=A8GIY6; Match level="QueryCoverage=100%, HitCoverage=34%, E-value=1e-128, Identity=81%"; Hit description =Penicillin-binding protein 1B
  Pfam annotation: Domain name=Transgly; Domain location=198-287; Score= 22.0; E_value=2.1e-12; Accession=PF00912.13; Description =Transglycosylase
MAGDDREPIGRKGKQPKNTASRKPPRRRRDDDYDDYEEDEYDDDEYEEEEERMPRKVKATPPRKKRRWLGLIIKLILVIAVLLAIYGVYLDSQIRSRIDGKVWQLPAAVYGRMVNLEPGMPYSKKEMVNLLEGMQYRQVSRMTRPGEFTVQANSIEMLRRPFDFPDGKEGQIRARLDFQNNRLAKIENLDSGRSFGFFRLDPRLITMLQSPNGEQRLFVPRAGFPDLLVDTLIATEDRHFYEHDGISPYSIGRAVLANLTAGRAVQGGSTLTQQLVKNLFLTNERSLW

SEQ ID NO: 160335 - protein, 88 aa, Glycine max
  Coding DNA Sequence Number=SeqID_68650
MTPDFMGQDDKGAEDDVSLCLSTGLLAPDCQRVQKTTLVSACYRTLSLTDSEIVFIRITTWLGYLRMSPDFTEDDVSLRVSTGLLAPD

SEQ ID NO: 160336 - protein, 142 aa, Glycine max
  Coding DNA Sequence Number=SeqID_68651
MVEPSKKRRDHPSSPPRTIRSTHNTYSSLFVISKIIHFSLFFSLTHLPSQGAPFEGTIVDDWKFDYSSHDARRMVCNDQAEMTGRLLAGSLTFDNRIMHYIIVRILLPRSSNLAQASEGGFDSDVGLPLPGRRIDWAHLIQY

SEQ ID NO: 160337 - protein, 325 aa, Glycine max
  Coding DNA Sequence Number=SeqID_68652
  Gene Ontology: Mol. function=endonuclease activity
  Homolog annotation: Hit_ID=A2VHV0; Match level="QueryCoverage=100%, HitCoverage=99%, E-value=1e-127, Identity=75%"; Hit description =Transcriptional regulatory protein whiA
  Pfam annotation: Domain name=DUF199; Domain location=1-302; Score =581.3; E_value=9.4e-172; Accession=PF02650.5; Description =Uncharacterized BCR, COG1481
MTAEVKDELSRLVVTQVSSRRAEVASLLRFAGGLHIVSGRVVVEAEVDQGSIARRLRKDIFDLYGYNAVVHVLSAGGIRKTTRYVVRVAKDGEALARQTGLLDLRGRPVRGLPAQVVGGSVADAEAAWRGAFLAHGSLTEPGRSSALEVSCPGPEAALALVGAARRLGVSAKAREVRGSDRVVVRDGEAIGALLTRMGAQDTRLTWEERRMRREVRATANRLANFDDANLRRSARAAVAAAARVERALEILGDTVPDHLAAAGKLRVEHRQASLEELGRLADPVMTKDAVAGRIRRLLSMADRKAKTEGIPDTESAVTPELLEEA

SEQ ID NO: 160338 - protein, 358 aa, Glycine max
  Coding DNA Sequence Number=SeqID_68653
RLADQADQVDEAVRVAPLVVVPGDHLGLVVDHLGQTRVEDRAVRVGDDVRGDDRRVVVLENALELALGGGLHRGIDLIGAGGLLEFDGEVGRRTGGDRHAQGVAVELALELGEHQADGLGGTGGGRHDVQGGGASTAQILMRAVLQVLVLRVGVDGGHQALDDAELVVEDLGERAQAVRGARGVRDDVLAAVVLVVVDAQHDGDVLVAGRRGDDDLLGAGVQVTLRLGACGEDAGRLDDDVNAQVAPGKGRRTLLDLERLDLVIADDDRVIALQADVIGQPAQDGVELQQVGQGGVIGQVVDRDDLDVSVDPLSLLRVQCPKEVPADPAKPVYAYPDSHVALPLCRFEMWCTRYRHSH

SEQ ID NO: 160339 - protein, 139 aa, Glycine max
  Coding DNA Sequence Number=SeqID_68654
MASYGGELVLDSSSPCSGISNHLSSFSIPLPLIFKKQRTPLMKKIKAYKLHMELHHVVSELTIKTWGVTITTTTTINVSATIIVPATTIIINNTTSVIATTTTTKVIATTTTPPSPISLPPPPHHRHCYHPHYRCHHLK

SEQ ID NO: 160340 - protein, 52 aa, Glycine max
  Coding DNA Sequence Number=SeqID_68655
MSLPSAVHVSSIIKREASEEKRRSRDESRHHEKAGRTKSVSYLCFPLISDER

SEQ ID NO: 160341 - protein, 98 aa, Glycine max
  Coding DNA Sequence Number=SeqID_68656
MAKFDPDIVLDFYANAWPTEEGVWDMRSWVRGQWIPFDADAFSQFLGDPLVLEEGQDFARTAAGRRVRIMRTSMPPLIQMWMTLLFSNFLPSDHNSAL

SEQ ID NO: 160342 - protein, 658 aa, Glycine max
  Coding DNA Sequence Number=SeqID_68657
  Gene Ontology: Mol. function=enzyme regulator activity; Cellular component=membrane; Biological process=lipopolysaccharide biosynthetic process
  Homolog annotation: Hit_ID=Q6D9W1; Match level="QueryCoverage=97%, HitCoverage=92%, E-value=1e-148, Identity=44%"; Hit description =Putative capsulatr polysaccharide biosynthesis protein
  Pfam annotation: Domain name=Wzz; Domain location=14-170; Score=67.5; E_value=4.5e-17; Accession=PF02706.6; Description=Chain length determinant protein
MAISLVENAKKKEGFIDFTPYFNKIKHKLIWCLVVVIVAAVASFILTRFMSSSYTATATVLFKAQSQDVSPLPRLENYDSTRSDYYETKYALMGSRVVLDAAVRKLKLEQDSEFNGGDNLDETARINNAIQALQKSLTISGVRTTQLVAVSMEAKSPQKAADIANGVAQAFIDYSLQQKQNTLLQAQGWNEKMMDDLKTKMDQQKADIDNFLKQNGLLTFRSMDGYETERLGIVINHLADATQRRLKAQTVWDKVRRQQGKPVEQIISLPEISGHPQVQDLRIALIQTRRNLSEAAKHYGPQHPKYLQAQAQLQAVNAQLGQVLGELFNGLRQQYQIALDDEQHYQKMLNDQKADFQALGAKRDQYNTMTTALNKTEELYKSLYQRANEQKLSETFSVPDEVIYDAAVPPDRPSKPQRGLLIVMITLMALALYIMYLIVSTALDKTVNSLSELKAKTSLEASGEFPLLAHLENAQQIFHNVLYADMIHSLRLALLNQRDKPATILVTSVQSRSGSSYIAELLACSASKSRKTLLIDLDYLATQGLSAKFPQHKQGFSQLLNGECMPEQSVVKLDDQLDFIPRGKLNDSSLLLLTSERLPALLATLHQTYDTLIIDAPALNHAQDSLLLAAQSDITLLVVKAGEQAPRIRKAEQRLQSA

SEQ ID NO: 160343 - protein, 239 aa, Glycine max
  Coding DNA Sequence Number=SeqID_68658
EEVVEKFLKKYFPESKTTEGKVVISSFHQFPDESLSEALERPQTKQLLDASVRGKIKLKTPEEATELIENMSASDHDILCDRVHQATKKSLLELSSHDALLAQNKLLSKQLEILTETLGKLMKQANVFPLKNTLKKFTIWEINRDKDILKEDFQASSRVLLMNKDNGDHTLPIQQGPNIFQRTTKLEETLTQFMQVTMSNHKSTESALKNLEVQDKDNVESKKKVAEKKSTDEKKDDVI

SEQ ID NO: 160344 - protein, 117 aa, Glycine max
  Coding DNA Sequence Number=SeqID_68659
MGTMIEAMMSMKKIMKVNAAAVSATSVVVEVDWTPTSGLNQINQAISDMVGQKGKELGSTSGPHFVQVQNKHSIPPYGLAPNHTLPNVAHTPNEDVNNPAPIPIESQQPQADHAHVS

SEQ ID NO: 160345 - protein, 42 aa, Glycine max
  Coding DNA Sequence Number=SeqID_68660
MDKSLKVGEDEWRKRERRSTKFRVPNEHTNPRSSPRFSTKCA

SEQ ID NO: 160346 - protein, 84 aa, Glycine max
  Coding DNA Sequence Number=SeqID_68661
EHEMELQRLNQNEETDKRKQSIALKASSSMQDENEDEESEDEEDFSLFVKKFHKFVKKRRIERHQNFNHGKRFQEDTPTLRCYK

SEQ ID NO: 160347 - protein, 87 aa, Glycine max
  Coding DNA Sequence Number=SeqID_68662
  Subcellular localization annotation: CTP_CleavageSite=52; ConfidenceScore=5.25e-01
SPRIDRLICPWLTKGAGNHKVRMSLDFTGNPACQVTSLVRTTKGAEDNVSLRASTGSFFAGAEDNVSPRASTGLVFPLFTKGAGNHK

SEQ ID NO: 160348 - protein, 57 aa, Glycine max
  Coding DNA Sequence Number=SeqID_68663
WSGGGLSFTGTPHGDVIGYRMKFDHVTVGQFLWNPYLHFLDALESIVFVDYGQPAPL

SEQ ID NO: 160349 - protein, 419 aa, Glycine max
  Coding DNA Sequence Number=SeqID_68664
MSPRSVPSTQDATVLGLDRLQCQLEQRRLPCPGLPHQEVDAAAPGVEGRIPDAASIAVAMADMLELDPAAFSVESAGRPRTGNVIDRARDHFKGHVELQQQQVEQHDIADAQVTALIAREQQCEGDDELDRQADAQQRDEADPLQHVGPPAVAHLLGLLFEALDHPRAAAELPQRLHRVHRIADEARILLARFDRRLTMDPCSPRSDGRERDGHRTVAQHDRHHLQVDQRTQCQQGQQDLQCAGNEHHQAKLHHDLQGVAALLPGHLQFGCVVIQEEAVCLLQQPREVAGAGDETQVLATEERQVLHGVLQDAGGAEHHRVEQEPSRQFTDAFRADAVDQAREQVRRCHRGQAGKHDDGGNQQQQPAVRLPVRGEDLGDRRRQREHSHQRRSGIGAVAPVWRCACCRLSAQQEIVAHLE

SEQ ID NO: 160350 - protein, 178 aa, Glycine max
  Coding DNA Sequence Number=SeqID_68665
MAKFGHRHSPGILCQCLAYTGGRAGYAILGKGSVDPFRCGCPQPVPGIPFSARRGPGVRDFARTAAGRRVRIMRTNMTTLTQTWMTLLLSNIQPSDHNSDLPLPKCQLVYAILTRMSIHVAQLIADAIYQFAGMPHTRHPLDPDKSNRALGFPALITGLCQSFGVLVAPSKVIRPPIT

SEQ ID NO: 160351 - protein, 93 aa, Glycine max
  Coding DNA Sequence Number=SeqID_68666
MSGLIRDSPQILASPHQLDFAAYASGLYNAQWNAPGLLHDKHTLCSSHILRKMEVGFVVDLGMAFVDKWVVGKEKGCYWLSNDIVGLVGNLAM

SEQ ID NO: 160352 - protein, 46 aa, Glycine max
  Coding DNA Sequence Number=SeqID_68667
MKWRGLFSGLVTGSDEESVEFPGGIYGSENERKRIQRMCLGEVSGT

SEQ ID NO: 160353 - protein, 265 aa, Glycine max
  Coding DNA Sequence Number=SeqID_68668
  Gene Ontology: Mol. function=potassium ion transmembrane transporter activity; Cellular component=integral to membrane; Biological process=potassium ion transport
  Homolog annotation: Hit_ID=A7QII3; Match level="QueryCoverage=87%, HitCoverage=34%, E-value=2e-74, Identity=55%"; Hit description =Chromosome chr12 scaffold_103, whole genome shotgun sequence
  Pfam annotation: Domain name=K_trans; Domain location=1-262; Score= -230.1; E_value=9.9e-13; Accession=PF02705.7; Description=K+ potassium transporter
MFADLCYFSVRSVQLSFVFLVLPCLLLGYLGQAAYLMENHADAGQSFFSSVPSGAFWPTFLIANIAALIASRAMTTATFSCIKQSTALGCFPRLKIIHTSLKFMGHIYIPVINWFLLALSLVLVCTISSIDEIGNAYGIAELGVMMMTTILVTLVMLLIWQIHIIIVLNFVVLFLGLEGCNLGTIRAPRIGLLYNELVKGIPAIFGHFLTTLPAIHSMIIFVSIKCVPVPMVLRWILFLVMTPKFVFCHVWWLSIVHLLASIMSD

SEQ ID NO: 160354 - protein, 98 aa, Glycine max
  Coding DNA Sequence Number=SeqID_68669
MLNSWKHRTLSMGGQGGVGIKNLSYFNEALPGRWRWNLFNHDALWVKILESKYEGVKGFGGWIYVLFVKVVRHLIDLCLIASGSLGVAKRCGFGMIYG

SEQ ID NO: 160355 - protein, 874 aa, Glycine max
  Coding DNA Sequence Number=SeqID_68670
  Homolog annotation: Hit_ID=A7Q1F9; Match level="QueryCoverage=89%, HitCoverage=99%, E-value=1e-117, Identity=39%"; Hit description =Chromosome chr7 scaffold_44, whole genome shotgun sequence
MGLEALPRGEPHLSMERSHRRDYSQQMYGPVGLPFKHWQQEDRFMDREMLHEVHPSTEQVAYKDMYEIWQQSQRASHDRGKWSEDVDEKRMALIRQKFMEAKRLSTDERLHQSEQFKDALEVLSSNSDLLIRLLDSQNVSDLYSTSPNETKRITLIKPLKMVDNDKSARKEKTNNRPIKKPSSVDQANPGNSPDSQKVDESPVRTTRIVLLKPSPGRTPEQKAVVSPTTSLNLKSRNFHHGPEYDDVLESIRVANEITQQMHKGPRSYQKDKTLYSSVFSNGYSDDESSFNKSYHEYASANFSDFEATSMSPLPRLSWDYNYINGYGSPYSRMSLGRVPCSPESSVCREAKKRLSERWTMMTSDNKGHQEQRQARKSSTLGEMLSLTHKKKSVTSEVESINEDQEPGKSVSCSHSFNAEISIEGSPKNLPRSNSVPASSTVYENGLTVKVNDHKNTGKAQGSKEQKKPKSMRSSFKGKVATFLFSRSKKSTKEKPSSSQSKDASQSTSTVTATLVLPANSPGVLRGDVSQSINVDGFEECSLAALCESSGKNSTDSVSNGHEEDMITLEPGLTMPRPMVPEIHSSENPDQPSPISVLQPPFEDYNNNNASHESLNCMKSGDQGSQVPLKSNLIDKSPPIESIARTLSWDGSSAEVASSYALKPLMVSSLDSKVEDQEWLLLVHKLLSAAGLDDQHQHDSSYTRWHSLESPLDPSLRDALYANLNEKEPQPIMHERRRRKMRSNHKLVFDYVNAALLELVGYGSEKCLKRSKSHYRVQVQEGASAAASPLLVDHIVAQMKELIASGVRCEWENGGASTSLVVENVVRKEVVQIGWVELMELEIDILGKEIEGDLIQELVENAVVDLTGRASESLS

SEQ ID NO: 160356 - protein, 223 aa, Glycine max
  Coding DNA Sequence Number=SeqID_68671
  Gene Ontology: Mol. function=transferase activity; Cellular component= cytoplasm; Biological process=response to stress
  Homolog annotation: Hit_ID=A7Q1G3; Match level="QueryCoverage=98%, HitCoverage=98%, E-value=4e-59, Identity=52%"; Hit description =Chromosome chr7 scaffold_44, whole genome shotgun sequence
  Pfam annotation: Domain name=GST_C; Domain location=97-194; Score =34.4; E_value=4e-07; Accession=PF00043.16; Description=Glutathione S- transferase, C-terminal domain
  Pfam annotation: Domain name=GST_N; Domain location=2-77; Score=71.9; E_value=2.1e-18; Accession=PF02798.11; Description=Glutathione S -transferase, N-terminal domain
  Pfam module annotation: Pfam domain module=GST_C::GST_N; Domain location=97-194::2-77
MGEVKLLGVWPSGFVYRIIWALELKGVKYEYIQGEFNKPDFSDLLLKYNPVYKKVPVLVLEGKPIAESMVILEYIEETWPQPHLLPQDPYERAVARFWVSFAEEKSVSFMSFFVSVGEEFQKARKEVREVLKVLEETIGDKKYFGGEEIGLLDINLGWIALFFGVIEDVVGIKVLVVDDFPRLFTWIQNFREHPAIKTNFPSHQELFDYYKQKRETMVPSQIA

SEQ ID NO: 160357 - protein, 319 aa, Glycine max
  Coding DNA Sequence Number=SeqID_68672
  Gene Ontology: Mol. function=hydrolase activity, acting on ester bonds; Cellular component=nucleus; Biological process=lipid metabolic process
  Homolog annotation: Hit_ID=A7PZ15; Match level="QueryCoverage=89%, HitCoverage=72%, E-value=1e-109, Identity=67%"; Hit description =Chromosome chr4 scaffold_39, whole genome shotgun sequence
  Pfam annotation: Domain name=Lipase_GDSL; Domain location=36-293; Score=57.2; E_value=5.6e-14; Accession=PF00657.13; Description=GDSL -like LipaseAcylhydrolase
MELVTMSRTRVVLMTLTLVVVTVLNNTESAESARTFYVFGDSLVDSGNNNYLPTTARADSPPYGIDYPTGRPTGRFSNGYNLPDLISQHIGSEPTLPYLSPELTGQKLLVGANFASAGIGILNDTGIQFVGILRMFEQYALFEQYQQRLSALVGAAQAQRIVNGALFLMTLGGNDFVNNYFLTPVSARSRQFTVPQYCRYLISEYRKILMVSDTDMDACQTPESTRSWSRLYELGARRVLVTGTGPLGCVPAQLATRSSNGECVPELQQAAQIFNPLLVQMTREINSQVGSDVFVAVNAFQMNMNFITDPQRFGLSTFA

SEQ ID NO: 160358 - protein, 217 aa, Glycine max
  Coding DNA Sequence Number=SeqID_68673
  Gene Ontology: Mol. function=metal ion binding
  Homolog annotation: Hit_ID=O80922; Match level="QueryCoverage=71%, HitCoverage=16%, E-value=3e-19, Identity=41%"; Hit description =Putative uncharacterized protein At2g37520
MGEKVVCVHTLEEGKQENNEESRTELKRDYDQCVADTEPHLSPNKKQAKEVSNDEVRSEVSNPNVSAAELAQTFPDISIQPTESENVNHAECGELTSTCLENSSSDETLSDEAGEQNNNNNNTSQSDKDTSSAAMTSCVVMEIPKHASSSGIRKITFKFSKKKEDYDYQPPPPMHHPALYNDGNYIGFHGNVKNIWQGMIVGVTIIKTAFQQFTKFC

SEQ ID NO: 160359 - protein, 86 aa, Glycine max
  Coding DNA Sequence Number=SeqID_68674
MVGVVSDGVGVEDVGAEIIAIKESFNSLFPIRIIVGKKFGDIGESDARKGFGWLMGVGNEGVVVGHGRQGWGTTSLIEEIGNGWIV

SEQ ID NO: 160360 - protein, 545 aa, Glycine max
  Coding DNA Sequence Number=SeqID_68675
  Homolog annotation: Hit_ID=A7QS70; Match level="QueryCoverage=22%, HitCoverage=31%, E-value=2e-23, Identity=46%"; Hit description =Chromosome chr5 scaffold_156, whole genome shotgun sequence
  Pfam annotation: Domain name=SANTA; Domain location=23-120; Score =107.7; E_value=3.6e-29; Accession=PF09133.1; Description=SANTA (SANT Associated)
MADSTPTATPSNDIVSSSFRRTVTLYDWWLVIAKNDFQGKRLAVAGVSSRKDEATRVFVSAAVIKRYDVFSLETADGICVIIRGFINEQRTLENGFSAEVFHHFLFGFPPDWERYALDCFKEEPTTDADLGSVVPDNAPASCPKILSDGVEKSIPTCLVSPEEASGDHEMSFPENECNVSKEMGGVHVACSSGGKSHSFKLHNIKVCQQKKQPASECLPNHPDNENSSSVALENCNVERLESPTTPIQPQLWSEYSNDACVENAIPTSLASEEAPGDHEKSFPENESNVSKEINGVNVACSSGGKSRSARLHDIKVYQQKKPASGGSLKHPNNENSTSVALENCDVKGLKSPATPIQSQSSRQLSTSPGQVIKKSASKISRTLSPKTEGCYKKKRVTVETKVVMPKGKLNKSASALKNPREKDLSPLAKGSQQKISTFTPESLSFRKSRSGRLLLPPLEFWRNQIPIYNADHEITEIRDGASLISPCRGFSPSLSRRHFLRLKYLCTLDGFSGKFRSQLDDFIDQLGRISTEVLALFMKQHISQC

SEQ ID NO: 160361 - protein, 1327 aa, Glycine max
  Coding DNA Sequence Number=SeqID_68676
  Gene Ontology: Mol. function=metal ion binding; Cellular component =cytoplasm; Biological process=arginine biosynthetic process
  Homolog annotation: Hit_ID=A7PSR4; Match level="QueryCoverage=57%, HitCoverage=98%, E-value=0.0, Identity=60%"; Hit description =Chromosome chr8 scaffold_29, whole genome shotgun sequence
  Pfam annotation: Domain name=ArgJ; Domain location=933-1327; Score =568.9; E_value=5e-168; Accession=PF01960.9; Description=ArgJ family
  Pfam annotation: Domain name=PHD; Domain location=570-613; Score =51.7; E_value=2.5e-12; Accession=PF00628.20; Description=PHD-finger
  Pfam annotation: Domain name=PHD; Domain location=643-699; Score=1.8; E_value=0.0081; Accession=PF00628.20; Description=PHD-finger
  Pfam module annotation: Pfam domain module=ArgJ::PHD::PHD; Domain location=933-1327::570-613::643-699
MGEEVVCVHALEEGKQENNEESRTELKRDYDQCVADTEPHLSPNKKQAKEVSNDEVRSEVSNPNVSAAELAQTFQDISSQPTESENVNHAECGELTSTCLENSSSDETLSDEAGEQNNNNNNNNTSQSDKDTSSAAMTSRVVMEIPKHASSSGIRKITFKFSKKKEDYDYQPPPPMHHPALYNDGNYIGFHGDDEEYLARDDCSGGSLESPCGMGYVRDGDLDLYTRNMELKMSKKVVPNCYPTNVKKLLSTGILDGAVVKYIYNPGKVELQGIIDGGGYLCGCSMCNYSRVLSAYEFEQHAGAKTRHPNNHIFLENGRPIYSIIQEIKTAPLSLLDEVIKNVAGSSVNEESFQAWKESLLQSNGKVQAHKSYSTKLVGMPHTNISLVNGGLKLICLVLMLCQPVLSGFGNCQSVESTSHLSSLHVPSHYEQHMYMNQTTDEWKRVVKKPSSYTSNSGVLQKRSADGCTKRRDNDLHRLLFMPNGLPDGAELAYYVKGQKLLGGYKQGNGIVCGCCDIEISPSQFEAHAGMAARRQPYRHIYTSNGLTLHDIALSLANGQNLTTGDSDDMCAVCGDGGDLILCNGCPRAFHAACLGLQCVPDSGWQCLNCIDNAGNGRESSIVRPIMIRLTRVDKTPEVEMGGCVVCREHDFSVAKFDERTVIICDQCEKEYHVGCLRDMGLCELEELPKDKWFCCDDCNRIYAALQNSVSAGAEIIPASFSELIIRKHEDKGLCTYGAMNDIQWRILSGKSRYPEHLPLLSRAAAIFRECFDPIVAISGRDLIPVMVYGRNISGQEFGGMYCIVLIVNYVVVSAGLLRIFGRNVAELPLVATSRAHQGKGYFQVLFSCIERLLSSLNVEKLVLPAAGDAESIWTKKLGFRKMSEDQAFNSPLRNLRIRAVSTKENHIPAAPIFLPEGPWNQIPGGVTAAEGFKAAGMYGGLRAKGEKPDLALVTCDVDAVSAGSFTTNVVAAAPVLYCKRTLDISNTARAVLTNAGQANAATGKEGYQDMIECVESLAKLLKVKPEEVLIESTGVIGQRIKKGALLNSLPTLVNSLSSSVEGADSAAVAITTTDLVSKSVAIESLIGGTKVRVGGMAKGSGMIHPNMATMLGVITTDARLTSDVWRKMVQVAVNRSFNQITVDGDTSTNDTVIALASGLSGLGCISSLDSDEAIQLQACLDAVMQGLAKSIAWDGEGATCLVEVCVTGANSEAEAAKVARSVASSSLAAIYGRDPNWGRIAAAAGYSGVSFHQDLLRVELGDILLMDGGEPQLFDRHAASSYLRKAGETHDTVKIQISVGNGPGRGQAWGCDLSYDYVKINAEYTT

SEQ ID NO: 160362 - protein, 555 aa, Glycine max
  Coding DNA Sequence Number=SeqID_68677
  Gene Ontology: Biological process=plant-type hypersensitive response
  Homolog annotation: Hit_ID=A7Q1I6; Match level="QueryCoverage=87%, HitCoverage=74%, E-value=3e-41, Identity=30%"; Hit description =Chromosome chr7 scaffold_44, whole genome shotgun sequence
MARPRILMSFFMDLNILNQMLNAASLNSHVMCFYVGGWGVLFIGNDILHKLGKVLRHIIARIACRDYPHARHLCGKFPFSSTPHKQHCSQCHCYVCDSLAPCLKWGTGISSSDHCHANETEVWQIQRKNFKLGQSSPLPASTNFGTSLRPGHPHHNELLPPCVNNLSPNSVLPNQASISTAVCSIPSLSSIPQTQASRLPTTRFLSASSPNSSVQNQVFRPINTPIMSPATNITMPNGANHGMRRGSRPTLVRNKYQPHSVPRPALGVRSHTIQRERGNGSSSLRPKVLRPHMMSRGVGSAGNTSMANNSHGSSVFGNAGNMTQQHLNYCTTTGMPNYRNCNGPSDLCHPTNISFYSQPSSLPASLSCVNQHNVAAETQAYSQPLPQSNIIQGFDQNCIQVSRAPSSYVAHPNSSQHGKEPQIRSQNGNASGITTQCGTVSQDTCQPQPHEESPRETAGKFSAFDSSWIDNTGQSILQSSGSVVQPPNVKEIDAQFTGSNEPLIESSQLPNSMVDLDDWVLEKNPFPVLTDGVLPSDMNIPSPDLYSIDMNMGLW

SEQ ID NO: 160363 - protein, 44 aa, Glycine max
  Coding DNA Sequence Number=SeqID_68678
MGGGVPIELAIDQKGISLNKTKADSEKESDKNLSLQDNNSNFSP

SEQ ID NO: 160364 - protein, 408 aa, Glycine max
  Coding DNA Sequence Number=SeqID_68679
  Gene Ontology: Mol. function=inositol or phosphatidylinositol phosphatase activity; Cellular component=intracellular; Biological process=abscisic acid mediated signaling
  Homolog annotation: Hit_ID=A7PSY4; Match level="QueryCoverage=96%, HitCoverage=78%, E-value=1e-142, Identity=64%"; Hit description =Chromosome chr8 scaffold_29, whole genome shotgun sequence
  Pfam annotation: Domain name=Exo_endo_phos; Domain location=16-341; Score=149.4; E_value=1e-41; Accession=PF03372.14; Description =EndonucleaseExonucleasephosphatase family
MEAPSVIDIDTLNLRMFVGTWNVGGKSPNEGLNLRDWLMLPSQADIYVIGFQEIIPLNAGNVLGPEDSGPASKWLNLIRQALNSNTSSSGENSPTSSFNSRRQCCPNEQHYYCLAASKQMVGIFLCVWVRADLYKHVSKLKVSCVGRGIMGYLGNKGSISISMTLYHTTFCFVCTHLASGEKDGDEVRRNLDVSEILKKTKFSHSFKALGQPLPPESILEHDKIIWLGDLNYRLAAAYDDTLGLLKKNDWQALLEKDQLRIEQRAGRVFKEWKEGKIYFAPTYKYLFDSDQYVAQTNKSKEKRRTPAWCDRILWRGEGVEQLWYVRGESKFSDHRPVYSLFSVDVDLTCNKLSSPSIAASDSSSIISTRSCSSRPLTNAALSSSCFAKVQAEEQLLLLTRVHRHRVLT

SEQ ID NO: 160365 - protein, 85 aa, Glycine max
  Coding DNA Sequence Number=SeqID_68680
  Gene Ontology: Mol. function=S-(hydroxymethyl)glutathione dehydrogenase activity; Cellular component=cytoplasm; Biological process=metabolic process
  Homolog annotation: Hit_ID=P93629; Match level="QueryCoverage=77%, HitCoverage=17%, E-value=2e-27, Identity=84%"; Hit description =Alcohol dehydrogenase class-3 (EC 1.1.1.1) (Alcohol dehydrogenase class-III) ...
  Homolog annotation: Hit description=(S-(hydroxymethyl)glutathione dehydrogenase)
  Pfam annotation: Domain name=ADH_N; Domain location=9-84; Score=7.2; E_value=0.00028; Accession=PF08240.3; Description=Alcohol dehydrogenase GroES-like domai
MEVFLNLPLIAFAGSRRSFPCILDHEAAGIVESVGEGVTAVQPGDHVIPCYQAECEECKFCILGKTNPCGKVRAATGVGVMLSNH

SEQ ID NO: 160366 - protein, 214 aa, Glycine max
  Coding DNA Sequence Number=SeqID_68681
  Gene Ontology: Mol. function=transferase activity; Biological process= D-ribose metabolic process
  Homolog annotation: Hit_ID=A7Q1H4; Match level="QueryCoverage=87%, HitCoverage=44%, E-value=9e-47, Identity=52%"; Hit description =Chromosome chr7 scaffold_44, whole genome shotgun sequence
MSSESVLPLPENPIIVGFGGVGVDFLAVVPSFPKPDSKIRTTEFTVQGGGNNGNTMTCAARLGLKPRIISKVSNDGPGKTMLEELEAEGVDTSFFVSEELRVTSTWRFFLLQMQKREGKKVSKEGTSPFSYIIVDNQSKTRTCIFTPGYPEMVPQDLSRANLLSALDGARVVYFDARMPDNALVIAQEKNFHRQVTHTISQSKLLENIISTWDL

SEQ ID NO: 160367 - protein, 308 aa, Glycine max
  Coding DNA Sequence Number=SeqID_68682
  Gene Ontology: Mol. function=DNA binding; Cellular component=nucleus; Biological process=regulation of transcription
  Homolog annotation: Hit_ID=A7NZN4; Match level="QueryCoverage=97%, HitCoverage=47%, E-value=1e-108, Identity=58%"; Hit description =Chromosome chr6 scaffold_3, whole genome shotgun sequence
  Pfam annotation: Domain name=Myb_DNA-binding; Domain location=123 -167; Score=26.6; E_value=9.1e-05; Accession=PF00249.22; Description =Myb-like DNA-binding domain
DDQSKKMETKKNAKADTGESPNPAHSGSSKPKRVTFSDQVDVCCDGLIRGKRFTPEEDEKIKLAVFDYIESHGLGDEGLDMVLHCKSHPEIRDCWKEIGAALPQRPYVSVYTRAHILFERGEDRKWTPEEYEFLRKVKEQHGSDWKSVAEALGKHRFHVKDAWRRIKLTNTNQGRWTQEEYQNLFDLVNLDLRVRASQDYRKSKHGMLRDNIGWEAIGDKLTTRSSVLCCKKWYDKLTSPMVANGVWSDTDDYRLVNALFTLDACCMEEVDWDNLLEHRPGDVEILAKRFCPDLLEVREAFDEKPVIC

SEQ ID NO: 160368 - protein, 127 aa, Glycine max
  Coding DNA Sequence Number=SeqID_68683
RQVQGNAPQAADVPPPHQAGPAGLFDTEQYCGIWFASRWPTTGHMYRLMIVFYQMSLSLQSQGFTSFPCPTPNQFRAEVAWPGDWPEAQAGEAPAGAPTEAPDEADEAREDEEMTDLLDFLGGSGAT

SEQ ID NO: 160369 - protein, 68 aa, Glycine max
  Coding DNA Sequence Number=SeqID_68684
MVDDVAQRSEDVPQMTADIDVTVVEDLGRDGAEGSHADEGFPGGPRDPSVLTSFAEHVAHAIWTGHVL

SEQ ID NO: 160370 - protein, 47 aa, Glycine max
  Coding DNA Sequence Number=SeqID_68685
KLNARLVPSSNPLTRAKREGGTKAHHSAYFEKRALEAARGAAFAERP

SEQ ID NO: 160371 - protein, 578 aa, Glycine max
  Coding DNA Sequence Number=SeqID_68686
  Gene Ontology: Mol. function=oxidoreductase activity, acting on the CH-OH group of donors, quinone or similar compound as acceptor; Cellular component=outer membrane-bounded periplasmic space; Biological process=...
  Gene Ontology: Biological process=carbohydrate metabolic process
  Homolog annotation: Hit_ID=P75804; Match level="QueryCoverage=61%, HitCoverage=95%, E-value=1e-141, Identity=66%"; Hit description =Soluble aldose sugar dehydrogenase yliI precursor
  Pfam annotation: Domain name=GSDH; Domain location=429-536; Score =231.3; E_value=2.2e-66; Accession=PF07995.2; Description=Glucose Sorbosone dehydrogenase
  Pfam annotation: Domain name=Pro_CA; Domain location=27-193; Score =270.7; E_value=3.1e-78; Accession=PF00484.10; Description=Carbonic anhydrase
  Pfam module annotation: Pfam domain module=GSDH::Pro_CA; Domain location=429-536::27-193
MQEIVKGFLNFQQNVFPERKDLFKSLASNQNPKALFISCSDSRLVPELVTQSEPGQLFVIRNAGNIVPPFGPEPGGVSATIEYAVVALGVTEIIICGHSNCGAMNAIASNADLESMPAVDHWLHYANAAKAVVEERNYESVEKRLNEMVKENVIAQLNNIKTHPSVSVALRKGKLRLHGWVYDIESGGIIALTKGDCEKENPMRLWRVALLAGALSGSFTALAADVQVQVLQDKLDHPWSVAFLPDQQTLLITERSGQLRSWQPGRGLSQPISGVPDVWANRQGGLLDVVLAPDFAQSRRVWLSYTTADDTGRAGGVVGYGTLSADLRQLQDFKVVLEQTPKLSGGANIGTRLAFDRQGYLYIAFGDNFASRSAQQLDKLSGKIVRLTQDGKVPADNPFNHRQGARAEIWSYGVRNPQGLALNPWTQQMWESEHGPRGGDEVNLAAKGKNYGWPLATYGIDYSGQKVPEAQGSAVAGTEQPLFYWQQSPAISGMAFYNSARFPQWKNSLFIGALKDKSLIRLRVNGEKVEEAQRLLSDRGERIRDVRQGPDGYLYVLTDEANGKLLKVGLADAASAAR

SEQ ID NO: 160372 - protein, 64 aa, Glycine max
  Coding DNA Sequence Number=SeqID_68687
MDCHHQKGGDCGSNDFQDYFDDAKESRVKQVSKNQESKSFKNNQVSRIKIREQSRSRFKNQEKT

SEQ ID NO: 160373 - protein, 114 aa, Glycine max
  Coding DNA Sequence Number=SeqID_68688
MTEARQKGVRKQNRGGACHPARPGELRTPRRARLLPPEATAFWKAQVGLLSKKLRKLTDCVTILPFGFRHITEFHGWSNHASFWFPPSRDFTYCATNGAKYFEAVNQRLHAIKQ

SEQ ID NO: 160374 - protein, 79 aa, Glycine max
  Coding DNA Sequence Number=SeqID_68689
MVPPLFLLLVVLLSILESGKSTCIKIVSGLVPHGYNIKIDELHHKLYILQPAKHKNVKYAQNEFELATYLVFQSMPQVA

SEQ ID NO: 160375 - protein, 351 aa, Glycine max
  Coding DNA Sequence Number=SeqID_68690
  Gene Ontology: Mol. function=signal transducer activity; Cellular component=membrane; Biological process=signal transduction
  Homolog annotation: Hit_ID=Q7WBK9; Match level="QueryCoverage=92%, HitCoverage=65%, E-value=2e-93, Identity=60%"; Hit description =Methyl-accepting chemotaxis protein
  Pfam annotation: Domain name=MCPsignal; Domain location=104-326; Score=223.6; E_value=4.4e-64; Accession=PF00015.12; Description =Methyl-accepting chemotaxis protein (MCP) signaling domain
MVLLHATYVVVQAAALGWLAWKMERAGVAAEELARLSAHIGREVGVFDLRFDGQGMHSDLGRSFKTTMDAVHRTMSEVRATATSLSVALSEMMQGNQQLDAHAGTQAESLARTAASMRDLAANVHDNAARAQQARQLTDQARQTVDAGSAVVAGVATMMGEIQQESKKISEIIGLIDSIAFQTNILALNAAVEAARAGESGRGFAVVATEVRALAQRSASAARDIRTLIEGSLHKTSEGFRQADHAAGVIREVVSSIDQAARIVGQIGEAGQTQSADIDAVNLAVSNMDELVRETASEVAQAARASAAQQSQAAALLRAVEVFRLQADPAADAVAAPGARPPSAALRLAGA

SEQ ID NO: 160376 - protein, 181 aa, Glycine max
  Coding DNA Sequence Number=SeqID_68691
MKVDMETMKEQMTTMMEAMMSMRKMMKDNTATVVSASIATVMNSIHSTGFNQVNRPVSNVVGQGGEAAKNVCGPHHVEVQSKHSFLPYGLPPNYTPPTIVYASGENINNSAPVLIENQQPQSDHAHVSQPMGETHEVPQDNTLTGAVIFWHPCAECSQNISMSPVITTLAFCKGRGAFPST

SEQ ID NO: 160377 - protein, 33 aa, Glycine max
  Coding DNA Sequence Number=SeqID_68692
MLQPPNYPCPHHHHLICAQIWVFASFLCCPVIP

SEQ ID NO: 160378 - protein, 172 aa, Glycine max
  Coding DNA Sequence Number=SeqID_68693
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MEESSRENNKDHISQSRGSALDGEEHIGEWRNPIGKITSKAAGNLYGKEFRCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCYCRYAPPRQ

SEQ ID NO: 160379 - protein, 76 aa, Glycine max
  Coding DNA Sequence Number=SeqID_68694
MALSMPLRAESLADRVQKTENKGAKQSKDAKTLAFGRILGLGVISRFLEVEETSPPLCNMLFPLKTLFLLVKGVAL

SEQ ID NO: 160380 - protein, 122 aa, Glycine max
  Coding DNA Sequence Number=SeqID_68695
MESGDMRGYRMVTRTFRQPRANKSVDVQRLTSSSAPFAIQGQRVRWQAEIPYGHPHLSSTEANEFDGIRMMLVFTLVIRRHSSPTTHEILLCWAGTIKFDGVGKCHGSTGRDIDRPNDVPLE

SEQ ID NO: 160381 - protein, 136 aa, Glycine max
  Coding DNA Sequence Number=SeqID_68696
WNSYVPINVSFRQKLAQGFPVSTGHQDYLFCEVISVTAVPPVQLLTGWCVTAKAPPDISAGKCSGHAARRVPFAIQAAQLLGRAIGAGLFAITPAGERGMCCKAIKLGIRSNPPSYYPTAIILAKKNAHVVAIPPR

SEQ ID NO: 160382 - protein, 67 aa, Glycine max
  Coding DNA Sequence Number=SeqID_68697
VERMRQSYPARALARRLQVDWARDPRKGPRVLMSLRVSLAIRELLKEVFSKKLLKEVFSRKLLKEAT

SEQ ID NO: 160383 - protein, 64 aa, Glycine max
  Coding DNA Sequence Number=SeqID_68698
MPPPPPLRRREGTTVGRDPILHLPPSLSTCKQETNNTWPIVTGHRLTLVDFCRQLVSTSDHGPR

SEQ ID NO: 160384 - protein, 177 aa, Glycine max
  Coding DNA Sequence Number=SeqID_68699
VVPSVVRLMKQAIVFPLKKILKKFTTWEINRDKDILKEDSQASSRVLIINKDSGDHTLVTMSNHKSTELALKNLEIQVGQLAKQLADKSSNNFRENTEKNRKEECKVVMTRSKRFVEVEDEDSVVLKKEAALKNGTDKRKDDVRGCRNLPFGGRATRDSRDACSTKGIRAESPPTFI

SEQ ID NO: 160385 - protein, 120 aa, Glycine max
  Coding DNA Sequence Number=SeqID_68700
MKTLWKMKYLEESKTVKEEGKGLDVEGKEASDQGNGDPKSNIHSIQRGDEIFDNWWERKWARLTGALPKGGKMHGVATNEGISTSHVDKSRAFAPTYPPLERKSDLRSSFLCMNQAILFT

SEQ ID NO: 160386 - protein, 57 aa, Glycine max
  Coding DNA Sequence Number=SeqID_68701
MEKERVEMWEITLIIHHEGTFIRNEADGKLEYVGGELDVRGVRRSNMAESGIMLMSF

SEQ ID NO: 160387 - protein, 83 aa, Glycine max
  Coding DNA Sequence Number=SeqID_68702
MSSSAPSQEMSASSSRDCEKISFAIHKTQSPITCSDYRRHLHLSWRCQRLLAETAKKSHLLSVAGGDTRVVIRTKTTSVNPDP

SEQ ID NO: 160388 - protein, 228 aa, Glycine max
  Coding DNA Sequence Number=SeqID_68703
MCKFLERENAEMKFPEFGKYYKRESQWQPDYHNEAEGFLNLDDLLMQFRDTVESMQQAYRRTETQKNVKRLKYIKKAFFKLSIHHQLTNEEEKHEVSSIREYPCLATVGYVGGKDKCRLELSVENKKISFDLFEAMKHSEIGDAYFEEEDVKQEIALLASTMVLQSPLEREPGYGIDCLVCDEELDDPKDSCVDHVVFEELKKNETNRKAQSRIKDPSGTFKVCILGR

SEQ ID NO: 160389 - protein, 682 aa, Glycine max
  Coding DNA Sequence Number=SeqID_68704
  Homolog annotation: Hit_ID=A0TVB9; Match level="QueryCoverage=68%, HitCoverage=52%, E-value=2e-44, Identity=30%"; Hit description =Putative uncharacterized protein precursor
MTAVAVSPIANPLLLVAKRAATIPLNASTEPTERSTPAVIMTKDDQGVFIAEKIVAAPGPLSDLIFANQRHDQAQCEKGDDNAVFVHTALIAGENEIPGDKEWALLIFFLSLLNRKFHQCCLGRIGCRKLAGQLPVTKHQYAIAHADNFRKLGGNHNDPFVLQGELRHKSIDLFLGPDVDTARRLVEQQNLRIQQRPTAQHHFLLVAAAQVAHRLFAVVGFNVEALDHVAGSRLLPFLADKPHPADGGKRGDIDVFTDGTAQHQAGFLAIFRHVGNTAVDGLARRVAVQRLVAQANRAAVGMLNAEDKVEKFTAARSHQPIDAQDLTVLQLQADIFYLAAPTQVIDRQQDLSAGLIEFGELAVVLAANNVFDQLFTGNVGDIAFMDIGAVAENGVALLKRLKDFLRILFANRRGGFIHDDDVGIGMRQRLGDLDQLLFGDAQVAHFFSGVDLEIEFFEQAGRALVERCEIDEPQASRLAAQPNVFGHRQIRDRAQLLLHDGDAGIEGFPRMMKFAALAIDKNVAAIGLNKAHQNAEKGGFTRAVAAAQGMDGSAPQAKLRILERHDRAEGFPDAADLQQVALIKRLVLRLPAGVWRRARGLIQRNEALAQFGQQCGGVPARIVGQHRRPHRLNGAAQRRGLFGFQTDHRASHYVRDDLSPGGAAGAAAGEADFARFDALTAK

SEQ ID NO: 160390 - protein, 170 aa, Glycine max
  Coding DNA Sequence Number=SeqID_68705
  Gene Ontology: Mol. function=catalytic activity; Biological process =trehalose biosynthetic process
  Homolog annotation: Hit_ID=A7NV04; Match level="QueryCoverage=42%, HitCoverage=20%, E-value=2e-28, Identity=82%"; Hit description =Chromosome chr18 scaffold_1, whole genome shotgun sequence
  Pfam annotation: Domain name=Trehalose_PPase; Domain location=1-166; Score=-44.2; E_value=0.00046; Accession=PF02358.7; Description =Trehalose-phosphatase
DSFPSKTSPLHSADKSTSGNSINTSEFEKRIIKVEQSVNIFLTEYTPDISGLCAMSHCFPFPPRGYTNKGYEKKATTEDMELLTKSWAALVEKVRLVLNEYPQLRLTQGRKVIEICLTIKWDKGKALEFLLESLGYENSNDVFPIYIGDDQTDEDAFRLTNAATPSQLVR

SEQ ID NO: 160391 - protein, 68 aa, Glycine max
  Coding DNA Sequence Number=SeqID_68706
HNIEIPNGDIALNWVANVVLKFHDDPTVNESEIIVFLRHVRWPAGKREGFGKREKKQHCEGEKAEESV

SEQ ID NO: 160392 - protein, 149 aa, Glycine max
  Coding DNA Sequence Number=SeqID_68707
  Gene Ontology: Mol. function=binding
  Homolog annotation: Hit_ID=A7PW36; Match level="QueryCoverage=32%, HitCoverage=5%, E-value=9e-14, Identity=71%"; Hit description =Chromosome chr8 scaffold_34, whole genome shotgun sequence
MSVPTTYVFMKRFLKAAQADRKEHAASAVLNFSEDCTPHMLTPYLDGINGKQIMQEGALTALASIADYSQVKDIVQGALFPEAGLDNRVGHARGVGGLVIVQDLDLLSYYGGAPSLNPTPSKVYDGPIKPVLEKHYLLRRKLANDRLRK

SEQ ID NO: 160393 - protein, 54 aa, Glycine max
  Coding DNA Sequence Number=SeqID_68708
MTNNHHYSVTHQFDVSHDIQNSVEGKIKQTMEKAFWDCIMENEADEKRPFIIFF

SEQ ID NO: 160394 - protein, 180 aa, Glycine max
  Coding DNA Sequence Number=SeqID_68709
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=37%, HitCoverage=33%, E-value=1e-19, Identity=69%"; Hit description =Chromosome chr4 scaffold_32, whole genome shotgun sequence
  Pfam annotation: Domain name=APC10; Domain location=44-180; Score= -45.4; E_value=3.1e-05; Accession=PF03256.7; Description=Anaphase -promoting complex, subunit 10 (APC10)
MKRRLYYTTKKKLFYIGQLTSVIAKTDVNESAVAFLNRSVDTHIAPHSFRYCRKPLAGTHRTSYRRKVEENPTLLLELCGSKKPYTSLGTVVGAQRSKLSTLPVNKLIVLFLVFKLDESYTPSKVSIRAGDGFHNLKENKTVELVKATGWVYLSLSGVNPRTTYNKQIDTWILNPLQPIY

SEQ ID NO: 160395 - protein, 81 aa, Glycine max
  Coding DNA Sequence Number=SeqID_68710
MVAFLELITLKTLIAAFLKLAITIRQDCSAPFGLRLTREFHYKQLEAIEGMSMTSLRQVLKVTTEVMADCEGHGRVKGESE

SEQ ID NO: 160396 - protein, 164 aa, Glycine max
  Coding DNA Sequence Number=SeqID_68711
  Homolog annotation: Hit_ID=A5C6D8; Match level="QueryCoverage=65%, HitCoverage=4%, E-value=1e-08, Identity=34%"; Hit description =Putative uncharacterized protein
MGRQLGFLEERNILDEILVANEVVHEVKTKKRAYLIFKADFEKTCDTVSLLQFADNTIFFFKDSMQESITLKNVLTRVARVLNSATMSTPFNYSGLPIGANARKLSTWQPGDQSRSQCFVRMLQPYGINIGLKEHSNRVTPKVYIPKSPSGPLPPDSGPTQKTF

SEQ ID NO: 160397 - protein, 154 aa, Glycine max
  Coding DNA Sequence Number=SeqID_68712
MLYAIKSTSGFSTPSPRNPRKLQRCFELEIREEKDSTFVEEDGKPRTRRQIARTKKEKPNSVPPSTPSPKSEEENGGNLDHVGQVCFVGLVAIGDSLIGCFVFLEFDLSKVCNCQCTSDGLLLLCGGRDVNSVIIFLCSKRDLSWAYLTSSWAK

SEQ ID NO: 160398 - protein, 112 aa, Glycine max
  Coding DNA Sequence Number=SeqID_68713
  Subcellular localization annotation: CTP_CleavageSite=63; ConfidenceScore=5.61e-01
MTTLHHTNQQPPTGFKSHTNHHTPQPSPNHSTSQKLTLFPPPTPLPNPDCNHLSSFFKDLTISQSIAPPLSSLHRTPTLDMIIQVPKLIFLYKDLSPKTYFLTEKHPYPFPL

SEQ ID NO: 160399 - protein, 84 aa, Glycine max
  Coding DNA Sequence Number=SeqID_68714
  Subcellular localization annotation: CTP_CleavageSite=46; ConfidenceScore=5.20e-01
MLRSISSTFLSPSYISADAFPANFSLFLSVALIFWLPLRVTLGQVNAMYDPAFERAGVPIDPILRLFNANSAEKPAEEVPENPN

SEQ ID NO: 160400 - protein, 69 aa, Glycine max
  Coding DNA Sequence Number=SeqID_68715
  Gene Ontology: Mol. function=aspartic-type endopeptidase activity; Biological process=DNA integration
  Homolog annotation: Hit_ID=Q9C536; Match level="QueryCoverage=82%, HitCoverage=4%, E-value=3e-09, Identity=55%"; Hit description=Copia -type polyprotein, putative
MMKKWQHQMSFCTPPPSPTHSIRETSSFEGSSKAMEDKRWRQAMEEEINIIKKNDTWELSKLPKNHEAI

SEQ ID NO: 160401 - protein, 68 aa, Glycine max
  Coding DNA Sequence Number=SeqID_68716
MDKWQRQSPQTRSPQCGCIHRSTSDFDTRRKKKNDRVQAQGERRRTIGFKRGCYYGVVNIGFGKNDVN

SEQ ID NO: 160402 - protein, 105 aa, Glycine max
  Coding DNA Sequence Number=SeqID_68717
  Gene Ontology: Mol. function=oxidoreductase activity, acting on single donors with incorporation of molecular oxygen, incorporation of two atoms of oxygen; Cellular component=chloroplast
  Homolog annotation: Hit_ID=Q208P3; Match level="QueryCoverage=88%, HitCoverage=15%, E-value=2e-38, Identity=78%"; Hit description =Dioxygenase RAMOSUS5
  Subcellular localization annotation: CTP_CleavageSite=58; ConfidenceScore=5.13e-01
MSLPRSNFTFSGSMAAVYGMSPMILALMVNPSKSTSPIYLIPRFPGKNNGKERDWRVPVEAPSQLWLLHVGNAFEVRHPHGNLDIQIQAAACSYQWFNFSKLFGN

SEQ ID NO: 160403 - protein, 71 aa, Glycine max
  Coding DNA Sequence Number=SeqID_68718
MSVKNLVGRLGVHDKTNHTLASQVTLTRMLQPYGINIGLKEHSNRVTPKAYTPKSPSGPLPPDSGPTQKTF

SEQ ID NO: 160404 - protein, 152 aa, Glycine max
  Coding DNA Sequence Number=SeqID_68719
MERYSQNIHSKNILPERNVNLFVIEYDEFRQELIRRNWHKALTQHMDGPINVALIKEFYSNLYDPEDKSPKQVRVRGKLIMFDGDSKNTFLEMHLILELEEQYTSYSLLCRTRINPYELAARLCIPGRGFVLNAKGAPWKLLRKDLTTLAQT

SEQ ID NO: 160405 - protein, 64 aa, Glycine max
  Coding DNA Sequence Number=SeqID_68720
MALSEPSRTKSPTKLKLAKNRDMLESLCNRETQHDKGAPKTSSFKRILGDNLPWKAKAFVGNFC

SEQ ID NO: 160406 - protein, 78 aa, Glycine max
  Coding DNA Sequence Number=SeqID_68721
MGNKWEVRKSSKGLSKELIQGRLIWLEAYKNKMPKSSPNMHVKQEVSTRVKPRLLCKQSMGQNILNKIDDDDSNSHQG

SEQ ID NO: 160407 - protein, 111 aa, Glycine max
  Coding DNA Sequence Number=SeqID_68722
MCHPEQRCPQWWLQPHVYNHQIPIHQVYPYKNKGVNLIVSPRYTHPQKYIKLIHGTVHYDEEPPLIAISPGPLSSVESASDADMTSSGESTSGSGSSSPSRKSEHPQQLRR

SEQ ID NO: 160408 - protein, 68 aa, Glycine max
  Coding DNA Sequence Number=SeqID_68723
MVRWLLYTIPSANYSLRYTYSSKQWSVSGLDFSNNHNFLFLLSKDTTMWDSSQKEQVHWFEPKISPPR

SEQ ID NO: 160409 - protein, 219 aa, Glycine max
  Coding DNA Sequence Number=SeqID_68724
MLHDRDVMNHHVLVVPENNLRQKSSLLNIDRVFPKEEKLQQEQSTPDSVVNRDQNTIPTNPTTAPRHFVNFVYDTKFERTGIPIYPISDYSNHHHHHHQGSSHRHKRDQGHLPVNTLHKVAIKAVDVLTVMAIRVELSPSAMPWIQIRALQKPGSNHIAAVNVTPSNNLPTPSHQDDSSNHEANIFQGCADAVKLEAYADAVRFSSLIIRHMEILHSRI

SEQ ID NO: 160410 - protein, 230 aa, Glycine max
  Coding DNA Sequence Number=SeqID_68725
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=Q14RS5; Match level="QueryCoverage=87%, HitCoverage=66%, E-value=3e-56, Identity=59%"; Hit description =Sterol decarboxylase
  Pfam annotation: Domain name=3Beta_HSD; Domain location=1-230; Score =7.7; E_value=3.5e-10; Accession=PF01073.10; Description=3-beta hydroxysteroid dehydrogenaseisomerase family
  Pfam annotation: Domain name=Epimerase; Domain location=28-217; Score= -31.0; E_value=7.5e-05; Accession=PF01370.12; Description=NAD dependent epimerasedehydratase family
  Pfam annotation: Domain name=NAD_binding_4; Domain location=17-216; Score=-83.0; E_value=0.0021; Accession=PF07993.3; Description=Male sterility protein
  Pfam module annotation: Pfam domain module=3Beta_HSD::Epimerase::NAD _binding_4; Domain location=1-230::28-217::17-216
MLIRHKEYYIRIVDLEVNIVLELAEQLGLLGQALHSGRAQYVSLDFCNKAQVLKALEGVEVVFHMAAPNSSINNYQLHHSINVQGAHNVIDACMVLNVKHLIYTSCLVYPSFPSIFFDDVHGIHNGNETMPYVHSVHTLATYLRIPNDHYSATKAEGEALVIKANGTNGLLTCYIRLSSIFGPGDRLSMSSLVAAARKGESKRGVSYSEIEGAEDIGFSSSFEVFYGRST

SEQ ID NO: 160411 - protein, 97 aa, Glycine max
  Coding DNA Sequence Number=SeqID_68726
  Homolog annotation: Hit_ID=A5BSR3; Match level="QueryCoverage=65%, HitCoverage=20%, E-value=4e-11, Identity=56%"; Hit description =Putative uncharacterized protein
MARTNKTGEMTTEATKEIAEKIDSFEEQVTQGSFVPHGRQDVLTTAIGRLEHPGRVRAAGAGVTIKQYFGSAPQMSRSSSSLPLEELQQLTQQIGTS

SEQ ID NO: 160412 - protein, 116 aa, Glycine max
  Coding DNA Sequence Number=SeqID_68727
MTNANCPQESLHSVSNGNLRVCVCVCGGHSRVAKDHHILNIINHTMHIYIAGIDKFPERETGATISELIWFAEKGHPITISLQETYKGLKNIAYMIWNERALNWFQWLELWTRVMI

SEQ ID NO: 160413 - protein, 126 aa, Glycine max
  Coding DNA Sequence Number=SeqID_68728
  Subcellular localization annotation: CTP_CleavageSite=59; ConfidenceScore=5.75e-01
MSSSVPLFEFASFPIAAELVASPNSSSSLTLLLTPSFLSKTNPTTPTTTPTSSGGQWCVANQGASCRSKLHDESRLIQRVLMITKMMTKSKAQKSRTLHDNKDDDLKNQRMSSRLNQEHFKVQEEI

SEQ ID NO: 160414 - protein, 240 aa, Glycine max
  Coding DNA Sequence Number=SeqID_68729
MRKGALAADQDGVDDTVCEKYDISKEKWAQFCQTRRDPSWEDVRKKAQVIQKQNTAPHILSRGGYEYLEQKLLAEKTKKKLEEDAQSRSVDGIIDPPSPVRRHVKWKMARTKKTGEMTTEAAKEITEKIISPFQPTIRIIFQYFVNAMYNCVFSMQDSFKEQATQGSFVPHGRQDVLIAAIRRPEHPGHVRAAGAGVTIKQYFGSAPRTSHSSSSLPPEELQQLTQQIRDQLEESITDVK

SEQ ID NO: 160415 - protein, 33 aa, Glycine max
  Coding DNA Sequence Number=SeqID_68730
MAEKEKDEKIVDGDKQQLAKFNKRHLRTKFNLN

SEQ ID NO: 160416 - protein, 61 aa, Glycine max
  Coding DNA Sequence Number=SeqID_68731
MLEPRGWGGFVLKEKIKCLNERLKLWNKEQFGVTFKRVQNIEAEINKLETESADRILTPEE

SEQ ID NO: 160417 - protein, 109 aa, Glycine max
  Coding DNA Sequence Number=SeqID_68732
  Gene Ontology: Mol. function=aspartic-type endopeptidase activity; Biological process=DNA integration
  Homolog annotation: Hit_ID=Q9C739; Match level="QueryCoverage=74%, HitCoverage=5%, E-value=3e-09, Identity=41%"; Hit description=Copia -type polyprotein, putative
MVLEEDVNMAKEEEIVTIVIIMKEVINPLETNEAKCLKDSIKDEAWGCLTSTILTNCAKHVSLANMQVFDQGRSKLDDMSVKHVFIGYNASSKGYKLYNPINGKNVVSR

SEQ ID NO: 160418 - protein, 92 aa, Glycine max
  Coding DNA Sequence Number=SeqID_68733
  Gene Ontology: Mol. function=oxidoreductase activity, acting on single donors with incorporation of molecular oxygen, incorporation of two atoms of oxygen; Cellular component=chloroplast
  Homolog annotation: Hit_ID=Q208P3; Match level="QueryCoverage=98%, HitCoverage=14%, E-value=7e-36, Identity=75%"; Hit description =Dioxygenase RAMOSUS5
MAAVYGMSPMILSLMVNPSKSTSPIYLIPRFPGKNNGKERDWRVPVEAPSQLWLLHVGNAFEVRHPHRNLDIQIQAAACSYQWFNFSKLFGN

SEQ ID NO: 160419 - protein, 332 aa, Glycine max
  Coding DNA Sequence Number=SeqID_68734
TCKRILQGSGTLKRVAWGLDVGTRGSVAPVVLVQLKGVLSMGRVLLRMIFLQLKDLGLSSTGRIVRGFFSLAEMHLDVKIDRNGIGCLSYWEELPCGIYSMHVDASKSSVYLDRRAPPILEEPQSSELSSIFPQTRESKTGAPEANIMIEGQPMRVTLEDYSSSVVPQFFTNMYAHLATYIEICNTVKIAGNSLNTWDEVVEKFLKYFPESKTAEGKAAISSFHQFPDESLSEALERFRGKIKLKTPKEEMELIENMAASCNIYGGAHESGCYITINDTPQEHGSNYNQQQGQWRSHPGNQFNKDQGGPSNRPQQQGPSLYDIATMLEENLA

SEQ ID NO: 160420 - protein, 107 aa, Glycine max
  Coding DNA Sequence Number=SeqID_68735
MDGPIDVALIKEFYSNLYDPEDKSPKQVRVRGKLIKFDGNSLNTFLETPLILELEEQYTSYSLFYRTRIDPQELAARLCISGRGFVLNAEGAPWKLLRKDLTTLAQT

SEQ ID NO: 160421 - protein, 121 aa, Glycine max
  Coding DNA Sequence Number=SeqID_68736
MATNRCFPSQKRKRKDGDLSLKEQVAFLTLKVKELESRLHVKEVDGQPNSTTKNVKDSCMLFFCNILEVYNCVANEKLHNRPLSLNHVKVLIGYVIESDAPLPLPIEDVGIMVVLDQVALE

SEQ ID NO: 160422 - protein, 42 aa, Glycine max
  Coding DNA Sequence Number=SeqID_68737
EKEEERYGSSTRRKKKNDRVQAQGERRRMIGFKRAGCAISEL

SEQ ID NO: 160423 - protein, 28 aa, Glycine max
  Coding DNA Sequence Number=SeqID_68738
MFKPTIATKENEVINLSSWPKTMKAKKR

SEQ ID NO: 160424 - protein, 225 aa, Glycine max
  Coding DNA Sequence Number=SeqID_68739
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=80%, HitCoverage=21%, E-value=8e-94, Identity=91%"; Hit description =Lipoxygenase-4
  Pfam annotation: Domain name=Lipoxygenase; Domain location=2-225; Score=-87.9; E_value=1.5e-14; Accession=PF00305.10; Description =Lipoxygenase
MNVYYTWVMPFLNSRRDLSSGREEEGVEIVSKRRDNNNDKNEVGGVAVKDPSAPHGVRLLIEDYPYASDGLEIWDAIKSWVEEYVSFYYKSDEELQKDPELQAWWKELIEVGHGDLKDKPWWQKMQTREELVEASATLIWIASALHVAVNFGQYPYGGLILNRPTISRRFMPEKGSPEYDALAKNPEKEFLKTITGKKETLIDLTIIEILSRHASDEFYLGQRDG

SEQ ID NO: 160425 - protein, 31 aa, Glycine max
  Coding DNA Sequence Number=SeqID_68740
MDPDQGSSKAWKLKFKLNPGISNQSELPKRN

SEQ ID NO: 160426 - protein, 57 aa, Glycine max
  Coding DNA Sequence Number=SeqID_68741
MDKSLKRDAQWLRARKNPEEDELSGSLSAPLQVIKRTASAHPLSERSALSQNPLMHA

SEQ ID NO: 160427 - protein, 124 aa, Glycine max
  Coding DNA Sequence Number=SeqID_68742
MATTEALEQETKKARKEEHGRNKFRGTLWGSNSELKLRRAKRDQSWIEGMILKDELKACHRSKRSLSEKLEDEYAKVSVLQAEREAREKAKAMADVYSAPEEVHGLLNYCQHMIDLMAHMIRSR

SEQ ID NO: 160428 - protein, 75 aa, Glycine max
  Coding DNA Sequence Number=SeqID_68743
MNDWSTSIGFAPVYCFLEPQSIRCAKDTHEECQQYIETWVRESHQEVYLGPYLNHAMKKICSNFQGKDNAPPPPP

SEQ ID NO: 160429 - protein, 175 aa, Glycine max
  Coding DNA Sequence Number=SeqID_68744
DFYANLYIFEDPSPKKVRVRGHQVRIDADSLNTFLERPHVVEGETLPAYSRYCRLPTDYKEIEVALCIPGRGFVFNSEGHPGKILRKDLMTLAQVWSVLSYSNLAPTSHTSDLTVDRARLIFGLDSQMDINVGALISGQITSIAQSNSSRLGFPTLITACVRPEGLIMIAWLSSA

SEQ ID NO: 160430 - protein, 133 aa, Glycine max
  Coding DNA Sequence Number=SeqID_68745
MQLGGFDERTSIQILDFRIERDIERNQEFSLFLRFMDPIQFSGIFHSYFFPSREFYKTLGLPNLEYPTFTQFTGFNKQSIFHDQVDCSAPVSSKRKKISESYFLDPKRVLGFSHTKKYIMPDLTGVRGGGGTG

SEQ ID NO: 160431 - protein, 130 aa, Glycine max
  Coding DNA Sequence Number=SeqID_68746
  Subcellular localization annotation: CTP_CleavageSite=58; ConfidenceScore=5.16e-01
EQQAEWVNAQRQTLRPLSFRNNKLSGNNKLSGNNKLSGQTRRDKFCALYQSGAVRQVPQAGRGNCHTLISSGDHPSLGCDPHLTSSRYLAPIIRQFVKFRDMPEVKRKHCSTIREVLRHAGNEKDVLVRN

SEQ ID NO: 160432 - protein, 74 aa, Glycine max
  Coding DNA Sequence Number=SeqID_68747
MLEDEYAKVSILQAEREARERVIDSLHKEAMMWMDRFTFTLNGNQELLRLLAKAKAMADVYSAPKEVNGLLDYC

SEQ ID NO: 160433 - protein, 382 aa, Glycine max
  Coding DNA Sequence Number=SeqID_68748
  Homolog annotation: Hit_ID=Q6WAY6; Match level="QueryCoverage=82%, HitCoverage=58%, E-value=8e-18, Identity=25%"; Hit description =Putative uncharacterized protein
MDGLVDLAAIDIFLTFHDRNESLVVAILADLYDTFDRRCEKNSTRIVCCTPALYVWLVSHLFRQEVRHACPLEGHRSCTEKKEASWDRLLASKEGASVNWFPRWKEGRTEILISCGGFPNVSLMGTRGCINYNPILAIRQLGYPMRGAPLEEDLTPIIARGFNSTNAQGMGDGAKEGQGTQRQVELEKAQTVKEKFKSAAIRIRKENAELRDINIATTKALEQETKRAHREEHGRNKFQGALWGSNSELKLRREERDQSRVDSLILKDEFRICLRSKRSLSQQLCEIETNMLAIINKYQEELNLATAHEHKVADEYARVYTEKEARGRVIDSFHQEATIWMEQFALTLNGSQELPRLLAKAKAKAMADAYSAPEEIHGLLNY

SEQ ID NO: 160434 - protein, 801 aa, Glycine max
  Coding DNA Sequence Number=SeqID_68749
  Gene Ontology: Mol. function=hydrolase activity; Cellular component =integral to membrane; Biological process=carbohydrate metabolic process
  Homolog annotation: Hit_ID=Q5PHK0; Match level="QueryCoverage=98%, HitCoverage=96%, E-value=0.0, Identity=63%"; Hit description =Putative hydrolase
  Pfam annotation: Domain name=Alpha-amylase; Domain location=2-389; Score=-57.6; E_value=3.5e-06; Accession=PF00128.15; Description =Alpha amylase, catalytic domain
MTFDRAAQLVPYLQQLGISHLYASPIFTATRDSTHGYDVTDANEIDPAIGGRAGFDRLSAALQQAGIGLILDIVPNHMAASLENAWWRDVIEHGEASRYARYFDIDWSRRLTLPFLGEDFDRVLANDELSIKADPHSGNPALVYYDSYYPLTPASWQQRKDEVLALRDRAAIAELHAQQPWQLMNWREARSALSYRRFFEITGLVGVRVEDDERCVSGLRVDHVDGLADPLGYLQQLRQAAGDACYITVEKILADGEQLPADWPVSGTTGYEFIAALSHALIDDNQIDMLHLAYEAVSAERNDVAAGLRAARELMVDRNFAGEFSRLLALATEAADLVHRNFSEAELHVALRELLIAFPVYRTYGRKAGMPLEGEALLLQVLEQVKHSASPAALSFLQALLLGAITEQGEQDAAEFRARFQQLTGPLMAKSVEDTLFFRNHVALAINEVGAEPLPHAFSLERFHREMQTRLQHQPDGLSGTSTHDTKRGEDARARLYTLSEAPALWAENVTRWRQMNQPHVVALADGPAPEPPVEWMLYQALAGVWPTTLQPEDTAALDALRDRFLPFVEKALREAKLRTDWADSNEAYENAVLEYARQLLSPTNPAFLQDFSHALQPFIRAGLVNSLSQTVIKLTAPGVPDIYQGCEALDFSLVDPDNRREPDFAQLTAQLDVHAAPDFASQQDWLSGRLKQQMVARLLHLRRDHAQLFRFGDYQPLSASGEHAEKVIAFARQDSDYALLVITPRLIFNGAQWSHTRLALPESLAHRHYRNVLTGETVVINNDVTLDNVSYSAPLVLISQ

SEQ ID NO: 160435 - protein, 370 aa, Glycine max
  Coding DNA Sequence Number=SeqID_68750
  Gene Ontology: Mol. function=pyridoxamine-phosphate oxidase activity; Biological process=pyridoxine biosynthetic process
  Homolog annotation: Hit_ID=A2WHH0; Match level="QueryCoverage=44%, HitCoverage=83%, E-value=6e-18, Identity=32%"; Hit description =Putative uncharacterized protein
  Pfam annotation: Domain name=DUF1275; Domain location=18-195; Score= -20.8; E_value=0.00032; Accession=PF06912.2; Description=Protein of unknown function (DUF1275)
  Pfam annotation: Domain name=Pyridox_oxidase; Domain location=209 -307; Score=51.0; E_value=4.2e-12; Accession=PF01243.11; Description =Pyridoxamine 5'-phosphate oxidase
  Pfam module annotation: Pfam domain module=DUF1275::Pyridox_oxidase; Domain location=18-195::209-307
DLFMLISTEDTRTFNTDIRLAATLAAVAGALNTAAFETVGFFSANMTGNVSSLSDHLAKANLHIGLFFLLIVLLFIAGSSVSTLIINSGRRRQIRGIYAINILLEGIALLRGRRVADSQPELSDGPAKCGGNAHLQCPRAHDAPAKTALLHRAGISRWRRAGHSAAAVAKLRAADRHWVTAQCAGAVGAETCGQQSASRPLRKGIMISLEDRLQAIWQLLSTATTSRSAFTLMQLATVTADGQPSLRTVVIRQFLPALPALRFTADRRSAKMQDIAAQPQVALLAYDAASRVQLRLAGTAQRVDDAQQRAAAWQALRPHSHALFQSPVRPGSVIAHPDDAQPASAQKAGTGPDEHFALVQITLHSVEWLD

SEQ ID NO: 160436 - protein, 122 aa, Glycine max
  Coding DNA Sequence Number=SeqID_68751
MIARVGKARAAVEELKRFLAAKSLEEVNRKLDKFYMVLILRSLHSDFDHVRDQILVGDQVPSMDSLITRLLCVPQALKEENLAESVETSAMAASRGRGGGRNNRGGRGCKRGLITRNMIKDT

SEQ ID NO: 160437 - protein, 47 aa, Glycine max
  Coding DNA Sequence Number=SeqID_68752
HGLEIYPKAHENPRAFPWISSPIYLESSNQCPCGAVLSDSTPASIAG

SEQ ID NO: 160438 - protein, 257 aa, Glycine max
  Coding DNA Sequence Number=SeqID_68753
  Gene Ontology: Mol. function=dipeptidyl-peptidase IV activity; Cellular component=membrane; Biological process=proteolysis
  Homolog annotation: Hit_ID=A6ECD1; Match level="QueryCoverage=99%, HitCoverage=35%, E-value=9e-66, Identity=50%"; Hit description =Dipeptidyl aminopeptidase
QLNRKQNQSKVIVADANSGNSKTIYTETDPAWIDIKSRWNDNDPSGWDWINNGKEFGWLSEKDRWRHIYKIDLNGKETLITKDDFDVIKPEFFDVPNKLIYFLASPKNATQEYLYKVSMNGGKSERVTPESYPGTNKYSISSNGKLAIFSNSSVNARSNGSIISLPDHKELVAAKNSTKADPSRSKAEFFQITTQDGITLDGWVVKPKNFDPNNKYPIVFTVYGEPGAQTVTDSFYTGWNGLYIGDMAQDGYIYVST

SEQ ID NO: 160439 - protein, 22 aa, Glycine max
  Coding DNA Sequence Number=SeqID_68754
DVNPYPRKQQQQQQQQQRLIPL

SEQ ID NO: 160440 - protein, 122 aa, Glycine max
  Coding DNA Sequence Number=SeqID_68755
LRNGTGMWKGPLVIDYQCWVIDYTEEQATAQFIHDRVEMECLEGAWETLEGNARCRFRGTIRFTATSLVHLEEPARTLQRTVEWILPTPTPYHLVEPVQVIEVTSSEEDPEEDPEELPPEPA

SEQ ID NO: 160441 - protein, 64 aa, Glycine max
  Coding DNA Sequence Number=SeqID_68756
MNRESTLIWQDAKRMNKKCSIECEEDEEMCTIRRYISIEVFFMWDEKAVFGSSEDNLIAEQAAI

SEQ ID NO: 160442 - protein, 182 aa, Glycine max
  Coding DNA Sequence Number=SeqID_68757
MAPTRHPLDPDKSNRALGFPALITGLCQLFGVPVAPSKVIRPPINRAFIEKYCTQRQVQDDAPQAANAPPPHQAGPAGSFDTEQYLRHLVRQQSTNHRAHVQTHDCLYQMSLGLQGQGFTSFPCPTPDQFRAEVAWPGDWPEAQAGEAPAEAPAEAPDEADEAREDEEMTDLLDFLGGSGTT

SEQ ID NO: 160443 - protein, 130 aa, Glycine max
  Coding DNA Sequence Number=SeqID_68758
MASNTINSRDNGGTTLEINSIEIKKSTESAIKNLEVQVGELAKQLADRSSSSFTANTEKNPKEECKAAMTRSRMAIHVDESEAEKKMKEHKPQLAPKPALEPVSDFVELEEINGEAEDDKEEKTPIKEKE

SEQ ID NO: 160444 - protein, 148 aa, Glycine max
  Coding DNA Sequence Number=SeqID_68759
MYPPLELIHKRCTLSCSQSTTQVDVLSTCTTKDVPSNVLRQRSQAVKPLILCEWGYKRILRREKGDTKEFRRLVLCSFGKGRRETQKEFSRLVLGEFFLAKGEEMKRMNSTSFLGLENQKTLENFMHKEEEEEQRDSKLVKVVQDRLD

SEQ ID NO: 160445 - protein, 111 aa, Glycine max
  Coding DNA Sequence Number=SeqID_68760
MAKMCRMIIICLRMSSGSPPIDEKRHRITIICLCVPSNLIVSRCRKGENDHNLSLHVIRLALDDEKAHSDHNFSLHVIGDFLRGCKRRRMTIICMCVPSDSIISGWRKGSE

SEQ ID NO: 160446 - protein, 131 aa, Glycine max
  Coding DNA Sequence Number=SeqID_68761
MWSKTISRFLLYMIFPLRKKPTANLRSFLLSLSEASRRYSLSSIYHLILKYQGLPSCSSSIKQQCSNLPQGQLEHGCQSGKGINRLILLSRNMVKGYVIEVLYQFSDVGLVGYQLMIPGLPFPSQLVDYQG

SEQ ID NO: 160447 - protein, 178 aa, Glycine max
  Coding DNA Sequence Number=SeqID_68762
MSFTKGKIGVNEIAPKKLSTKRSRRDATEEGSSAASEFDSHRFRSAEHQQRFEAIRGWSFHRERRVQLREDEYTDFQEEIARRRWTPLVTPMAKFDPEIVLEFYANAWPTEEGVRDMRSWVRGQWIPFDADALSQFLGDPLILEEGQQCEFSQRRSRADDFDEEAIAQLLCIPGQDFA

SEQ ID NO: 160448 - protein, 96 aa, Glycine max
  Coding DNA Sequence Number=SeqID_68763
MLLPEKNVVVYYIEFDEFKEELERRHWDEELTNFLDGNIDVAIVKEFYANLYDPEDKSPKQVRVKGHLIKFDEDTLNIFLKTPVVVEEGETLCAYF

SEQ ID NO: 160449 - protein, 77 aa, Glycine max
  Coding DNA Sequence Number=SeqID_68764
MMTTKDDDKSDEQKAQVNQRTSQENQEQVKSSRRKPTKKNQDSRFKISRIKIKIQESRIKTQDLKHQDQDSRKKTQE

SEQ ID NO: 160450 - protein, 329 aa, Glycine max
  Coding DNA Sequence Number=SeqID_68765
  Gene Ontology: Mol. function=helicase activity; Cellular component =nucleus; Biological process=viral genome replication
  Homolog annotation: Hit_ID=A2Q378; Match level="QueryCoverage=84%, HitCoverage=17%, E-value=2e-74, Identity=50%"; Hit description =Putative uncharacterized protein
  Pfam annotation: Domain name=DUF889; Domain location=1-211; Score =224.8; E_value=2e-64; Accession=PF05970.5; Description=Eukaryotic protein of unknown function (DUF889)
MRLLSSAFGQPNNQEFKQFSDWLLGIGDDKVGQANDGFSEITIPDEFLIKNYTDPIHAIVEATYPNLIHNYSNTDYLQKKKVVLASKKDIVEKINDYVLSLIPNDEKEYCSADSIDKSDELLNPAFGLLTPEFLNSLQTSGIPNHKLKLKVGTPIMLIRNLDQADGLCNGTRLIITRLGSNVVESEVIIGPNTGNRTYIPRINMSPFDSPWPFKLIRRQFPFIVSYAMTINKSQGQSLEHVGLYLPHPIFSHGQLYVVLSRVKSNKRLHILIHDNQGMLPSYNSKALHLNAVQILRQYSSLLLQQHLTQHCIFQLFHSQIRFRRVRPRA

SEQ ID NO: 160451 - protein, 136 aa, Glycine max
  Coding DNA Sequence Number=SeqID_68766
  Subcellular localization annotation: CTP_CleavageSite=48; ConfidenceScore=5.25e-01
MTIFRTKFVSTSGIPKFFFRKKYFRKLFGTSFSGRFPEILLPEEELLKGNLATSLFAGCPSNNAGNVCIGPQRANAQQLWNCVLRGASEKSKVERSNTLGACYQAIKCNILKSFKSYKLFRSNYEGSYRKAFVLPY

SEQ ID NO: 160452 - protein, 256 aa, Glycine max
  Coding DNA Sequence Number=SeqID_68767
  Gene Ontology: Mol. function=aspartic-type endopeptidase activity; Cellular component=small subunit processome; Biological process=DNA integration
  Homolog annotation: Hit_ID=A5AFV0; Match level="QueryCoverage=85%, HitCoverage=19%, E-value=2e-25, Identity=30%"; Hit description =Putative uncharacterized protein
  Pfam annotation: Domain name=zf-CCHC; Domain location=181-198; Score =12.0; E_value=0.023; Accession=PF00098.14; Description=Zinc knuckle
  Subcellular localization annotation: CTP_CleavageSite=18; ConfidenceScore=5.13e-01
MAASGPMFSFSGTPTITTAKLNWKNIPRGLLPWNFGFSKAQEIFVNDIQSLFDATMKVIALKQTSHGMIAHVGKARAAVEELRKFLVADSLEEVNRKLDKFYMVLILRSLHSDFDHVRDQVLAGDQVPSMDSLITRLLRVPHLLKDENPADGVETSAMAASRGRGGSRNNRGGCSGRGGRPHCTYCKRMGHTQENCYSLHGFPDKVAQEYLKLKSEKPNNQAQSSFEPCFSTACISQSIEGSSPWILNSGVSDHIS

SEQ ID NO: 160453 - protein, 92 aa, Glycine max
  Coding DNA Sequence Number=SeqID_68768
SQVVPFLVKLMRQANAIPLTITLKKFISWGISRGKGTLKEGFQASSKVLIINKDSGGHTLTTSSIKTKVDPRTGQFNKGLTSFRGQLSWKRP

SEQ ID NO: 160454 - protein, 36 aa, Glycine max
  Coding DNA Sequence Number=SeqID_68769
ASGSTAETAMGSLPQRGWSERSFENSREGHGETSRF

SEQ ID NO: 160455 - protein, 50 aa, Glycine max
  Coding DNA Sequence Number=SeqID_68770
KYCTPRQAQGETPQQPGDGQQRATDAPPSPLEFTSALHKKVERYLGYACM

SEQ ID NO: 160456 - protein, 48 aa, Glycine max
  Coding DNA Sequence Number=SeqID_68771
MAIGRGGAGTGIASPVLNSDSPTLLYYFHTRQVSVHLSTKIIKKKINK

SEQ ID NO: 160457 - protein, 521 aa, Glycine max
  Coding DNA Sequence Number=SeqID_68772
  Gene Ontology: Mol. function=protein binding; Cellular component =nucleus; Biological process=regulation of transcription
  Homolog annotation: Hit_ID=A7Q1Q9; Match level="QueryCoverage=69%, HitCoverage=74%, E-value=1e-150, Identity=71%"; Hit description =Chromosome chr7 scaffold_44, whole genome shotgun sequence
  Pfam annotation: Domain name=GRAS; Domain location=127-425; Score =351.3; E_value=1.7e-102; Accession=PF03514.5; Description=GRAS family transcription factor
MIRPHMHETWDDHYSNNITTSLPFSSPTTPSNPYPKPATENNHCLNMGQNNELCDWMEEQVSDFTKHLVEDFPETTTTSDNLLSNNPTRVNIASHHNLNVPSLLSPKFSQRKPSCLFRPQFESFTNNDPPNFNLHIQTNTSTLDQSQHNVVYDQGLSLITLLMECAVAISVDNLGEAHRMLLELTQVSSPYKASCAERVVAYFAKAMTSRVMNSWLGVCSPLVDHKSINSSFQVFNNISPFIKFAHFTSNQAILEAVSHCDSIHIIDLDIMQGLQWPAFFHILATRMEGKPQVTMTGFGASMELLVETGKQLTNFARRLGMSLKFLPIATKIGEVIDVSTLHVKPGEAVAVHWLQHSLYDATGPDWKTLRLLEELEPRIITLVEQDVNHGGGGSFLDRFVASLHYYSTLFDSLGAYLHNDDENRHRVEHGLLSREINNVLGIGGPKRSEDKFRQWRNELARHCFVKQVPMSANSMAQAQLILNMFSPAYGYSLAQVEGTLRLGWKDTSLYTASAWTCSNSS

SEQ ID NO: 160458 - protein, 465 aa, Glycine max
  Coding DNA Sequence Number=SeqID_68773
  Gene Ontology: Mol. function=protein serine/threonine kinase activity; Cellular component=plasmodesma; Biological process=protein amino acid phosphorylation
  Homolog annotation: Hit_ID=A7NXD5; Match level="QueryCoverage=99%, HitCoverage=98%, E-value=0.0, Identity=73%"; Hit description =Chromosome chr5 scaffold_2, whole genome shotgun sequence
  Pfam annotation: Domain name=Pkinase; Domain location=9-291; Score =128.2; E_value=2.4e-35; Accession=PF00069.16; Description=Protein kinase domain
  Pfam annotation: Domain name=Pkinase_Tyr; Domain location=9-286; Score=-148.3; E_value=0.0025; Accession=PF07714.8; Description =Protein tyrosine kinase
  Pfam module annotation: Pfam domain module=Pkinase::Pkinase_Tyr; Domain location=9-291::9-286
MEHVIGGKFKLGRKIGSGSFGELYLAVNVQTGEEVAVKLFLTIPSCSAKQFQEPVKTRHPQLHYESKLYMLLQGGTGIPHLKWFGVEGDYNVMVIDLLGPSLEDLFNYCNRKFTLKTVLMLADQLINRVEYMHSRGFLHRDIKPDNFLMGLGRKANQVYAIDYGLAKKYRDLQTHRHIPYRENKNLTGTARYASVNTHLGIEQSRRDDLESLGYVLMYFLKGSLPWQGLKAGTKKQKYDKISETKVSTPIEVLCKSYPSEFVSYFRYCRSLQFEDKPDYSYLKRLFRDLFIREGYQFDYIFDWTMLKYPQISGSSRGRHVTGKAAMHAGPHVQKAEKISVGKEIREKFSGAVEVFSWRNPANASPRGDHTKHRSFEDAPVQKDLHYAQHNSTRYGSSSRRAMISSNRPISSGDHTGRQTITGSRPSGAHRVQPVYDTKQATYTHGGSIRGRDDPLRNFELLNIRK

SEQ ID NO: 160459 - protein, 135 aa, Glycine max
  Coding DNA Sequence Number=SeqID_68774
  Gene Ontology: Mol. function=protein binding
  Homolog annotation: Hit_ID=A5C2Z6; Match level="QueryCoverage=88%, HitCoverage=27%, E-value=3e-20, Identity=45%"; Hit description =Putative uncharacterized protein
MGLVGNIPASMGVHLKKLSYIGLDNNNLDGSVPYGLLQYASEINLENNKLSGRVELFSTTTKVGQKVKLAGNKGLCVDNKVVGGGVLGQQQLKACKKTDVPDAVVFSGTSSLLLRFYSLAGVVVVVFFVFIFTGF

SEQ ID NO: 160460 - protein, 191 aa, Glycine max
  Coding DNA Sequence Number=SeqID_68775
  Gene Ontology: Mol. function=Rho GDP-dissociation inhibitor activity; Cellular component=cytoplasm; Biological process=negative regulation of cell adhesion
  Homolog annotation: Hit_ID=A9PI76; Match level="QueryCoverage=83%, HitCoverage=67%, E-value=6e-74, Identity=83%"; Hit description =Putative uncharacterized protein
  Pfam annotation: Domain name=Rho_GDI; Domain location=1-190; Score =3.3; E_value=5.1e-09; Accession=PF02115.8; Description=RHO protein GDP dissociation inhibitor
MSFRSLVFYYVQLLVYSVNKHCIESNDFLMYSKEDESLRRWKEKLLGCMESDLDGQIHPEVKFHSIGIISEDFGEVITSLSVDESQNGHILFTLREGSHYQLKLKFSVLHNIVSGLTYCNTVWKGGLQVDQSKGMLGTFAPQKEPYVHALKEDITPSGVLARGVYSAKIKFEDDDRRCHMELKYSLEIKKR

SEQ ID NO: 160461 - protein, 489 aa, Glycine max
  Coding DNA Sequence Number=SeqID_68776
  Homolog annotation: Hit_ID=Q2HSI4; Match level="QueryCoverage=18%, HitCoverage=44%, E-value=4e-09, Identity=39%"; Hit description =Putative uncharacterized protein
  Pfam annotation: Domain name=DUF1723; Domain location=180-223; Score =16.8; E_value=0.0054; Accession=PF08330.1; Description=Protein of unknown function (DUF1723)
  Subcellular localization annotation: CTP_CleavageSite=37; ConfidenceScore=5.01e-01
MVKTRGSGRTLSSVVGRGLGRGDGHDSDGAPQRRRPTASARRQRVPVTIANDVPAVLADSPTIPADSPAVPAAEPPVVGDEVMIDADAQDTGAEDDAHDTDADDATDDDEGFPGGPKDPSVLTGYADHVAASVWFGEERHELRLSSHGRKVRKLGKPIPAIEELVAGTGLSPLIACSVDTGDQGLISSFVERWHRETSSFHLLVGEVVLMLVELLMVSLEVAVAEIGQCCGPFLDALRDLTQTRRYAWGAVGLVHMYDHLNDASISTSRQVVGYITLLQCWIYEHFPSVAECNVDPDYGEDSRCLLDAICRASTGPGVSADFMIFRSTLLGACCCQAIPAPPVDSWVSLDDIDDRWMHYPDHLAPTCEMCVVPGQCALDYIDCFFCISHPLMIATQPSNPLPNAHAAQPRHVPQVPDDLARSNVDEPIHVVEACDVIAKRLERHLSLGVVTPDTSTHEVIEECLRIVRSVTEDRIVYVRSRCRRRMDQS

SEQ ID NO: 160462 - protein, 620 aa, Glycine max
  Coding DNA Sequence Number=SeqID_68777
  Gene Ontology: Mol. function=transferase activity, transferring glycosyl groups; Cellular component=integral to membrane
  Homolog annotation: Hit_ID=A7Q1K1; Match level="QueryCoverage=74%, HitCoverage=87%, E-value=0.0, Identity=88%"; Hit description =Chromosome chr7 scaffold_44, whole genome shotgun sequence
  Pfam annotation: Domain name=Exostosin; Domain location=127-475; Score=569.3; E_value=4e-168; Accession=PF03016.6; Description =Exostosin family
MRKRPDQMEKGAAAKNQNSRICFLASLSAFFWFLLLYFHFVVLAGDNSNRKISYNNQVDLDHSTLSTTPVSVSYEPPPTHQVQAPPRKIGFPDTDTDTLHATKKSFPFMRAMRASENKSDPCGGRYIYVHDLPSRFNEDMLKECRSLSLWTNMCKFTTNAGLGPPLENAEGVFSNTGWYATNQFAVDVIFGNRMKQYECLTNDSSIAAAVFVPFYAGFDIARYLWGYNISTRDAASLALVDWLMKRPEWSTMNGRDHFLVAGRITWDFRRLSEEESDWGNKLLFLPAAKNMSMLVVESSPWNANDFGIPYPTYFHPAKDADVFMWQDRMRQLERKWLFSFAGAPRPGNPKSIRGQLIDQCRRSNVCKLLECDFGESKCHSPSSIMQMFQSSLFCLQPQGDSYTRRSAFDSMLAGCIPVFFHPGSAYTQYTWHLPKNFTKYSVFIPEDDIRKRNISIEERLSQIPPEQVKIMREEVISLIPRLVYADPRSKLETLKDAFDVAVQAVIDKVTNLRKDIIEGRTDDNFIEENSWKYALLPEGEHEVGPHEWDPFFSKPKDGFSDFCFMYFSSLLSGSKNDLGGNINKIITVNGTRTSLTIEVMDRSVEVSFLRYISLPYTKMR

SEQ ID NO: 160463 - protein, 259 aa, Glycine max
  Coding DNA Sequence Number=SeqID_68778
MTYGKSKKSDLRENLKFSFGGGGAEEAGLLELEVVELLLAVHLDDQRDDEDEEGGAGDPRGLAGAAEELLGDECGVDGGFLAAVNPKVKVRVPEQEEELVHPENNSGTWMFSKLIELLYFKEEKNQNQNECPPSISESTKACTQHVETGVDFDDVSTSTGLFKSINRVGESPKVNARACSVIRPRAVLSSPENDGLIGSINDLNHSVSSAHRKNNAKVKIEGQAKVLSIQVKEGKYSDKEECEAFNKGRTPSKVHVRNF

SEQ ID NO: 160464 - protein, 16 aa, Glycine max
  Coding DNA Sequence Number=SeqID_68779
MEVGRTQKSSEVVEVL

SEQ ID NO: 160465 - protein, 904 aa, Glycine max
  Coding DNA Sequence Number=SeqID_68780
  Gene Ontology: Mol. function=ATPase activity; Cellular component =chromosome; Biological process=chromosome organization and biogenesis
  Homolog annotation: Hit_ID=A7Q1S8; Match level="QueryCoverage=99%, HitCoverage=81%, E-value=0.0, Identity=57%"; Hit description =Chromosome chr7 scaffold_44, whole genome shotgun sequence
  Pfam annotation: Domain name=ABC_tran; Domain location=747-871; Score= -57.9; E_value=0.043; Accession=PF00005.18; Description=ABC transporter
  Pfam annotation: Domain name=SMC_N; Domain location=20-892; Score =14.7; E_value=8.9e-13; Accession=PF02463.10; Description=RecFRecNSMC N terminal domain
  Pfam annotation: Domain name=SMC_hinge; Domain location=289-366; Score=57.3; E_value=5.3e-14; Accession=PF06470.4; Description=SMC proteins Flexible Hinge Domain
  Pfam module annotation: Pfam domain module=ABC_tran::SMC_N::SMC _hinge; Domain location=747-871::20-892::289-366
MKGEHFLWKLFNIHNDYAETIKDLEDEEKSREGVVKELEYFESEASKKKKEQAKYLKEIALREKRIAEKGNKLDKSQPELLKLKEEMTRITSKIKKGKKELDKKKVERKKHDADIALLQNDIQDLTAKMADLQEKGRDVDDELDLQGNDLEEYFRIKEEAGMKTAKLREEKELLDRKLNADSEAQKNLEENLQQLRNRESELNSQEEQMRARLEKILDNSAKNKVGLENLKKELRVMQDKHRDSKKKYENLKLKIGELENQLRELKADRYENERDVRLSQAVETLKRLFQGVHGRMTDLCRPTQKKYNLAVTVAMGKFMDAVVVDNEKTGKECIKCKFDPSLEKAILFAVGNTLVCDDLEEAKILSWSGERFKVVTVDGILLTKSGTMTGGTSGGMEARSKQWDDKKIEGLNKKKEQYESELEELGSIRDMHLKESEASGKISGLEKKIQYAEIEKLNDAVNKSNADVRKLEKRINEITDRIYRDFSKSVGVANIREYEENRLKAAQSIAEERLNLSSQLSKLKYQLEYEQNRDMNSRIQDLESSLGALEKDLKRVHDREAAAKLAAENATEEINQLKEEAKEWKSKSEDCEKEIQEWKKKASAATTNISKLNRLIHSKAQIDQLNVQKQEILEKCELEQISLPIILDPMDTDSSVPGPSFDFDQLNRALKDRRHSDRDKIEVEFKQKIDALISEIERTAPNLKALDQYEALLEKERAVTEEFEAVRKEEREKTQRFNEVKQRRNSLYLICLLMKPKFVLDAAYLNLENDDDPFLHGIKYTAMPPTKRFRDMEQLSGGEKTVAALALLFSIHSYKPSPFFILDEVDAALDNLNVAKVAGFIRSKSCEGARISQDVDGGNGFQSIVISLKDTFYDKAEALVGVYRDSERGCSRTLTFDLTKYREF

SEQ ID NO: 160466 - protein, 839 aa, Glycine max
  Coding DNA Sequence Number=SeqID_68781
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6DAR6; Match level="QueryCoverage=76%, HitCoverage=76%, E-value=0.0, Identity=76%"; Hit description =Phosphoenolpyruvate carboxylase
  Pfam annotation: Domain name=M20_dimer; Domain location=1-109; Score =94.3; E_value=3.9e-25; Accession=PF07687.5; Description=Peptidase dimerisation domain
  Pfam annotation: Domain name=PEPcase; Domain location=185-838; Score =153.2; E_value=7.1e-43; Accession=PF00311.8; Description =Phosphoenolpyruvate carboxylase
  Pfam annotation: Domain name=Peptidase_M20; Domain location=5-198; Score=-25.5; E_value=0.063; Accession=PF01546.19; Description =Peptidase family M20M25M40
  Pfam module annotation: Pfam domain module=M20_dimer::PEPcase::Peptida se_M20; Domain location=1-109::185-838::5-198
HLSHAIRIQGQSGHSSDPARGVNAIELMHESITQLMQLRNTLKERYHHDGFAIPYPTMNFGHIHGGDAANRICACCELHMDIRPLPGLTLSDLDGLLNEALAPVSARWPGRLTVGELHPPIPGYECPADHELVKVVEKLLGVPTEVVNYCTEAPFIQQLCPTLVLGPGSINQAHQPDEFIDTAFIKPTHALITQGHMNEQYSAMRSNVSMLGKLLGDTIKDALGENILDRVETIRKLSKSSRAGNDTHRKELLSTLQNLSNDELLPVARAFSQFLNLTNVAEQYQTISRSGDGANHPELLKKTFERLKQQSDLSEPAIRQAIEELSLELVLTAHPTEITRRTLIHKLGEVNSCLQQLDHSDITDYERNQVMRRLRQLVAQAWHTDEIRKYRPTPVDEAKWGFAVVENSLWEGVPAFLRELNQQVEESFGIQLPVDFVPIKFTSWMGGDRDGNPNVTAPITRHVMQLSRWKAADLFLRDIGVLVSELSMSECSDEVRELCGDAEALEPYRVILKRIRSQLMSTQSYLERRLKGERLPRPADLLVSNDQLWQPLFAIYQSLQQCGMGIIANGQLLDTLRRVKCFGVPLVRIDIRQESTRHTEAIAEVTRYLGLGDYESWSEADKQAFLILAAEAPQGSIAAYVISMAKTPSDVLAVHLLLKEAGIPYAMPVAPLFETLDDLNNANDVMSQLLNIDWYRGFINGKQMVMIGYSDSAKDAGVMAASWAQYQAQDALIKTCDKAGITLTLFHGRGGSIGRGGAPAHAALLSQPPGSLKGGLRVTEQGEMIRFKYGLPEVTIASLSLYTGAILEANLLPPPEPKREWQEIMNGLSAYSCAMYRGY

SEQ ID NO: 160467 - protein, 552 aa, Glycine max
  Coding DNA Sequence Number=SeqID_68782
  Gene Ontology: Mol. function=NAD(P)+ transhydrogenase (B-specific) activity; Cellular component=cytoplasm; Biological process=cell redox homeostasis
  Homolog annotation: Hit_ID=Q5PK71; Match level="QueryCoverage=78%, HitCoverage=92%, E-value=0.0, Identity=86%"; Hit description=Soluble pyridine nucleotide transhydrogenase (EC 1.6.1.1) (STH) (NAD(P)(+) transhydrogenase [B-specific])
  Pfam annotation: Domain name=DAO; Domain location=17-429; Score= -43.1; E_value=0.0072; Accession=PF01266.15; Description=FAD dependent oxidoreductase
  Pfam annotation: Domain name=Pyr_redox; Domain location=187-279; Score=99.4; E_value=1.1e-26; Accession=PF00070.18; Description =Pyridine nucleotide-disulphide oxidor
  Pfam annotation: Domain name=Pyr_redox_2; Domain location=17-325; Score=166.9; E_value=5.4e-47; Accession=PF07992.5; Description =Pyridine nucleotide-disulphide oxidore
  Pfam annotation: Domain name=Pyr_redox_dim; Domain location=355-456; Score=91.4; E_value=2.8e-24; Accession=PF02852.13; Description =Pyridine nucleotide-disulphide oxidored
  Pfam module annotation: Pfam domain module=DAO::Pyr_redox::Pyr_redox _2::Pyr_redox_dim; Domain location=17-429::187-279::17-325::355-456
MYRNIGRTGMQKSYDYDAIVIGSGPGGEGAAMGLVKQGARIAVIERYHNIGGGCTHWGTIPSKALRHAVSRIIEFNQNPLYSDHTRLLRSSFADILNHTENVISQQTAMRQGFYERNRCELYQGDAHFVDANTIEVEQPDGTRERLTAEKFVIACGSRPYHPADVDFTHPRIYDSDSILNLHHEPGHVIIYGAGVIGCEYASIFRGLNVKVDLINTRDRLLAFLDQEMSDSLSYHFWNSGVVIRHNEEFEKIEGVSDGVIMHLKSGKKVKADCLLYANGRTGNTDSLALENVGLEADGRGLLKVNSMYQTAQPHIYAVGDVIGYPSLASAAYDQGRIAAQAIIKGEATAHLIEDIPTGIYTIPEISSVGKTEQQLTAMKVPYEVGRAQFKHLARAQIVGMHVGSLKILFHRETKEILGIHCFGERAAEIIHIGQAIMEQKNGAAHSGCAEAIPDDTPARWCAAAPRRQQSDAAASGYHVAQRFQAGRAEMGIFISAGFEAEAHRLIAQTVTIFQHQQFFTGQIRHRHAIAIVPRDDPDRSPASLAHRTAALQ

SEQ ID NO: 160468 - protein, 107 aa, Glycine max
  Coding DNA Sequence Number=SeqID_68783
  Subcellular localization annotation: CTP_CleavageSite=36; ConfidenceScore=5.17e-01
VSDIYPRIELANGQTKYSDSKSIQMPKLRRITQMTRVMSKMTAIVTKSISLKPMGRDGTVRRHLAEEIPIVVPRYVVAEGAADDRHVDEKLGVVEGGEEGAEAGNGN

SEQ ID NO: 160469 - protein, 192 aa, Glycine max
  Coding DNA Sequence Number=SeqID_68784
  Gene Ontology: Mol. function=helicase activity; Biological process =viral genome replication
  Homolog annotation: Hit_ID=Q9LTU4; Match level="QueryCoverage=86%, HitCoverage=11%, E-value=4e-47, Identity=50%"; Hit description =Helicase-like protein
MRQWFAYRLHSRSNEAQTLLHSRKLFQQFIVEGYTMVESERLSYIRNNQKKLRVDKYCSLQSSLDVGTNKGLTKGKRVILPSTFVGIPRYMDQLYFDGMTICSHVGFPNLFITLTCNPNWPEIRRLLSPLNMKATDKPDIVSRIFRLKYEQMLSDLTKHHLLKKVVACKCEYEQVYKLSVQKERKSRERNDV

SEQ ID NO: 160470 - protein, 70 aa, Glycine max
  Coding DNA Sequence Number=SeqID_68785
MASRKLSTKRSRRDAAAEGTSVAPEFDSHRFKSAEHQQCFEAIKGWSFHRDKWVQLRDDEYTDFQEEIAR

SEQ ID NO: 160471 - protein, 94 aa, Glycine max
  Coding DNA Sequence Number=SeqID_68786
MAKEKPRRVTLEDYSSTSVPQFFTSIAWPESSYTTNFLSQPTHLRVSEERLMGASSIGGKCVESPPTFIERKTLEKLKKTGHEEYSRFGSYLYV

SEQ ID NO: 160472 - protein, 364 aa, Glycine max
  Coding DNA Sequence Number=SeqID_68787
  Pfam annotation: Domain name=Transposase_23; Domain location=51-121; Score=-0.9; E_value=0.0015; Accession=PF03017.5; Description =TNP1ENSPM transposase
  Subcellular localization annotation: CTP_CleavageSite=34; ConfidenceScore=5.42e-01
MASFSQMQSQFQSQMQSQGLALPPKPLVGPSGPRVGTKESCVDPSRNDPETGDSDRCGLYIEANHACLVALRRVYEGSTIVHNTPLLPSQVKVGVEEVKDPDAAVPVPTDEVSLVGQAILTFLAWSSHLVKSLSQQVLYSYYMFLLFQLLHSVCLKLAHLTFFHEQPVVSPAKPPQKSNPEVDDPLYLMTLTIPELFLRPYQVTWDATVFRVFNSDFPLYIKHEDLSEIAHGGQCLSISVLQLWILHLTETSMRAENFDIYGFLEPQSIQRSGQSQFETESYIKSWMQSSKCDVYLGAYLNGGHWQMVVIMPKEHLVVWFCSLHNRSDNYLKGIINRSVFFSMHLNSNASTTPLFNCYSPGTVL

SEQ ID NO: 160473 - protein, 94 aa, Glycine max
  Coding DNA Sequence Number=SeqID_68788
MAKVEKTMAGLATDQGTDVNQPIRLPNTRDNQINFSSWLHNNLNHNKFMGASTEDPMLISQDFYNYAYRKCSRLAQLAPTSFTNHMGGSQRQIP

SEQ ID NO: 160474 - protein, 58 aa, Glycine max
  Coding DNA Sequence Number=SeqID_68789
MRGTMHEPQANLGADHKFLPGVEPDTRVERNQSTSNTLKVLTQYNPQKLFEPLKSFLS

SEQ ID NO: 160475 - protein, 81 aa, Glycine max
  Coding DNA Sequence Number=SeqID_68790
  Subcellular localization annotation: CTP_CleavageSite=55; ConfidenceScore=5.45e-01
MNLKKCPNALGVGYHGTKSRIIRSVVFMKTQRRASQRRCCGICRSFQGLSVFLLMEMMLKTLHDMQIGETAMEWLLDQRPQ

SEQ ID NO: 160476 - protein, 99 aa, Glycine max
  Coding DNA Sequence Number=SeqID_68791
MVAITPARFRQSPFFRGYDSNATCACHGEAPRRSIEHCRALKSKVQGLIDAGWLKFEENRVIFKCKPLVNLLKRPVLLSLDFQDRSIRDYSSCTLVGLP

SEQ ID NO: 160477 - protein, 147 aa, Glycine max; identical to SEQ ID NO: 156656
  Coding DNA Sequence Number=SeqID_68792
  Subcellular localization annotation: CTP_CleavageSite=88; ConfidenceScore=5.12e-01

SEQ ID NO: 160478 - protein, 78 aa, Glycine max
  Coding DNA Sequence Number=SeqID_68793
  Subcellular localization annotation: CTP_CleavageSite=65; ConfidenceScore=5.17e-01
EGEALTDSSECSPWASPSLSAPLSLCRSHMVGAFSQNSRLSDAILPRKGPITRTMSKRLQEDWARAAEEGPRVLMNLR

SEQ ID NO: 160479 - protein, 114 aa, Glycine max
  Coding DNA Sequence Number=SeqID_68794
MEITSWPPQQGPNIFQRTTKLEETLAQFMQVTISNHKSTESALKNLEIQVGQLTKQLVEKSSNNFGENIEKNPKEECKVVVTRSGKLVAAEDEDVVALKEQFAFKDTTVKKKNE

SEQ ID NO: 160480 - protein, 198 aa, Glycine max
  Coding DNA Sequence Number=SeqID_68795
MSCLVIITPTILCRSVSWCMPPTRHPLDPDKSNRALGFLALITGLCQSFRVLVTPSKVIRPPITRAFIEKYCTPRQAQGDAPQAADASPPPHQADPAGSLGMERYLQHLVCQQAANHRGQVQIHECLYQLSLSQQGQGFIPFACPTPDQFRAEVAWPEDWPEAQAGEAPAEAPSDVEEACMDEEMTDLLGFLGGSRAT

SEQ ID NO: 160481 - protein, 129 aa, Glycine max
  Coding DNA Sequence Number=SeqID_68796
  Gene Ontology: Mol. function=glutamate decarboxylase activity; Cellular component=cytoplasm; Biological process=carboxylic acid metabolic process
  Homolog annotation: Hit_ID=Q8LFR4; Match level="QueryCoverage=72%, HitCoverage=19%, E-value=7e-44, Identity=85%"; Hit description =Glutamate decarboxylase, putative
  Pfam annotation: Domain name=Pyridoxal_deC; Domain location=1-129; Score=-206.0; E_value=0.013; Accession=PF00282.10; Description =Pyridoxal-dependent decarboxylase conse
MLRNLVDYIIIPFLTYGILRNLTNCATMLPFDFRWDTPIHVDAASSAFIAPFLYPELEWDFRLPFVESINVSSHKYELVYAGIGWVIWMTKDDLPEDFVFHINYLGADQPTFTLNFSKGSSQIIAQSYS

SEQ ID NO: 160482 - protein, 91 aa, Glycine max
  Coding DNA Sequence Number=SeqID_68797
MTRGNPSDLQPFDPEIDRTFHRLVRHNLHPGHSVHFEHSVEGDSEYSNFEHSTTNFHTENMAQPPPHERTLREMAAPDFTYESLCIKYPDE

SEQ ID NO: 160483 - protein, 142 aa, Glycine max
  Coding DNA Sequence Number=SeqID_68798
  Homolog annotation: Hit_ID=A5AK77; Match level="QueryCoverage=69%, HitCoverage=12%, E-value=2e-09, Identity=35%"; Hit description =Putative uncharacterized protein
MAQPPPRERTLREMIAPDFTYESLCIQYPDEGVPYVLKTGLIHLLPKFHGLAGEDPHKHLKEFHIVCSTMKPPDVQEDHIFLKAFPHSKQTHDKSSILPCSQVYFQRTDDLKQGVLGEILPNLEDQSSTKQAVRPLDFLECC

SEQ ID NO: 160484 - protein, 130 aa, Glycine max
  Coding DNA Sequence Number=SeqID_68799
MAPRKLASKRSRKDKAAEGTSSAPEYDSHRFRSAEHQQRFEAIKGWSFLRERRVQLRDDEYTDFQEEIVRRRWASLVTPMAKFDPDIVLKFYANAWPTEEGTGADHAHQHDHPDSDMDDFAAQQHPAQRS

SEQ ID NO: 160485 - protein, 316 aa, Glycine max
  Coding DNA Sequence Number=SeqID_68800
  Gene Ontology: Mol. function=RNA methyltransferase activity; Cellular component=ribosome; Biological process=RNA modification
  Homolog annotation: Hit_ID=P30851; Match level="QueryCoverage=48%, HitCoverage=18%, E-value=1e-78, Identity=95%"; Hit description =Ribonuclease R
  Pfam annotation: Domain name=RNB; Domain location=1-126; Score= -101.1; E_value=0.00012; Accession=PF00773.10; Description=RNB-like protein
  Pfam annotation: Domain name=SpoU_methylase; Domain location=201-312; Score=58.5; E_value=2.2e-14; Accession=PF00588.10; Description=SpoU rRNA Methylase family
  Pfam annotation: Domain name=SpoU_sub_bind; Domain location=117-186; Score=15.1; E_value=0.0042; Accession=PF08032.3; Description=RNA 2' -O ribose methyltransferase subs
  Pfam module annotation: Pfam domain module=RNB::SpoU_methylase::SpoU _sub_bind; Domain location=1-126::201-312::117-186
MILANISAARFVEKAKEPALFRIHDKPSTEAITAFRSVLAELGLELPGGNKPEPRDYAELLESIGDRPDAEMLQTMLLRSMKQAIYDPENRGHFGLALQSYAHFTSPIRRYPDLSLHRAIKYLLAQEQGHKGNTTETGGYHYSMEEMLQLAQGVVIQVASRQFLDEKSEGAVHQGIIARVKPGRQYQENDLPDLLAQFDQPFLLILDGVTDPHNLGACLRSADAAGVHAVIVPRDRSAQLNATAKKVACGAAESVPLIRVTNLARTMRLLQEENVWIVGTAGEADHTLFQSKIPLTLTLSPKGRGKRTVIMRTINE

SEQ ID NO: 160486 - protein, 223 aa, Glycine max
  Coding DNA Sequence Number=SeqID_68801
MSLRTKHQSKLGFEGTFLSSMLRPDPQELATRLCIAGREFVLNTEGLPWKLLRKDLTTLAQTWSVLSYSNLALTSHTSDLNLDRARLVYGLVMKMNMNIGALISEQILLIAQSNSSRLGFLALITALCKARGVTLDSLTYESLSPAINLAYIKKNCWNLDDPSVTFPGTQKSRARRSEAPSPSAAPTPPTSSLPSALAAPVLLGPSAQSSEPFMSMLKSLHQG

SEQ ID NO: 160487 - protein, 555 aa, Glycine max
  Coding DNA Sequence Number=SeqID_68802
MAAEWRRRKGDWRRHFMEKMRQEQAHHHRKPWAHENPGPSPASLAQSSWSLLAMALVLGPLLGRIASKMRNEIEEENKQTLGKMKQELNEAIKIELSQRGLVYTPPIDMDIQILGARVSTKGSNAEIVVHASGEEHDANVILTMGLYVQGDNCTRLVALGNIYDRGLASGSPGPSKDFNVKKPVRLGELQLTWAGRGVKEGVLRQALDTFIAWPENLVKLVSHEDSHVTPKKVVEHVKRSNDVGAKDLLRQLIRAMYDIYDNPDKLLWDRSKFGIPNADALFFLTFSYVNEIISGVSNGNMVMKLHHSLIIVVEEFALMEWDESHSSACWGDFPRLCHGDHSQLLIDNPVKALIYRGDTTNWLWGQSLAGTYHGQVGGEVSLSIALVGPTQVSITPKRKEFSMDFKNKVKGNIRGQIPLSKHKELRGVSDSTNGNIILKFRSRQCDQGLRDFLHRIFEEDSENSTPIKVFLLKRRVKNLVFHAEDGSLSAPLGRSAQFPSIGIALSTPFSLSGRPKVITFQNPNGQTVETYLREMQTKFEDDPTVNEFGIAISLN

SEQ ID NO: 160488 - protein, 85 aa, Glycine max
  Coding DNA Sequence Number=SeqID_68803
MAKPVMNLLKKTKHFDWSEECDAFQQLKVTPTTPPILTKPKTSKRLIPSTWETSLRSKEGSFLGRIKEESFLEKLEGGYLHPSNS

SEQ ID NO: 160489 - protein, 80 aa, Glycine max
  Coding DNA Sequence Number=SeqID_68804
MVKWGPELHTSARRGTVVAFADNSQLVDNSRELTDNGAPPHGSNAILAANTIPCIALPSTYAHQPPSKNMATTSTRASSL

SEQ ID NO: 160490 - protein, 74 aa, Glycine max
  Coding DNA Sequence Number=SeqID_68805
MQQIFYILVGPERRLEVVGKGSSSSSATIVAVKRLRGALRRFSFIVEGASSPSIVEGASSPSIVEGASSPSIVE

SEQ ID NO: 160491 - protein, 120 aa, Glycine max
  Coding DNA Sequence Number=SeqID_68806
MESGKNHMLSFQKVLGNLQSCVPGAVVTTQTKLVFKEGEMGTHLWRRCTDGILGISIRISQVQRPKPHLKLPDHLEGDVSSIGACRPRIFFINGFLCFLEDEWQQNGEGRERIDATSRRR

SEQ ID NO: 160492 - protein, 114 aa, Glycine max
  Coding DNA Sequence Number=SeqID_68807
MTKARQKGVRKVNETKIKSTRNKWGPPRGKEGEACHPARPGVLEELLGRPKTLRIVQQCFLLTSDMLQNLTDCATMLPFDFRHVKELHGLCNNGCQVSRSGQAKVACHQTMVLR

SEQ ID NO: 160493 - protein, 198 aa, Glycine max
  Coding DNA Sequence Number=SeqID_68808
MALAHDLERSDPWNKWVANVLNVWGFAQIHIDVCISEEVEMAPKKLSTKRSRRDAHGEGSNAPMEFDNHRFWSAEHQQRFEAIKGWSFHRERQFQLREDEYPNFQEEIAHRHWKRLVTPMAKFDPEIGVQDMRSCVRGHWIPFDADALSQFLGHRPTPVHTGAGFRPNRCAEVGADHAHQHNYPNPDMDDTGAQQRLA

SEQ ID NO: 160494 - protein, 661 aa, Glycine max
  Coding DNA Sequence Number=SeqID_68809
  Gene Ontology: Mol. function=microtubule motor activity; Cellular component=microtubule associated complex; Biological process =microtubule-based movement
  Homolog annotation: Hit_ID=A2ZV76; Match level="QueryCoverage=86%, HitCoverage=75%, E-value=0.0, Identity=66%"; Hit description =Putative uncharacterized protein
  Pfam annotation: Domain name=Kinesin; Domain location=65-390; Score =515.6; E_value=5.7e-152; Accession=PF00225.14; Description=Kinesin motor domain
MPASTRSQTVPNESNSEHDALKEKMKSLLALYEQHKQKHGAAAAAPPPSKNPSLKTGTRILVFVRVRPLAKKEMEAGSRCCVRIVDRRDVYLTEFASEKDYLRLKRLRGRHFAFDASFPDSATQQDVYSTTTSELVEAVLQGRNGSVFCYGATGAGKTYTMLGTVESPGVMVLAIKDLFNKIRMRSYDGNHAVHLSYLEVYNETVRDLLSPGRPLVLREDKQGIVAAGLTQYRAYSTDEVMALLQQGNRSRTTEPTRANETSSRSHAILQVVVEYRVRDAAMNIIKKMGKLSLIDLAGSERALATDQRTVRSLEGANINRSLLALSSCINALVEGKKHIPYRNSKLTQLLKDSLGGSCNTVMIANISPSNLAFGETQNTLHWADRAKEIRTKFITSASTGFNLFLTCFMCIQAINANEDLLPVPETETDQAKLVLELQKENRELRMQLARQHQKIMTLQAHSSAPPTPPSATSLLSTPPTSAPPSEKRRTRPSLLAATHFTPEAKNKGDEVAVTIRTLQQRVKALEAELERVKKDYSLQLKQKDDVIRELSQKGGKKVVATRASLRPKEANTGELKSPSYRFWSPVQTAKKRSFWDITTANSPSVTTLNGRKTRSHLISEPTAHPSMLLQLLGLYYSARICSKKGRYLNVGSSWKELQEEV

SEQ ID NO: 160495 - protein, 183 aa, Glycine max
  Coding DNA Sequence Number=SeqID_68810
  Gene Ontology: Mol. function=protein dimerization activity; Cellular component=nucleus; Biological process=regulation of transcription, DNA-dependent
  Homolog annotation: Hit_ID=A5B2U1; Match level="QueryCoverage=56%, HitCoverage=27%, E-value=2e-15, Identity=43%"; Hit description =Putative uncharacterized protein
MDEFLSSIWNSDDNNQVNPPLPTLDEAAKGKSVVATEPTTISQPLSLPPPICKKTVDEIWSQIHKSQPHYNEANNSLAKNEPLLKRQQKLGEMTLEDFLVKAVVKYVNWGKDMQGLILSVLIYILPTFENGPQRVQRNTRNWNQRGGTQTEAGFQHPKSSSFSPLWLSMWSNQRKRWALFGSN

SEQ ID NO: 160496 - protein, 63 aa, Glycine max
  Coding DNA Sequence Number=SeqID_68811
PKEEKVQVVDVSLSEADSLSEWHLLSEAYNSLRGLGNPRRGLFKDVLAQCAASSLSQNSLTLA

SEQ ID NO: 160497 - protein, 76 aa, Glycine max
  Coding DNA Sequence Number=SeqID_68812
MLQCEGFSYDLRHDFAIPNGENARNWVANVVLKFHDDPTVNESEIIVFLRQVLWAAGKRKGFERKRRKTKMRGRGG

SEQ ID NO: 160498 - protein, 137 aa, Glycine max
  Coding DNA Sequence Number=SeqID_68813
  Gene Ontology: Mol. function=RNA-directed DNA polymerase activity; Biological process=RNA-dependent DNA replication
  Homolog annotation: Hit_ID=O64612; Match level="QueryCoverage=76%, HitCoverage=7%, E-value=2e-09, Identity=35%"; Hit description =Putative reverse transcriptase
MSFILWLAKRNRLLTLDKVAFLNKGSLCHLCSNEAESNAHLFFSCRKSLQVWAHICDLAPFRRRFTSLQCITDSLIRDRSTSGVQEKFRCLAIAITVYCIWMSRNKLIFKDYQFSVIEVINKIKFLMYRQAHLLHLF

SEQ ID NO: 160499 - protein, 168 aa, Glycine max
  Coding DNA Sequence Number=SeqID_68814
MHEGFQKITFQMLKYLMVFLLTLLHICKQHALCGSNVFQDYFDDAKESRVKQVPKNQESKSFKNQVSRNLDSRIIKFQDSIKFQESRFKNNQDLDSRLKIQESREDSIKIRYILCGTSRGYIYLGCYTENKRGYISCGSVQVEGTSTWLFKENKGGYIPYGSLACKGF

SEQ ID NO: 160500 - protein, 209 aa, Glycine max
  Coding DNA Sequence Number=SeqID_68815
  Gene Ontology: Mol. function=protein binding; Cellular component =nucleus; Biological process=nucleosome assembly
  Homolog annotation: Hit_ID=A5C155; Match level="QueryCoverage=69%, HitCoverage=61%, E-value=3e-53, Identity=64%"; Hit description =Putative uncharacterized protein
  Pfam annotation: Domain name=NAP; Domain location=2-149; Score=14.1; E_value=6.4e-12; Accession=PF00956.9; Description=Nucleosome assembly protein (NAP)
  Pfam annotation: Domain name=SPC22; Domain location=98-209; Score= -27.9; E_value=0.00013; Accession=PF04573.3; Description=Signal peptidase subunit
  Pfam module annotation: Pfam domain module=NAP::SPC22; Domain location=2-149::98-209
MEASDKVLEVEQKYNEIRKPVYNKRNDVVKSIPDFWFTAFMSHPALYELLNVEDQKIFMYLGSLDVEDNKDVKSGYSITFNFNPNPYFENIKLTKTFTFLEEGTAKITATPIKWKMERGQVSLVGLVTVAELIKDDLWPNPLTYFNNVLNINWFQKQPNGNDEVSMTMNISADLQSLFTWNTKQVFVFLAAKYETPKNSLNQVLVSISK

SEQ ID NO: 160501 - protein, 74 aa, Glycine max
  Coding DNA Sequence Number=SeqID_68816
MTTGSQNSQEISLASPLRWNHDLCTGQPPPPLPPLVIGSWLHRHLSATLHHGSLRDLLRQAGTYVPHSYAVTRS

SEQ ID NO: 160502 - protein, 89 aa, Glycine max
  Coding DNA Sequence Number=SeqID_68817
MDNSNDEWFVNLEDDNDVNSSDTNSSNGSDAEVDIDVDNEEGVEDVDNEEEAKDLYCSNYVPLIPMYHGLSNADKAKGDSLHAQGVRAC

SEQ ID NO: 160503 - protein, 50 aa, Glycine max
  Coding DNA Sequence Number=SeqID_68818
  Homolog annotation: Hit_ID=A5B7I8; Match level="QueryCoverage=52%, HitCoverage=2%, E-value=5e-07, Identity=88%"; Hit description =Putative uncharacterized protein
MAAEFVTCYEASNHGTNSMVADPLTKGLPPKVFHEHVAHIYYTLYIKVIK

SEQ ID NO: 160504 - protein, 347 aa, Glycine max
  Coding DNA Sequence Number=SeqID_68819
  Gene Ontology: Mol. function=catalytic activity; Biological process =metabolic process
  Homolog annotation: Hit_ID=Q0WQ54; Match level="QueryCoverage=80%, HitCoverage=92%, E-value=1e-95, Identity=63%"; Hit description =Acetyl-CoA synthetase-like protein
MAYYKSLSSITVSDIESHGIAREDAATLHHGLAEIIETHGNGTPATWQHVSNSILNPELPFSFHQMLYYGCYKDYGSDPPAWIPDPESAALTNVWKLLERKGEEFLCSAYKDPITSFDDFQKFSVSNPEIYWKCVLDEMSISFSKPPECILRDSPSGESPLSHPSGQWLPGASINPAQNCLNVNGKRSLNDTVIIWRDEQLDDLPLQRMTLEELRDEVWLVAYALKSLGLEKGSAIAIDMPMNVKSVVIYLAIVLASYVVVSIADSFAASEISTRLKISKAKVAGFIPLNLDAGVADDMIIEKRWKKIVASHMEVQINQNLLSFGPPPEPPNSTRLQGSGSFPAKLQ

SEQ ID NO: 160505 - protein, 471 aa, Glycine max
  Coding DNA Sequence Number=SeqID_68820
  Gene Ontology: Mol. function=catalytic activity; Cellular component =mitochondrial matrix; Biological process=metabolic process
  Homolog annotation: Hit_ID=A7PGK3; Match level="QueryCoverage=94%, HitCoverage=62%, E-value=0.0, Identity=78%"; Hit description =Chromosome chr17 scaffold_16, whole genome shotgun sequence
  Pfam annotation: Domain name=AMP-binding; Domain location=3-386; Score=30.8; E_value=1.4e-08; Accession=PF00501.19; Description=AMP -binding enzyme
MGVNFVANCGVIVIYFSCLILPFPSSCFINQDLIMRGDKSIPLYSRVVDAQSPMAVVIPTKGSEFSMKLRNGDVSWHDFLEKVNNLKGKEFIATEQPIETFTNILFSSGTTGDPKAIPWTNITPLKAAADAWCHMDVRKGDVVCWPTNLGWMMGPWLVYASLLNGASVALYIGSPLGSAFAKFVQDAKVTMLGVIPSIVRSWRSTNSTSGYDWSSIRCFGSTGEASNVDEYLWLMGRALYKPIIEYCGGTEIGGGFVCGSLLQAQSLAAFSTPAMCCSLFILDDEGLPIPQNVPGIGELALGPLMLGASNTLLNADHYGVYFKGMPLLNGKVLRRHGDVFERTARGYYHAHGRSDDTMNLGGIKVSSVEIERICNGVDSSILETAAIGVPPSGGGPELLTIAVVFKDSNSTKQDLHQLRMSFNSALQKKLNPLFRVSQVVTLPSLPRTASNKVMRRVLRQQLSETNQNSKI

SEQ ID NO: 160506 - protein, 74 aa, Glycine max
  Coding DNA Sequence Number=SeqID_68821
MEHSDFMRPNFPHLKQDLPLGFLFFINFLNFLTINVRFSLSEPYALSSLLPSLDGMEDFSVKPILLFYLASSSI

SEQ ID NO: 160507 - protein, 271 aa, Glycine max
  Coding DNA Sequence Number=SeqID_68822
MVTTLGTFFSLDVALCEVLVDDTGVSEINDDLINNVFIHKLSSSFRLCVTTYPSAGGLGEIKSASSKKGENARESPPTFIRGKWVDKGVALAPTYPQEMRGFETLVACPSELLLHPEASQKLAWVSQGPEKAKNDPSAPPLGLRGNGGGRCLDVEDGRLHDGDKGASSVVSLLDDEGGEGGAHSFSTILGLALVALNRVPYPNFVWGLSFTDVLILASQTAFQHPSSPRLAFSLPGPSNDFRVKEPARLGEPVTLGAEEGFQGSKVERKKK

SEQ ID NO: 160508 - protein, 66 aa, Glycine max
  Coding DNA Sequence Number=SeqID_68823
MQVQGQSLKGLKWFTELKEEDFKCFGGKLMEKLEEKALKKRVEEGTARLVHKPGPACLLAQWPAQA

SEQ ID NO: 160509 - protein, 256 aa, Glycine max
  Coding DNA Sequence Number=SeqID_68824
MNLSLWQNKPEKSFTSKIHVIQDCQWFYKEEQVGHRITAKLPSAFRWSFTDQPRPAVNFDATTGRGSDPHKEKLHSYLGVVAREKIPIVHSNWIDVPESLKELVWDEILGIRKRAREIQKHNGCPHLLLVEDMDSLEEQMTQRSFVPQGRDDILNTAIRRPEHGGRVHAARSGVTISQYYGRASCGSSSSSTSISQQQLVEIIGSLKEEWRNEIIVNLKEEIDVAPCRACRPWIFFINGVLCFLKINGNGMEKEER

SEQ ID NO: 160510 - protein, 105 aa, Glycine max
  Coding DNA Sequence Number=SeqID_68825
MDKAISRICPLDLMMKYVQFQLSLAHEWAKRASTAKRIFSALSTIEESGRASISRPCAKHEISALSVEQLSSVRLSARLTLSSNPLTRAKHKGGAKRNVANLEPI

SEQ ID NO: 160511 - protein, 104 aa, Glycine max
  Coding DNA Sequence Number=SeqID_68826
WGGISPVENDLEWQSEGKRHQKWVFLCRQSLTLLKIYLVSISGRTSTLFHKARVTMMILKQRAKLVMATARWALKHPVYGIVILRLGITQIDTTFPSYVLSSVQ

SEQ ID NO: 160512 - protein, 36 aa, Glycine max
  Coding DNA Sequence Number=SeqID_68827
MGLTENKRGYSSCGSILDFYKVERNLKDRRSLGDWR

SEQ ID NO: 160513 - protein, 138 aa, Glycine max
  Coding DNA Sequence Number=SeqID_68828
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=2e-24, Identity=68%"; Hit description=LacZ protein
MALQCRWAWGGPIRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 160514 - protein, 191 aa, Glycine max
  Coding DNA Sequence Number=SeqID_68829
ARVMGPVEEVQEKMKADMEDMKEQIATMMEAVMSMKKIIEANAVTIAATSIVTKVNPMPPSGLNQMNHPTIDMVGKDLGSRDGPHDVQNQNKHAFPPYGLPPNYTPPNVAYTPNEDVNNSTPILVESRQTQTNHAHVSQTVEETHEIPHHNPADSKPCLGYATEGQAVGDIPLQNTLEALSITHNHTPCIP

SEQ ID NO: 160515 - protein, 146 aa, Glycine max
  Coding DNA Sequence Number=SeqID_68830
MGFRGFRDTRYFRSWIASGGSNPARLGELGGNLLPFFPINRLKVAVLRVRDPPGDVFKLFWVKKNCFREENPSRGASVTLPICFRKQIREGFPPLFTVLHPFFVLQRDKNNLTKHFVHKELRRSDFLIAIKEYVGARETPSSTTKR

SEQ ID NO: 160516 - protein, 155 aa, Glycine max
  Coding DNA Sequence Number=SeqID_68831
IDGDPALRGTRIRATWEYVSSVGGGQQGMAGLYVICGCGELSCTIARPPPSTTCDGGTWRYVAGVRRPWGRQASSWQSTDKRTKTTKQGGLSGGWPTVNFECYMGYGLWLKNEIRKLRGLLVIDYQRIVMAAQLIHDRVEMECLEGAWETLEGNA

SEQ ID NO: 160517 - protein, 47 aa, Glycine max
  Coding DNA Sequence Number=SeqID_68832
MEKTMKNKELKSMAAEWKMRKSDWRRHFKEKMGQEQAHHHRKPWIRA

SEQ ID NO: 160518 - protein, 86 aa, Glycine max
  Coding DNA Sequence Number=SeqID_68833
MGAKYLKVVKRESHPNNGWSPDEIRAQNDHNLSLRVFGRDRAWVARRRMTIICLCMSPDTIATGWRKGVRNDHNLSPPASRLTVLE

SEQ ID NO: 160519 - protein, 710 aa, Glycine max
  Coding DNA Sequence Number=SeqID_68834
  Gene Ontology: Mol. function=transporter activity; Cellular component= integral to membrane; Biological process=transport
  Homolog annotation: Hit_ID=A8GE58; Match level="QueryCoverage=40%, HitCoverage=80%, E-value=1e-112, Identity=64%"; Hit description =Extracellular solute-binding protein family 1 precursor
  Pfam annotation: Domain name=BPD_transp_1; Domain location=326-575; Score=48.0; E_value=3.4e-11; Accession=PF00528.13; Description =Binding-protein-dependent transport s
  Pfam annotation: Domain name=SBP_bac_1; Domain location=1-239; Score =31.4; E_value=3.3e-06; Accession=PF01547.16; Description=Bacterial extracellular solute-binding protein
  Pfam module annotation: Pfam domain module=BPD_transp_1::SBP_bac_1; Domain location=326-575::1-239
LHDKIVAARGAGGNGYDVVLFDAIWPAEFSKFDLLQDVSSRISADEKEKIFPGAMNTVVFKGKTLGMPWILDTKYLYYNKAMLEKAGIKDLPQTWQQAEALVCDYTTLVSGFGGKFYNNGKLDFSTPASLQAVKLMKSSLDEGLTNPASREYLEEDVRKAFSNGDAAFALNWTYMYNMANDAKQSKVAGQVGIMPAPGDAPNRFGAVNGSMGLGIAKGSSHPEQAWQYISYMTSQPESLIAAADKSLNVMLSRPETADYSRLSNTLQQQLQQVLVGSATPEAAMQAYAEFASTRTTAGMGAAGTHATAPQWIGLENYLYAITDADFQTSLWRTLYFTVVSVAIEGVIGVLVALLLNQKFAGRNVLRVLVILPWALPTIVNAMMWRLNFNPDYGSINALLTQLGIIDGYRSWLGSPASALNAVMFADIWKNYPLVTLLVLAALQSVPEDLYEAARLDGASAWRRFRAITFPAIVGSLSVALVLRTIDAFKIFDIIYVMTRGGPVDSTKTLSFYVYQESFSYLRAGSGAAYAIAVGEVPMKVKLRTCAKYAAALLVALSVVAPMGWLFLMSVSATSDLTRVPLEWLPRQWDFSRYGRLISLEPGQPGALFLHALGNSLLVSTGATLVCLLLAIPAAFSFSRYRGRDGWLFASLAIYMVPPVAFVLPLYFLLQQFDLLNTRPGLIIVAAAHYAAAGETGAGRGGAVWLAAGVG

SEQ ID NO: 160520 - protein, 164 aa, Glycine max
  Coding DNA Sequence Number=SeqID_68835
  Homolog annotation: Hit_ID=A7MK90; Match level="QueryCoverage=57%, HitCoverage=78%, E-value=3e-20, Identity=47%"; Hit description =Putative uncharacterized protein
MSCAIPNLIYPDYAYQTIINSGERMKLLYFVSLIAAAGYLLAFLPKLRTRREPVAYWGCWAYLGLNARLLVENIDGHIVDIGGAERVGDRYRWQLDGKDAGGETEQEVDELLAEVEKHLSFLFVDGQFTSLPDVSADYGDRLDNAPSRQIALPELNDRDEDIVR

SEQ ID NO: 160521 - protein, 216 aa, Glycine max
  Coding DNA Sequence Number=SeqID_68836
  Pfam annotation: Domain name=Transposase_23; Domain location=127-197; Score=11.5; E_value=6.5e-05; Accession=PF03017.5; Description =TNP1ENSPM transposase
MKKKLEEAAESGSVDCIIDPPSPIRRHVKWKMARTKKIGEMTTEAAKEIAEKIDSFEEQATQGSFVPHGLADPANQGPARGVDHRKSGSATHGIVQPDAVPDAILGTCTTSRASGGSLRSSINDLETGDSDRCSLYIEANPARLVALGRVYEGSTIVHNTPLLPSQVKVGVEEVKDPDALVLVPTDEVSLVGQAIHTFLAWPTHLVKSLSQQRASN

SEQ ID NO: 160522 - protein, 77 aa, Glycine max
  Coding DNA Sequence Number=SeqID_68837
DRGRKTFSGPEEVQQGLGDASSNYGPLLVLWSACRPQQGRRRAKHHSSLGMAGSRQQTHSHHLQSPLAHPQKLERCL

SEQ ID NO: 160523 - protein, 94 aa, Glycine max
  Coding DNA Sequence Number=SeqID_68838
MAPRKLASKRFRKDKAVEGTSSAPEYDSHCFRSAEHQQRFEAIKGWDDEYTDFQEEIVRRRWASLVTPMAKFDPDVVLEFYANAWPTEEGVRDM

SEQ ID NO: 160524 - protein, 120 aa, Glycine max
  Coding DNA Sequence Number=SeqID_68839
  Gene Ontology: Mol. function=nucleoside-triphosphatase activity; Cellular component=integral to membrane; Biological process=protein catabolic process
  Homolog annotation: Hit_ID=A7NYK3; Match level="QueryCoverage=34%, HitCoverage=7%, E-value=7e-11, Identity=82%"; Hit description =Chromosome chr6 scaffold_3, whole genome shotgun sequence
MSRLLAPKQQCRPSICIGEIDNQVDTAHSHDSHMCRLSMLKHNLTLDETELELHKAKPHGQIREGADEIEEKTAKLKGSEKALVARHEARHAVVGTAVANLLAGQPHVEVNHGYVDIFGH

SEQ ID NO: 160525 - protein, 184 aa, Glycine max
  Coding DNA Sequence Number=SeqID_68840
MAPKKLSTKRSRRDAAAEGSSATPEFDSHHFRSAEHQQGFKAIKGWTFHRERRVHLRDDEYTDFREEIARRRWTPLVTPMAKFDPEIVLEFYANAWPTEEGVRDMRSWVRGQWIPFDADALSQFLDDPLVLEEGQQCEFSQRRNRADGFDEEAIAQLLCTPGQDFAWTATGRRVRIMCTSMTTS

SEQ ID NO: 160526 - protein, 191 aa, Glycine max
  Coding DNA Sequence Number=SeqID_68841
DQLEESITEKVTWQLMASFSQMQSQLQSQMQSQGLALPLEHAVGRSVACVSTKGSCVDPSPTDLEISDSDKCGLYIEENPSRPVALGRVYEGSTVIHNIPLLHGQVKVGVEEVKDAEAPILIPTDEAIVSPAKPPDRSDPEVDDPLYLMTLTIPQLFLKPLQVMWDAIVFGVFNPDFPLYIKHEDLSEIAH

SEQ ID NO: 160527 - protein, 116 aa, Glycine max
  Coding DNA Sequence Number=SeqID_68842
  Homolog annotation: Hit_ID=Q2HW90; Match level="QueryCoverage=78%, HitCoverage=18%, E-value=2e-08, Identity=35%"; Hit description =Putative uncharacterized protein
MGLDQAQSFEKRFYHVKVKNLEVASLRKLGQWMDQVQCQSFSKVYGKIWDLAMIEVSVEAIASLTQYYDQSLRCFTFGDFQLTPTIEEFEGILGCLIGGRKPYLFSGYYPSMAKVA

SEQ ID NO: 160528 - protein, 90 aa, Glycine max
  Coding DNA Sequence Number=SeqID_68843
MYKATTYNGGISHGRRSFTTKRVPWKRSLERKLQWRKRKRERGEHEIEGGKEGEKLNFEVCLSRLSFIKVTTSVTHASIYSLGSFLEKLP

SEQ ID NO: 160529 - protein, 147 aa, Glycine max
  Coding DNA Sequence Number=SeqID_68844
MAPRKLASKRSRKDKAAEGTSSAPEYDSHRFRSAEHQQRFEAIKGGRARYEVLDAIGQFLGYPLVLEEGQECEYGQRRNRSDGFDEEAIAQLLCIPGQDFARTAAGRRVRIMRTNMTTLTQIWMTLLHSNIQPSDHNSDLPLPKCQL

SEQ ID NO: 160530 - protein, 194 aa, Glycine max
  Coding DNA Sequence Number=SeqID_68845
MRGAPTGESLSPFLVRDFGAQSFKIVQRVHKAWESLLRKDKELRGIRNGIIDGYHEWLKVHTRGLDWLSKLKIINEENFEAPEEDEEVRALKIELGKAKLAKEKFKLVATDVRKECVGLREENTTPEPFTIKVHRPRLFRFFRRFSQINVGGDSAHFPPMEDTPMSPVSPSRRRVGCDSWRLHWGPFLSELGQF

SEQ ID NO: 160531 - protein, 107 aa, Glycine max
  Coding DNA Sequence Number=SeqID_68846
  Gene Ontology: Mol. function=oxidoreductase activity; Cellular component=cytosol; Biological process=auxin mediated signaling pathway
  Homolog annotation: Hit_ID=Q52QX9; Match level="QueryCoverage=80%, HitCoverage=25%, E-value=4e-38, Identity=88%"; Hit description =Aldo/keto reductase AKR
MPMIDNDTYNLQCMCFNLLQSLPRFQPENLEQNKTIFERVNELAAKKGCTPSQLALAWVHHQGKDVCPIPGTTKIENFNQNIGALSVKLTPEDMAELESFAAADAVK

SEQ ID NO: 160532 - protein, 130 aa, Glycine max
  Coding DNA Sequence Number=SeqID_68847
MELSFAQHVADPPTPVHERPADPSTPILEIPKDSTTLVLTLNTTPPSTPELQFSDEEGGRITTPPGTPTHLLLEAASPLSLPSPFHCHSSSKKQRILLMKKILVLQALVELTSTVPSAVREGEGPSAQKV

SEQ ID NO: 160533 - protein, 130 aa, Glycine max
  Coding DNA Sequence Number=SeqID_68848
  Subcellular localization annotation: CTP_CleavageSite=22; ConfidenceScore=5.17e-01
MGRDCLAQFSIFNFFGSPMNCVFVHVSSTLEFGAMVSSTFEFGGLGRDWLVQFSIFNLFWSPMKWVFVHVSSTFEFGAMRSDCLVQFSILNLFRSPMNCVFVHVSSTFEFGAMRSDCLVQFSILNLFGAP

SEQ ID NO: 160534 - protein, 80 aa, Glycine max
  Coding DNA Sequence Number=SeqID_68849
MSPMESPIVATYPSAGGRRETDRCVFHGRKMRGVATNVYSRKTSEKPEKTWSTNFKCERFGSFIYSRGRVFPLLLRIPQL

SEQ ID NO: 160535 - protein, 85 aa, Glycine max
  Coding DNA Sequence Number=SeqID_68850
MKEAQARKVVMPHKIYVSQRSIKNNLRVQDKNQEEFKTQEESLESRIKIQGSRSQESRSRFKTQDSRIKRRLNQDKYEKFFSKIE

SEQ ID NO: 160536 - protein, 58 aa, Glycine max
  Coding DNA Sequence Number=SeqID_68851
MVMMLWCNGDKCSINGGNNDDVIDNYNGGGDVSNDDSDNDDDCGSVVVAAMTLLQCWW

SEQ ID NO: 160537 - protein, 177 aa, Glycine max
  Coding DNA Sequence Number=SeqID_68852
  Gene Ontology: Mol. function=endonuclease activity
  Homolog annotation: Hit_ID=A7PW65; Match level="QueryCoverage=46%, HitCoverage=30%, E-value=7e-31, Identity=80%"; Hit description =Chromosome chr8 scaffold_34, whole genome shotgun sequence
MWDCHTLSSNVRAMIGSLSRPVNVVGWKRAICLEFMEKADVLEYYAKTVNSPSGSFYIPAVLRVPQLLQVVKRRIVKNNLSRKNILFRDNYTCHTINRNSFFPSPSKSRVKEEGCVRPWAANIKLNISNTLVGQMNWERIQGNEFRQNPTRACSIMKRETNGGEIFLLVLFAFTQAI

SEQ ID NO: 160538 - protein, 430 aa, Glycine max
  Coding DNA Sequence Number=SeqID_68853
  Gene Ontology: Mol. function=hydrolase activity, hydrolyzing O -glycosyl compounds; Cellular component=anchored to membrane; Biological process=cell wall organization and biogenesis
  Homolog annotation: Hit_ID=A2Q5Q4; Match level="QueryCoverage=100%, HitCoverage=90%, E-value=0.0, Identity=84%"; Hit description =Glycoside hydrolase, family 17; X8
  Pfam annotation: Domain name=Glyco_hydro_17; Domain location=23-343; Score=269.8; E_value=5.8e-78; Accession=PF00332.9; Description =Glycosyl hydrolases family 17
  Pfam annotation: Domain name=X8; Domain location=364-429; Score=73.7; E_value=5.9e-19; Accession=PF07983.4; Description=X8 domain
  Pfam module annotation: Pfam domain module=Glyco_hydro_17::X8; Domain location=23-343::364-429
MEKNWVLRWIFVVGLMCLSVEGIGVNWGTQATHKLPPDTVVQMLKDNGIKKVKLFDSDDSTMSALAGTGIEVMVAIPNNQLAEMNDYGRAKQWVKKNVTRYNFNGGVNVKYVAVGNEPFLKSYNNSFLNITLPALQNIQNALNEAGLGDKIKATVPLNADVYQSPESNPVPSAGIFRPDISGLMTQIVQFLSKNGAPFTVNIYPFLSLYGNDDFPFNYAFFDGVDNPVNDNGTPYTNVFDANFDTLVAALKSVGFGDLPILVGEVGWPTEGDKNANAGNALRFYNGLLPRLAANRGTPRRPGYIEVYLFGLIDEDAKSIAPGNFERHWGIFRYDGQPKFPMDLSGQNQNKFLIGAQNVKYLAPRWCMFNPDAKDLSKLPDNINYACTFGDCTALGYGSSCNNLDANGNASYAFNMYFQVQNQNPMACNFQ

SEQ ID NO: 160539 - protein, 39 aa, Glycine max
  Coding DNA Sequence Number=SeqID_68854
MLFMVLPGGVDNTVSPCFVASSPDSRGHVASPTSGGSHS

SEQ ID NO: 160540 - protein, 68 aa, Glycine max
  Coding DNA Sequence Number=SeqID_68855
MVCLNRGACAYYTSHAVRSVVCKALAEEAYNWNLRNDGNNSPHNKWKESKKAVHVEKNIRKAFTVSHQ

SEQ ID NO: 160541 - protein, 105 aa, Glycine max
  Coding DNA Sequence Number=SeqID_68856
  Gene Ontology: Mol. function=hydrolase activity; Cellular component =nucleus; Biological process=mRNA transport
  Homolog annotation: Hit_ID=Q9XFC9; Match level="QueryCoverage=60%, HitCoverage=13%, E-value=1e-22, Identity=77%"; Hit description=Nod factor binding lectin-nucleotide phosphohydrolase
MAYAVSITCTNSNDAARAEIFKVADGSSSPCLLAGYDAIYSLSFEDAKSTYPHFQKSKFPYVCQDLTYHYTLLVDGFGLDPFQEITVAEGIEYRDAIVETAWPGL

SEQ ID NO: 160542 - protein, 48 aa, Glycine max
  Coding DNA Sequence Number=SeqID_68857
MSIPYRMFERKELPTYREGTGEKDYRTESPLDALNDHCWVIPLRSSSC

SEQ ID NO: 160543 - protein, 128 aa, Glycine max
  Coding DNA Sequence Number=SeqID_68858
MEGNEHKCKSDSKIWLKECWVGYLRDLSMYEKIDEVNFFGSLGEAKLRHMGGGMEFHFMRDASIFAKVVERCRTLVDIDKSTENMNKINFARILVQTSAGMHMYFAQGVDVMNDEFNREVDVAMAEVV

SEQ ID NO: 160544 - protein, 367 aa, Glycine max
  Coding DNA Sequence Number=SeqID_68859
  Gene Ontology: Mol. function=binding; Cellular component=nuclear pore; Biological process=protein import into nucleus, docking
  Homolog annotation: Hit_ID=A7PA79; Match level="QueryCoverage=58%, HitCoverage=69%, E-value=7e-64, Identity=61%"; Hit description =Chromosome chr14 scaffold_9, whole genome shotgun sequence
  Pfam annotation: Domain name=IBN_N; Domain location=26-94; Score=6.3; E_value=0.023; Accession=PF03810.10; Description=Importin-beta N -terminal domain
  Pfam annotation: Domain name=Xpo1; Domain location=120-277; Score =85.8; E_value=1.4e-22; Accession=PF08389.3; Description=Exportin 1 -like protein
  Pfam module annotation: Pfam domain module=IBN_N::Xpo1; Domain location=26-94::120-277
MELAMKVAEAVHVLNHDTQSCNRVAANQWLVQFQQTHAAWDVATAILTADRRLPLPANFEVEFFAAQILKRKIQNEGYLLQLGAKDALLNALLLAVKRFSTGPPQVHGFSFFVILLILFSRELLTQICLALSALVLQVAAHGNPIEQLFYSLRNLQSQDDGNFAVLEMLTVLPEEVVDNQRIDSKISSLHKSHYTQELLSHTPMVLEFLLQQSETNFDGSVQQHERNRKILRCLLSWVKAGCFSEISPGTLPAHPLLNFLFNSLQVPLSFDLAIEVLVELVTKHEASYARGGLASYKLIIKGQFYGFLGAVNYIMEVGVEAETKLQIETSMNSRNKTTFKPSTNASSRLSRGQIEEESMQRKKGKAV

SEQ ID NO: 160545 - protein, 273 aa, Glycine max
  Coding DNA Sequence Number=SeqID_68860
  Gene Ontology: Mol. function=binding
  Homolog annotation: Hit_ID=A7PA76; Match level="QueryCoverage=83%, HitCoverage=40%, E-value=4e-81, Identity=70%"; Hit description =Chromosome chr14 scaffold_9, whole genome shotgun sequence
MISFQSVLVQQFGIYSELFIGGWASHNLSIPWKEVESKLFALNAVYRSLADAVGSYSKWISAFKENFRALLLFLAIGISEPLSSNACASALRKVCEDASVVIYEPSNLEILMWIGEGLDKWHLSLEDEEEVMHAISLILGSVPSRELKNKLLAKLLSPSYEAIGKLVDPEISLSLKQNPASYTQVLNASSRGLHRMGTVFSHLPISMATEPAADDSILSLLRVFWPILEKFFGSEHMENGNLSVAACRALSLAVRSSGLPTWTHLFTVLWFLL

SEQ ID NO: 160546 - protein, 311 aa, Glycine max
  Coding DNA Sequence Number=SeqID_68861
  Gene Ontology: Mol. function=FMN binding
  Homolog annotation: Hit_ID=Q9M7D2; Match level="QueryCoverage=99%, HitCoverage=100%, E-value=1e-130, Identity=74%"; Hit description =Root border cell-specific protein
  Pfam annotation: Domain name=Pyridox_oxidase; Domain location=86-177; Score=32.9; E_value=1.2e-06; Accession=PF01243.11; Description =Pyridoxamine 5'-phosphate oxidase
  Subcellular localization annotation: CTP_CleavageSite=47; ConfidenceScore=5.84e-01
MKSMVTPLTRVLPFRHPNGYNTLPFSLTRYPSSPNFSFSFSPLTLTLSMAASPQSSAPTVSPGDANINKDGVFQLIQAHQEKAARLPPVEEIRTVLDRSVRGMLSTFSKKFDGYPSGSMVDFACDSNGYPILAVSDLAVHSKDLTANPKCSLLVARDPEDRTDLVITVHGDAISVPENEREAVRAAYLARHPNAFWVDFGDFRFLRIEPKVVRFVSGVATALLGSGEFSGDEYKSAKVDPIAQFSKPVASHMNKDHAEDNKVIVQHWTSVPAGYQGDTFKLRVPFPRRAEDRKDVKTLIVEMLQAARPKVD

SEQ ID NO: 160547 - protein, 243 aa, Glycine max
  Coding DNA Sequence Number=SeqID_68862
  Pfam annotation: Domain name=GRP; Domain location=32-83; Score=-25.6; E_value=0.033; Accession=PF07172.2; Description=Glycine rich protein family
MGKARATVEELRRFLVPDSLEEVLAKDQVPSMDSLITRLLCVAHALKDENLTEVVETSAMVAPRGRGGGRNSRGGRNGRSGRPQCTYCKRMGHTQENWSYQRLGWRLTQFEDGRRRIPNMRSRIRMGIPIIWVEKSEFEREKKKPNANPRKKCNKDSLSLIPKAPLPRRPTWERIGLEPGYKSYKDDMQGNNGDQGKPSREKRRAWERKNLIGLGSPTIRERAKKEKEMLLEKEINTTKLKPK

SEQ ID NO: 160548 - protein, 66 aa, Glycine max
  Coding DNA Sequence Number=SeqID_68863
  Subcellular localization annotation: CTP_CleavageSite=50; ConfidenceScore=5.56e-01
MATSPWIMDRAGYFSQIHFNTPKNKNATPSHAFSLSLLPLSRFKPLSPISTSSEPPRLSMRCRGVR

SEQ ID NO: 160549 - protein, 105 aa, Glycine max
  Coding DNA Sequence Number=SeqID_68864
MLAIISRYQEELNLATAHEHKVVDEYARVYAEKEARGRVFDSLHQEATMWMDRFALTLNGSQKLPRLLARAKAMADTYSAPEEIHELLSYCQHMIDLMAHIIRNR

SEQ ID NO: 160550 - protein, 77 aa, Glycine max
  Coding DNA Sequence Number=SeqID_68865
MSYRMSRHHASEHADYMCPYEQIKQHFQYSRAGCQDIVSDIVDPSTSIHHLGQGYRKELLCGHRGVRGGGEKCGRHG

SEQ ID NO: 160551 - protein, 59 aa, Glycine max
  Coding DNA Sequence Number=SeqID_68866
MEEFLQEHPLKVIPAGNGPGSKLNAQNQNVQNHQQQNAQNAQNARNAQNAQNDQDAHYA

SEQ ID NO: 160552 - protein, 170 aa, Glycine max
  Coding DNA Sequence Number=SeqID_68867
  Gene Ontology: Mol. function=aspartic-type endopeptidase activity; Biological process=proteolysis
  Homolog annotation: Hit_ID=A5C995; Match level="QueryCoverage=72%, HitCoverage=7%, E-value=1e-15, Identity=39%"; Hit description =Putative uncharacterized protein
MTRGNPSDLQPFDPGIDRTFHRLVRHHLVPFEHPEHSAIGDFEHYSFEHSDFEHFENMAHPPPRERTLRELVAPDFTYESLCIQYPNEDVPYVLKIGLIHLLPKFHGLAGEAPYKHLKEFHIVCSTMKPPDVQEDHIFLKAFPHSLEGVAKGWLYYLAPRSITSWDDLKR

SEQ ID NO: 160553 - protein, 110 aa, Glycine max
  Coding DNA Sequence Number=SeqID_68868
MLAEKYQSLLYNGRCHQLLMRIMKLAKIQGKGPSGEGRRPKWRRTKPPKWRRMKAQTYQGNPCGVYPDLSSFTGSGVYPDLSSFTGSGVIQNLRSLYQTICSYSGSHQCA

SEQ ID NO: 160554 - protein, 127 aa, Glycine max
  Coding DNA Sequence Number=SeqID_68869
LITGLCQSFGVPVAPTKVIRPPITRAFIEKYCTQRQAQEDAPQAAGAPPPPHQAGPAGSFDMEQYYGIWFASRRPTTGHMVEVAWPGDWPEAQGGEAPPEAPGDGEEAHEDEEMADLLDFLGGSGAT

SEQ ID NO: 160555 - protein, 125 aa, Glycine max
  Coding DNA Sequence Number=SeqID_68870
  Gene Ontology: Mol. function=FMN binding
  Homolog annotation: Hit_ID=Q6DA83; Match level="QueryCoverage=98%, HitCoverage=76%, E-value=2e-37, Identity=57%"; Hit description =Putative uncharacterized protein
MPHVLSLCASDGDALWCANCFYVFDEARMAFWLMTEADTRHGALMARHPRVAGTVNGQPKTVLLIKGVQYRGRIQLTDEAQALKAYQSRFPVAKKVTAPLWEITLDELKMTDNALGFGKKIVWQR

SEQ ID NO: 160556 - protein, 225 aa, Glycine max
  Coding DNA Sequence Number=SeqID_68871
  Homolog annotation: Hit_ID=UPI00016621D1; Match level="QueryCoverage =95%, HitCoverage=40%, E-value=7e-15, Identity=32%"; Hit description =UPI00016621D1 related cluster
MSPIFKGGHALTFRGLHTLAIRGLHVLTFVGLHALTFRGPHILTFRRLHALAIRGLHVLTFRGLHALVFRGLRVLTFRGLHVLTYRRLHALAIRGLHVLTFRVLQALAIRRMHVLTFRGLHVLTFVGNTPSPLEDHTSSPSEGYTPSPSEDYMFPNFKGDMPSPSEGYTPSPSEDCTVLTFRGLHALAFRGLRVLTFRGLHVLTFRRLHALAITGLHVLTFIEAT

SEQ ID NO: 160557 - protein, 97 aa, Glycine max
  Coding DNA Sequence Number=SeqID_68872
MENILPHDKDDNYIDDDESKKRTRGFTHMLDVWDLPDGEFILVEVDHWGNPMGWEGKTLLIAVGSLVRRHQCAPINFLSWKDMPKDYITDIVELIQV

SEQ ID NO: 160558 - protein, 67 aa, Glycine max
  Coding DNA Sequence Number=SeqID_68873
MLSKCNRQKGSTECGYYVMHWMSTIILGSFKNNWETYFNDARPVELERLKALRIQWAKYYLKVRNET

SEQ ID NO: 160559 - protein, 133 aa, Glycine max
  Coding DNA Sequence Number=SeqID_68874
MSKRLQEDWARAAEEGPRVLMNLRVTICLLHPIATSYSHTLCMSFMLYMPHNTCHTLISSGDHPLLGCDPRLTTSRYFEPIVRQFVKFRDMPEVNEGIVARSDVPPEGGCFWRKQPSSAGRAGWQASPSFSYK

SEQ ID NO: 160560 - protein, 316 aa, Glycine max
  Coding DNA Sequence Number=SeqID_68875
  Gene Ontology: Mol. function=motor activity; Cellular component=cell projection
  Homolog annotation: Hit_ID=UPI00006A2D9E; Match level="QueryCoverage =55%, HitCoverage=97%, E-value=6e-18, Identity=18%"; Hit description =UPI00006A2D9E related cluster
GGPLGTSTLTLRGLHALAIRGLHVLTFRGLHVLVFRGLHALTFRGLHILTFRGLHVVVFKGLFALAFRGLHALTFRGLHVLPFRGLHALAFRGLHVLTFKGLHALAISGLHGLTFRGLHVLTFRGLHALAFRGLHALAFKGRHVLNFRGLHALAFRGLHTLTFKGRHVLNFRGLHALAFRGLCSSLSATNAQPEEEAIAQLLCIPGQDFTRAAAKRRVRIMRTNMTTLTQIWMTLLLSNILPSNCNADLPLRKDRDHKAPCGPGGVRQGPGVSSSGYGPLSVLQDAHTPSKVMPSWHRDHAHKTPSGPGEVQQGPG

SEQ ID NO: 160561 - protein, 31 aa, Glycine max
  Coding DNA Sequence Number=SeqID_68876
MRWVVTLVVSEQGVMAGQNDRVIADALQALA

SEQ ID NO: 160562 - protein, 65 aa, Glycine max
  Coding DNA Sequence Number=SeqID_68877
MKKDYEAGKQIQGAQRQGHDKTEGIIQDQHPTFADGIGEQSAVPKFFTREPQGGRFNAFFSTGIQ

SEQ ID NO: 160563 - protein, 241 aa, Glycine max
  Coding DNA Sequence Number=SeqID_68878
  Gene Ontology: Mol. function=4-aminobutyrate transaminase activity; Cellular component=cytoplasm; Biological process=gamma-aminobutyric acid metabolic process
  Homolog annotation: Hit_ID=Q6F767; Match level="QueryCoverage=100%, HitCoverage=56%, E-value=2e-98, Identity=71%"; Hit description=4 -aminobutyrate aminotransferase, PLP-dependent
  Pfam annotation: Domain name=Aminotran_3; Domain location=27-241; Score=72.3; E_value=5.4e-19; Accession=PF00202.12; Description =Aminotransferase class-III
MEGKNSQLQQRKDDALPRGTGNLCQWYVDQTENATLRDVEGNSWIDFAGGIAVLNTGHRHPRIVQAIADQLAKFTHTAFQVTPYESYVALAERINQRVPIAGKAKTAFFTTGAEAVENAVKVARAATRRHGIITFGNAFHGRTFMTIAMTGKVAPYKRDFGPMPASVFHARYPNAVTGISVEDAIASLHDLFSHDIAPQDVAAIVLEPVQGEGGFHIAPAEFLTQLRALADEHGILLIADE

SEQ ID NO: 160564 - protein, 142 aa, Glycine max
  Coding DNA Sequence Number=SeqID_68879
  Gene Ontology: Mol. function=transcription factor activity; Biological process=regulation of transcription, DNA-dependent
  Homolog annotation: Hit_ID=UPI00005FA2E1; Match level="QueryCoverage =88%, HitCoverage=41%, E-value=3e-53, Identity=83%"; Hit description =COG0583: Transcriptional regulator
  Pfam annotation: Domain name=HTH_1; Domain location=5-64; Score=65.6; E_value=1.7e-16; Accession=PF00126.18; Description=Bacterial regulatory helix-turn-helix protein, lysR family
  Subcellular localization annotation: CTP_CleavageSite=72; ConfidenceScore=5.41e-01
MALDMALLHAVVAVAKAGGFREAARMSGSNPSRLSDAVRRAEQQLGVRLFNRTTRTVVLTEAGRALMSRLLPAMNEVDAALDALNTFRDTPGGTLRLNVPVSAARLVLPAIVPGFLQRYPDIRLEIVAESNVQDIFRDSCDA

SEQ ID NO: 160565 - protein, 492 aa, Glycine max
  Coding DNA Sequence Number=SeqID_68880
  Gene Ontology: Mol. function=mannosyltransferase activity; Cellular component=membrane; Biological process=protein amino acid O-linked glycosylation
  Homolog annotation: Hit_ID=A4WAM1; Match level="QueryCoverage=63%, HitCoverage=56%, E-value=1e-92, Identity=52%"; Hit description =Undecaprenyl phosphate-alpha-4-amino-4-deoxy-L-arabinose arabinosyl transferase
CAADLLPEQTDVRQPQNSAHRQRDLSYLAAGLRHRHLCCARSDSAVVAGGGNVQLLVCCAGAQYLTAADGVCAARRGLCHGLHDPKAFWRWRCRCWRLCPGCSGSDEGDFWHYFFWVEHIQRFAESDAQHKAPFWYYLPVLVAGCLPWLGLLPGALSGAWRQRQPHAAAIYLLSWVVLPLLFFSIAKGKLPTYILPCFAPLALLMAHYAHGNTARLKQALVVNGWINLLFGLGATLLVVVVLAPWGLAHHPVYARDELLRVVCAALAFAGWAVMGWLSLKTGRWQLAALCPLALALLVGLAIPQKVRDSKQPQSFVSAVRPQLAQSRYLVVDNSGIASAVAWELRRSDITFFDEKGELEYGLGYPDAKTRYVDGEAFADWLRLHRRQGPVALVLLLNSDEKQADAHLPVPDDVYQQGRLPAQLCRPAVSETGGPLRRAPPVRLAGAQPAAAHGDAAVAAGAALLPAQPALSAAQSELCAGVAGARHFSAGLA

SEQ ID NO: 160566 - protein, 119 aa, Glycine max
  Coding DNA Sequence Number=SeqID_68881
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=43%, HitCoverage=50%, E-value=4e-24, Identity=100%"; Hit description=LacZ protein
MGAEDEVCLCVLSGFSSYKQQNKVYTDNHSGISAFLERPPPRWSSNSPYSESYYNSLAVVLQRRDWENPGVTQLNRLAAHPPFASWRNSEEARTDRPSQQLRSLNGEWDAPCSGALSAA

SEQ ID NO: 160567 - protein, 190 aa, Glycine max
  Coding DNA Sequence Number=SeqID_68882
  Homolog annotation: Hit_ID=A5B6Y9; Match level="QueryCoverage=22%, HitCoverage=8%, E-value=4e-14, Identity=85%"; Hit description =Photosystem I P700 chlorophyll A apoprotein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDESRLSDPTVPSGRAVAQRIKGWAVRPLKRYVSWVQNVVRQFGPYPVWALEH

SEQ ID NO: 160568 - protein, 406 aa, Glycine max
  Coding DNA Sequence Number=SeqID_68883
  Homolog annotation: Hit_ID=Q6WAY4; Match level="QueryCoverage=47%, HitCoverage=36%, E-value=3e-16, Identity=30%"; Hit description =Putative uncharacterized protein
MELGVRSFSKKFIEDKAQEYENKGEWMYFMSILDLLIYRVILFPSMIDQIDLAAVDAFLAYHYRRESPVVSIPSNVYYTLDLSWEKKSTRVVICCLPELYVWMVSCFVMLNGSTIRWFPRWEEVPNVLCRCGAFTNIPLMGPKGYVNYNPMLGISYSQWLENRVREVKLLKKTNGEGVKIDVPIETEEVRKLKAELQKSMGTKEKLKGVVIRESLKEQLGMMEKNMLVIIGRYELKMMKDWQDLESRRWMNRFALTLNESQELPKLLAIAKTTTDTYSAPDLEQMKADMEAMKKQMTMMMEATMDMRKIMGASIATVVAASTATERDPAHPPSFNQESHLVTDMEGQGGVTGVATYGPQYTQSHTFPPYSLPPNYTPSMAVPVPAINVTNPTPICTENNPAQPNQT

SEQ ID NO: 160569 - protein, 194 aa, Glycine max
  Coding DNA Sequence Number=SeqID_68884
  Homolog annotation: Hit_ID=Q2QUR6; Match level="QueryCoverage=24%, HitCoverage=4%, E-value=4e-07, Identity=56%"; Hit description =Retrotransposon protein, putative, Ty3-gypsy subclass
MAGAGDNGGVYHQLDAMTTQMQRLLNRNKEELYRRIVKSSLFTLKPLSPREVCDDQIRMREKREQEKENKASEVRKVLPAHEPLYLQGIEHQVDLLPGASLPNRPTYESNPQETQRKDAHAKVEYVKGLYDQVKVQIAKKNESYAKQANKKRKEVVLESGDDPRHLRANVYQEGGNDENPETGQLQAKGPSGEG

SEQ ID NO: 160570 - protein, 304 aa, Glycine max
  Coding DNA Sequence Number=SeqID_68885
  Gene Ontology: Mol. function=motor activity; Cellular component=cell projection
  Homolog annotation: Hit_ID=UPI00016621D1; Match level="QueryCoverage =71%, HitCoverage=40%, E-value=2e-14, Identity=29%"; Hit description =UPI00016621D1 related cluster
DLYAFAFVGLGVLKFRGLHVLAIRGLHVLAFKGLYALAFIGLHVPTLRGLHALAFRGLHALTVRGLHVLAFRGLHVLTFRGLHAFAFVGLGILKFRGLHVLAFKGLYVLAFRGLHDLALRGLHVLAFRGLHILTFRGLHASGLHVLTLRGLHALAFRGLHALTVRGLHVLAFRGLYILTFRGLHTFAFVGLGVLKFRGLHVLAIRGLHVLAFKGLYALAFIGLHVPTLRGLHALAFRGLHALTVRGLHVLAFRGLHVLTFRGLHAFAFVGLGILKFRGLHVLAFKGLYVLAFRGLHALALRGLR

SEQ ID NO: 160571 - protein, 417 aa, Glycine max
  Coding DNA Sequence Number=SeqID_68886
  Gene Ontology: Mol. function=motor activity; Cellular component=cell projection
  Homolog annotation: Hit_ID=P15305; Match level="QueryCoverage=74%, HitCoverage=85%, E-value=1e-16, Identity=19%"; Hit description =Dynein heavy chain
SCTPSSFEDCTPSPSEGCTPSPLEDCTPSPSKDWTSSPSEDYTSSPSEDCTSLPSEGYTPSPSEDDTSSPSEDCTSSSLEAYRPSPSKDYTSSPSEDYMSSPSEGYTPLPSEDYTGLHALTFRGLHVLSLRGLHALTFKGLHILAFRGLHVLALRGLHVLAFRGLHVLAFRGLHALTFRALHIPAIRGLHFLAFRGLHALAFRGLHIIVLRQLHVLTFKGLHVLAFRGLQVLSFKGLHVLAFRGCTSSPSKGYTPSPLEDCTSLPSEDCIGLHALSFRGLHVLAFGGLHILAFRGLHVLAFRGLNVLAFGGLHVLAFRGLHALVFKGLHILTFRGLHVLTFEGLHVLDFRGLHLLALRGLHVLTFRGLHALVFTGLHALAFRGLHTLTFRGLHALTFKGLDVLTFRGLHILAFRGLH

SEQ ID NO: 160572 - protein, 99 aa, Glycine max
  Coding DNA Sequence Number=SeqID_68887
MEADGTMVNEVVMVAKAIMVVMTIYDVCGAMVTKMVMHGMLISMAMEEEVVAKVVVANVMAKTMIPVATIRQATTVEPNSVTIASTLPACAKLKELDLG

SEQ ID NO: 160573 - protein, 167 aa, Glycine max
  Coding DNA Sequence Number=SeqID_68888
  Homolog annotation: Hit_ID=A5C0F5; Match level="QueryCoverage=47%, HitCoverage=12%, E-value=1e-07, Identity=38%"; Hit description =Putative uncharacterized protein
  Subcellular localization annotation: CTP_CleavageSite=34; ConfidenceScore=5.01e-01
MVQGASAAQDTVAQVHIVFDMTSSSSSSSNFDVVCGPRENDVLWMQKQHVSQHNWNKDVDKKIKNEASDSNLSSTNIDGIDMCEQYLGVRPNANALADENTLKLSWLASKFANIQDYVDDEEHLKMFARAWILRFIRGVLLVDKSSKRVPMRYLQFLVAFKECNTYA

SEQ ID NO: 160574 - protein, 74 aa, Glycine max
  Coding DNA Sequence Number=SeqID_68889
  Subcellular localization annotation: CTP_CleavageSite=35; ConfidenceScore=5.16e-01
MVLSVTATKDLDTTSHWNQPTKQNYIFNGRHATASSAAAWSVLLTVAFNNDYLKLLSGCPGMLDSRVPLMRKNV

SEQ ID NO: 160575 - protein, 53 aa, Glycine max
  Coding DNA Sequence Number=SeqID_68890
  Gene Ontology: Mol. function=aspartic-type endopeptidase activity; Cellular component=oxygen evolving complex; Biological process=DNA integration
  Homolog annotation: Hit_ID=A5BVN0; Match level="QueryCoverage=96%, HitCoverage=8%, E-value=1e-11, Identity=62%"; Hit description =Putative uncharacterized protein
MDAVEQILRYLQSTPGKANDRRSTAVCFTFVGGNLVTWRSKKQQVVARSSAEI

SEQ ID NO: 160576 - protein, 65 aa, Glycine max
  Coding DNA Sequence Number=SeqID_68891
MGSGVGMIPVVGGDFTEKEHRECWLGIEFRGHGGLGGSEMELSYSEFGNGGLEVVQARCGTCRFP

SEQ ID NO: 160577 - protein, 297 aa, Glycine max
  Coding DNA Sequence Number=SeqID_68892
  Gene Ontology: Mol. function=protein serine/threonine kinase activity; Biological process=protein amino acid phosphorylation
  Homolog annotation: Hit_ID=A7PP49; Match level="QueryCoverage=48%, HitCoverage=19%, E-value=6e-17, Identity=33%"; Hit description =Chromosome chr8 scaffold_23, whole genome shotgun sequence
  Pfam annotation: Domain name=LRR_1; Domain location=118-140; Score =12.8; E_value=1.3; Accession=PF00560.24; Description=Leucine Rich Repeat
  Pfam annotation: Domain name=LRR_1; Domain location=142-164; Score =11.5; E_value=2.3; Accession=PF00560.24; Description=Leucine Rich Repeat
  Pfam annotation: Domain name=LRR_1; Domain location=165-186; Score =7.1; E_value=15; Accession=PF00560.24; Description=Leucine Rich Repeat
  Pfam module annotation: Pfam domain module=LRR_1::LRR_1::LRR_1; Domain location=118-140::142-164::165-186
MTKTFFLVDIIIFVQQTREPDSSQGLKPQWALTAKPEPARHALQCGPPEQQAQWPITLLSRTVSALDHNNLIATTGDWKLPEALQGSTKLTNFSCFVVEQPAGRASQWGIDVVAIMVSLTSLWLQGNAFTGTFPENIRDLSSLKDLNLNGNNLIGLVPQGLGGIKLDMLDLNNNRFMGPILDFKAVMVSYYFNDFCVSKSWVLLRMMKRGVVVVNGALVVPLWLFDEGSQELGLFMNALPTAENISRRNIVVPKSNGVCPFSGLVEESRDHVLLWCKEVWEIWLKCYSWLELSFVFS

SEQ ID NO: 160578 - protein, 234 aa, Glycine max
  Coding DNA Sequence Number=SeqID_68893
MRGREWEKHNDGLSEGGREVFFAPWRDRGGHHYNFLCFLDVKNDRKLERTLDTVCIGTKKMHVNTPKFIKFDKQIKKDLNLRDRGQRKVRLMPMRSSNLERRQGKSGKRKSICVLRRHIWRGIPLQAWGPECFAKVVSGYETFVKVDKGIKELESLDTLRIVVRVSEVGIEGFLESDIGIKIASLGLDFDGDMEGEEEDVVGKQPVYVEASDGGAYKTFSRGNEVEACVEDEIW

SEQ ID NO: 160579 - protein, 298 aa, Glycine max
  Coding DNA Sequence Number=SeqID_68894
  Gene Ontology: Mol. function=metalloendopeptidase activity; Cellular component=proteinaceous extracellular matrix; Biological process =metabolic process
  Homolog annotation: Hit_ID=A7R3M8; Match level="QueryCoverage=78%, HitCoverage=44%, E-value=3e-76, Identity=59%"; Hit description =Chromosome chr2 scaffold_541, whole genome shotgun sequence
  Pfam annotation: Domain name=PG_binding_1; Domain location=59-122; Score=42.5; E_value=1.5e-09; Accession=PF01471.9; Description =Putative peptidoglycan binding domain
  Pfam annotation: Domain name=Peptidase_M10; Domain location=155-296; Score=167.3; E_value=4.1e-47; Accession=PF00413.15; Description =Matrixin
  Pfam module annotation: Pfam domain module=PG_binding_1::Peptidase _M10; Domain location=59-122::155-296
  Subcellular localization annotation: CTP_CleavageSite=36; ConfidenceScore=5.06e-01
MFLSVRYSFTLFFILLLLSPSHIASTTPTLAHTLTQSATKIAITNRNIHSLNNAGRGTKITGISQFKRYLHRFGYLQNNNISFSDEFDAVLESALFRYQRNLGLQVTGKLDSNTVSQMITPRCGDPDTNTTPHHHNHVHKTRLTKNFVFFPGKPRWSRSMPMTLTYAFSRENMIHSLSMKEIREAFQRAFTRWASVIPVSFVEVSDFELTDIKIGFYNGEHGDGEPFDGVLGVLAHSFSPEIGRLHLDAAETWAVDFRSTTSEVAVDLESVATHEIGHLLGLSHSFGERGCYVSKFEA

SEQ ID NO: 160580 - protein, 60 aa, Glycine max
  Coding DNA Sequence Number=SeqID_68895
MEVCGLSSCDAVDGVSSAVEAVVRCTGYRGLGERRLGFAWEKNSKKGVLRRLKYFLVLVN

SEQ ID NO: 160581 - protein, 32 aa, Glycine max
  Coding DNA Sequence Number=SeqID_68896
MDFGENNMFSLNTHTKEENENTPNNNNNIVNV

SEQ ID NO: 160582 - protein, 70 aa, Glycine max
  Coding DNA Sequence Number=SeqID_68897
  Subcellular localization annotation: CTP_CleavageSite=42; ConfidenceScore=5.72e-01
MTTWRMLDERCRSCTTSPATVTSWSSRALTRTATPSTSSWSYAALASSSTGSLSRATTPSVSLPTFIARS

SEQ ID NO: 160583 - protein, 162 aa, Glycine max
  Coding DNA Sequence Number=SeqID_68898
  Gene Ontology: Mol. function=binding; Cellular component=protein complex; Biological process=protein catabolic process
  Homolog annotation: Hit_ID=A7PJ90; Match level="QueryCoverage=55%, HitCoverage=23%, E-value=1e-18, Identity=42%"; Hit description =Chromosome chr12 scaffold_18, whole genome shotgun sequence
MGRHDECQLYIQTWLKESQGEIYLGAYLNHVMKELKRFHGNPSQSKPLLATHRIDVKGVCAHLLDGCISAGARVESTRQNLDASFVNAFDKLMTITSSSDSLGNWVFKNMEHGKTSAATSLEMVVLRDYIDKEDATIKIGAIMGLGIAYSKVYWKLEVESTA

SEQ ID NO: 160584 - protein, 137 aa, Glycine max
  Coding DNA Sequence Number=SeqID_68899
MTKHQRSTKRDTSYWEYVDALHSVQNNNSSIKRSTSSYDQAIPRRIMPMLDQFHSCIHNSIENIVNVKDDGNYGYRAIAVLLSVGEDSWSLVHDHLLKELTKWSDEYINLLGDIDKYEELKRPLLVDGLSMLLWISA

SEQ ID NO: 160585 - protein, 437 aa, Glycine max
  Coding DNA Sequence Number=SeqID_68900
  Gene Ontology: Mol. function=receptor activity; Cellular component =integral to membrane
  Homolog annotation: Hit_ID=A7QFP3; Match level="QueryCoverage=92%, HitCoverage=83%, E-value=1e-168, Identity=67%"; Hit description =Chromosome chr8 scaffold_88, whole genome shotgun sequence
  Pfam annotation: Domain name=Lung_7-TM_R; Domain location=158-424; Score=440.9; E_value=1.8e-129; Accession=PF06814.4; Description=Lung seven transmembrane receptor
MTTAFERHALPLFLFLFLTPIINASIHDYSNEPFTHRSDAFFFHGGSEALFAKSFIRFETVTFARPRESASVHGRMQSNTGLVEAIILEVRDRNRIGGSYLKSDLICCDPKLAKDRNCNLGEVIIQKNPDNHELPKRIKTFFQGTDEQVQMDAVTLEINATGMYYLYFMFCDPSLKGTTIQGRTVWRNPNGYLPGKMAPLMTLYGFMSLAYLLLGLAWFLRFVQFWKDIIQLHYHITAVIALGMCEMAVWYFEYANFNSTGTRPMGITLWAVTFTSVKKTLSRLLLLVVSMGYGVVRPTLGGNVIAYRVLLLGLLYFSASEALELVEHLGNINDFSGKTKLLLVLPVTRRNLAKLELYRKFTNTLAVSVLLSIAWIGFELYFNATDPLSELWQIAWIIPAFWCLLSYALLVVICILWAPSRNPTRYLFFPWSWCGEC

SEQ ID NO: 160586 - protein, 44 aa, Glycine max
  Coding DNA Sequence Number=SeqID_68901
MGSSQMPWLKKRFYQVKIKSLGIASLKELGQLMEVSTEAIASIA

SEQ ID NO: 160587 - protein, 290 aa, Glycine max
  Coding DNA Sequence Number=SeqID_68902
  Homolog annotation: Hit_ID=Q5XM22; Match level="QueryCoverage=42%, HitCoverage=84%, E-value=7e-26, Identity=45%"; Hit description =Resistance-like protein HAAS-2
MLVELLKVNVAEARAETIQCHDSYVRLSWLCDVYEMKIEVCHWIVAVRAYLLHLLGCTLFANKSATHVHVVFLDALRDLTQSGGYAWGVAALVNMYDNLNDASKSTTRQLARYITLLQCWIYGYFPSVGSAVPAKDYDERRVWGPLTVIHRPERVIRQFGYIQTILPHPVASSLFVEEIDDRWMQFGEYIALVGQLCAVPGHCSPDYMDWFYMISHPFMSPAQPGDLPRVSPDGFVAIDYKLERLLNLRILIEGTEAYTVVEECMGIARSYIGQPTVGHRLRRRRRMDSH

SEQ ID NO: 160588 - protein, 99 aa, Glycine max
  Coding DNA Sequence Number=SeqID_68903
MHYVSFIFNIHVLKDQNIISPSQSISINTQALCNIYTKIQSYMQCGTMVTLFCENAPTTWDQHRLKGTLKPSIFTPKAYTPKSPSGPLPPDSGPTQKTF

SEQ ID NO: 160589 - protein, 69 aa, Glycine max
  Coding DNA Sequence Number=SeqID_68904
MQRLDKKFDEQLPPPSRGGDDHSRRRFITPAHSDYWRAAFIRAAGIQGLGPGRGILLGSGRIGPLVRSA

SEQ ID NO: 160590 - protein, 42 aa, Glycine max
  Coding DNA Sequence Number=SeqID_68905
MWRLPSSDLEKGMYVFNTPIPTNREDEIIAKGPLENKYDGYI

SEQ ID NO: 160591 - protein, 68 aa, Glycine max
  Coding DNA Sequence Number=SeqID_68906
  Gene Ontology: Mol. function=oxidoreductase activity; Biological process=metabolic process
  Homolog annotation: Hit_ID=A2WG93; Match level="QueryCoverage=100%, HitCoverage=26%, E-value=2e-12, Identity=60%"; Hit description =Retinol dehydrogenase
MAAELLVEQGHQVVLHGRNAARARAAQEALPQAEAVVSGDVITIAGARSVAQQVNALGRFDAVIHNVA

SEQ ID NO: 160592 - protein, 137 aa, Glycine max
  Coding DNA Sequence Number=SeqID_68907
MQQGQTYILVATFPEPNYGVKMENHEGLTVASFSTETARQVWKILLRLKGSSQCGVSTENNGGPWWPPVVVGDGEEAWDIGNGFGRRKEKENGVFPRLHEIQRLKHSNAYALGKRSVSHTPEDISQIATIRLWKSVL

SEQ ID NO: 160593 - protein, 379 aa, Glycine max
  Coding DNA Sequence Number=SeqID_68908
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=39%, E-value=0.0, Identity=87%"; Hit description=DNA -directed RNA polymerase subunit beta
  Pfam annotation: Domain name=RNA_pol_Rpb2_6; Domain location=1-316; Score=482.0; E_value=7.3e-142; Accession=PF00562.19; Description=RNA polymerase Rpb2, domain 6
  Pfam annotation: Domain name=RNA_pol_Rpb2_7; Domain location=318-379; Score=88.4; E_value=2.4e-23; Accession=PF04560.11; Description=RNA polymerase Rpb2, domain 7
  Pfam module annotation: Pfam domain module=RNA_pol_Rpb2_6::RNA_pol _Rpb2_7; Domain location=1-316::318-379
MHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLL

SEQ ID NO: 160594 - protein, 115 aa, Glycine max
  Coding DNA Sequence Number=SeqID_68909
MFWGETFYLRGSSEDRPPKQSRVRGHLVKINADSLNTFLETPVVLAEGETLPAYFRYYRLPTDFREIEAALCIPGRGFILNSEGHPRKILKKDLTTLAQVWRPKGLSLTALPLST

SEQ ID NO: 160595 - protein, 67 aa, Glycine max
  Coding DNA Sequence Number=SeqID_68910
MDNHQHGNHSDPAQARIKKKANILDSSEDESSESTQGSDSVSSPENQNCMSSTNEPAINRERKNYYS

SEQ ID NO: 160596 - protein, 229 aa, Glycine max
  Coding DNA Sequence Number=SeqID_68911
QSGAIEQPKAYAANIYNRPPQPQQQNQPQQNNYDLSSNRYNPGWRNHPNLRWSNPSQQQQQQPYFQNAASPSRPYVPPPIQQQQQPQKQQTVKAPPQPSLEELVRQMTMQNMQFQQETRASIQSLTNQMGQLATQLNQQQSQNSDRLPLQSVQNPKNVSAIALRSGKQCESKEKQHIPPPFPPRAISNKKMEETEKEILETFRKVESCALITGSLKEVKELAWAEMSPH

SEQ ID NO: 160597 - protein, 105 aa, Glycine max
  Coding DNA Sequence Number=SeqID_68912
MKASGNRLPRGCNRLPGLEMKRNGSLVIDYQIVMAAQLIHDRVEMECLEGVWETLEGNTRCRFRGTIRFTATSLVHPDEPVRTLQRTVEWILPTPTPYHLVEPVQ

SEQ ID NO: 160598 - protein, 117 aa, Glycine max
  Coding DNA Sequence Number=SeqID_68913
MELASLFRSWRGSIIMPIGGADIEEEEPTDLRANPLQGGGDDAILPRKGPVTRAMSKRLQEDWARVDKEGLRLSSSFSRKLLKELLKEVFSKKLLKEVFLRKLLKEVFLRKLLKEAT

SEQ ID NO: 160599 - protein, 131 aa, Glycine max
  Coding DNA Sequence Number=SeqID_68914
MVIATMVVVVVVTSNDDNSHVGGGHVDDHYDKNVHDSNGCNIPKRGFVFYVGAAIDTGGKPTSGQARQKWVPPFLLAGHAYVGSPAFGAGGIGAKKTRLWSWRDRGLFMAGHITAGPMAYDDALTWHTQTH

SEQ ID NO: 160600 - protein, 169 aa, Glycine max
  Coding DNA Sequence Number=SeqID_68915
  Subcellular localization annotation: CTP_CleavageSite=41; ConfidenceScore=5.43e-01
MAESSKKRKGTSSTTAAASHRRHGPSKAPTALIHPSLSSPRSSTLFSLDDQRLWYNSQFPSRIILDPKYLDTDFFNDETFDCYQVFQNSGLVDFMSLKLPYYPELVKIFYSNLKIQDGIISSEVHGISMIIDQSLFFSLTILPSQGAPFEGTIVDDWKFDYSSHDACRM

SEQ ID NO: 160601 - protein, 148 aa, Glycine max
  Coding DNA Sequence Number=SeqID_68916
  Gene Ontology: Biological process=transposition, DNA-mediated
  Homolog annotation: Hit_ID=Q1J7G7; Match level="QueryCoverage=27%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINSSWAETSIVTWIAHIMATGSP

SEQ ID NO: 160602 - protein, 360 aa, Glycine max
  Coding DNA Sequence Number=SeqID_68917
MANGESGARADLDDHRGDGVRDPGVAGGCPRHPYRCAVVGSGAALLAARRDGGRLGTRPRPSRGAVACGPGRARLSGDLGYRHHDPRAVHWLVPVLLPRPAAGERPDGVRGVVGDRARDVRRRRHGPRAHQQDAAARAPGQRCRGDHRCAPDACGGARGRKGLSDVEGERCEGGLDRLVLRELRELDGCRCTDDTDEDVLPGRRAQVDPGGDRHVGADGVPDRLVVLPERFVPPQPDRLDGAHAERGDRATVGERQRRVELDAAVLEHTERHGHDDAVERERLAGTQAHTHAGVVVGEARDGGVEPDGDAVQRLLHERGEVAGGRCRVARGQRWREPAGELVGSGARPRGEDREQGCRVR

SEQ ID NO: 160603 - protein, 303 aa, Glycine max
  Coding DNA Sequence Number=SeqID_68918
MIINQSLFFSLTKLPSQGAPFEGTIVDDWKFDYSNHDARRMIDWAHLVRYRMHKALWANAPLPYPQLVTLFLRHFQIPLDDEPFVQVKRSFAIGAGAVTSFGYRKDRNGQWLKKDALPPQDERTPSPPPQRDDSFTLLTEVLSKLRGLCTYVGERFDSLDGCFEGMDTRITQLEEDELNCYHQKGGDCRSKDFAFDVLMMPYDREVLMPYKNAFLKFNSRQKSKNTRYNIKKISSVLGREFQIQTAKGIKRPRSLVVKKYEHKVMQSYPARALDRKLQVDWARDAREGPRVLMSLRVDFGPMG

SEQ ID NO: 160604 - protein, 184 aa, Glycine max
  Coding DNA Sequence Number=SeqID_68919
  Homolog annotation: Hit_ID=Q2HW90; Match level="QueryCoverage=96%, HitCoverage=35%, E-value=2e-20, Identity=32%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVFLAYHNHKECPVVAMLADLYDTFDRRCEESNARIVCCTPALYVGLVSHLFLQE

SEQ ID NO: 160605 - protein, 122 aa, Glycine max
  Coding DNA Sequence Number=SeqID_68920
PAHPGNGSAGGRVQRLEEHRTSRGVRQGKSAKWIRNLGKRIGSEGWARGAGRRVPVGGRIGNGPFGASSPGVEQSTQNCALNVKVKKFNQARVNGGSNYDSLKRNHSQGNGLGGISGERRPC

SEQ ID NO: 160606 - protein, 255 aa, Glycine max
  Coding DNA Sequence Number=SeqID_68921
  Gene Ontology: Mol. function=2-dehydro-3-deoxyglucarate aldolase activity; Cellular component=mitochondrion; Biological process =aromatic compound metabolic process
  Homolog annotation: Hit_ID=P23522; Match level="QueryCoverage=99%, HitCoverage=99%, E-value=1e-114, Identity=81%"; Hit description=2 -dehydro-3-deoxyglucarate aldolase
  Pfam annotation: Domain name=HpcH_HpaI; Domain location=19-245; Score= 343.6; E_value=3.4e-100; Accession=PF03328.5; Description=HpcHHpaI aldolase family
MSNAWPNPFRRRLLAGETLIGSWCALANPLTTEVLGLAGFDWLVLDGEHAPNDITTFIPQLMALKGSPSAPVVRPPCNEPIIIKRLLDIGFYNFLIPFVETAEQAALAVASTRYPPEGIRGVSVSHRANMFGTVPDYFVQSNSNITILVQIESQQGVDNVDAIAATHGVDGIFVGPSDLAAALGHLGNAGHPDVQRAIQHIFARASAHGKPSGILAPVEADARRYLEWGATFVAVGSDLGVFRSATQKLADAFKK

SEQ ID NO: 160607 - protein, 41 aa, Glycine max
  Coding DNA Sequence Number=SeqID_68922
MMLSYNLRQGRWRLQFTSSGFKSFNQKQAQHGCKGFIIHEQ

SEQ ID NO: 160608 - protein, 245 aa, Glycine max
  Coding DNA Sequence Number=SeqID_68923
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160609 - protein, 101 aa, Glycine max
  Coding DNA Sequence Number=SeqID_68924
  Gene Ontology: Mol. function=RNA-directed DNA polymerase activity
  Homolog annotation: Hit_ID=Q2HSQ4; Match level="QueryCoverage=64%, HitCoverage=69%, E-value=3e-12, Identity=54%"; Hit description=RNA -directed DNA polymerase ; Zinc finger, CCHC-type; Peptidase aspartic, catalytic, putative
MARFLNGLYKDIQDVVELQNYDNMDELIHRAVKVEQQLKRKQTNKKTSYTYSSWKDKDTSKKEETIFMMMNHVNSSSFDDDKKPKRMISRLSQQVQVQDQD

SEQ ID NO: 160610 - protein, 282 aa, Glycine max
  Coding DNA Sequence Number=SeqID_68925
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSYSNNALNKIAEPYDQHDVNSPTYSNEEPSSTTPLVVQMRRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160611 - protein, 173 aa, Glycine max
  Coding DNA Sequence Number=SeqID_68926
MAPRKLASKRSRKDKAVEGTSSAPEYDSHRFRSAELQQCFEAIKGWSFLRERRVQLRDDEYTNFQEEIGRRRWASLVTPMAKFDPDIVLEFYANAWPTEEGVRDMRSWVRGQWIPFDADVIGQLLGYPLVLEEGQECEYGQRRNQSDGFDEEAIAQLLCISGQDFARTAAGRR

SEQ ID NO: 160612 - protein, 160 aa, Glycine max
  Coding DNA Sequence Number=SeqID_68927
  Homolog annotation: Hit_ID=A5AK77; Match level="QueryCoverage=55%, HitCoverage=11%, E-value=3e-09, Identity=37%"; Hit description =Putative uncharacterized protein
MTRGNPGDLQPFDPKIDRTFHRLVKHSVHPNHFVHFEHSEYSVAGDSEYSDFEHSTTNFHIESMAQPPPRERTLREMVAPDFTYESLCIQYLDEGVPYVLKTGLIHLLPKFHGLAGEDPHKHLKEFHIVCSTMKPPDVQEDHIFQKAFPHSLEGVAKDWI

SEQ ID NO: 160613 - protein, 76 aa, Glycine max
  Coding DNA Sequence Number=SeqID_68928
MRNWKTTLMKTTAVECLERFVSAICTIFGNEYLRRSNNEDIKRLLQMGTARRFPADDIYPDFAMSVKTISMPQEEK

SEQ ID NO: 160614 - protein, 94 aa, Glycine max
  Coding DNA Sequence Number=SeqID_68929
LCTRLALSSNLLTCAKCEGGAKCNIAVATYPSVGWRCEGSRVHLPREEGARSRHQRLFEENVGKTRKGVSLAPTYPQLRIGNQTYIVLLELNIG

SEQ ID NO: 160615 - protein, 57 aa, Glycine max
  Coding DNA Sequence Number=SeqID_68930
MAEGKQRYKMGVAAAFGGGEEGTTAWIGSTVYTGKPNLPCKFQFRTWITKDIFGNTR

SEQ ID NO: 160616 - protein, 718 aa, Glycine max
  Coding DNA Sequence Number=SeqID_68931
  Gene Ontology: Mol. function=aspartic-type endopeptidase activity; Cellular component=extracellular region; Biological process =proteolysis
  Homolog annotation: Hit_ID=A5AKV9; Match level="QueryCoverage=59%, HitCoverage=89%, E-value=1e-163, Identity=66%"; Hit description =Putative uncharacterized protein
  Pfam annotation: Domain name=Asp; Domain location=129-470; Score= -42.0; E_value=4.1e-11; Accession=PF00026.14; Description=Eukaryotic aspartyl protease
MEEKLKYPCLSSLLTLFLCISATSTNPHNSQTQTLLLHTLPDPPTLSWPESATVEPDPEPTTSLSLHHIDALSFNKTPSQLFHLRLERDAARVKTLTHLAAATNKTRPANPGSGFSSSVVSGLSQGSGEYFTRLGVGTPPKYLYMVLDTGSDVVWLQCKPCTKCYSQTDQIFDPSKSKSFAGIPCYSPLCRRLDSPGCSLKNNLCQYQVSYGDGSFTFGDFSTETLTFRRAAVPRVAIGCGHDNEGLFVGAAGLLGLGRGGLSFPTQTGTRFNNKFSYCLTDRTASAKPSSIVFGDSAVSRTARFTPLVKNPKLDTFYYVELLGISVGGAPVRGISASFFRLDSTGNGGVIIDSGTSVTRLTRPAYVSLRDAFRVGASHLKRAPEFSLFDTCYDLSGLSEVKVPTVVLHFRGADVSLPAANYLVPVDNSGSFCFAFAGTMSGLSIIGNIQQQGFRVVFDLAGSRVGFAPRGCATLSSCLGFGGLTAAISAKQDSNRRNSLRKKLLLDLKVNPNQIPNDPFSVSGNGVEESGVGVQGVDNVVEVEKPKSKLLRESVLWNKLGNWADQYKRDVEYWGVGSGRIFTVYEDSIGGIKRVVVDEDPILKRSKGGFVKAVQGFVAKPRLLPRLSELGRKVLYVLVVVWMVKKLFVAFGEGDKEGTVEVVVEPWETPAVDIKKQLDKEQLRNSILKVKDSVYKSVVHDSSDKVKTRFTEMDYKVQ

SEQ ID NO: 160617 - protein, 626 aa, Glycine max
  Coding DNA Sequence Number=SeqID_68932
  Gene Ontology: Mol. function=nucleotide binding; Cellular component =cytoskeleton; Biological process=cell division
  Homolog annotation: Hit_ID=A7QU90; Match level="QueryCoverage=100%, HitCoverage=100%, E-value=0.0, Identity=76%"; Hit description =Chromosome chr2 scaffold_176, whole genome shotgun sequence
  Pfam annotation: Domain name=Dynamin_M; Domain location=255-524; Score=291.5; E_value=1.7e-84; Accession=PF01031.11; Description =Dynamin central region
  Pfam annotation: Domain name=Dynamin_N; Domain location=37-246; Score= 254.1; E_value=3e-73; Accession=PF00350.14; Description=Dynamin family
  Pfam annotation: Domain name=GED; Domain location=529-622; Score =126.8; E_value=6.1e-35; Accession=PF02212.9; Description=Dynamin GTPase effector domain
  Pfam annotation: Domain name=MMR_HSR1; Domain location=35-247; Score=- 13.3; E_value=0.018; Accession=PF01926.14; Description=GTPase of unknown function
  Pfam module annotation: Pfam domain module=Dynamin_M::Dynamin _N::GED::MMR_HSR1; Domain location=255-524::37-246::529-622::35-247
MENLIQLVNKIQQACTALGDHGEEGAMPTLWDALPSIAVVGGQSSGKSSVLESVVGKDFLPRGSGIVTRRPLVLQLHKIDEGREYAEFMHLPRKKFTDFAAVRQEIADETDRETGRNKGISSVPIHLSIYSPHVVNLTLVDLPGLTKVAVDGQPDSIVQDIENMVRAFIEKMYELQWWKLNFLSMSLNPNCIILAISPANQDLATSDAIKISREVDPKGKVKLKVRKMLKIQNLEGERTFGVLTKIDLMDKGTDAAEILEGKSYKLNFPWIGVVNRSQADINKQVDMIAARKREMEYFANTPEYRHLASRMGSVHLGKVLSKHLESVIKSRIPGLQSLINKTIIELETELNRIGKPIAADTGGKLYMIMEICRTFDQIFKDHLDGIRPGGEKIYQVFDNQFPASIKRLQFDKHLSIDKVRKLITEADGYQPHLIAPEQGYRRLIESCLVSIRGPAEAAVDAELKQYPTLRVELGSAAVDSLERMREESKKSTLLLVDMEYGYLTVDFFRKLPQDAEKGGNPTHSLFDRYNDSYLRRIATTVLSYVNMVCGTLRHTIPKSVVYCQVREAKRSLLDHFFTELGKKEGKQLASLLNEDPAIMQRRTSLAKRLELYRNAQSEIEAVAWER

SEQ ID NO: 160618 - protein, 230 aa, Glycine max
  Coding DNA Sequence Number=SeqID_68933
MESGTWLRSSLLVTFCTVRLRREAERSGTWPERALFCNLNVRRHSEDIFVKISTLKSLRERYSSSRLVQFKRGEMVSLKRFLWRLRKRSVKDVIKAGTTLVAAEQTVWIEAEQNTPPTVAAAAAIPMCVVPAQTFYYSHHFHAELQEEEEEKRIDIEKEVGAAHSGYFRPETQHPLPSVHNPSHQATNHYYTPPHPAAKTTAPQTSPITFHCNTPNESHRNEKDLEDVHV

SEQ ID NO: 160619 - protein, 696 aa, Glycine max
  Coding DNA Sequence Number=SeqID_68934
  Gene Ontology: Mol. function=histone-lysine N-methyltransferase activity; Cellular component=nucleus; Biological process=DNA mediated transformation
  Homolog annotation: Hit_ID=A7PZX4; Match level="QueryCoverage=100%, HitCoverage=70%, E-value=0.0, Identity=59%"; Hit description =Chromosome chr15 scaffold_40, whole genome shotgun sequence
  Pfam annotation: Domain name=PHD; Domain location=112-166; Score =39.3; E_value=1.4e-08; Accession=PF00628.20; Description=PHD-finger
  Pfam annotation: Domain name=SET; Domain location=543-678; Score =154.8; E_value=2.3e-43; Accession=PF00856.19; Description=SET domain
  Pfam module annotation: Pfam domain module=PHD::SET; Domain location =112-166::543-678
MDRFQGQTRLYKSKPSDFRMALEEAMLAEDGVLESHLGREELTGVDAHPDGLMEATVSYVDGECYGQDQDTRCCAGCGLMFPCKTMKKIKDSNGAPQFCCKYCSKLRKSKQYCGICKRIWHHSDGGNWVCCDGCNVWVHAECDKISSKVFKDLENTDYYCPDCKGKFNCKLPASQTYKSNIELIENSQKSMIPEKVLVVCNGMEGFYIPKLHLVMCKCGSCGSRKQTLSEWEKHTGCRSKKWKHSVKVKSTMLPLEKWMEENIPLDGIPEQLDQQQVLAFLQEKYEPVNVKWTTERCAVCRWVEDWEDNKIIICNRILELLVFYFKFYEALKMPNSSPPRMLWGKECSGFYFLGGALKPTDVEMLWVHVTCAWFRPQVVFQNHEAMEPAMGILKIPPNSFVKTCVICKQSHGSCISCCKCSTYFHVMCASRAGYTMELHSMEKNGTQVTRKLIYCAIHRVPNPDSVLVVHTPLGIFSPRTSLQNQKGCFRGSRLILSKNIELNESSTTENDLVEPLSAARCRVYRRSPNKDADESKVFTSFKERLHHLWETEKFRVCFGKSGIHGWGLFARRDIQEGEMVVEYRGVHVRRSVADLREEKYRSEGKDCYLFKISEEVVVDATNRGNIARLINHSCMPNCYARIMSLGDQGSRIVLIAKTNVSAGEELTYDYLFDPDERDELKVPCLCKAPNCRRFMN

SEQ ID NO: 160620 - protein, 242 aa, Glycine max
  Coding DNA Sequence Number=SeqID_68935
  Homolog annotation: Hit_ID=A7PZU9; Match level="QueryCoverage=87%, HitCoverage=56%, E-value=1e-89, Identity=76%"; Hit description =Chromosome chr15 scaffold_40, whole genome shotgun sequence
  Pfam annotation: Domain name=A_thal_3526; Domain location=89-144; Score=96.7; E_value=7.5e-26; Accession=PF09713.1; Description=Plant protein 1589 of unknown functio
MEVLHGGIYLNKFGVKVYYFIKGSDIILFSKLTVVETSEELQSSTQASHEPKSEQPNNHTTDAPVTDTGSASATSNDSKKVSRQDIEFVQNLIERCLQLYMNKDEVVKTLLTRAKIDPGFTTLGRHLKKLEEENADFFRAYYIRLKLKKQILLFNHLLEHQYHLMKCPMPAKVPLAPIQNGIHPMPVNNLPMGYPVLQQPPMPATGQPHIDSMGCGLSSCHVVNGVPASGNFHPIRMNSGNE

SEQ ID NO: 160621 - protein, 814 aa, Glycine max
  Coding DNA Sequence Number=SeqID_68936
  Gene Ontology: Mol. function=ATP-dependent helicase activity; Cellular component=mitochondrial matrix; Biological process =regulation of translation
  Homolog annotation: Hit_ID=A7PZU7; Match level="QueryCoverage=83%, HitCoverage=95%, E-value=0.0, Identity=66%"; Hit description =Chromosome chr15 scaffold_40, whole genome shotgun sequence
  Pfam annotation: Domain name=DEAD; Domain location=369-548; Score =214.6; E_value=2.3e-61; Accession=PF00270.20; Description=DEADDEAH box helicase
  Pfam annotation: Domain name=Helicase_C; Domain location=622-698; Score=94.9; E_value=2.6e-25; Accession=PF00271.22; Description =Helicase conserved C-terminal domain
  Pfam annotation: Domain name=ResIII; Domain location=365-543; Score= -23.7; E_value=0.0047; Accession=PF04851.6; Description=Type III restriction enzyme, res subunit
  Pfam module annotation: Pfam domain module=DEAD::Helicase_C::ResIII; Domain location=369-548::622-698::365-543
MPPSKGVIPPMHTPHLHQRSVVEGPWHTSTRMAPQRSEEQSPAVEDTLLLFGTRITIAFFINNMASSINVVIVLGQRTTTQEGGLVLSRRYMIHIGSEQTLTLFFAVAVAAMPTKLFSQLHLLHPLLPMKPRTLPLLSRPFFFPSSKFLRTSPFKVRAFSSREKVPLRPSKSLIDDEADLSNWVDELRSGGPDEMRSGRGNEVRTGRRDRFADSGRFSRDDREREFRPPRNNNRASALGKRRGEDLRKGGQSVGSRRKFQPRSDDDDNEVMNGRKLKGGGVGAFPSEDEDEDEDEESEGSEEEEILNKSRTALFGQQNVLNRRNTEPTPRPSSPGGGSDSYLSETRFDQCSISPLSLKGVKDAGYEKMTVVQEATLPVILKGKDVLAKAKTGTGKTVAFLLPSIEVVAKSPPSDRDHRRPPIAVLVICPTRELASQAAAEATKLLKYHPTIGVQVVIGGTRLALEQKRMQANPCQILVATPGRLRDHTENTAGFATRLMGVKVLVLDEADHLLDMGFRKDIEKIIAAVPKQRQTLMFSATVPEEVRQVCHIALRRDHEFINTVQEGTEETHSQVCQTHLVAPLDKHFSLLYVLLKDHIADDVDYKVLVFCTTAMVTRLVAELLGELNLNVREIHSRKPQSYRTRVSEEFRKSKGLILVTSDVSARGVDYPDVTLVIQVGLPADREQYIHRLGRTGRRGKEGQGILLLAPWEDFFLSTVKDLPIEKAPVVPSVDPDTKKKVEKALSNVEMKNKEAAYQAWLGYYNSNKKVGRDKYRLVELANEFSRSMGLDNPPAIPKLVLGKMGLRNIPGLRAK

SEQ ID NO: 160622 - protein, 95 aa, Glycine max
  Coding DNA Sequence Number=SeqID_68937
  Gene Ontology: Mol. function=hydrolase activity, acting on ester bonds; Cellular component=anchored to membrane
  Homolog annotation: Hit_ID=A7P9W2; Match level="QueryCoverage=70%, HitCoverage=97%, E-value=2e-25, Identity=79%"; Hit description =Chromosome chr14 scaffold_9, whole genome shotgun sequence
MADWGPVFVSVVLFILLTPGLLIQIPGKGKMVEFGNFQTSGVSILVHSILYFALVCIFLMAIGVHMYTAHLSSKTSWSVDFTGSVFCSNGSDICY

SEQ ID NO: 160623 - protein, 101 aa, Glycine max
  Coding DNA Sequence Number=SeqID_68938
MTTTTTMRVAQQESFWGVSSLNKVGQESLHCRFRFICEKEEPERENQRKKMIYRKWSLLTGPVAILGGVVVAIAAANVIFVKNDPFLKPEERKYENEPATK

SEQ ID NO: 160624 - protein, 572 aa, Glycine max
  Coding DNA Sequence Number=SeqID_68939
  Gene Ontology: Mol. function=ligase activity; Cellular component =cytoplasm; Biological process=response to auxin stimulus
  Homolog annotation: Hit_ID=A5AXT7; Match level="QueryCoverage=99%, HitCoverage=99%, E-value=0.0, Identity=69%"; Hit description =Putative uncharacterized protein
  Pfam annotation: Domain name=GH3; Domain location=12-557; Score =871.5; E_value=4.2e-259; Accession=PF03321.4; Description=GH3 auxin -responsive promoter
MLEKVEEFNTERMMEEFERVTKDAERIQRETLKRILEDNASAEYLLNLGLNGRTDPESFKAFVPLVTHKDLEPYINRIIDGDFSSVLTGKPITTMSLRYITPLLPSETASWNWQMTPIPLCREFPINNGKALGFIYSSKQFKTKGGVLAGTATTNVFRNPGFQHAMKAIQSPLCSPDEVIFGPDFHQSLYCHLLCGLIFREEVQLVSSIFAHSIVYAFRTFEQVWEELCVDIKEGVLNSKVTVPSIREAMSKLLKPDPELANLIHNKCMGLSNWYGLIPELFPNVKYVHGIMTGSMEPYLRKLRHYAGELPLLTSDYGSSEGWIGTNVKPTVPPELATYTVLPQIGYFEFIPLRELEEIKGDASFLCMEPKPVGLTEVKVGEEYEIVITNPAGLYRYRLGDVVKVMGFHNSAPEIKFVRRSNLLLSINIDKNTEKDLQLAVESASQLLAEEKLEVVDYTSHIDLSKEPGHYVIFWEISGEASEEVLGGCCNCLDKSFVDAGYTSSRKVNCIGALELRVVRRGTFQKILEHSLALGAAVSQFKTSRCVGPTNTKVLQILNENVVKNYLSTAFN

SEQ ID NO: 160625 - protein, 1298 aa, Glycine max
  Coding DNA Sequence Number=SeqID_68940
  Gene Ontology: Mol. function=glycylpeptide N-tetradecanoyltransferase activity; Cellular component=extrinsic to membrane; Biological process=early endosome to late endosome transport
  Homolog annotation: Hit_ID=A7QWF6; Match level="QueryCoverage=99%, HitCoverage=48%, E-value=0.0, Identity=55%"; Hit description =Chromosome undetermined scaffold_203, whole genome shotgun sequence
  Pfam annotation: Domain name=WD40; Domain location=1015-1052; Score =10.5; E_value=1.6; Accession=PF00400.23; Description=WD domain, G -beta repeat
  Pfam annotation: Domain name=WD40; Domain location=1109-1154; Score =3.8; E_value=11; Accession=PF00400.23; Description=WD domain, G-beta repeat
  Pfam annotation: Domain name=WD40; Domain location=1190-1228; Score =32.5; E_value=1.5e-06; Accession=PF00400.23; Description=WD domain, G-beta repeat
  Pfam annotation: Domain name=WD40; Domain location=1250-1286; Score =2.7; E_value=15; Accession=PF00400.23; Description=WD domain, G-beta repeat
  Pfam annotation: Domain name=WD40; Domain location=964-1000; Score =5.9; E_value=6; Accession=PF00400.23; Description=WD domain, G-beta repeat
  Pfam module annotation: Pfam domain module=WD40::WD40::WD40::WD40::WD4 0; Domain location=1015-1052::1109-1154::1190-1228::1250-1286::964 -1000
MEKLARAQYLKNKNPKDCALLYIALNRVQVLAGLFKISKDEKDKPLVGFLSRNFQDEKNKAAALKNAYVLLGKHQLELAIAFFLLGGDHSSAINICAKNLGDEQLALVICRLVEGHGGPLEHHLITKYILPFAIDKGDYWLASLLEWEMGNYYQSFYRMLEFSVNPVPRESTVMSNCGPFLDPTVGFYCQMLATKNSMRNAVGEQNSAILLRWATLMTVAALKRCGNPLEALEYFSSSLSMPGTADQESELGDSHDVLSSTLKPLPRKCSNWLSANMSVHLEFHIKLNLALCYLSKLIKEHPSWLDTFAEYNGEASDSDEYMMQYEKSVESFKQKLYTGLALFERRFLLAPRCLISMILLLLCHHGSLYIGYDMTDGYTQAELSQKKSNIFDDFNLYYSRIKPLFKTAEEVSFFYSRFFCACSMENSQQNSSIDSKPKFLDAFQCCFEGVLISLWFLRANFRIQLSSICKDLVKTHLDILDLYEYYLHFSLAWLQKNSEALLYMLEPFLVAQSNDRNPYNIDIVNLKKLIPKIGQLLAQTSFMSNIQNLQLSERAEDKLVADIKHSIPDDERWKIIGTCLWQHMSRFMIFNLNLVLAKLEDGKLSGPFHRKYTYGESYLINMDSESISLPEKIRLVLFSLCDLLMTTVTHISSYHVKQQAEFLWQKVGNDLNVMTLQWLKQKSEFSQNQNLDILELGNMKDNYSVNQLLWDRCADPKLISDCFAQEKLNWPNDLDQMNTKGWNDLSIIMTGLHKTDDTCGDGCKLSTRSSNHEVGTPVKGTSLSGNASARSNQKDITYTNFAVFQSPREMYKRNGELLEALCINSTNQREAAVAGNRKGSVLSFLLWVGIECGAKKGIMFFHWEDEIPFSGKSDDLLWATADWPQNGWAGSESTPAPTCVSPGVGLGSKKGAHLGLGGATIGVDSSAWPSNDLTGGGVLGMLGYTGIGASGLGWEIQQDFEDFVDPLATLENISTRALSSHPMRPFFLVGSSNTHIYLWEFNKDKATATYGVLPAANVPPPYALASISALQFDHFGHRFASAALDGTVCTWQLEVGGRSNVRPTESSLCFNGHASDVTYFSSSGSIIAVAGYSSNGVNVVIWDTLAPPTTSRASILCHEGGAHTVSVFDNHVGSGSVSPLIVTGGKGGDVGLHDFRYIATGKAKRHKRADNIGQSSVSSLTRDKDQNVDGMLWYIPKAHSGSVTKVVTIPNTSLFLTGSTDGDVKLWDAQSTKLIHHWSKIHEKHTFLQPSSRGFGGVVRAAVTDIQVVPHGFLSCGGDGIVKLVRLDNHLRAHGIEL

SEQ ID NO: 160626 - protein, 111 aa, Glycine max
  Coding DNA Sequence Number=SeqID_68941
MIHGTDRKEFQPTSARKDDRSRSARFFRACSTEVLYQPTPPLFHLLGKENICPPREMMRIMKQAKYSLKAIMRIMKQAKYSLKAQVEKDEGPSGEGQSPRVEKDEGPSGEG

SEQ ID NO: 160627 - protein, 1096 aa, Glycine max
  Coding DNA Sequence Number=SeqID_68942
  Gene Ontology: Mol. function=monooxygenase activity; Cellular component=outer membrane-bounded periplasmic space; Biological process=transport
  Homolog annotation: Hit_ID=A4WAN5; Match level="QueryCoverage=35%, HitCoverage=89%, E-value=1e-180, Identity=79%"; Hit description =Putative uncharacterized protein
  Pfam annotation: Domain name=Acetyltransf_1; Domain location=981 -1060; Score=63.5; E_value=7.2e-16; Accession=PF00583.15; Description= Acetyltransferase (GNAT) family
  Pfam annotation: Domain name=Peptidase_M20; Domain location=2-172; Score=-12.4; E_value=0.0094; Accession=PF01546.19; Description =Peptidase family M20M25M40
  Pfam annotation: Domain name=SBP_bac_3; Domain location=691-920; Score=111.2; E_value=3.1e-30; Accession=PF00497.11; Description =Bacterial extracellular solute-binding proteins, family 3
  Pfam module annotation: Pfam domain module=Acetyltransf_1::Peptidase _M20::SBP_bac_3; Domain location=981-1060::2-172::691-920
IVVASQIIQALQSLTSRSFNTLDSLVLSVTRIDAHRHDGQQTAEAEFGGTVRTHDKQVRAQLEQRAREVVVNIAAASGATATFSWHPGPPVLENDAHWAQFASQVAQQVGYQVQQAELHLGGEDFAYYLQQLPGAFVSIGSASEFGLHHGGFNPDEALIAPAAHYFSQLAQQALQQLNARSLYGDKAIAGRLRHEQRETIMTARQLRLGTILHGASGNMSAWRHPAAQADASISFDYARRIARKAEAGKLDFLFVADGLFINEKSIPHFLNRFEPLTLLSALAGVTEHLGLVGTVSTSYSEPFTVARQFASLDHLSGGRAGWNVVTSPLEGSAKNFSRQQHPEHALRYRIADEYLQVVKGLWDSWEEGAFVRNKASGQFYAPDKLHTLNHHGDFFQVQGPLNIERTPQGRPIIFQAGASEDGRKLAARHADAIFTHQPTREEAQAFYRDVKQQLVANGREPGDLHIFQGVSVIVGENDADVERQYQTTAALVSIEDALNYLGRFFDHHDFSQYPLDQPFPDIGDIGQNSFRSTTDEIKRKAREHGHTLRQAALEAATPRPLFHGTPQQVADGLQLWFETEATDGDSGSPGARPDASRIPGQHAARQLWSETTAQPVHTTITMRKHAMQKKSLIVLLLLSLSSAALAEDVAVNGQQVSLAANKTPINTPENPAAVAQIPAGHKFAVPGSFTVAVAALNSPPLTVFSDDNKTLLGSEVDIARLVADSLGLKLNIVPTSWEDWPLGVASGKYDAAITNVTVTKDRKQRFDFATYRKDSLGFYVKTSSPITSLSKAEDIAGLRIIVGSGTNQEAILLAWDKENQAKGLKPFTPVYTKDDAAQTLALQAGRADAYFGPNVIGAWKAALTKKTRLVGSVDGGWPKAAHIAVTVKKDNGLVQPINTALNGVIKNGDYDKVLNRWGEGVERLDRMSQQFFREVSPEAPELQPILDGLFGEYAARYGDFFRKHNEVELTEWYLPPRGLFIVLERDGEIIAMGAYKPWDATTAELKRIWTRRDLRRQGLALLILQELERRALRAGYQRVFLTTGFRQPEAVQLYIGHGYQPQFELREDMEIYGQPPHDGRLRFLKVIDVHNVAQAS

SEQ ID NO: 160628 - protein, 89 aa, Glycine max
  Coding DNA Sequence Number=SeqID_68943
MEVIMEKDFQMHFNFCTTGTSNYQREGLTAPFSDSEIRDAIWKPLINKFKAKLSKWNQKYLSMGGKILARFLAGTGRQPSAEVQSIICD

SEQ ID NO: 160629 - protein, 74 aa, Glycine max
  Coding DNA Sequence Number=SeqID_68944
MGRGDQILFSEDGWAEDGIPLKDQFPERQKLMISGWKILIWLSQKFCSICRAAVFRFTKKMSGSGKQTLLDNIR

SEQ ID NO: 160630 - protein, 175 aa, Glycine max
  Coding DNA Sequence Number=SeqID_68945
  Homolog annotation: Hit_ID=Q6UUU1; Match level="QueryCoverage=49%, HitCoverage=55%, E-value=1e-18, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGVSLEVMRRLKAKLKGQVLVTALLPSQLPSVPK

SEQ ID NO: 160631 - protein, 160 aa, Glycine max
  Coding DNA Sequence Number=SeqID_68946
  Homolog annotation: Hit_ID=A5BEV8; Match level="QueryCoverage=72%, HitCoverage=15%, E-value=3e-10, Identity=34%"; Hit description =Putative uncharacterized protein
MGAKHLARTKERSHVIKQRSPDEIRRLSFLDQGLSEPQVTITEEMKTISKRFEELDVCHKSSASSPDQAIPRRTMPMLDQFHSFIHDFIENIMDVKADGNCEYRAIAALLGMGEDSWSLVRNHLLKELAKWSYEYVNLFGDLDRFEELKRSLLIDGLSMN

SEQ ID NO: 160632 - protein, 32 aa, Glycine max
  Coding DNA Sequence Number=SeqID_68947
MYTLILSNNLSYPNFVRGPLLDDMRPFFGPCK

SEQ ID NO: 160633 - protein, 117 aa, Glycine max
  Coding DNA Sequence Number=SeqID_68948
  Subcellular localization annotation: CTP_CleavageSite=52; ConfidenceScore=5.67e-01
MATSLASPPPPPPPPTVASASPSTLKRTRKATRLRSLATRPPGAERPVEHVDLATGKANGPHKKKLRTYLGIVAPDKDSVDDTVCEKYDISKEKWTQFCQTRRDPSWEDVRKKAQAI

SEQ ID NO: 160634 - protein, 172 aa, Glycine max
  Coding DNA Sequence Number=SeqID_68949
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=95%, HitCoverage=18%, E-value=3e-09, Identity=32%"; Hit description =Gag/pol polyprotein, 3'-partial, putative
  Pfam annotation: Domain name=G-patch; Domain location=38-82; Score =13.1; E_value=0.005; Accession=PF01585.14; Description=G-patch domain
MPYVKAAEELLEMTFQSFEVVSIASVDSLPRQPRLSGVAMMVAWVMLGHGYEPEMGLGKNNGGRAGLVKVRGNHGKFGLSYKPTQVDVRKNISERKNKGQSPRSGQQAKEVPPCHISRIFASVGLRCKGQVAAICDEDSSRGSDLVQPCLPSFQLGNWRVEERPEVYTTSIM

SEQ ID NO: 160635 - protein, 57 aa, Glycine max
  Coding DNA Sequence Number=SeqID_68950
MAEKTKKKLEEAAQFGTTDGVIDPPSPIRCHMKWKMASTKKTGQMTSEAAKEILEKI

SEQ ID NO: 160636 - protein, 91 aa, Glycine max
  Coding DNA Sequence Number=SeqID_68951
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 160637 - protein, 88 aa, Glycine max
  Coding DNA Sequence Number=SeqID_68952
MARIPNKIKSIDGSKETPKLAVRNTDLWFVGTPVKSEQAQMVFVDSEGDQIHDVCKADQLKSWKANLKENSTYVMHNFKVVKNDGQFR

SEQ ID NO: 160638 - protein, 195 aa, Glycine max
  Coding DNA Sequence Number=SeqID_68953
  Pfam annotation: Domain name=G-patch; Domain location=26-70; Score =8.9; E_value=0.016; Accession=PF01585.14; Description=G-patch domain
MAFQSFEVVSCASMEPSPSLPSLSKVAIMVARVMLRNRFEPGMGLGKDCLGNADVVDIKGNPCKYGLGYEPGMPGRRNVPSRFRADRVWPGRISQCFTSAGMVSEEEGRFFEDPNNEGLTIDFDRDISQTINEEEEEDVLSPELERLVAQEEHEMKPHQEETELVNLGTTKEKKEVTVGTGMTAPIRQGLITLLE

SEQ ID NO: 160639 - protein, 195 aa, Glycine max
  Coding DNA Sequence Number=SeqID_68954
MASRKRKAPSTPTQVKFDKSRFTSQEALERYTDVIVPRKLLPERNVVVYSTEFDEFLDELARRHWDEELTDFINGNLYDPEDKSPKIPVIVEEGESLYAYSRFALLRPNPQELATKLCIPGRGFELNADGYPVKILRKNMTTLAQTWSVLSFSNFIPTSHTSDVTPDKARLIYGIIMKMDLNVGYLISHQISLIA

SEQ ID NO: 160640 - protein, 127 aa, Glycine max
  Coding DNA Sequence Number=SeqID_68955
MDKIDIFVPHPLTNASWLIQLSPECGCKPLVCLLKRPALLSVDFQDRSIKDYSSCTSLREERNANLIYIGSATSCAYGQSSSNPLEIFHSLCKTPFTKSEPRIDNPSLVFRNPLQQETHGLLIPFQK

SEQ ID NO: 160641 - protein, 254 aa, Glycine max
  Coding DNA Sequence Number=SeqID_68956
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=20%, HitCoverage=50%, E-value=1e-23, Identity=100%"; Hit description=LacZ protein
  Subcellular localization annotation: CTP_CleavageSite=63; ConfidenceScore=5.06e-01
MPISPCGSISWSVSSRHRGHAYKTPSGPEEVQQGPGGSRPQDTQWTQRSPTGSWGFQLWLRASVSSTECPSPPARSSGLLLTELSSRSIAPPGRQRARHHNSLGMASNRQQMHHRHLQSPSAHPQKGRKIPWICIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 160642 - protein, 164 aa, Glycine max
  Coding DNA Sequence Number=SeqID_68957
  Pfam annotation: Domain name=zf-CCHC; Domain location=92-109; Score =23.7; E_value=0.00039; Accession=PF00098.14; Description=Zinc knuckle
MSLATLFGKLQEHEMELQRLNQNEETDKRKRSIAPKASSSMQEEEKEEEESDDEEDFSLFVKKFHKFIKNRRIEKCHHFDNGKRSQEGCPTLKCYKCNRPDHIKAHCPTNESWPEKNEKKSHEERRSKKVYIAWDDNDSSDGSEKEINLLSKDYESDGNISQED

SEQ ID NO: 160643 - protein, 71 aa, Glycine max
  Coding DNA Sequence Number=SeqID_68958
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=28%, E-value=5e-09, Identity=93%"; Hit description=LacZ protein
MLLPSAVHVSSTFEFGVVFHDCLTHPLFATWRNSEEARTDRPSQQLRSLNGEWDAPCSGALSAAGVVIRAA

SEQ ID NO: 160644 - protein, 138 aa, Glycine max
  Coding DNA Sequence Number=SeqID_68959
  Gene Ontology: Mol. function=protein dimerization activity; Cellular component=extracellular region; Biological process=proteolysis
  Homolog annotation: Hit_ID=Q15MX7; Match level="QueryCoverage=92%, HitCoverage=30%, E-value=5e-18, Identity=39%"; Hit description =Peptidase M20 precursor
  Subcellular localization annotation: CTP_CleavageSite=58; ConfidenceScore=5.19e-01
MKPTITPLIKEFFDNIGGTMPFANRLAISNQWLLKSVLLSQLAKNNSTNALIRSTTALTMMKGSDGTNVLSPEVEFVVNFRLLSEVEEIDNTREASAISPTNVRAYKVIEQGIKEVYPNSLVTPYLTIAGTDAYKYQI

SEQ ID NO: 160645 - protein, 68 aa, Glycine max
  Coding DNA Sequence Number=SeqID_68960
MAAKRECLRQFTLTIAKFCKLFLYILSLQKFAHLASVLSLCIAYFQSQSTSDTKAEFLQLPLSGSTCR

SEQ ID NO: 160646 - protein, 128 aa, Glycine max
  Coding DNA Sequence Number=SeqID_68961
MPKKELVEELWRLQAALGEQTEITKGNHGVVIREDKNPTNPSFDATTSRFLISCILPFYISLLLFVYDVRDNIIDLVKDKWRISEVCDELCSHTIVRPFKGDKFMLDEFCNELHCGNSMSLITGSAMS

SEQ ID NO: 160647 - protein, 62 aa, Glycine max
  Coding DNA Sequence Number=SeqID_68962
MGVKHFEVVKRRSHADKQWSPDEIREGGIGVVGASDGPWWRWPVEVVMEDVPFCFFDDSAIR

SEQ ID NO: 160648 - protein, 196 aa, Glycine max
  Coding DNA Sequence Number=SeqID_68963
MTKYDPKIVMEFYANAWPTEEGVKDKRSWVRGQWIPFDEDAINQFLGHPLVLEEGQHWIMPPRHPVDPEKSNRALGFPALITGLYQFYGVPVNPTKLIRAPISRAFIEKYCMPRQVQGDIVPGVHLRSPVEVRASNAQSQNTSPFLWPTPEQFGATFAWPEDAPDFETGTGPVGAPRDDEGAQEDDDMANVLDFFT

SEQ ID NO: 160649 - protein, 371 aa, Glycine max
  Coding DNA Sequence Number=SeqID_68964
  Subcellular localization annotation: CTP_CleavageSite=41; ConfidenceScore=5.41e-01
MAESSKKRKGTSSTTATADHRRHRPSEAPTAPTHPSLSSPRSSTLFSSDDQRLQYNSQFSSRIILDPKYLDIYFFNDETFDCYQVFQNSGLVEFMSLKLPYYPELVKVFYSNLKIQDGIIHSEGTIVDDWKFDYSSHDARRMVCNDQAEMTTSEEDLILMWAFLTGRQIDWAHLVRYQMHKALRANAPLPYPQLVTLFLRHFQIPLDDEPFVQVKRSFAIGAGAITSFGYRKDRDGQWLKKDALPPQDECTPSPPPHYGASAPMLVNDSIPWMVALKAWIPASPSLKRIEARLTGASSIGGKCAESPPTFIERKTLEKPKETGHEEYSRFGVIFTFEEGISTSHVDKSGALAPTYPPSKRKSDLRSSFKRQ

SEQ ID NO: 160650 - protein, 63 aa, Glycine max
  Coding DNA Sequence Number=SeqID_68965
MGIIFLKNESRDIMDCCSMRSMLPEDPGNVNPGHEFICMYVECDFFDVDDDVDVDNNTEMRWC

SEQ ID NO: 160651 - protein, 97 aa, Glycine max
  Coding DNA Sequence Number=SeqID_68966
  Subcellular localization annotation: CTP_CleavageSite=50; ConfidenceScore=5.29e-01
MSMNDAHFSWLARASTFSSKRFLGIPITPFLFCYTQSNSCAEILTTFATPSMEGYNPENRYGFLTLGGPVTRAMSKRIQEDWARAVEEGPRVLMNLR

SEQ ID NO: 160652 - protein, 75 aa, Glycine max
  Coding DNA Sequence Number=SeqID_68967
AEIPYGRPHLSSTEVNEFDGIRMMLVFTLVIQRHSSSTSHEILLCWARTIKFDSVGKRHGSTGLDIDRPNDVPLE

SEQ ID NO: 160653 - protein, 266 aa, Glycine max
  Coding DNA Sequence Number=SeqID_68968
  Homolog annotation: Hit_ID=Q6WAY6; Match level="QueryCoverage=83%, HitCoverage=41%, E-value=4e-27, Identity=35%"; Hit description =Putative uncharacterized protein
RQKQVENGVVGIPRKYLEAKARILAGKGEWAPFIDILALLIFGGVLFPNVDGLVDLAAIDAFLAYHNHKESPVVAMLADLYDTFDRRCEKSIQGLFAVLQLFMYGANWDQLLTNKEGASVNWFPRWKEGRTGVLISCGGFPNVPLMGTRGCINYNPVLAIRQLGYPMRGAPLEDELEPVISRGFNKTNMETLQKVRKAWEVLQKKDKELWGSNNGPIGGYRKWLKAHVQGLDWLSSLRTAKREEVEAPEEDEEVQALRMELKQAQT

SEQ ID NO: 160654 - protein, 138 aa, Glycine max
  Coding DNA Sequence Number=SeqID_68969
MHHVETLVGQGSSTDILYWWTFKELENFYAKIKAYHDQLIGFSGKGQPEDTSISTLSSVECTRMGTWLSKKCDKQITKVLQANANLFAWTTFDMLGTDPKFHFQRILIFPDARLTAQKEEKVGGRKKKGSDRGNCKLD

SEQ ID NO: 160655 - protein, 163 aa, Glycine max
  Coding DNA Sequence Number=SeqID_68970
  Gene Ontology: Mol. function=peptidyl-prolyl cis-trans isomerase activity; Cellular component=integral to membrane; Biological process=auxin mediated signaling pathway
  Homolog annotation: Hit_ID=A7PNW9; Match level="QueryCoverage=96%, HitCoverage=24%, E-value=2e-50, Identity=64%"; Hit description =Chromosome chr8 scaffold_23, whole genome shotgun sequence
  Pfam annotation: Domain name=FKBP_C; Domain location=41-154; Score =61.6; E_value=2.8e-15; Accession=PF00254.19; Description=FKBP-type peptidyl-prolyl cis-trans is
MAANEDAAHEFAPKKKPPSEDEKRKKKIVPGSLMKALMRPGGGDAGPSDGDQIIYHCTIRTLDGVLVESTRSDYGGEVILAARDLFGKGIPIRHVLGKSKMLLGLLEGIPSMLKGEVAMFKMKPQLHYGEDDCPVSAPDGFPKDDDLHFEIELIEFFKAKARM

SEQ ID NO: 160656 - protein, 139 aa, Glycine max
  Coding DNA Sequence Number=SeqID_68971
  Gene Ontology: Mol. function=aspartic-type endopeptidase activity; Biological process=RNA-dependent DNA replication
  Homolog annotation: Hit_ID=Q69F85; Match level="QueryCoverage=87%, HitCoverage=8%, E-value=2e-11, Identity=31%"; Hit description=Gag -pol polyprotein
MKLKAKEGTETKLELKAENGKCIHVNSNTKLENAEAGNKVILGELMNRLGVDKGRWIKKLIKPSLHRTLYNDQEIENSIKRELDLVEETKVMARVRIEAKKQRASRRYISRLKLMDFRVGNLAWRVQSEVKKDSKEGKL

SEQ ID NO: 160657 - protein, 93 aa, Glycine max
  Coding DNA Sequence Number=SeqID_68972
MEAECRWKKDDWRCHFKEKMSQEEAHHHMNPLIQDQVQDSPLSVLRCHETSHRPEIYPKAHENPGAFSCISGPIFLEYSIQCPCRVGLHHLVA

SEQ ID NO: 160658 - protein, 52 aa, Glycine max
  Coding DNA Sequence Number=SeqID_68973
MTQVDDPDWVGDPDVVEVLLLMVGSGRAKPLLVLLPPLREVPVALGGMTIFL

SEQ ID NO: 160659 - protein, 273 aa, Glycine max
  Coding DNA Sequence Number=SeqID_68974
MALSSLSVFLTIKENGHEVDIASSLYLLPYEAEEWTVMRLDEARKNFKSLEFDDDALDDMEVALAGLAGLSSIGESTHNGLTLAWWLSSPLTNWARQFDGYLQVEGLLLDCSVIGRQGLFLLFNLPDLVLEPGHFFHLDVAFGSFTQLVHATRDSNSPNLSMNLYRDSSSACHRLASVADVTMRLASCILRIEALNKGVKAVDGPWRESTILGQESIQVFIWIGGLSYRSKLSGFQPRDLVMQSYPTRVLDRRLQEDWARAAKEGLGVLMNPM

SEQ ID NO: 160660 - protein, 90 aa, Glycine max
  Coding DNA Sequence Number=SeqID_68975
MKRVSEEKKERREKVKIWICEKEETRERGKECGSVEREKRRCFWPHARLGDSVVHAPFMHFCNFYRFGMVTYSVSLCRWVVLFGITALNT

SEQ ID NO: 160661 - protein, 79 aa, Glycine max
  Coding DNA Sequence Number=SeqID_68976
MTSQAAKEIVKKIDSLEEQVSQGSFVPHGRQDLLTAAIGRLEHLGRVRVAGAGVTIKQYFESAPQTSRTSSSMAPEELE

SEQ ID NO: 160662 - protein, 324 aa, Glycine max
  Coding DNA Sequence Number=SeqID_68977
  Gene Ontology: Mol. function=transferase activity, transferring glycosyl groups; Cellular component=chloroplast; Biological process =biosynthetic process
  Homolog annotation: Hit_ID=A3C8U7; Match level="QueryCoverage=95%, HitCoverage=71%, E-value=8e-69, Identity=47%"; Hit description =Putative uncharacterized protein
MDNSRLNTMINANCPQELLHSVSSRNLSHAFRATLYKGHAHGNGNINDQLDLPITSVLQSTGHWYEGGLWTNHAKHHPLDNERHVAIVTTATLPWMTGTVLAIILMKHINNWVTRAYCNKVVRLSAATQDLPKSIICNVHGVNPKLLKIGENIVAVRELGQKPFTKGAYFLGKMVWAKGYEELIDLSAKHKADLDGFKLDVFQNGEDANEIQSAARRLDLNLNFQKIRDHADDSLHGNGTELSFNPPYLYKLNKENNGEKTSVDKGKLIAKSASMPNLTELVDGGLAFPHYCLIGNQFQRLCIGAIPGTRDYDNQHCKDLHLLP

SEQ ID NO: 160663 - protein, 393 aa, Glycine max
  Coding DNA Sequence Number=SeqID_68978
  Homolog annotation: Hit_ID=A2Q4S5; Match level="QueryCoverage=40%, HitCoverage=25%, E-value=2e-18, Identity=35%"; Hit description=IMP dehydrogenase/GMP reductase, putative
MAVEELNEKQLEAPVEEVVTNVDGFSGGPHDTSVLKDFENHIDLREHPELKLSSHGRQMAKFGRLASEIEGLVAASGLSPLIAYSLDTEVTITLDDIASLLHLPIIGAFHSFELLHVDVVVDMLVELLEMKIKAWGYAWGTAALVHMYDNLNDAFKSTARQLAGYITLLQHFPSIGSTIPVEDYNERRPRACRWTSGKALPVSMYQRHLDRLTHDAVCWIPYSDHLSFRELEVISLFSGHLRWGPLTVIHQPERVVQQFGYIQTISPYPTTSSLSIEEIDDRWMQFGEYIAPRGDPPRVPLVQQYEEFVEPHVYQQPIAEMTPIEADVDVHHVRHAVDGFVAIGDKLERLLDLRILIKGTKAYTVVEECVGIARSYIGQPTVGHRSRHRRHTD

SEQ ID NO: 160664 - protein, 85 aa, Glycine max
  Coding DNA Sequence Number=SeqID_68979
  Homolog annotation: Hit_ID=A5BEV8; Match level="QueryCoverage=81%, HitCoverage=8%, E-value=2e-11, Identity=49%"; Hit description =Putative uncharacterized protein
MSLLVDGLSMVTMDKWMDITDMGYVIALRYNVILVSLSLQQSMTFFPLRSQPPTDSSVHRVICIGHVYDNLFVQYIYDTVVPYRL

SEQ ID NO: 160665 - protein, 88 aa, Glycine max
  Coding DNA Sequence Number=SeqID_68980
MTEEEGTEDKKEEETKEEEKLEEEEKVVSPPKTKSQKATEAKKEESPVLPQDLSYPKVPTKKNKERYFKRFLEIFKGLEITMPFGEAL

SEQ ID NO: 160666 - protein, 310 aa, Glycine max
  Coding DNA Sequence Number=SeqID_68981
  Homolog annotation: Hit_ID=A5B5G7; Match level="QueryCoverage=65%, HitCoverage=14%, E-value=1e-10, Identity=25%"; Hit description =Putative uncharacterized protein
MASRKHQAVPTPGEASNWDSSHFTSKIAWHRYQDNIQLRNILPERNAELGPVMFDEFLQELRRCRWDQVLTRLSEKRIDVALVKEFYSNLYDLEDHNPRFCRVRGQVVRFDADTINDFLDTPVILEDGEEYPVYTRYLNTHPDPNTIPATLCTPGGRFVLNADGLPWKLLRKDMTTLAQTWSVLSYYDLAPTSHTYDVNLDKARLIYSLVSRMDMDVGNFISQQISQIAQSSTSRLGFPTLITALCDIQGVVSDTLIFESLSPTINLAYVKKNCWNPADPSITFPGARWTRTRAPASISEAPPTSQPSSQ

SEQ ID NO: 160667 - protein, 120 aa, Glycine max
  Coding DNA Sequence Number=SeqID_68982
  Homolog annotation: Hit_ID=A7PNW1; Match level="QueryCoverage=63%, HitCoverage=16%, E-value=3e-18, Identity=62%"; Hit description =Chromosome chr8 scaffold_23, whole genome shotgun sequence
MESSGFTEEDVKLNVLDQAWLEAIHHVGEKLGVPKLGLGGMDVGKSILESYSRVLESLTSNIIAFVDDVLCVDDLTKHYDPISSLVSVISHKSIVVPYSIHGQTTSPKPSFGTPSFSLTH

SEQ ID NO: 160668 - protein, 360 aa, Glycine max
  Coding DNA Sequence Number=SeqID_68983
MKGLGGLDDIYFASLIDKMLWDQWVYHVFNKMDEDSKHTLIAKGSVVAKQQKFSKNNLKAIKVDLEQSQKEAPQVDLDVINKRKQKRLAIAIADEDQEEEEELLAKEHRTKKIHELYTTSSPMHLMAATSIPQRLKDLSETDEEDEGLVQVALQKRKIVALIASTPKKIKKTNPKIGDKEWAVSFIGNKEDQASSSSDNESIDNTSIFPLRKHVSSTQPCPPSSPIHLERIRRVAPREPLINAQRFPLSFINGNPTPITPYSKFIYVELVEMETINVQAPTWTKYNIRIIHMPPHWLAPGTKQRVRPSTEHERDPSQEVEPLKSEFQTKDAAKKKGFKLYYNEEMPSRKMKMEIVNHPRN

SEQ ID NO: 160669 - protein, 76 aa, Glycine max
  Coding DNA Sequence Number=SeqID_68984
MDKSLKVGKDEWRERERWGTKLCASNEVHENLRAFFNSSSTILSEPLAHGSGDWSLPRKDCINGCVLGLSRESLQV

SEQ ID NO: 160670 - protein, 46 aa, Glycine max
  Coding DNA Sequence Number=SeqID_68985
MMVVARLGANVTHVGTKAWRHGFEEGKGGRATYSKTIILKYDTLLK

SEQ ID NO: 160671 - protein, 101 aa, Glycine max
  Coding DNA Sequence Number=SeqID_68986
MGSNQAPSFKKRFYHVKIKSLEVAGLQELGQGMGQLQLQAFRKTYGKIWDLAMIEFVPTVEEFEGILGCLLEGRKSYLFSGLYPSMARITKVVKVSAQELD

SEQ ID NO: 160672 - protein, 655 aa, Glycine max
  Coding DNA Sequence Number=SeqID_68987
  Gene Ontology: Mol. function=aspartic-type endopeptidase activity; Biological process=RNA-dependent DNA replication
  Homolog annotation: Hit_ID=Q2HW90; Match level="QueryCoverage=33%, HitCoverage=47%, E-value=5e-19, Identity=30%"; Hit description =Putative uncharacterized protein
QEPRGFQLARARAADGSSPTSSLPQNIWEDLGFGYDRNSVEAITSLTQYYDQSLRCFTFGDFQLVPTIEEFEAILGCPLGGRKSYLFSGLYPSMARVSKVVKIAAQELDRVKQNINGLVEIPMKHLEGKAKALADQGEWTSFVDVLALSVFGIVLFQNVDELVDLAVTGAFLAYHHNKESLVIAVLDDAYDTFDLRCEKSSARIVCCTPALYVWLVSHIFRHESRPVCPLQGHRMCAEKGKTNWEELLAGFPNVPLMGTRGYPVRGAPSEEIIAPFIAEVLVKAMQKYFRESKKHGMPWKEKIRSLEEATTISSGEEAEVPAEREEVQALKAKLERTRVVKEKFKMAATRVRKEYDELRDVNMAMTEALERETKRARKEEKNELKLQRAERDESRVESLMLEDKLKACQRSKRSLTEQLSKTEENMLTIIDQYKEKLNLAASHEQRLEDEHAKVSALQVEREARERVIESLHEAMKWMDRFALTLNKSLELPRLLARAKAMADAYSSPEEDHALGEFEPYIIYATEGPTFSGMPQPNAAGAPQHRPLQPLHFSVGRLPPTMATKGINDYPFADMAKLCLVPDIVIPPKFKVLDFDKYKRTTCPKNHLKIFSDPFLEGLDMAPDRTQLQNMSKKKHESFKEYTQRWRDLAAQVAPP

SEQ ID NO: 160673 - protein, 98 aa, Glycine max
  Coding DNA Sequence Number=SeqID_68988
MPIHNRIKGRPRTIPCSPQSNHQSMDSQTNYLTKFAKNMTTRAPKYHNGKLKFEGRWYLLVLTCSILLKCSWHPVDRANWLRIQWARLRVYVIKDNKK

SEQ ID NO: 160674 - protein, 144 aa, Glycine max
  Coding DNA Sequence Number=SeqID_68989
MLITGLCQSFGVPVTPSKVIRPSITRAFIEKYCTPRQAQGDAPQATDTPPPPHQANLARSFGMEQYLQHLVRQQAANHRGQSQGFAPFSCPTPDQFRAEVAWPGDWPEAQAWEAPAEAPGDTEEARMDEEMTDLLGFLGGSGAT

SEQ ID NO: 160675 - protein, 134 aa, Glycine max
  Coding DNA Sequence Number=SeqID_68990
MRCYKMCVVDVPDDNTKENIRFFIWSVVMLKFIKAWVVVHPRISEVFTQFLLRGDSKGKRKTKQENKAQVIMDYGQGEDELQLELGTHLHSMGKAGTNCWVINAPSNKIAHTHKGLWEHNKDCTVGKIITITRI

SEQ ID NO: 160676 - protein, 171 aa, Glycine max
  Coding DNA Sequence Number=SeqID_68991
MLIIIDQYKEKVNLAASHGQMLEDEQEKVSSLQIEREERERVIELFHGEAMKWMNRFALTLNESQVLPRLLARAKAVADMIWFNPMFYGMFYMLHYSFHSVFSSHYHHQKVTIVTKKNECALRHCRNLPFGGRAMRGLTGASSKKGKCAESPPTFIEGKRRKNQKGVVYEL

SEQ ID NO: 160677 - protein, 279 aa, Glycine max
  Coding DNA Sequence Number=SeqID_68992
MAPKKLLAKRVRKAATGEESSAAPQAEIEFDGHHFRSEEHQLRFKAIKDWSFLKERRVRGQWITYDEDAINQFLGHSLILEEGQHYEYAERRSQVPGFDEEAIGQLLCSLGQDFARSVPGRQCSRSTAYLGCHLPVCRYCTSETLSGPKEVQQGTEISSIDHKPLPVLQGTNLAHKAHPESTIAGVRPTADAPLPPPHQPPSLESISAHMQRMELQMHTYMQHLANQQVATYRGQFKVTVAWPGDMPNFQGGVGPAKSQGDEDGAEEDGDMENVMDFFL

SEQ ID NO: 160678 - protein, 110 aa, Glycine max
  Coding DNA Sequence Number=SeqID_68993
  Homolog annotation: Hit_ID=B0L632; Match level="QueryCoverage=49%, HitCoverage=51%, E-value=8e-10, Identity=61%"; Hit description =Protease inhibitor/seed storage/LTP family protein
MEAYTKVFGILGLLVFVSISEIHRVEGAGECGRSTTPDNEAIKLIPCVSAAKDEKAEVTQNCLKNLVGRLGVHDKTCLTMGKSGLQEYSNRMTPKAYTPKSPSGPLPPDS

SEQ ID NO: 160679 - protein, 152 aa, Glycine max
  Coding DNA Sequence Number=SeqID_68994
MKAYIEALKDQMASMMEAMLSMKKMMESNAATIAATSAAAEADPTHPFAINQTNLSIPDMVGQGGEVLGNTGGPHMGHNRNSYPYGLPPNYTPPNAIHMPNENANRAVLVPFEGQQPQSVGDTHEEPWDHAQDDFDPYLTFTAEGPTFNAMP

SEQ ID NO: 160680 - protein, 193 aa, Glycine max
  Coding DNA Sequence Number=SeqID_68995
MLEVEVKVGGIIAATTGFSSSPSAVVHHDESAAVSSVALSLLFYYTGWEEIKAAIRKEVGPIRLSMHARAATRSPPESTVRPMKPIKPHTLDTVLACCSDGWAGTRSIGMGGGDYYTGAASHTLHPNESFPDQLYNISLASGTHTNTSGIMTKSNTKRRTLLPTTTSSSGLLNQSTSNYELHQTGIEEDGYRI

SEQ ID NO: 160681 - protein, 102 aa, Glycine max
  Coding DNA Sequence Number=SeqID_68996
MPTRMNLQLANHSIPRPYGVIEDVLVQGPVTRAMSKRLQEDWARAAEEDPRVLMNLRVSICLLHAIATSYSHTLCMSFMLYMPHDTEAHLVENLGIDLGIVG

SEQ ID NO: 160682 - protein, 112 aa, Glycine max
  Coding DNA Sequence Number=SeqID_68997
MRAQPEEEAITQLLCIPGQDFTRAAAKRRVGIMHTNMNTLTQICMTLLLSNILPNDHNADLPLRKYQLDRTRKTPSGPEEVQHGLGVSSSDYGPLSILRSACRPQQGHQAPY

SEQ ID NO: 160683 - protein, 140 aa, Glycine max
  Coding DNA Sequence Number=SeqID_68998
MHKALRANALFLSSIGHPILYHFQIPLDDEPFVQVKRSFAIGTGAITSFGYCKDRDGQWLKKDALPQQDERTPSPSPQRDDSTTLMNEVLLELRGLCTYVGERFDSLDGRFEGMDTRITQLEEDVTYLRQCFDLPPPSKS

SEQ ID NO: 160684 - protein, 78 aa, Glycine max
  Coding DNA Sequence Number=SeqID_68999
MGCNTENKRGYISRGFVQVKRTSTWCFKENKGGYIPCGSLLVKDFTRLKEISRTGGCLGTGCRHRLWPNHFYFRFTFV

SEQ ID NO: 160685 - protein, 111 aa, Glycine max
  Coding DNA Sequence Number=SeqID_69000
TLVSTATPLELEVIPQVKELLDEGLVRKSLNSCALLVPKIGVIRHQIPKIGGMMNVSSGATLFCKIIHAPKIFIIRVLKDSLGSDQGVPAEPKRIKVIPGWPTPPSFEGKA

SEQ ID NO: 160686 - protein, 160 aa, Glycine max
  Coding DNA Sequence Number=SeqID_69001
MWAVHKGLQIDWAHLVRYRMHKVLRLNAPLPYPHLITLFLQHFNIPLDSEPYVPIKRSFLIGASVIASFGYIMEHDGSWVKKGSRNVGEEGHEGEDSSLLSKILERFDGLQTFVGERFDTLELRVDMRFNEMESRMTKVEEDVSYIRSSFDLPPLPPPSS

SEQ ID NO: 160687 - protein, 115 aa, Glycine max
  Coding DNA Sequence Number=SeqID_69002
  Homolog annotation: Hit_ID=UPI00006A2D9E; Match level="QueryCoverage =88%, HitCoverage=71%, E-value=2e-08, Identity=19%"; Hit description =UPI00006A2D9E related cluster
GGPLGTTTLTFRGLHTLTFRGLHILAIRGLHVLTFRGLHALAFIGLHALAFIGLHALTFRGLHVFTFRGLHVLTFRGLHVLAFGGLHASAFRGLCVLTFSGLHIHTLREFKVLCP

SEQ ID NO: 160688 - protein, 192 aa, Glycine max
  Coding DNA Sequence Number=SeqID_69003
MTEEQRQLAALCKIEIKRWQAASESNPNMRYMVELMEMALAALTARPKGFIESKANGTDCFILKGFYLNGLVEGDELYTAPPAPVLRVPDEMHHKQSPHGESSLWAMGWNECLAEVKRLNTQPSPPEEVARKHSSLTAREAYEIARELLALRNAFSVPDCWEIAGQIFATEEEALSYGFIGKPEPLYSKPEA

SEQ ID NO: 160689 - protein, 47 aa, Glycine max
  Coding DNA Sequence Number=SeqID_69004
AKVAWPRDWPEAQAGEVPAGAPSDAEEARMDEEMTDLLGFMGGSGAM

SEQ ID NO: 160690 - protein, 42 aa, Glycine max
  Coding DNA Sequence Number=SeqID_69005
MALYGSAFAYSNPLRRCFPFVQGWARDNNLSVVTLAFTCVRP

SEQ ID NO: 160691 - protein, 136 aa, Glycine max
  Coding DNA Sequence Number=SeqID_69006
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MGQNTPNDYDDGWLKFSQSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRAVLLPLRTT

SEQ ID NO: 160692 - protein, 469 aa, Glycine max
  Coding DNA Sequence Number=SeqID_69007
STPRGSPIALFNAWQQAGAQQAGAKTETPAVNEAEVVAIAVAQGRDPVAALKAAHDKADGDKAKAAAAKPPENGPLGKLPDPVYVPLKAKALEVMLADQLSWITAWRTERFASPQYADKYYQRKPFYQQALNEQTSALPSAAAPAESEGPREVPFIDKDRLDRAAWGYDFAHTGIVALLGQVLLDVIPTTQTNQLGGPLVAAQESEYIQIKKSGDARRAALMGSPTMLDFYDNYVHDTLAKYNHDPLHSSFSHGANGYERSEYGIGRAGHDGMSGADIAVLNHGPDAIVSVQVDGYGGPRANPYGGGGGGPEAIPDDHASHYQRHGPITVPIERWEKGADSPFLHTTWTAGVSGSPVATRLEAKSSENTYQTYQGGNCMSDTADSTLSALKALIAAFQTGATPVAVKTSTAEAASLPPNFPGPDDKKGEKPADNSVLQKAEYNERGRLPASRTQAEGNYARQYLEGYVG

SEQ ID NO: 160693 - protein, 973 aa, Glycine max
  Coding DNA Sequence Number=SeqID_69008
  Gene Ontology: Mol. function=aspartate-tRNA ligase activity; Cellular component=cytoplasm; Biological process=tRNA aminoacylation for protein translation
  Homolog annotation: Hit_ID=A6TB35; Match level="QueryCoverage=59%, HitCoverage=97%, E-value=0.0, Identity=83%"; Hit description =Aspartyl-tRNA synthetase
  Pfam annotation: Domain name=DUF28; Domain location=742-973; Score =496.3; E_value=3.6e-146; Accession=PF01709.11; Description=Domain of unknown function DUF28
  Pfam annotation: Domain name=GAD; Domain location=299-398; Score =158.4; E_value=1.9e-44; Accession=PF02938.5; Description=GAD domain
  Pfam annotation: Domain name=NUDIX; Domain location=539-690; Score =34.5; E_value=3.9e-07; Accession=PF00293.19; Description=NUDIX domain
  Pfam annotation: Domain name=tRNA-synt_2; Domain location=109-551; Score=718.3; E_value=5.5e-213; Accession=PF00152.11; Description =tRNA synthetases class II (D, K and N)
  Pfam annotation: Domain name=tRNA-synt_2b; Domain location=132-284; Score=-39.2; E_value=0.016; Accession=PF00587.16; Description=tRNA synthetase class II core domain (G, H, P, S and T)
  Pfam annotation: Domain name=tRNA_anti; Domain location=10-94; Score =94.8; E_value=2.7e-25; Accession=PF01336.16; Description=OB-fold nucleic acid binding domain
  Pfam module annotation: Pfam domain module=DUF28::GAD::NUDIX::tRNA -synt_2::tRNA-synt_2b::tRNA_anti; Domain location=742-973::299 -398::539-690::109-551::132-284::10-94
LNLSHVGQQVTLCGWVNRRRDLGSLIFIDMRDREGIAQVFFDADHQQAFQLASELRNEFCIQITGTVRAREEKNRNSDMATGDIEVFAHELNIINRAEPLPLDSNQTNSEEARLTYRYLDLRRPEMAQRLKTRARITSFVRRFMDGEGFLDIETPMLTKATPEGARDYLVPSRVHKGKFYALPQSPQLFKQLLMMSGFDRYYQIVKCFRDEDLRADRQPEFTQIDVETSFMSAEQVRSVMEQMIRELWLDIKGVDLGDFPQMTFAEAMNRYGSDKPDLRNPMELVDVADLLKSVEFQVFAGPANDPKGRVAALRVPGGAALTRKQIDEYGSFVGIYGAKGLAWMKINARASSFDGVQSPVAKFLTPEIVEAILQRTDAQDGDLIFFGADRARVVADALGALRLKVGRDLQITNDKAWAPLWVVDFPMFEEDDEGGLAAMHHPFTSPKALTAEQLAADPTQAVANAYDMVINGYEVGGGSVRIHSGNMQQTVFSILGISEEEQREKFGFLLDALKFGTPPHAGLAFGLDRLTMLLTGTDNIRDVIAFPKTTAAACLMTEAPSEANPAALADLGIQIAPKKRRDDPSFWQSVTGSLEPGETPAQTAQREVAEELAIDIAAEGLVLEDCHKQIEFEIFPHYRHRYAPGITHNREHWFRLALPAERQPLLSEHLAAPVADTGRRRRTNPLVDQASSAQQGCSPPAHSNRSVHEYVRIARTAGEQDCQQDSLHPVKDRRICKMAGHSKWANTKHRKAAQDAKRGKIFTKIIRELVTAAKLGGGDAGSNPRLRAAMDKALSNNMTRDTMNRAIARGVGGEDDSNMETIIYEGYGPGGSAVMVECLSDNRNRTVGEVRHAFSKTGGNLGTDGSVSYLFSKKGVISFAPGQDEDAVMEAALEAGAEDVVSYDDGAIDVFTAWEELGSVRDALEATGLKADSAEVSMIPSTKAELDAETAPKLLRLIDMLEDCDDVQEVYHN

SEQ ID NO: 160694 - protein, 206 aa, Glycine max
  Coding DNA Sequence Number=SeqID_69009
  Homolog annotation: Hit_ID=A6T929; Match level="QueryCoverage=100%, HitCoverage=47%, E-value=9e-99, Identity=82%"; Hit description =Putative uncharacterized protein
  Pfam annotation: Domain name=DUF187; Domain location=1-198; Score =28.0; E_value=1.8e-16; Accession=PF02638.6; Description =Uncharacterized BCR, COG1649
FDDYFYTETATSPLNDSATFRQYGAGFASKADWRRHNTQLLIEQVSRTIKQLKPGVEFGVSPAGVWRNLSHDAAGSDTRGAAAYDEAYADTRRWVQLGLLDYIAPQLYWPFARQAARYDVLARWWANVVQPTRTRLYIGVALYKVGEASKSEPDWTVQGGVPELKKQLDLNESLPHIDGTILFREDYLNQPQTQQAVDYLRQRWGK

SEQ ID NO: 160695 - protein, 191 aa, Glycine max
  Coding DNA Sequence Number=SeqID_69010
LLPFCKPPIRKNHNLGTNKSHHSCSVNGEGISHKDHLSRILDELSSLKLWKEKLERKERGKERVEINQDEREQKGEEERRKILKELRKEKHSSYSSHNSCKSLSDELRDYYEGRHRSHLRPHSHRREKERNPQEANINLPYFHGKDNVEAYLNWEIRVEQQLKKKVYFKILWLSLLSKERSRSRHLKGGIF

SEQ ID NO: 160696 - protein, 185 aa, Glycine max
  Coding DNA Sequence Number=SeqID_69011
VTGCTIYGEAHETGQCIPIEENTQEVHYMGNQQRQRYTQGGFSGQWRSHLGNQFNKDQGGPSNRPIQQGPNIFQRTTKLEETLTQFMKVTMSNHKLKNLEVQVGQLAKQIADKSSNNFVANTEKNPKEECKAVMTRSKRFVEAEDEESVVHKKKAAEKKGTDGKKNDVRGESNQEKEKQIMVKKK

SEQ ID NO: 160697 - protein, 101 aa, Glycine max
  Coding DNA Sequence Number=SeqID_69012
MVPMFHTLYVVYVHGGVVTLLDIPGGGNRVFFMRKKYLYLGACHSIWNSLETQADHHGGGGDACAQQGDLDTYCLVFLSESVVWTRLGYFLGDGTTFAFES

SEQ ID NO: 160698 - protein, 70 aa, Glycine max
  Coding DNA Sequence Number=SeqID_69013
MQLYKLVKTQGKHAPGPRLAKPKEYKSIKNQGPSLVPKTQGLPLVCTPTKPKAPRWSAHSQQLQRPKSKV

SEQ ID NO: 160699 - protein, 118 aa, Glycine max
  Coding DNA Sequence Number=SeqID_69014
  Homolog annotation: Hit_ID=A5AK77; Match level="QueryCoverage=93%, HitCoverage=13%, E-value=5e-09, Identity=32%"; Hit description =Putative uncharacterized protein
HPEHSVIGESEHSVVGNFEHSKNMAQPPPRERTLREMVAPDFTYESLCIQYPDEDVPYVLKIGLIHLLPKFHGLAGEDPHKHLKQFHIFCSTMKPPDVQEDHIFLKAFPHSLEGVAKD

SEQ ID NO: 160700 - protein, 56 aa, Glycine max
  Coding DNA Sequence Number=SeqID_69015
MASLVDDLDLSLKIHFDAILSRRGPTRAMARRLQEDWARDAGEGPRILMSHRGSIV

SEQ ID NO: 160701 - protein, 99 aa, Glycine max
  Coding DNA Sequence Number=SeqID_69016
MQKPLVITWKSSDCSIHSEVEALEHMMKRDRGHQNVSLENKTGDSTVVKMSEKNNNADVGDCMILDDHEGEENCCGKGTNARSVFFFFAKKPRKDRRFG

SEQ ID NO: 160702 - protein, 72 aa, Glycine max
  Coding DNA Sequence Number=SeqID_69017
MDVVLSELQNEEAEQGSNFSTFREIRELSSDCEVLRGGGDIPPPVNFSIGKCIVSLELDRAGLDNCISRDRV

SEQ ID NO: 160703 - protein, 124 aa, Glycine max
  Coding DNA Sequence Number=SeqID_69018
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVDCAPPSQLPRFKELVAQRTLRKTALQG

SEQ ID NO: 160704 - protein, 101 aa, Glycine max
  Coding DNA Sequence Number=SeqID_69019
MKALEKFKWSYLFTRMSDSDTSHIETLQTEQRKLREIQMVKNFHMEVRFRCIIYLDAQTDHRKLSRNSNGHNFSLGCLIQAHHISRRCKLNNESFEEFKWS

SEQ ID NO: 160705 - protein, 60 aa, Glycine max
  Coding DNA Sequence Number=SeqID_69020
MNGRPRISGISTSSLVFMIIKSVGKDPLNDNTTIAFHHNVVTVDIFALLCQQIFEKLGVE

SEQ ID NO: 160706 - protein, 230 aa, Glycine max
  Coding DNA Sequence Number=SeqID_69021
MDMNIGALISGQISSIAQSNSSRLGFPALITAHAELEKLPLTLTLEGQGRQGFDQLVFPSSSTQPTPSTSTTPTPAPRGPYAQDSQRFESMLQSLHKGQILLMQSLQVIAPPGSILIVEQFLEKVQDASSEATIPEPFILEVGETQVRQEAAALERSPQTSPDPPSLVVDQSSLQQPADPSTPLLDLLEDPSTPVLGLTTTPPATPVLRLTDKEGTQDEDTQSQDLSQEF

SEQ ID NO: 160707 - protein, 173 aa, Glycine max
  Coding DNA Sequence Number=SeqID_69022
TAGNRRGIHSRAMKTFQFAHGKRCNKGEHYPISPAHRLSLPYEIPDEHSSGGQECTMSNGLKCLKMFFTMPLGYINGVGTCYVPINVSFSPKVGPGIPGAPVASVLSAVLLSATDGVVRNGKSTAGHQRWQAAQLLGRAIGAGLFAITPAGERGMCCKAIKLGNARVFPVTTL

SEQ ID NO: 160708 - protein, 2414 aa, Glycine max
  Coding DNA Sequence Number=SeqID_69023
  Gene Ontology: Mol. function=nucleic acid binding; Cellular component= SWI/SNF complex; Biological process=regulation of transcription from RNA polymerase II promoter
  Homolog annotation: Hit_ID=A7NW95; Match level="QueryCoverage=16%, HitCoverage=39%, E-value=2e-76, Identity=68%"; Hit description =Chromosome chr5 scaffold_2, whole genome shotgun sequence
  Pfam annotation: Domain name=SNF2_N; Domain location=1-258; Score =106.2; E_value=1e-28; Accession=PF00176.14; Description=SNF2 family N-terminal domain
MEAKNDRGPFLVVVPSSVLPGWDSEINFWAPGVHKIVYAGPPEERRRLFKERIVHQKFNVLLTTYEYLMNKHDRPKLSKIHWHYIIIDEGHRIKNASCKLNADLKHYQSSHRLLLTGTPLQNNLEELWALLNFLLPNIFNSSEDFSQWFNKPFESAGDSSPDEVDLQAQARAHRIGQKRDVLVLRFETFYLFIYAEVASSAKCNKVQTVEEQVRASAEHKLGVANQSITAGFFDNNTSAEDRREYLESLLRECKKEEVAPVLDDDALNDLLARSETELDIFEAVDKKRKEDELATWKKLVLGQAADGSDSDIPPLPARLVTDEDLKQFYEAMKISDVPKAEVESSGVKRKGGYIGGLDTQHYGRGKRAREVRSYEEQWTEEEFEKMCQVENPDSPNKVKEVAEKSCPTNTSSSVVSTSNSQPVAVPPVVPTLPAVESLPVVVQQVKEITPPAKRGRGRPKRITSDKSPAVVISPVTSGTVEVDTQLQKGIGSGHLASSTPDSVAHSAEVVGVNAPVQQSDPGVSPNSQPVIPMPSIPPNSQVAAVPVSVPIQARGQGRKSHGGEGIRRRGKKQVMTSSPIPAGSVVPDLKVNEKLEDTLVSPSSGQAISQSETVPSSAAVPHPPSASLSSGKDPVGVGIVLNSQAPPPLPSNTTLIQTAPTYPSVQMQSKGQNQKSQTGVSRRRGKKQATILASVPDLLHQDLHQTANLPISSDSMSGEKATELKSLQANNVQESKCVVQDQASQSVGDQDLKSLGGSDDSSKQTVIMSSCEDSMIKSPGQDLDEVKNPDAHDSSVKVVKSSEITSSKIDEVCNNSGNETLLVTTVPVTEAIKDQHLGGKTHNQTVETSKTFPSVVDTSINSLTGNETTENISKSLDPVTPKIVPSTLSTVYSSTPGSESTHPGSIESMPTKRQGRKTQNRAEPPRRRGKKSTAVLPVVPDAVTGQDPKLSHHAQNSSGDSLLGKATANVTQTQALEILLPCGVVSHDSNRKERATNSTHNKQQKVASTRIDGAPISTDKISVHDVARVMKEVFSGTCIPKPKAHDSAGSEDRNAPVVPVLTKAAVDVTSNNQSLKDKVYSDIAATGAACLTSNVAVNVNEKQPEMASNMQNLEGKSCLDMPITGEHNLTSDVKEKAEQMLHCVESSTTGCKIALDTTLNAVQKTDDSSERLPTSCALNDLNIDSSSHQMCSSSGAEPLAVIDHKIKSQSDSLEKCSRSSPLDIGSMGCPPTPLEPDTFSNNPVTSQADTCTQSHSSTNKPPVSTELISNEKLESLEPSLKSSSLACVDGSGFLVQTENLGDQPQVIPSSPATDLPPMTMIVSSISEHAEVKSETESTLKASAELSSDEGIVGYKVPSSQLLETENRNPFGHNSQKVLEPSVKQCSESASEMKVPVSPKAVQVQKHPDALEPADLHGTPLIESCPKSLCEEKKDDGNSICEPLQSCVVEPINIDPVSQENIVLPIPIENLKTDSSEACHMEMDTSDRLVLPQPSGLEAVGNDLVGISGVGSLVEGNKSEAAVLPPSTLKEEQNRGLAVTCTVRSSEPLEESMEKGVANDSRVQEEAKVDKVETDIQMDSSISQTLQAKHEIFQENMNFPSHLMTKEENIEVSSSRPLSISSSPSHELKDSELELGDKYISQVGDSQTGSEDNMLKRLDLVSSPSVTKEEVLSSTSDIDGSGGLSTSLNVHQLVTVPDAVKSSSSQVREEEKIGVSSDSKLVVRSVSENDMEGTDLLPENPLLEINKMSSDSPMIISHSVKGRVSFVKEDNSVIKISDQMDASQVSENNSERVTSKCMDVPSCFQMVEGDNVDMLSDKGPLCNSLAPSEPRDPLIENSSDGIEDSIPNPLPQQKSECSESEKVDEVKTSDVVRVDPGLMSKNTDLPSSLVMEQDKADASYDSPLAAAEPKYCLTGENCEDANEEPNPSEAEIGNEMDASDVAGINTQLSSSNNIVPSSFLMTKDDKIVVSSDNGPQCSVQVLKGSEDCQTEGSCKDATEGPSTNPVLLQELIINSEAETCNEGKTQVRLSVEDVTASGGKREVETLSDEGPQGILEAQDGSRGLADFEEGADIPKPSVSAVKGEEILEAQDGSRGLSDIEEGTCSKSCAAEMGNLSEVPKPSVSAEKVEGILESQDGSRGLADIEDGTDSKSCAAEMGNVSEVPKPSVSAVKGEGILEAQDGSRGLSDIEEGTDSKSCAAEMGNVSEVPKSSVSAEKVEGILESQDGSRGLADIEDGTDSKSCAAEMENVSEVPKPLVSVEKVEGLSKEGIVGSQAIVQVSEESETVTGDGIDVTPDCLAVPETVSNDGASSLCSSAAGSEHVDSLSEKDLVGNSVAELYTKESEAGVSDQENQVVQENAMEDMEHEYLSEKDLVGNTAAKLDTKESEAGVSNQERQENELDIEKSPPSAAEGSS

SEQ ID NO: 160709 - protein, 181 aa, Glycine max
  Coding DNA Sequence Number=SeqID_69024
MTLLLSNVLPSDHNFDLPLTKCQLVYAILTRMSVHVAQVIADAIYLFAAFIEKYCTPRQAQGDAPQAADAPPPPHQADPAGSLGMKRYLQHLVRQQAANHRGQVQIHECLYRFSLSQLGQGFAPFACPTPEQFGAEVTWPGDWSEAQTGEAPVGSPSDAEEARMDEEMTNLLGFLGGSGAT

SEQ ID NO: 160710 - protein, 200 aa, Glycine max
  Coding DNA Sequence Number=SeqID_69025
MQERHIIFNLGAEGRVNERNSISFKLLVRVRESILWNSKFIRTADFVDTLARSSCTRVTVIARSLYLIWHISGSTARDKKKHRLNLVLLLPQNQSPILMHKKKHSILIHKAVTIAVKNSKELKRRKKKQKVVMVTRSSTGTSLISILEKGKLLNSERGKEDGVEVDKEGLKLGEEHELPSRLICVAMSLLERAGDTLVTA

SEQ ID NO: 160711 - protein, 1114 aa, Glycine max
  Coding DNA Sequence Number=SeqID_69026
  Gene Ontology: Mol. function=nucleic acid binding; Cellular component= chromatin remodeling complex; Biological process=ATP-dependent chromatin remodeling
  Homolog annotation: Hit_ID=A7NW74; Match level="QueryCoverage=91%, HitCoverage=96%, E-value=0.0, Identity=80%"; Hit description =Chromosome chr5 scaffold_2, whole genome shotgun sequence
  Pfam annotation: Domain name=DEAD; Domain location=184-349; Score= -42.3; E_value=0.06; Accession=PF00270.20; Description=DEADDEAH box helicase
  Pfam annotation: Domain name=HAND; Domain location=754-874; Score =11.7; E_value=3.4e-07; Accession=PF09110.2; Description=HAND
  Pfam annotation: Domain name=Helicase_C; Domain location=529-608; Score=102.4; E_value=1.4e-27; Accession=PF00271.22; Description =Helicase conserved C-terminal domain
  Pfam annotation: Domain name=Myb_DNA-binding; Domain location=875 -921; Score=20.9; E_value=0.0047; Accession=PF00249.22; Description =Myb-like DNA-binding domain
  Pfam annotation: Domain name=ResIII; Domain location=180-344; Score =1.7; E_value=3.5e-05; Accession=PF04851.6; Description=Type III restriction enzyme, res subunit
  Pfam annotation: Domain name=SLIDE; Domain location=930-1043; Score =236.8; E_value=4.7e-68; Accession=PF09111.1; Description=SLIDE
  Pfam annotation: Domain name=SNF2_N; Domain location=186-515; Score =353.7; E_value=3.1e-103; Accession=PF00176.14; Description=SNF2 family N-terminal domain
  Pfam module annotation: Pfam domain module=DEAD::HAND::Helicase _C::Myb_DNA-binding::ResIII::SLIDE::SNF2_N; Domain location=184 -349::754-874::529-608::875-921::180-344::930-1043::186-515
MGRPSKTQVSNDFSSEEEEEDASAAASHQIVDDEEELEAVARSASSDDDDNSPDEAAEDDDEDKQDESNVDPEVSKREKARLREMQQLKKQKVQEILDAQNATIDADMNNRGKGRLNYLLQQTELFAHFAKGDQSSQKKAKGRGRHASKVTEEEEDEEYLKGEEDGLANTRLVTQPSCIQGKMRDYQLAGLNWLIRLYENGINGILADEMGLGKTLQTISLLGYLHEFRGITGPHMVVAPKSTLGNWMNEIRRFCPVLRAIKFLGNPDERKHIREELLVAGKFDVCVTSFEMVIKEKSALRRFSWRYIIIDEAHRIKNENSLLSKTMRLYNTNYRLLITGTPLQGLHGDYRMILKTEKLYEVEVEMLRGSRMAWKTEKLHEVENNLHELWALLNFLLPEIFSSAETFDEWFQISGENDEHEVVQQLHKVLRPFLLRRLKSDVEKGLPPKKETILKVGMSQMQKQYYKALLQKDLEGAEPGPPFTTGDHLITNAGKMVLLDKLLPKLKERDSRVLIFSQMTRLLDILEDYLMFRGYQYCRIDGNTGGDDRDASIEAFNKPGSEKFVFLLSTRAGGLGINLATADVVILYDSDWNPQVDLQAQDRAHRIGQKKEVQVFRFCTEYTIEEKVIERAYKKLALDALVIQQGRLAEQKTVNKDELLQMVRFGAEMVFSSKDSTITDEDIDRIIAKGEEATAELDAKMKKFTEDAIKFKMDDTAELYDFDDEKDENKFDFKKIVSENWVEPPRRERKRNYSESEYFKQTMRQGGPTKPKEPRIPRMPQLHDFQFFNTHRLSELYEKEVRYLMQAHQKNQVKDSIDVDEPEDRRVKKGICLEEYWGVKVAKNAYSNWLVGKMVGDPLTAEELEEKEQLLEEGFSSWSRKDFNAFIRACEKYGRNDIKGIASEMEGKTQEEVERYAKVFKERYKELNDYDRIIKNIERGEARISRKDEIMKAIGKKLDRYKNPWLELKIQYGQNKGKLYNEECDRFMICMIHKLGYGNWDELKAAFRMSPLFRFDWFVKSRTTQEITRRCDTLIRLVEKENQEYDERERQARKEKKLAAKSMTPSKRSMPRQTESPSLKKRKQLTMDDYLSSKSHCDFPEPDFMVLWQGKKKK

SEQ ID NO: 160712 - protein, 156 aa, Glycine max
  Coding DNA Sequence Number=SeqID_69027
  Homolog annotation: Hit_ID=A9PAG2; Match level="QueryCoverage=64%, HitCoverage=55%, E-value=9e-14, Identity=40%"; Hit description =Putative uncharacterized protein
MLTEPDEIDAVFSYWVKELGGSSLELAKYPVIFRLSLKKWIAPRASVVRFLAAQGLLERSGNMVTMFIMSEKRFLDTFVKRYEKHSSQLLKMYKESVNMNVANSKENKKKTCLSFACGNLLYVFLQKLNKGSTSLLMKERIDHACEKNGAFYKPGK

SEQ ID NO: 160713 - protein, 114 aa, Glycine max
  Coding DNA Sequence Number=SeqID_69028
  Gene Ontology: Mol. function=kinase activity
  Homolog annotation: Hit_ID=A7NW56; Match level="QueryCoverage=78%, HitCoverage=14%, E-value=3e-21, Identity=61%"; Hit description =Chromosome chr5 scaffold_2, whole genome shotgun sequence
MDVYIVILFSGSKYLLHALFVQALQLGQDSYNTYELRSQRCQMCLRTDSLHKVMERLANPVIGLNYEDCCAENFGFTNLDLGVRRLVIVEAGSKRVEGIIALSDIFNFFLGYNS

SEQ ID NO: 160714 - protein, 1449 aa, Glycine max
  Coding DNA Sequence Number=SeqID_69029
  Gene Ontology: Mol. function=zinc ion binding
  Homolog annotation: Hit_ID=A5ALQ1; Match level="QueryCoverage=97%, HitCoverage=88%, E-value=1e-157, Identity=32%"; Hit description =Putative uncharacterized protein
  Pfam annotation: Domain name=zf-CW; Domain location=649-697; Score =61.7; E_value=2.5e-15; Accession=PF07496.6; Description=CW-type Zinc Finger
MEANTEFEEGEAFFCYKDDDDDNIDLDSLSYIDERIQHALGHFRKEFEEGISADRLGAKFGDYGSFLPTCERSPPLRSCPKTPQKHSSSPKSPSNLHMVAAFQNSKAPPNIPPSMRLGTASYKAPPFRNIRVPSADNSVKNTDISSNEVIEKFTLKDCANKSENLTDQRTLKLRIKVKSDILAKKKAVIYSGLGLDDSPSSSMENSHEESEDMPHVSQETPEESPTSIVQKLWENAADAASRNCGCYALVVMISFTIPGGVLISPLHDSLLYLIRKEKAHGNIKPMYSLNGHQEHYSMSTDESDSFVGDGHLLKKRKVTVVDQSDKQHMNGNHSENDMTLHTKKKLRSRTLNRKDFLSNDLRCTPLSSSICDAGETDEVTVKAFEVSKEVDKDGVKCRMVSTEAVKEDTLESISGQDFDKIEKQNTGSSFMQKVLEHKTEIFQNNNSTDPKINSKCNAFAISKRIKCDTMKCKVDQDTQKCETNQEGKVKSESKNESKGERSPGKVMTDAEKDSIGTSNNAMVNDRKSTGIGVTSSKSKMHKIKSMKDNKVTDCDRDSLKGKKSQRKVDRINPTDRPTLNKATVNSILDHVYKSAYIVKERPSGNKVVNQLSAGPCVKDAPGAFSIAENKPTSEIVPSSAAATPQVIEEDWVCCDSCQKWRLLPMGLKPEQLPEKWLCSMLYWLPGMNRCNISEEETTKTLYASYQMPIFVGQNNMQNCATGPETEVRSVDALQLGLNHKKSSSDVMLDRGKKKHGINEKARSVINNDIGPADSNRMKKSISKHSSRLNNLIEEKNTPKVKEKQMNGGDRNHFRLKHKMEDNQHGSGTAKKSKTEDVYYADKQLNPSMEFKKVGLNSRNGLPTKASGKNMGKYDDYCWSDDLEDKLVVPVKKGDWAQFSSDDGSLDATNSSKIGSIKKRKMTDWLDSEKHNKTLSLEGDMKCGKEGNVNRREKKYIVLNMDAKSVTERDDKLVRESGVKRVFSSDSRDEMAIGTEVKSVNKVQQPRKHKKNVASYQALDCFDQLGKDLGSGELSLTATSSSSKVSGSHKARTNLEDVRGSPVESVTSSPLWTSNMDKRILAAGDTSEKDDARKRGLSKSLDNREGKLSVKMKERISYDIHPAHGNCGSGSHLEEKMNKSNKENALSWQKSGKVTSLRVKEKDRISGSEVIRDKMKVSASDNDFYKNDVSYESRVDPNHHASGTETRNDVKNSSLKSNHKIVDPSKKNSSRHWSNEAGKQTVQKQNEIGNPVLKVDATRSTNRKIISQQNLIQNFVEENIANQVCTGSRDGKAKVIASSEDKVKRETLYVGSRTAPESQKGDMSNGHPVHASGNDVPKFARNPIDVCCKVGVNCSSESFIPDGQLSESGPVTTNSSQTASSILEEATKLKDSADHYKNSGFEFESNETYFKAALKFLHGASLLESSHSESSKHGETSQMQIYATTAKLFE

SEQ ID NO: 160715 - protein, 235 aa, Glycine max
  Coding DNA Sequence Number=SeqID_69030
  Gene Ontology: Mol. function=transporter activity; Cellular component= mitochondrial inner membrane; Biological process=transport
  Homolog annotation: Hit_ID=A7NW36; Match level="QueryCoverage=90%, HitCoverage=98%, E-value=1e-99, Identity=53%"; Hit description =Chromosome chr5 scaffold_2, whole genome shotgun sequence
  Pfam annotation: Domain name=Mito_carr; Domain location=126-216; Score=96.5; E_value=8.5e-26; Accession=PF00153.18; Description =Mitochondrial carrier protein
  Pfam annotation: Domain name=Mito_carr; Domain location=9-117; Score =112.2; E_value=1.6e-30; Accession=PF00153.18; Description =Mitochondrial carrier protein
  Pfam module annotation: Pfam domain module=Mito_carr::Mito_carr; Domain location=126-216::9-117
MEEPSKLKRAMIDSLAGAISGGISRTVTSPLDVIKIRFQVQLEPTSSWALLRKDLASATAAASKYTGMLQATKDILREEGVQGFWRGNVPALLMVMPYTAIQFTVLHKLKTFASGSSKTENHINLSPYLSYISGALAGCAATVGSYPFDLLRTILASQGEPKVYPNMRSAFMDIVHTRGFQGLYSGLSPTLVEIIPYAGLQFGTYDTFKRWGMIIFLPISEDSAHRLLLPLYVNH

SEQ ID NO: 160716 - protein, 919 aa, Glycine max
  Coding DNA Sequence Number=SeqID_69031
  Gene Ontology: Mol. function=DNA binding; Cellular component=nucleus
  Homolog annotation: Hit_ID=A7NW34; Match level="QueryCoverage=95%, HitCoverage=95%, E-value=1e-171, Identity=42%"; Hit description =Chromosome chr5 scaffold_2, whole genome shotgun sequence
MECLKLVRHLVDAVQVNDLNCIDEQSLSPEYSGVYDAFGEPDIFPRVGDQYQVEIPSLISKSDYYWLLRNPHEAESTASRTLHKFRVGLPIPIIWIKDVENNRHDHQKNACKSNGVTNKIESSKLECIEETLNGLDCDKLKPKLGSVDSTLVKLGESGNSNMQQETEIEMCKKHRDKGHCLVPGAASDTWNQIEEASFILGLYIFGKNLVQVKRFIGNKKMGDILSFYYGKFYKSDKFQRWSGCRKMRSRKCIYGQKIFTGPRQQELLSRLLPTVSGECYNKLLEVSKAFVEGKMLLEDYVLTLKASVGLKALVEGVGVGKGKEDLTGLAIDSMKSTQVLPARQEIPVGKACSLLTPSEIISFLTGDFRLSKARTSDLFWEAVWPRLLARGWHSEQPDSHNYAATSKYSLVFLVPGVKKFSRKLVKGNHYFDSVSDVLCKVASDPELIELETIADNDCTSKEGNGWTKDTKLDRENSPDQPRHCYLKVKTPNHSTDVMKFTVVDTSLASEKMTKVRELRSLPFEILKACTFENDSDDENTSEEQTNESESVNTTCLDREKNDITKASKSNTGKCVSSLLNCLEHNPSKEELPRSSMGSSSLSAASKGPKTEFLSNTLKRDGMKCPSLQRMVSDNKNDLVPVTKRRRRLTACSRAKKNSNTANFFVVPRVNQEEASFCPDPDNSKSSANVTANVFVASRVKQEEAIPHKSKCSESVLSWEIPTQEKNSSADFPTQKNKTLADPPSNPSSIINGEAVRDTSSSGNKDQCDKPQPRTMIDLNLPVPLEVEADETFVNEVAEMQQNNTGKESDDLSVVTNAKLSEQPDIHTRRQSTRNRPPTTKVLEAFAFGYLDRKEKCRNRDYLQDSSTRPSRRVSRKLAGSRNGGTDLEKEEKTDVVCNGNGNHSIDSNVIYPGSTCNER

SEQ ID NO: 160717 - protein, 210 aa, Glycine max
  Coding DNA Sequence Number=SeqID_69032
  Gene Ontology: Mol. function=transferase activity, transferring glycosyl groups; Cellular component=membrane
  Homolog annotation: Hit_ID=A7QVE1; Match level="QueryCoverage=81%, HitCoverage=39%, E-value=2e-63, Identity=64%"; Hit description =Chromosome chr2 scaffold_187, whole genome shotgun sequence
  Pfam annotation: Domain name=Exostosin; Domain location=1-174; Score=- 1.0; E_value=2.7e-09; Accession=PF03016.6; Description=Exostosin family
  Subcellular localization annotation: CTP_CleavageSite=43; ConfidenceScore=5.34e-01
MGIQLQRQTRPSALPPHGASRVGLLPVAPILQPHLPPSQPRVRRSIRSECENATSSSDSSYDTLCEIVDCSNGVCEHDPVRFMRPMLSASFCLQPPGDTTTRRSTFDAVLAGCIPVFFEELSAKAQYGWHLPEAEFEELSVFIPKEEVVFRGMRILDVLQQIPRGRVRRMRERVLELMPSVFYRKHNSSPGLKTKKDAVDLAIDGTLDKI

SEQ ID NO: 160718 - protein, 72 aa, Glycine max
  Coding DNA Sequence Number=SeqID_69033
MPRVYQWTVVVYSAVEQRKHARMAIKVEALLANEVSFFRTRFSPICCAEASTKKKFLACTNAWKQNFWALTD

SEQ ID NO: 160719 - protein, 498 aa, Glycine max
  Coding DNA Sequence Number=SeqID_69034
  Gene Ontology: Mol. function=cysteine-type peptidase activity; Cellular component=nuclear envelope; Biological process=proteolysis
  Homolog annotation: Hit_ID=A7NW26; Match level="QueryCoverage=100%, HitCoverage=83%, E-value=6e-51, Identity=44%"; Hit description =Chromosome chr5 scaffold_2, whole genome shotgun sequence
  Subcellular localization annotation: CTP_CleavageSite=35; ConfidenceScore=5.74e-01
MAVVTSNGKRRQHWPSANYHFPSPNSKRPRLPTMSQNHAQSVLSSSSIISRISTYPETKPPLHREVHAPCRPRKFDSPAFNRSAHYYRKEEISHDVGNLLSKNYQRAKNSALASIRFGEKGKEVIEVDADSSKDMVSEEDSSVEEVRFVEEDGREVRSVVTEHKWQEGDLVVTEVKDLDAKDMCGGPQQQSTSSVVSELTNGDLNVVNAEKMLDILSLTPDHDLSSVQAYKKLLDALGQRTDTLNRLEAEIKVNEKRMSTFELLRPKKELVEEVPLEPFIPLTKEEEVEVAHAFSTNRKKILVSHEKSGIEISGEKFQCLRPGAWLNDEVINVYLELLKERERREPQKFLNCHFFSTFFYKRVSFLSWKVTVMEMLSEKRLNMFCTMLLNNCYGAAITSCVAFLDPLCHSPSGICHHMELSTMEPAVLISGKNGYDFKSVRRWTSQKKLGYGLHECDKIFVPIHKEIHWCLAVINKKDKKFQYLDSLRGTDAQVMKVL

SEQ ID NO: 160720 - protein, 287 aa, Glycine max
  Coding DNA Sequence Number=SeqID_69035
  Gene Ontology: Mol. function=cysteine-type peptidase activity; Biological process=proteolysis
  Homolog annotation: Hit_ID=A7NW26; Match level="QueryCoverage=20%, HitCoverage=12%, E-value=3e-21, Identity=77%"; Hit description =Chromosome chr5 scaffold_2, whole genome shotgun sequence
  Pfam annotation: Domain name=RnaseH; Domain location=98-234; Score= -35.4; E_value=0.083; Accession=PF00075.15; Description=RNase H
MFIIDVYQASYIVDEVKDKTGKDIDVSSWKKEFVEDLPEQQNGYDCGVFMIKYADFYSRNLGLCFNQIVDWTDYTYHPDIQSPSYQIQRGFLQVWGRINSNCDGAVSGGVAACGRVLRNQAGAVVVFAHNLGMCSISQAEIWAITMGVKLAWDKGFTNLYVESDFKYAIEMMDGIQCEERHILGATFSVRQTRQQMLLLNLALMLDGQSKVFYSTPSFLSAHVLADVAALLGESMIDDGSYKDGATDPTLLCFAFALWEVKCTHNLHLLKVSQAYVLERDMSSTPFD

SEQ ID NO: 160721 - protein, 254 aa, Glycine max
  Coding DNA Sequence Number=SeqID_69036
  Homolog annotation: Hit_ID=A7Q8D5; Match level="QueryCoverage=83%, HitCoverage=52%, E-value=1e-30, Identity=43%"; Hit description =Chromosome chr5 scaffold_64, whole genome shotgun sequence
  Subcellular localization annotation: CTP_CleavageSite=77; ConfidenceScore=5.51e-01
SSVKLKDKRCSGSSLKTDIVVEQDNTNSPNTASASASSFERKVSRSRSVGCGSRSFSGDFFERISTGFGDCTLRRVESQREGKPKGIGGGSSAVSRGGEHHHHHHCMKERVRCGGLFSGFMMTSSSSSSSSSSYWVSSSADDAAAAAAVNGKSATVALSHNRGRSWGWAFASPMRAFSGKPSSKESNRRDIIRGASDKNATPNLSAIPSLLALWAILWEIRILAGGSEWSVFEKREISRRKSRCIAFSVITWLV

SEQ ID NO: 160722 - protein, 81 aa, Glycine max
  Coding DNA Sequence Number=SeqID_69037
  Gene Ontology: Mol. function=3-hydroxyacyl-CoA dehydrogenase activity; Cellular component=glyoxysome; Biological process=fatty acid metabolic process
  Homolog annotation: Hit_ID=A7Q8E4; Match level="QueryCoverage=53%, HitCoverage=5%, E-value=2e-12, Identity=69%"; Hit description =Chromosome chr5 scaffold_64, whole genome shotgun sequence
ETTRKGFYLYDDKRKASPDPELKNYIQKARSFTGFSVDPKVLQSKHLILIFLLSWAWVFHLRGEVSYSGLTLLDPSTYVQD

SEQ ID NO: 160723 - protein, 693 aa, Glycine max
  Coding DNA Sequence Number=SeqID_69038
  Gene Ontology: Mol. function=catalytic activity; Cellular component =nucleus; Biological process=metabolic process
  Homolog annotation: Hit_ID=A7PEJ0; Match level="QueryCoverage=100%, HitCoverage=100%, E-value=0.0, Identity=65%"; Hit description =Chromosome chr11 scaffold_13, whole genome shotgun sequence
  Pfam annotation: Domain name=PPR; Domain location=121-155; Score =40.2; E_value=7.5e-09; Accession=PF01535.11; Description=PPR repeat
  Pfam annotation: Domain name=PPR; Domain location=222-256; Score =51.0; E_value=4e-12; Accession=PF01535.11; Description=PPR repeat
  Pfam annotation: Domain name=PPR; Domain location=288-322; Score =46.7; E_value=8e-11; Accession=PF01535.11; Description=PPR repeat
  Pfam annotation: Domain name=PPR; Domain location=389-423; Score =50.2; E_value=7.5e-12; Accession=PF01535.11; Description=PPR repeat
  Pfam annotation: Domain name=PPR; Domain location=424-458; Score =16.4; E_value=0.089; Accession=PF01535.11; Description=PPR repeat
  Pfam annotation: Domain name=PPR; Domain location=459-493; Score=8.8; E_value=0.71; Accession=PF01535.11; Description=PPR repeat
  Pfam annotation: Domain name=PPR; Domain location=59-93; Score=13.5; E_value=0.2; Accession=PF01535.11; Description=PPR repeat
  Pfam module annotation: Pfam domain module=PPR::PPR::PPR::PPR::PPR::PP R::PPR; Domain location=121-155::222-256::288-322::389-423::424 -458::459-493::59-93
MKVKQKLHQAIDLLYSHGLASFDDYTRLVLHCARANDFIQAKRLQSHMELNLFQPKDSFIHNQLLHLYAKFGKLSDAQNVFDNMTKRDVYSWNTLLSAYAKMGMVENLHVVFDQMPYRDSVSYNTLIACFASNGHSGKALKVLVRMQEDGFQPTQYSHVNALQACSQLLDLRHGKQIHGRIVVADLGENTFVRNAMTDMYAKCGDIDKARLLFDGMIDKNVVSWNLMISGYVKMGNPNECIHLFNEMQLSGLKPDLVTVSNVLNAYFRCGRVDDARNLFIKLPKKDEICWTTMIVGYAQNGREEDAWMLFGDMLRRNVKPDSYTISSMVSSCAKLASLYHGQVVHGKVVVMGIDNSMLVSSALVDMYCKCGVTLDARVIFETMPIRNVITWNAMILGYAQNGQVLEALTLYERMQQENFKPDNITFVGVLSACINADMVKEGQKYFDSISEHGIAPTLDHYACMITLLGRSGSVDKAVDLIQGMPHEPNYRIWSTLLSVCAKGDLKNAELAASHLFELDPRNAGPYIMLSNLYAACGRWKDVAVVRSLMKEKNAKKFAAYSWVEVGNKVHRFVSEDHYHPEVGKIYGELNRLISILQQIGYNPDTNIVLHNVGEEEKFRSISYHSEKLALAFALIRKPNGVAPIRIIKNIRVCDDCHVFMKFASITISRPIIMRDSNRFHHFFGGKCSCNDNW

SEQ ID NO: 160724 - protein, 77 aa, Glycine max
  Coding DNA Sequence Number=SeqID_69039
MAPPAAKLREIGLEGFALWCRGRRASSNNGVFPASQGRWVVQVPNDEMEELALNSNQANCKFCCDCGTTFLSPVSLR

SEQ ID NO: 160725 - protein, 225 aa, Glycine max
  Coding DNA Sequence Number=SeqID_69040
  Gene Ontology: Mol. function=isomerase activity; Cellular component =mitochondrial inner membrane; Biological process=metabolic process
  Homolog annotation: Hit_ID=Q45W70; Match level="QueryCoverage=72%, HitCoverage=92%, E-value=9e-64, Identity=66%"; Hit description =Isomerase-like protein
  Pfam annotation: Domain name=FAA_hydrolase; Domain location=30-154; Score=90.9; E_value=4.1e-24; Accession=PF01557.9; Description =Fumarylacetoacetate (FAA) hydrolase family
MAVAGCQKLLELSTKIVAVGRNYAAHAKELGNAVPKEPVLFLKPTSSYLKNGGTIQIPHNEGSLHHEVELAVVIAKKARDVSESSAMDYVAGYALALDMTARDLQAAAKLPKTAVPNPDDLELWLKPKLELGLEIGSLPALTSGTPPGVGPVKEGQTITAGVTGLVDQELKDRGAMKSRTKGDNISEFLKEIVDVLADLIRPFLMEKVTSPFKYNYFLQKRYISL

SEQ ID NO: 160726 - protein, 160 aa, Glycine max
  Coding DNA Sequence Number=SeqID_69041
  Gene Ontology: Mol. function=hydrolase activity; Cellular component =cytoplasm
  Homolog annotation: Hit_ID=A7NWE4; Match level="QueryCoverage=88%, HitCoverage=58%, E-value=3e-47, Identity=61%"; Hit description =Chromosome chr5 scaffold_2, whole genome shotgun sequence
  Pfam annotation: Domain name=DLH; Domain location=1-159; Score=-32.1; E_value=4.7e-05; Accession=PF01738.9; Description=Dienelactone hydrolase family
MSGFYNFIIIFATGLPPFQEKGIETAKPVIEALKREGASAIGAAGFCWGGKTVTDLGKSKHVQASVLLHPAYVEVDDIRGIKTPIAILGGQNDTITPPKLIKQFKQALQNAKPKVDSFVKIFPNVSHGWTVRYDPKDPKAVKAAEKAHDIMIGWFDKYLK

SEQ ID NO: 160727 - protein, 116 aa, Glycine max
  Coding DNA Sequence Number=SeqID_69042
  Gene Ontology: Mol. function=structural constituent of ribosome; Cellular component=ribonucleoprotein complex; Biological process =translation
  Homolog annotation: Hit_ID=Q9LX88; Match level="QueryCoverage=84%, HitCoverage=75%, E-value=2e-48, Identity=95%"; Hit description=40S ribosomal protein S15a-4
  Pfam annotation: Domain name=Ribosomal_S8; Domain location=5-102; Score=98.3; E_value=2.5e-26; Accession=PF00410.10; Description =Ribosomal protein S8
MVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQSLISIKRMSGISIEIHGL

SEQ ID NO: 160728 - protein, 596 aa, Glycine max
  Coding DNA Sequence Number=SeqID_69043
  Gene Ontology: Mol. function=RNA binding; Cellular component=nucleus; Biological process=regulation of transcription, mating-type specific
  Homolog annotation: Hit_ID=A7Q8H8; Match level="QueryCoverage=98%, HitCoverage=99%, E-value=0.0, Identity=63%"; Hit description =Chromosome chr5 scaffold_64, whole genome shotgun sequence
  Pfam annotation: Domain name=PUF; Domain location=107-141; Score =15.2; E_value=0.19; Accession=PF00806.10; Description=Pumilio-family RNA binding repeat
  Pfam annotation: Domain name=PUF; Domain location=143-178; Score=6.9; E_value=1.9; Accession=PF00806.10; Description=Pumilio-family RNA binding repeat
  Pfam annotation: Domain name=PUF; Domain location=179-213; Score=9.7; E_value=0.86; Accession=PF00806.10; Description=Pumilio-family RNA binding repeat
  Pfam annotation: Domain name=PUF; Domain location=292-327; Score=6.8; E_value=1.9; Accession=PF00806.10; Description=Pumilio-family RNA binding repeat
  Pfam module annotation: Pfam domain module=PUF::PUF::PUF::PUF; Domain location=107-141::143-178::179-213::292-327
MAAKKQDAGDTKKRKRLNTEAPKASKLVASKKHKPDSVAKDNKNKKTAPLTGRERRLHAKELADARKKKRKRHFTLEQELARLWEKMRRHKIAKEDRAKLVTEALRKMKGKIPEIVGSHISSRVLQTCVKHCSQAERDAVFEELRPHFLTLAFSAYAVHLVKKMLDNASKKQLAGFISTLRGHVAPLLRHMVGSIVVEHAYELANAAQKQELLSELYSTELQLFKDLVSLKESRLSDVMSKLGLQKGSVLRHMTSVIQPILEKGIVDHSILHRVLMEYFSIADKERKKIIKGLKGHIDKTAYHQYGCMVLVCILSVVDDTKLITKVIIRELQSILKELVLDKNGRRLLLQLLHPNSSRYFSPDDLASLNLSIPSLSLKDQSEASFLTETSKVSLGDKESKEDIEVAVDEVNKDKTSADDSDLAESGKKDPFVRRQELLIKSGLADSLLDICIESVGELIRSNFGKEVLYEVATGGSDGIMHPVLDDKINSLHNAVASLAALPKSEDSQEEHVLENFHSSRTIRKLILDCPNFASTLWEKALKGKSELWVHGHSCKVISAFLESPDPTVLKLVKKELQPLIDIGILKNPKPIEQANQ

SEQ ID NO: 160729 - protein, 225 aa, Glycine max
  Coding DNA Sequence Number=SeqID_69044
  Homolog annotation: Hit_ID=A7Q8H5; Match level="QueryCoverage=96%, HitCoverage=75%, E-value=7e-79, Identity=62%"; Hit description =Chromosome chr5 scaffold_64, whole genome shotgun sequence
MAIPLPSLDLTHHSDFEPLVSPDGYISICGYGSLLSETSARTTFPDLVNFRIARLTGFRRLFNSVGRIFFTHRVANIKTQEIAGLSVEPCDGEFVVVAVFEIKNTEVVPETLDGKPFINPAVLCASYTDEEFFKFRCSEGREKYFEQYGEYKIHKIWRDDVFPCRVYLRHCVLAAKSLGDEVHNNFLDHTFLADRKTTIRQYFEKVGTSILEEEPPESLKTRYGG

SEQ ID NO: 160730 - protein, 171 aa, Glycine max
  Coding DNA Sequence Number=SeqID_69045
  Gene Ontology: Mol. function=aspartic-type endopeptidase activity; Cellular component=small subunit processome; Biological process=DNA integration
  Homolog annotation: Hit_ID=A5CB76; Match level="QueryCoverage=88%, HitCoverage=52%, E-value=3e-18, Identity=32%"; Hit description =Putative uncharacterized protein
  Pfam annotation: Domain name=zf-CCHC; Domain location=126-143; Score =11.3; E_value=0.03; Accession=PF00098.14; Description=Zinc knuckle
MKVTALKQTSHDMIAHIGKARAAVEELKRFLVAESLEEVNRKLDKFYMVLILRSLHSDFDHVRDQVLAGDQVPSMDSLITRLLRVPHALKEENPADVVETSAMAAPRGRGGGRNSRGGRGGRGGRPQCTYCKRMGHTQETCYSLHGFPDKVAQVTQTETEKSESKFSDKEY

SEQ ID NO: 160731 - protein, 85 aa, Glycine max
  Coding DNA Sequence Number=SeqID_69046
MKKRAVATEKQRKMKQANKPGNCLTIRQYKKEATIGKIRSFANIIDLNKSDSYNADSESQNIVPYLPWYAEKIRNSSVKITLGRN

SEQ ID NO: 160732 - protein, 70 aa, Glycine max
  Coding DNA Sequence Number=SeqID_69047
MHFGMPTTVLVQGELTGTGAGGELTEIGVGGELTCVIAGVAAGGVATGGVFVGAGATALDGGDATVGDET

SEQ ID NO: 160733 - protein, 374 aa, Glycine max
  Coding DNA Sequence Number=SeqID_69048
  Gene Ontology: Mol. function=catalytic activity; Biological process =metabolic process
  Homolog annotation: Hit_ID=A7Q8M2; Match level="QueryCoverage=98%, HitCoverage=99%, E-value=1e-140, Identity=63%"; Hit description =Chromosome chr5 scaffold_64, whole genome shotgun sequence
  Pfam annotation: Domain name=Epimerase; Domain location=8-259; Score=- 46.0; E_value=0.00097; Accession=PF01370.12; Description=NAD dependent epimerasedehydratase family
MEAQASVALIVGVTGLTGLSLAETLKKPNCLGGPWKVYGAARRPPPSWFSPSMVDHFITFDAEDSSDTRAKLSPIAHEVTHLFWVTFQIHADEEYNATVNKTMLLNLLTALKSSTTSRLAHVTVQTGTKHYMGPVFDPVHSTQLIGHQPPFDENMPRLPYPNFYYALEDLVASYAPSLTYSVHRSSIIIGASSRSVYNALLTLATYAVICRHVGLAFRYPGTRYTWEHFCDMTDAGVLAQQHVWAAVTPNAKNQAFNCTNGDVFAWKTVWKLLAELFDVEFVAFDESHKFDLAELMHDKGSVWEEIVEKYELHNTKLEEITCYEALQTVLHFKFQHVSAMNKSREHGFFGHVDTLKSIRFWVKKLRQMKIMPSY

SEQ ID NO: 160734 - protein, 409 aa, Glycine max
  Coding DNA Sequence Number=SeqID_69049
  Gene Ontology: Mol. function=RNA binding
  Homolog annotation: Hit_ID=A7Q8L9; Match level="QueryCoverage=98%, HitCoverage=98%, E-value=2e-88, Identity=41%"; Hit description =Chromosome chr5 scaffold_64, whole genome shotgun sequence
MTIDLDSIARRVEVDNRIPIRYYYRIADNLLKQRSRAVLDELESLKPEFKRRVEKMNDSHVKAPFPEENGFNKALQSSVNSSLEWPAVSKQPTAGFSSHSSWNYDNMLSLDSRPIDKQFQKLSLSLPPPNKETLSRHSFLGPNGLRGQWLGPSAEIKRGENERIDIEYSKVDGLDMVQYPSSSDLTHAKDSSLNQAGLYDLGAIKDGDQGPVTSTMDSVLSLDDGSWLRPAVESCSPVVTESREDPLQLLNIKQPLPPPVLAQVYPEHAPIPPSKVADPRPGPAKSSHDSGLGSTTYQHLHIPVKMMEDFLRLASENTRKNLETCGVLAGSLIMLPEAIAIVMAPTDTTSPHGIFHLSDPGGVSVIRNCQQRGFHPHEEPEDGTPIYEHCSHVYMNANLKFDVVDLRER

SEQ ID NO: 160735 - protein, 194 aa, Glycine max
  Coding DNA Sequence Number=SeqID_69050
MADLQEKLDALKGLVGVLNNMDEGETHNNNATSSPNNSHSPAPMPGRNRSVGKYNNSGTQKIKVCDCGKFQELRMSCSHVVTACKHAHHEYKNYMHPAKNSMAGIASGISTLAIGSGDARRRPAQAQSTPNTNTNTNTNSNTSSSTPSSEGFTYLNSAKQDIKGLTNQTGYVKGNANGVINFGTLTASASVQRQ

SEQ ID NO: 160736 - protein, 570 aa, Glycine max
  Coding DNA Sequence Number=SeqID_69051
  Gene Ontology: Mol. function=dihydrolipoyl dehydrogenase activity; Cellular component=cytoplasm; Biological process=cell redox homeostasis
  Homolog annotation: Hit_ID=Q2HU25; Match level="QueryCoverage=95%, HitCoverage=95%, E-value=0.0, Identity=84%"; Hit description =Dihydrolipoyl dehydrogenase
  Pfam annotation: Domain name=DAO; Domain location=88-304; Score= -27.7; E_value=0.00072; Accession=PF01266.15; Description=FAD dependent oxidoreductase
  Pfam annotation: Domain name=FAD_binding_2; Domain location=88-422; Score=-131.3; E_value=0.0055; Accession=PF00890.15; Description=FAD binding domain
  Pfam annotation: Domain name=GIDA; Domain location=88-430; Score= -205.0; E_value=0.00019; Accession=PF01134.13; Description=Glucose inhibited division protein A
  Pfam annotation: Domain name=HI0933_like; Domain location=87-409; Score=-264.1; E_value=0.019; Accession=PF03486.5; Description=HI0933- like protein
  Pfam annotation: Domain name=Pyr_redox; Domain location=257-358; Score=87.7; E_value=3.6e-23; Accession=PF00070.18; Description =Pyridine nucleotide-disulphide oxidor
  Pfam annotation: Domain name=Pyr_redox_2; Domain location=88-409; Score=141.3; E_value=2.7e-39; Accession=PF07992.5; Description =Pyridine nucleotide-disulphide oxidore
  Pfam annotation: Domain name=Pyr_redox_dim; Domain location=438-551; Score=153.2; E_value=7e-43; Accession=PF02852.13; Description =Pyridine nucleotide-disulphide oxidored
  Pfam module annotation: Pfam domain module=DAO::FAD_binding _2::GIDA::HI0933_like::Pyr_redox::Pyr_redox_2::Pyr_redox_dim; Domain location=88-304::88-422::88-430::87-409::257-358::88-409::438-551
  Subcellular localization annotation: CTP_CleavageSite=67; ConfidenceScore=5.82e-01
MHSSLSLSFSATSSSAATVSRSRHSFHSPAVATPLNLRFCGLRREAFASGLAASRNRHHSHLPRRPRSAAVSAALSSNGIPPKSFDYDLLIIGAGVGGHGAALHAVEKGLKTAIVEGDVVGGTCVNRGCVPSKALLAVSGRMRELKSDHHLKSFGLQVSAAGYDRQGVADHANNLASKIRNNLTNSMKALGVDILTGFGTILGPQKVKVGSSDKIVTAKDIIIATGSVPFVPKGIEIDGKTVITSDHALKLESVPDWIAIVGSGYIGLEFSDVYTALGSEVTFIEALDQLMPGFDPEISKLAQRVLINPRNIDYHTGVFATKITPARDGKPVLIELIDAKTKEPKDTLEVDAALIATGRAPFTQGLGLENIDVVTQRGFVPVDERMRVIDANGKLVPHLYCIGDANGKMMLAHAASAQGISVVEQVTGRDLVLNHLSIPAACFTHPEISMVGLTEPQAREKGEKEGFEVSVAKTSFKANTKALAENEGEGLAKLIYRPDNGEILGVHIFGLHAADLIHEASNAIALGTRIQDIKFAVHAHPTLSEVLDELFKSAKVKAQASSPVSEPVAV

SEQ ID NO: 160737 - protein, 63 aa, Glycine max
  Coding DNA Sequence Number=SeqID_69052
  Gene Ontology: Mol. function=endonuclease activity; Cellular component=nucleus; Biological process=tRNA processing
  Homolog annotation: Hit_ID=Q8LGU7; Match level="QueryCoverage=65%, HitCoverage=14%, E-value=5e-12, Identity=75%"; Hit description =Nuclear ribonuclease Z
MKPPTIIVPISVKEDAEKLFEIHRKMDQSELKHNLIGLDVGVIDDAAHYFKDAYDSMIDSLFL

SEQ ID NO: 160738 - protein, 193 aa, Glycine max
  Coding DNA Sequence Number=SeqID_69053
  Gene Ontology: Mol. function=catalytic activity; Cellular component =mitochondrion; Biological process=metabolic process
  Homolog annotation: Hit_ID=Q9SMK7; Match level="QueryCoverage=70%, HitCoverage=51%, E-value=2e-62, Identity=88%"; Hit description =Putative enoyl CoA hydratase
  Pfam annotation: Domain name=ECH; Domain location=77-191; Score=30.2; E_value=1.9e-09; Accession=PF00378.11; Description=Enoyl-CoA hydrataseisomerase family
MLTTVYTVVFIVGDEDEDVEVVAGRVVQERSGRKATKKMSKKSDTEGAPVQDRFGSNMDGKSPEKLILVNREPNGVALVTINRPGSLNSLTRPMMVDLAQAFKRLDRDELVRVIILTGSGRSFCSGVDLTAAEDVFKGDVKDPESDPVVQMELCRKPIIGAIRGFAVTAGFEIALACDILVAAKGSKFMDTHA

SEQ ID NO: 160739 - protein, 133 aa, Glycine max
  Coding DNA Sequence Number=SeqID_69054
MALTPRLIRLLISLVEESLKETLLPSEKITEEVGIGSIKCLDAYELDSSMFNAKPKVFNSQTAAPQYKKLMDEITKYVIEDLYKNTVPEDFDRSHQVQSAKNQVVLLWFCIWLIGVLAIFFFISDIHCPYLNY

SEQ ID NO: 160740 - protein, 391 aa, Glycine max
  Coding DNA Sequence Number=SeqID_69055
  Gene Ontology: Mol. function=protein serine/threonine kinase activity; Cellular component=cytoplasm; Biological process=protein amino acid phosphorylation
  Homolog annotation: Hit_ID=A7NWE3; Match level="QueryCoverage=92%, HitCoverage=62%, E-value=1e-154, Identity=77%"; Hit description =Chromosome chr5 scaffold_2, whole genome shotgun sequence
YTPAIDIWSIGCIFAELLTGKPLFPGKNVVHQLDLMTDFLGTPSPEAIARVRNEKARRYLCCMRKKKPVPFSQKFPNVDPLALRVLERMLAFEPKDRPTAEEALAYPYFKGLAKVEREPSAQPVTKMEFEFERRRITKEDVRELIYREILEYHPKMLKEHLEGEEPTGFMYPSAVDHFKKQFAYLEEHYGKAGTVTPPERQHASLPRPCVLYSDNSRQNMAEVADDISKCIIKEVEKPAMDRTGGIPMTRLPLQAPQNIQGVMTDRIASGVAARPGKVVGSILHYNNCGAAVTADAEQRRMGRNPSVSAQYAAPSSSYPRRNPSCKSERAEEVIEGANGLQTKPQHITQKVAAAALGGPGAYQVSWPTRNADQSSELNKDMRGHSIDNIEG

SEQ ID NO: 160741 - protein, 249 aa, Glycine max
  Coding DNA Sequence Number=SeqID_69056
  Homolog annotation: Hit_ID=A2Q675; Match level="QueryCoverage=90%, HitCoverage=99%, E-value=1e-35, Identity=45%"; Hit description =Putative uncharacterized protein
MDLKSAKDEDTEVDLESGLVLTDDESKDVSTEDCIKGEDRYSGFCKESKLTVVSMDMVKVTNKLYSVEYAENNTPEKEKRKKSSNKKSPKPPRPPRAPSLDAADQKLIREITELAMLKRARIERMKALKKMKVAKASSSSSSSMLATVFTVVFCIVILLQGMSSGKSSVTSFQGSPVPAGLMEGGLIDVQHQLNPSSSDPNAPSLEPHKIVQQVTGLDLPAKLRRGAVTSSATSCCIHVEIQSRRRFCF

SEQ ID NO: 160742 - protein, 254 aa, Glycine max
  Coding DNA Sequence Number=SeqID_69057
  Gene Ontology: Biological process=response to stress
  Homolog annotation: Hit_ID=A7Q8T7; Match level="QueryCoverage=75%, HitCoverage=63%, E-value=1e-52, Identity=54%"; Hit description =Chromosome chr5 scaffold_64, whole genome shotgun sequence
MESSAVWLSEKKITNCGGVTVAKARLYRRSDDNRGSGWERSLIYGGAMVLWVVVWHGEVAHGYGLDAFAPGLAQGGPPPIGGQKANLDPLTEDLTLQSGLALIGRLRAIKRAVKGFPRPLINLNKELFAQIVDQAFGQPLNPPFDPYANSLNYQLAAYITTVVGPNIYVGIIPKLQNTESKELFAGLLGTASGGRTSRRAYLYERWDSPVPPYKVTVAEFTNRISERANKLGMEGIKSEGIVVSPWNGAEGKVS

SEQ ID NO: 160743 - protein, 641 aa, Glycine max
  Coding DNA Sequence Number=SeqID_69058
  Gene Ontology: Mol. function=hydrolase activity, hydrolyzing O -glycosyl compounds; Cellular component=peroxisome; Biological process=carbohydrate metabolic process
  Homolog annotation: Hit_ID=Q1M320; Match level="QueryCoverage=88%, HitCoverage=89%, E-value=0.0, Identity=90%"; Hit description =Putative beta-glycosidase
  Pfam annotation: Domain name=Cellulase; Domain location=162-496; Score=-83.0; E_value=0.063; Accession=PF00150.9; Description =Cellulase (glycosyl hydrolase family 5)
  Pfam annotation: Domain name=Glyco_hydro_1; Domain location=171-534; Score=-5.3; E_value=2e-18; Accession=PF00232.9; Description=Glycosyl hydrolase family 1
  Pfam module annotation: Pfam domain module=Cellulase::Glyco_hydro_1; Domain location=162-496::171-534
  Subcellular localization annotation: CTP_CleavageSite=25; ConfidenceScore=5.37e-01
MTVVGLFLTATKLAGALFTLTVAANAFSYSRFRKKNLRRFRSPIDESQDTLAHFNIAGEDEFFFGLATAPAHVEDRLDDAWIQFAEKKRGGGGGDSEGKQRVDAVIGSASGDGGSQQAITSPRSRKPLKVAMEAMIRGIEKYMEVEVQEGEEEARPNVTAWHNVPRPEERLRFWSDPETEIKLAKDTGVTVFRMGIDWTRIMPMEPVNSLNESVNYAALERYKWIINRVRSYGMKVMLTLFHHSLPPWAGEYGGWKLEKTVDYFMDFTRLVVDSVSDLVDYWVTFNEPHVFCMLTYCAGAWPGGHPDMLEAATSALPTGVFQQAMHWMSIAHSKAYDYIHGLSNPLNSIVGVAHHVSFMRPYGLFDIAAVSLANSLTLFPYIDDISEKLDYIGINYYGQEVVSGAGLKLVENDEYSESGRGVYPDGLYRMLLQYHERYKHLNIPFIITENGVSDETDLIRRPYLLEHLLAIYAAMIMGVRVLGYLFWTISDNWEWADGYGPKFGLVAVDRANNLARIPRPSYHLFSKIVNTGKVTREDRERAWDELQRSAKEKKTRPFYRAVDKHCLMYAVVEREEFRRFMMKLSTLKRDMLCVKRAKSENKIGFTESPCLSPNLEVLKQNNQVNGSTQEPRLSVTFCAFK

SEQ ID NO: 160744 - protein, 233 aa, Glycine max
  Coding DNA Sequence Number=SeqID_69059
  Gene Ontology: Mol. function=oxidoreductase activity; Cellular component=cytoplasm; Biological process=response to red or far red light
  Homolog annotation: Hit_ID=Q4W8C1; Match level="QueryCoverage=95%, HitCoverage=60%, E-value=5e-83, Identity=72%"; Hit description =Gibberellin 2-oxidase
  Pfam annotation: Domain name=2OG-FeII_Oxy; Domain location=42-175; Score=80.8; E_value=4.3e-21; Accession=PF03171.11; Description=2OG -Fe(II) oxygenase superfamily
STLSAYTEAVRELACEILELIAEGLGVPDTRAFSRFIRDVDSDSVLRLNHYPPIINKDKDKDMSQYSKVGFGEHSDPQIITILRSNDVGGLQISLQDGVWIPVTPDPSAFYVNVGDVLEHDDKFGTRVGTKMEVIDMVLCGVNKVMTNGRFVSVRHRAMTNSYKCRMSVAYFGAPPLHATIVAPSVMVTPQRPSLFRPFTWADYKKATYSLRLGDTRIQLFTNRLTTNHHPKV

SEQ ID NO: 160745 - protein, 263 aa, Glycine max
  Coding DNA Sequence Number=SeqID_69060
MPSSVKVNHGGNFIRNPILKYVGGEKALLLDIDEDKWSFFELIGILKDDVNYKGDFNLWWTGVHDVGLKELALDNDALELANFSLSNNPETLDDGDEVVGVEVVVSEFDSSDTESNESGSESGFDNDNEGVVFEDSEEEREIRVNDGFDSEDECLVNLVSKKKCRKASCVGSSGSHRNVEEGNGFEFDEDKHKFVRYRKSKVEILSSRLVLKIAAKKLKSNDDVKLTHIMDVVRLKYGIGITLVVAWEARMIAKARMDGDAVR

SEQ ID NO: 160746 - protein, 89 aa, Glycine max
  Coding DNA Sequence Number=SeqID_69061
  Gene Ontology: Mol. function=aspartic-type endopeptidase activity; Biological process=DNA integration
  Homolog annotation: Hit_ID=A5AKY6; Match level="QueryCoverage=94%, HitCoverage=7%, E-value=1e-27, Identity=70%"; Hit description =Putative uncharacterized protein
MALEERKVKIEKFDGRDFSFWKMQIEDYLYQKKLYQPLSGVKPEDMKQEEWNLLDRQALGVIRLTLAKNVAFNIVNEKTTVGLMKSLSD

SEQ ID NO: 160747 - protein, 457 aa, Glycine max
  Coding DNA Sequence Number=SeqID_69062
  Homolog annotation: Hit_ID=A5BPP1; Match level="QueryCoverage=85%, HitCoverage=20%, E-value=2e-56, Identity=34%"; Hit description =Putative uncharacterized protein
MQKQDVAYLNAQKKIWLLMGRKEDKLVSWEKYIYPNILEKSNIAAEKATLFSQLQSTTEKLEKLSEKSNLLENSLFDVNAELEGLRVKSKVLEDTCRSLDHEKSSICQEKETLVSQLNITHQTLKDLEKLHSELELKHLELKGERESALQKVEELLVSLYSEREENSKVLKLNEDELAEKELQILILQEDANCKKKEYEEEVDRAIHAQLEIFILQKCIDDFEKKNLSLLVECQRLLEASKMSDKMISKLETENVQKHVDVNSLSEKIKILRIGLIQVLKTLDNNSGHFGEDMLEEDQMLLNHIYGKLQERQKSFDTIFNGSQQMAIENSILIAFLEKLKLKVENLVRKIAENIKISTLNNKKEVQYNKTTKIEELSDQLIPVPEPANLFLHETSTQELGASSRPRPVQWKKATMSKRRGSMLNVKERTKQKWEETCARVQRKDKQKHRLGFKERSS

SEQ ID NO: 160748 - protein, 504 aa, Glycine max
  Coding DNA Sequence Number=SeqID_69063
  Homolog annotation: Hit_ID=Q2HTA0; Match level="QueryCoverage=69%, HitCoverage=60%, E-value=8e-22, Identity=26%"; Hit description=IMP dehydrogenase/GMP reductase, related
  Pfam annotation: Domain name=DUF1723; Domain location=160-202; Score =19.5; E_value=0.0026; Accession=PF08330.1; Description=Protein of unknown function (DUF1723)
MVRTRGLHRSLGRGIGRAWGGLDEHHPDDVPRRSRPTASVRRQQVRVSVPEEVADMTKDVPQMTTGVPAAGVEGLVADDVVVGSVADDAEGFPGGPRDPSVLTSFPNHVAHNIWTRDERPDMKLASHGRKVEKIGRPTPKIEGLVAAIGLSPLIGRLVVTGDLGLISALVESFHLLMGQLTITLDDVASLLHLPITGALHSFEPLVVEEAVVLLMKLLEVLGQEARVETAQACRAYVRLSWVRDIYQSRCEARWWSLPACAYLLHLVGCTLFGNKSATHVHVVHLEAFRDMGESGSAGYMCTFLVFMTASLTMRTMRHPHVPTAPAYQTRLDALTITDVPWMPYGDHRGVKGVELILCFQGQVRWGPIVVIVRPDRVIRQFGYIQTIPPPPVSASLSYEDINDKWMHYEDHIADGGEIFVVPGQVSADYMEWFFRISHPFVTPTQAAIAERLERVLSLRMVTKGTKLHEIVEDCLRIARGVTAQMKMLGRDEDDAQIIDRSFYV

SEQ ID NO: 160749 - protein, 237 aa, Glycine max
  Coding DNA Sequence Number=SeqID_69064
  Gene Ontology: Mol. function=calcium ion binding
  Homolog annotation: Hit_ID=A7NWD9; Match level="QueryCoverage=97%, HitCoverage=42%, E-value=1e-113, Identity=86%"; Hit description =Chromosome chr5 scaffold_2, whole genome shotgun sequence
MDASVIAEYDPKSDLLDQEFMLKGKWYQRKDVEIKNSRGDVLQCSHYLPIGCADWVKCLYDSGCRADASEAAIILLPSNITVFTLDFSGSGISGGEHVTLGWNEKDDLKAVVNYLRDDGNVSLIGLWGRSMGAVTSLMYGAEDPSIAGMVLDSPFSDLVDLMMELVDTYKVRLPKFTVKFAIQYMRRAIQKKAKFDIMDLNTIKVAKSCFVPALLGHAIDDDFIQPHHSDRIFEAYM

SEQ ID NO: 160750 - protein, 31 aa, Glycine max
  Coding DNA Sequence Number=SeqID_69065
MEPLKVRKFGFWVDGVAVSSKSVEAYYKEVF

SEQ ID NO: 160751 - protein, 134 aa, Glycine max
  Coding DNA Sequence Number=SeqID_69066
MAVTTVPEGDREQRGGKDGGAEQIVANIGEGTYGVVYKGRDHISNETITLKKIRRGYYPNTNVSDFESVRILVWGEVVSSLSKNPTAVEARAMFKKFIRKFEEAYQKHNSFVTDTTSILLEAIGYIRFLQSQIE

SEQ ID NO: 160752 - protein, 48 aa, Glycine max
  Coding DNA Sequence Number=SeqID_69067
MSVKNLVGRLGVHDKTNHTLGDKSGSRCFTRMLQPCALLENTLSTSVI

SEQ ID NO: 160753 - protein, 59 aa, Glycine max
  Coding DNA Sequence Number=SeqID_69068
MGLVDSSLVPSSALSLSPCFSLKIMRPHMEKIKQEIEDKAMDPVAVAEGQKRMKKLFKE

SEQ ID NO: 160754 - protein, 60 aa, Glycine max
  Coding DNA Sequence Number=SeqID_69069
MGNGIGGGSKWWWCGGGIKSDVGCAVLVVVAMTLDKGDIGGGCGGNGCGSRNDNDGSSGQ

SEQ ID NO: 160755 - protein, 49 aa, Glycine max
  Coding DNA Sequence Number=SeqID_69070
MASHSTSLINGIPINEASNLGWQQPQIWHTSVDKLLLVVPAAVVSIAGN

SEQ ID NO: 160756 - protein, 86 aa, Glycine max
  Coding DNA Sequence Number=SeqID_69071
MEKRVREGTRRRRKRERVNGEEESASKIVCDLNVVGLDLINEMSITSYKCIRSIIKFTVLGPKRRLCNINLGHGGLSFKRVKTSQE

SEQ ID NO: 160757 - protein, 75 aa, Glycine max
  Coding DNA Sequence Number=SeqID_69072
MRNANLHDNDFVKFAEEAMMKKRRGDRRACLCDFQDKQLYETACGIGSRFHIAIGALVTHCGVELYGGGCERWGA

SEQ ID NO: 160758 - protein, 122 aa, Glycine max
  Coding DNA Sequence Number=SeqID_69073
MAKPAFFFLFLHESRQTNWRIHVDQQHQQFHHFDWRKLHNDGCADGCLDKKTCGHGVSRQWEWRNPMHEESAFDVGGIRYCILVLYGKVNSRRQTGQGRNREKGTGKAVRVTQQNDAWAREE

SEQ ID NO: 160759 - protein, 2378 aa, Glycine max
  Coding DNA Sequence Number=SeqID_69074
  Gene Ontology: Mol. function=transferase activity, transferring phosphorus-containing groups; Cellular component=chloroplast; Biological process=phosphorylation
  Homolog annotation: Hit_ID=Q42910; Match level="QueryCoverage=40%, HitCoverage=99%, E-value=0.0, Identity=79%"; Hit description =Pyruvate, phosphate dikinase, chloroplast precursor
  Pfam annotation: Domain name=PEP-utilizers; Domain location=1906 -1996; Score=172.3; E_value=1.2e-48; Accession=PF00391.14; Description=PEP-utilising enzyme, mobile domain
  Pfam annotation: Domain name=PEP-utilizers_C; Domain location=2008 -2378; Score=658.3; E_value=6.2e-195; Accession=PF02896.9; Description=PEP-utilising enzyme, TIM barrel domain
  Pfam annotation: Domain name=PP2C; Domain location=54-339; Score =128.4; E_value=2.1e-35; Accession=PF00481.12; Description=Protein phosphatase 2C
  Pfam annotation: Domain name=PPDK_N; Domain location=1497-1857; Score= 643.6; E_value=1.7e-190; Accession=PF01326.10; Description=Pyruvate phosphate dikinase, PEPpyru
  Pfam annotation: Domain name=zf-C3HC4; Domain location=1362-1401; Score=11.9; E_value=0.004; Accession=PF00097.16; Description=Zinc finger, C3HC4 type (RING finger)
  Pfam module annotation: Pfam domain module=PEP-utilizers::PEP -utilizers_C::PP2C::PPDK_N::zf-C3HC4; Domain location=1906-1996::2008- 2378::54-339::1497-1857::1362-1401
MGCVHGKSCCGDSSSSDDGSRDYRELGFIHGHRKNVLAQRSLKHVPVPSHNFILEYTFLSQRGYYPDSPDKENQDSFCITTQLQGNPNVHFFGVYDGHGQFGSQCSNFVKHRLVEKLSNDPALLEDPVQAYNSAFLATNQELRSTSEIDDSMSGTTAITVLVIGDTLYVANVGDSRAVLAVRDGNHIVAEDLSSDQTPFRRDEYERVKLCGARVLSVDQVEGLKDPDIQHWGDEESRGGDPPRLWVPNGMYPGTAFTRSIGDSLAETIGVIAIPEVKTVQLTPNHLFFVVASDGIFEFLTSQTVVDMAASYMDPRDACSAIAEKSYKLWLELENRTDDITIIIVQIKGLSNSGTSGVGSDEINGGGTVMNSRTGTHEISATPGSNVYRSVRNSLSDLHSCQHVASVTSAAIERGFTEASSSLFAVSPKWYISTFQLPEHCALLLYIYWSLHFRLPTCQLKKPNPSEENTCAHLPVTQLHLHSTDLIFGRGINNELEIKGRWYTRSCDCDYHLQWIVEETHRMVDAKMISLVASCSSQMSPSVSCQEKGSRNKRKFRVDPPLGEPNKFIPAPQLKCFSYEFSAERFEITPGHGQAAACDLCGVSQDYSDGLKLGLGLYNPGTSEVGPSQSKDEPETDEINDADWSDLTEAQLEELVLTNLDTILKSAIKKIVACGYTEDVATKAILRPGICYGCKDTLSNIVDNSLAFLRNGQEIDTSREHYFEDLVQLEKYNLAELVCVLREVRPFFSVGDAMWCLLICDMNVSHACAMDCNPLSSLGNDNSTGGPSNQAESLSKAETKCPEPSLISPSKSIPTCSHNSQSKKPFVTRIPGVNNLNPQIIGGASEKEGASCGSECINKAFSAAGTSQSGLMKEKRGTVRKVHSGSTKRDYILQHKSFHKEKSYRTYGLKGSSRRGKVNGLSGLVLDKKLKSVSESSTINLKSASLQISKAVGIDTTQDSISVNFSCNAGTSTSTAFSLVNSSDSVCRSTNTSFAINAANTIPVFSCPASLSATNTDLSLSLSSKIKPSTESVCSNNEAPNSSYMGILYNNNNNNKSPRQWIPHDGKDEMILKLLPRVRELQNQLQEWTEWANQKVMQAARRLSKEKAELQTLRQEKEEVERLKKEKQSLEENTLKKLSEMENALCKVSGQVERANATVRKLEVEKAALRKEVEAAKIRATETAASCQEVSRREKKTQMKFQSWEKQKSLFQEELTIEKRKLAQLLQELEQARMQQEQVEGRWQQEAKAKEEFILQASSIKKEREQIEESGKSKEDAIKLKAERNRQMYRDDIHKLEKEISQLRLKTDSSKIAALRMGIDGCYASKCLDMKNGTAQKEPRASFISELVIDHSATGGVKREQECVMCLSEEMSVLFMPCAHQVVCKTCNELHEKQGMQDCPSCRSPIQQRIAKEDRSEMSSIVKGIFIRSTADVCNNSILLNGKNKHSEIVGGRSTRVQWQLRLRSKSNTWKRGSRRSYQPPIRGQAILTPATPSTTKKVFTFGKGRSEGNKAMKSLLGGKGANLAEMATIGLSVPPGLTISTEACQEYQQNGKKLPDGLWEEVLEGLQFVENEMGATLGNPSKPLLLSVRSGAAISMPGMMDTVLNLGLNDEVVAGLAAKSGERFAYDSYRRFLDMFGDVVMDIPHSLFEEKLEKLKHTKGIKLDTDLAAYDLKDLVEQYKNVYLEARGEKFPSDPKKQLELAVKAVFNSWDSPRAIKYRSINQITGLKGTAVNIQSMVFGNMGNTSGTGVLFTRNPSTGENKLYGEFLINAQGEDVVAGIRTPEDLEVMKTCMPEAYKELEENCEILEKHYKDMMDIEFTVQENRLWMLQCRSGKRTGKGAFKIAVDMVDEGLVDIRSAIKMVEPQHLDQLLHPQDPSTYKDKVIAIGLPASPGAAVGQVVFTADDAEEWHAQGKSVILVRNETSPEDVGGMHAATGILTARGGMTSHAAVVARGWGKCCVSGCSDILVNDAEKVFVVGDKVITEGEWVSLNGSTGEVILGKQPLSPPALSDDLETFMSWADEIRHLKVMANADTPEDAVTARQNGAQGIGLCRTEHMVQINIQLLVISMRSVDNERIKAVRMMIMAVTPEQRKAALDLLLPYQRSDFEGIFRAMDGLPVTIRLLDPPLHEFLPEGDLEHIVSELTSETGMKEEEIFSRIEKLSEVNPMLGFRGCRLGISYPELTEMQARAIFQAAVSVSNHGITVLPEIMVPLIGTPQELRHQVNLIRNVADKVLSEMGSSLSYKVGTMIEVPRAALVADEIAKEAEFFSFGTNDLTQMTFGYSRDDVGKFLPIYLSSGILQHDPFEVLDQKGVGQLIKICTEKGRAARPNLKVGICGEHGGEPSSVAFFAEIGLDYVSCSPFRVPIARLAAAQVAV

SEQ ID NO: 160760 - protein, 607 aa, Glycine max
  Coding DNA Sequence Number=SeqID_69075
  Gene Ontology: Mol. function=metal ion binding; Cellular component =nucleus; Biological process=regulation of transcription, DNA -dependent
  Homolog annotation: Hit_ID=A7NVY3; Match level="QueryCoverage=95%, HitCoverage=54%, E-value=1e-142, Identity=50%"; Hit description =Chromosome chr5 scaffold_2, whole genome shotgun sequence
  Pfam annotation: Domain name=SBP; Domain location=31-109; Score =173.6; E_value=5.3e-49; Accession=PF03110.5; Description=SBP domain
MLEEEEKSGKKTKVIGTNTTTTTTTTSNRAVCQVQDCRADLSNAKDYHRRHKVCDVHSKATMGLVGNVMQRFCQQCSRFHVLQEFDEGKRSCRRRLAGHNRRRRKTHPDVSVVNEGSLNDQRDSNYLLMSLLRILTNLHSNGSDHTRNQDILSHLLKNLASLAGPNNGGRLAPLLEESKGLVNAGTHGADHDKPNLNSNAPEASRPSSSIKTDNGIIAQDPPMSVVQYETPANGMTQKCIASGDGVGNLKPPSGPLLSNVCEPRDSVPSQLTTAETKVGRGNLNNIDLNNVYNDIQNTVENHKKPYPPVASGMGFIDHASWLQCDSLKSSPPQTSRNSDSTSTQSPSSSSGEAQISLLIKILFCQGHHLKSPFQSRTDRIVFKLFGKDPSDFPLLLRSQILNWLSRSPTEIESYIRPGCIILTIYLRLEKSAWEELYCNLGSSLRKLLAASNDSFWRTGWVYARVQHAVAFLYNGQVVLDVPLRLKSPQHCMISCINPLAVPASASAQFIVKGFNLSQSSTSPDVDLLLMISRLHCALEGKYLVHASCHDLIGGADAPIQHLSFSCQIPSVTGRGFIEVVSIHHTPKIVCCKIPETNRRTQSSGACF

SEQ ID NO: 160761 - protein, 49 aa, Glycine max
  Coding DNA Sequence Number=SeqID_69076
  Gene Ontology: Mol. function=nucleoside-triphosphatase activity; Cellular component=integral to membrane; Biological process=transport
  Homolog annotation: Hit_ID=A7NVY0; Match level="QueryCoverage=91%, HitCoverage=5%, E-value=9e-15, Identity=77%"; Hit description =Chromosome chr5 scaffold_2, whole genome shotgun sequence
MTVRETLDFSARCQGVGSHSELLMEISRKEKEAGIVPDPDLDAYMVTQT

SEQ ID NO: 160762 - protein, 441 aa, Glycine max
  Coding DNA Sequence Number=SeqID_69077
  Gene Ontology: Mol. function=protein transporter activity; Cellular component=nuclear pore; Biological process=protein import into nucleus, docking
  Homolog annotation: Hit_ID=A7NVX1; Match level="QueryCoverage=99%, HitCoverage=64%, E-value=1e-158, Identity=63%"; Hit description =Chromosome chr5 scaffold_2, whole genome shotgun sequence
  Pfam annotation: Domain name=IBN_N; Domain location=26-95; Score =15.2; E_value=0.0026; Accession=PF03810.10; Description=Importin -beta N-terminal domain
MAEDLTHIAQLLDQTLSPDATAVRTATAALDLISLTPHFPFYLLSISTGGGNQGQKIAAATYLKNLTRRTVDSTGVKPSNVSKEFKEQLMQALLQVELSVLKILVEVFRAIAAADFVKQNLWPELVPNLQSAIQNSHLTSGSNTKWSTVNALLVLHALLRPFQYFLNPKVAKEPVPPQLELISKEVLVPLLAVFHQFVEKALATHGIAEKETEKVLLTICKCLHFAVKSYMPSTLAPLLPSFCRDLMSILSSLSFDSIVNQEDEYLTRLKTGKRSLLIFSALKLPFLSERLLSLGFDVISNILETGPGWRLVSPHFTTLLESAIFPALVMNDKDMSEWEEDPDEYIQKNLPSDIGEISGWREDLFTARKSAVNLLGVISLSKGPPMETATDSLSSSKRKKGQKNKKSNQRRSMGELLVLPFLSKFPIPSASNLSQKKILNE

SEQ ID NO: 160763 - protein, 243 aa, Glycine max
  Coding DNA Sequence Number=SeqID_69078
  Homolog annotation: Hit_ID=A9P8X3; Match level="QueryCoverage=79%, HitCoverage=82%, E-value=5e-87, Identity=73%"; Hit description =Putative uncharacterized protein
MVIYDPSMSTCSILQPHHDFEMTQVQSAIIPPSQDTVFVLLNCSIDSPVLNHYKYLCFNFAGHTCDELYGSCNAFRVFHLLTNSSPPCCFTSYSTVKFMSMNILDCTHYTSVFNTDNLKGVGPLDWVYGIKLSFSVPDTGCQSCKESGGTCGFDTDTEGLLCLCSSFANSTRECAAGSIISKGQNNAPWTHFLLVLLVVANFLTKVRLSQGCSQLSNDAKWLTENRRETSSSFLYVVHSGHYK

SEQ ID NO: 160764 - protein, 626 aa, Glycine max
  Coding DNA Sequence Number=SeqID_69079
  Gene Ontology: Biological process=protein localization
  Homolog annotation: Hit_ID=Q9C7Z6; Match level="QueryCoverage=98%, HitCoverage=15%, E-value=0.0, Identity=60%"; Hit description =Putative uncharacterized protein T2J15.2
MAGRQVLDVPSTNVGGSAFCIAVSTRGMDIQKALESSSTWILAFREEEKASWFKGLVQATYQASTPPSVDVLGDSEGNATSYNVLSTPNTKTADIVINGALVELKLFIYGKVGDTINGKLDESLILEVVADGGKVHVLLADGDLTVKMKLHSLKIKDELQGRLSVAPRYLAVSVLQSETSSSDMYDSHGKEVSHDDDDSFTDALSEFISQTDGGYCLHNMDLDHQGLVGIASDFESLENIMHEKGTPREVYYEAQGSDTSNFVSVSFTTRSSCSPDYDGIDTQMCVRMSKLEFFCNRPTIVALISFGLDISSGNKVTSPTDTLATSSEKLVVKERTDEEGPVSGLLGFGKERVVFYLNMNVDSVTIFLNKEDGSQLATLVQESFLLDLKVHPSSLSIDGTLGNFRLCDTSLGSDQCWDWLCDIRNPGVDSLIKFKFNSYSAGDDDYEGYDYSLQGHLSAVRIVFLYRFVQEIMMYFMELASPHTEEAIKLVDKVGGFEWLIQKYEIDGATALKLDLALDTPIIIVPRNSMSKDFIQLDLGKLQIKNEFSWYGSQEEDPSAVHIDLLHAQILGINMSVGIDGRLGKPMIREGQGLDIFVRRSLRDVFRKVPTFSLEVKVTPIPNPNV

SEQ ID NO: 160765 - protein, 2232 aa, Glycine max
  Coding DNA Sequence Number=SeqID_69080
  Gene Ontology: Biological process=protein localization
  Homolog annotation: Hit_ID=Q9C7Z6; Match level="QueryCoverage=100%, HitCoverage=49%, E-value=0.0, Identity=57%"; Hit description =Putative uncharacterized protein T2J15.2
  Pfam annotation: Domain name=DUF1162; Domain location=1789-2114; Score=-79.8; E_value=0.0042; Accession=PF06650.3; Description =Protein of unknown function (DUF1162)
  Pfam annotation: Domain name=DUF946; Domain location=484-769; Score= -405.5; E_value=0.012; Accession=PF06101.2; Description=Plant protein of unknown function (DUF946)
  Pfam module annotation: Pfam domain module=DUF1162::DUF946; Domain location=1789-2114::484-769
MSDKEYKVILDCTYMNLSEEPRLPASFRGGKSGSRDTIRLLVDKVNLNSQLLLSRTVTIIAVTVNHALLELCNGTDGESPLAHIAMEGLWVSYRMTSLSETDLFVTIPKFSVLDVRPDTKPEMRLMLGSSADASKQTVTGNVPFLFNPGSFRRTTSEVEIDDMPISTMFLMDYRWRVSSQSYVIRVQQPRVLVVPDFLLAVAEFFVPSLGALTGREEKMDPKNDPISRNSSIVLMESIYKQEEDVVHLSPSKQLVADSVGIDEYTYDGCGKVICLSVETDAKEVRSTRFRPIIVIGHGKKLRFVNVKIENGSLLRKYTYLSNDSSYSISSEDGVDMVVSGNLPSSDEKSLDNVNQTSGTSIDSQSGSNATQSFSFETQVVSSEFTFYDGTKSFLDDSFYGEKLVRAKLDLSFMYASKEKDTWIRALVKDFSVEAGSGLIILDPVDISGGYTSVKDKTNISLLSTDICIHLSLSALSLMLNLQSQASAALSFGNAIPLVQCTNYDRIWVSEKETGHNNNITFWRPRAPANYVILGDCVTSRPIPPSQAVMAVSNTYGRVRKPVDFHLIGSFLNIQGHSGSEDHSIDGNDCSLWMPIAPPGYTALGCVAHVGNQPPPNHVVHCLRSDLVTSAKYTDCLFNIPLNNHFTSGFSIWRLDNAIGSFFAHSSTGCPLKERCYDLNHLLVWNSNRAPLLGPVSDYPSDHDNNNQQTSKSVNTSGWDILKSISKATNCYMSTPNFERIWWDKGSDLRRPVSIWRPIARHGYAVLGDCITEGLEPPALGIIFKNDSPDISSKPVQFTNVSHIVGKGFDEVFFWYPIAPPGYVSLGCVVSRTDEAPRVDLFCCPRMDLVSQANIHEVPLSRSSSSKSPQCWSLWKVENQACTFLARSDLKKPSSRLAYIIGDSVKPKTRENINAELKLRYFSLTILDSLCGMMRPLFDTTITNVKLATHGGLDGMNAVLIASIVASTFNAHLEAWEPLVEPFDGIFNQDQSRNVASSNSEFALKVALENAILFLSFQIDQQWKNKWDAPSSVILQKGHCISVSCPVENMPLTRSLLSNLFRFETFDTNAPSGLGKRVRISATSILNVNVSAANLESFVGSILSWRQQLDLEQKALKLNAEAGGQQGKGENTTFSALDEDDLQTVVVENKLGCDIFVKKVEHDVDTVDKLQNGDCVSVWIPPPRFSNRLNVANESREARYYVAVQILEAKGLPIINDGNSHNFFCALRLVVDSQASEQQKLFPQSARTKCVKPVVSRTKDQVEGTVKWNELFIFEVPRKAPAKLEIEVTNLAAKAGKGEVVAALSFSVGHGANILKKVASVRMFHQPNDVPNIRSYPLNRLVQQNVEAMHDGCLFASTSYFERNKIANLQNDIESENVGDRDMGFWVGLGPESEWESIRSLLPLSVAPISLQNEYIGMEVVMKNGKKHVIFRGLVTVVNDSDVILNILTCHASHGCDSLLGVNSSNTVTAEVFQNQYYQPSSGWGNNWPAVHNDNPGHWSTRDFSYSSKDFFEPPLPPGWKWASGWSIDKSQYVDKEGWAYGPDIKSLRWPPISSHFSTKSASDVVRRRRWIRTRQSLSEQGTESLQGGASTVQPGASAVLSWRSSSKNSDQCLQVRPKFDNSQPSYSWGCAIAVGSSYIYSKDQLLDPGSTRLTSVTPTCSLKLNELEKKDILVCCNPSSGSKQLWFSVCTDASVLNTELNVPVYDWRISINSPLKLENRLPCPAEFSISEKTKEGNCIERHHGWLGYGKVDAQSSSLLDSSAQDPTIVLDPSFSNHVSSFWMIHRQSKRKLRVSIEHDMGGTSAAPKTLRLFVPYWIVDDFSLSLAYRVVEVEPLENVEMDSVLLSRAVKSAKTALKNPIGSLDRRHSNSRRSLQVLEVIEDNSPFPSMLSPQDYAGRSGVSMFQSPKDTRLGISVSMQSSEVYSSGISLLELEKKERIDVKAFNSDGSYYKLSALLNMTSDRTKQCDTQSAVWIHPTDSPKPFAWQLSAKVELLKLRIDGYKWSTPFSVSYEGVMRISLKKDVGDEPMQIRVAVRSGAKKSRFEVVFRPDSLSSPYRIENRSMFLPIHFRQVDGIPDSWQLLVPNSAASFLWEDLGRRRLLELLVDGTDPMKSLKFDIDEIFDHQSIHVNDGPTRALRVTIVKEEKTNVVKISDWMPENEPTGVPRRHLSSTNDSQKQQLTSITDCEFHINFDLAELGISIIDHTPEEILYLSVQNLVLAYSTGLGSGIS

SEQ ID NO: 160766 - protein, 546 aa, Glycine max
  Coding DNA Sequence Number=SeqID_69081
  Gene Ontology: Mol. function=transferase activity; Cellular component= intracellular; Biological process=protein localization
  Homolog annotation: Hit_ID=Q9C7Z6; Match level="QueryCoverage=97%, HitCoverage=12%, E-value=0.0, Identity=72%"; Hit description =Putative uncharacterized protein T2J15.2
MCGLQVDNQLPLTPMPVLFRPQRAVSETDYILKCSITMQSNGSLDLCVYPYIGLHGPESSSAFLINIHEPIIWRLHEMIQQVKLSRLYDSKTTAASVDPIIQIGYGLLETAYDITLNYSVLNISEVRFRVSMAMSPSQRPRGVLGFWASLMTALGNTENMPVRINQRFNENVCMRKSSMITMAISNVRKDLLGQPLQLLSGVDILGNASSALGHMSKGVAALSMDKKFIQSRQRQENKGVEDLGDVIREGGGALAKGLFRGVTGILTKPLEGAKSSGVEGFVQGVGKGIIGAAAQPVSGVLDLLSKTTEGANAMRMKIASAITSDEQLLRRRLPRVIGGDNLLKLYDEYKAQGQVILQLAESGSFFGQVDLFKVRGKFALSDAYEDHFMLPKGKILVVTHTRVILLQQPSNIIAQRKFSPARDPCSIMWDILWDDLGTMELTHGKKDKPKAPPSQLILYLQSRSMDMKENHRIIKCIRETHQALQIYSSIQHALNTYGPGVSKGVLKNKVAKPYSPHVDARSVDLSPQQMPGSVPLSSTFGSSARD

SEQ ID NO: 160767 - protein, 103 aa, Glycine max
  Coding DNA Sequence Number=SeqID_69082
  Homolog annotation: Hit_ID=A7R888; Match level="QueryCoverage=49%, HitCoverage=64%, E-value=3e-07, Identity=56%"; Hit description =Chromosome undetermined scaffold_2360, whole genome shotgun sequence
MSNKKKPVKMSVPQFGGWEHKPAGVPTDYSMVFNQAREKKKTQMNDLTEVKRLSLGNERDALKPNHRRGHGQGHGHGHGHGHGHGHGHGHGLDHEDPPVMVRP

SEQ ID NO: 160768 - protein, 636 aa, Glycine max
  Coding DNA Sequence Number=SeqID_69083
  Gene Ontology: Mol. function=dihydrolipoyl dehydrogenase activity; Cellular component=cytoplasm; Biological process=cell redox homeostasis
  Homolog annotation: Hit_ID=Q9SPB1; Match level="QueryCoverage=76%, HitCoverage=92%, E-value=0.0, Identity=90%"; Hit description =Dihydrolipoyl dehydrogenase
  Pfam annotation: Domain name=DAO; Domain location=38-437; Score= -31.6; E_value=0.0013; Accession=PF01266.15; Description=FAD dependent oxidoreductase
  Pfam annotation: Domain name=FAD_binding_2; Domain location=38-366; Score=-142.7; E_value=0.02; Accession=PF00890.15; Description=FAD binding domain
  Pfam annotation: Domain name=GIDA; Domain location=38-362; Score= -203.5; E_value=0.00016; Accession=PF01134.13; Description=Glucose inhibited division protein A
  Pfam annotation: Domain name=HI0933_like; Domain location=37-358; Score=-252.7; E_value=0.0042; Accession=PF03486.5; Description =HI0933-like protein
  Pfam annotation: Domain name=Pyr_redox; Domain location=209-306; Score=124.8; E_value=2.5e-34; Accession=PF00070.18; Description =Pyridine nucleotide-disulphide oxidor
  Pfam annotation: Domain name=Pyr_redox_2; Domain location=38-352; Score=250.6; E_value=3.5e-72; Accession=PF07992.5; Description =Pyridine nucleotide-disulphide oxidore
  Pfam annotation: Domain name=Pyr_redox_dim; Domain location=381-486; Score=190.5; E_value=4.3e-54; Accession=PF02852.13; Description =Pyridine nucleotide-disulphide oxidored
  Pfam annotation: Domain name=Thi4; Domain location=14-226; Score= -134.5; E_value=0.035; Accession=PF01946.8; Description=Thi4 family
  Pfam module annotation: Pfam domain module=DAO::FAD_binding _2::GIDA::HI0933_like::Pyr_redox::Pyr_redox_2::Pyr_redox_dim::Thi4; Domain location=38-437::38-366::38-362::37-358::209-306::38-352::381- 486::14-226
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGGNTVVKGKHIIIATGSDVKSLPGITIDEKKVVSSTGALALTEIPKRLIVIGAGYIGLEMGSVWGRLGSEITVVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFLANSRAKAIDNAEGLVKILAEKETDKILGVHIMAPNAGELIHEAAIALQYDASSEDIARVCHAHPTMSEAVSGNEEEVPQRRRSTTSTRREWTLVAVAEDVENVDDAADEIHDSVTDHEHTESKLAFHGKKVEKFRRPTLEIEGIMVVTGLSSLITCSLETGAFPTFDAIDVEEVVDLLVELLEASTQEAKDETEQCKMTYVRLAWLGDIYHNKLFCKYYL

SEQ ID NO: 160769 - protein, 220 aa, Glycine max
  Coding DNA Sequence Number=SeqID_69084
  Homolog annotation: Hit_ID=A5AMY3; Match level="QueryCoverage=36%, HitCoverage=41%, E-value=1e-26, Identity=74%"; Hit description =Putative uncharacterized protein
MTSLCRRIPIAGTGQLCLRCAPRTAAIGAVRYGYLPKWPTIALRLPPPAKCGGAWERSGEKKVVAPRPRSVGRFAAESGRESGNRLAEVMLAAAVTVVMGAGNRVLYKLALVPLRNYPFFLAQLATFGYVIVYFSILYIRYRAGIVTDEMLSVPKTPFLVVGLLEALGAATGMAAGGVGLGGREAVAGQFVQLTIFFFGSMVGPVAILGELGPNGTRPGV

SEQ ID NO: 160770 - protein, 193 aa, Glycine max
  Coding DNA Sequence Number=SeqID_69085
MFALQNGYNEELRAQVEEAFHNDPAKDENFVGWQLNTGSGHCELTGKEPHKQRRTITVLNDCDSATTATQGPRFQMVAPAVRAAAAELFFFSFFREAFLLPSFSTSHFFFLVILLPRELLHLPCEVVVLLSCELMLLPPSSASSSSILPRGAALPCFIGAMLNLRIRLIHKQKRLIRKLHADQVDPHEACGST

SEQ ID NO: 160771 - protein, 378 aa, Glycine max
  Coding DNA Sequence Number=SeqID_69086
  Homolog annotation: Hit_ID=A2Q4S5; Match level="QueryCoverage=80%, HitCoverage=63%, E-value=1e-16, Identity=37%"; Hit description=IMP dehydrogenase/GMP reductase, putative
  Pfam annotation: Domain name=DUF1723; Domain location=89-138; Score =47.7; E_value=4.1e-11; Accession=PF08330.1; Description=Protein of unknown function (DUF1723)
MVDADAQDTDAETGVQDTGAEDVADEVEGFPGGPRDPSVLTEYAEHERPELKLSSHGRKVYKLGRPVPAIEEMVAGTGLSPLITCSVDTGDQGLISSFVERWHRETSTFHLPMGEVSITLDDVASLLHLSIVDDFHAFQPLQIDEAVLMLVELLMVSPETSCVTSLRLGGMHGELLASSMCTISLMMQCWIYEHFPSVVECNVDLEYNEVSPRACRWIATKKTVKKISTATYRQCLDRLRIPDVYWMPYGEHRLVQDFHLISCFLGQLRWGPAVVRYKPERVMRQFGYIQCILAHPVDSWEPTPASTHVHSDADEPRHVVETCHVIAETLKHHLSLNEVMPDTSTHEVIQKCFRIVRGVTKDVNVYLRSHRRRHTDQP

SEQ ID NO: 160772 - protein, 266 aa, Glycine max
  Coding DNA Sequence Number=SeqID_69087
  Gene Ontology: Mol. function=hydrolase activity, acting on ester bonds
  Homolog annotation: Hit_ID=A5AZ21; Match level="QueryCoverage=31%, HitCoverage=15%, E-value=2e-23, Identity=65%"; Hit description =Putative uncharacterized protein
MRKEKIPHQAPFAIQAAQLLGRAIGAGLFAITPAGERGMCCKAIKLGNARVFPVTTLGNPGDLQTFDPEIDRKFHRLVRHSVHLDHSVLFEHCEHFEHSEYSVAGDSEYSDFEHSTTNFHTENMAQPPPRERIFREMAAPDFTYESLCIQYPDEGVPYVLKTRLIHLLPKFHGLADENPHKHLKEFHIELIQLAAVIKGDNILTSFPDTIGKDMTVKQGKDYMDEAVRRFFEAGRYARKMGVNEEHIVRMKPSLTTRSSESSNTNP

SEQ ID NO: 160773 - protein, 74 aa, Glycine max
  Coding DNA Sequence Number=SeqID_69088
MEKNEETTMEEKVKLKIDGDVAKDKGEKVRGGVIHSGISHGKKELHHQENVLDKKLRVEVSMKEKKERRRGTRN

SEQ ID NO: 160774 - protein, 86 aa, Glycine max
  Coding DNA Sequence Number=SeqID_69089
  Subcellular localization annotation: CTP_CleavageSite=43; ConfidenceScore=5.08e-01
MTLMAAIQATSFALYVKKDWSQWKLGSSIRILTVAYKKTTTVVVMAKFGRPALEIEGLVAASGLSLLIACSLNTGDQGLMSAFVER

SEQ ID NO: 160775 - protein, 186 aa, Glycine max
  Coding DNA Sequence Number=SeqID_69090
  Gene Ontology: Mol. function=helicase activity; Biological process =viral genome replication
  Homolog annotation: Hit_ID=Q2HUT8; Match level="QueryCoverage=97%, HitCoverage=46%, E-value=4e-44, Identity=50%"; Hit description =Putative uncharacterized protein
  Pfam annotation: Domain name=DUF889; Domain location=2-161; Score =99.4; E_value=1.1e-26; Accession=PF05970.5; Description=Eukaryotic protein of unknown function (DUF889)
MDFDDSIQAIVDTTYPDLLQNYNNADFLQKRAILASTKDVVDKINDYVLSLILDDEKEYYSADIVDKSDELLNPTFGVLTPEFLNSLKTSGILNHKLRIKISTPIILLRNLDQAYGLCNGTRLIVIKLGTNVVEAEVITEPNIGHRTYIPRMNMSPSDSPWPFKLIRRQFPFMVSFAMTINKSHSP

SEQ ID NO: 160776 - protein, 258 aa, Glycine max
  Coding DNA Sequence Number=SeqID_69091
  Gene Ontology: Mol. function=DNA binding; Cellular component =mitochondrion; Biological process=regulation of transcription, DNA -dependent
  Homolog annotation: Hit_ID=A5C1L4; Match level="QueryCoverage=55%, HitCoverage=50%, E-value=2e-17, Identity=34%"; Hit description =Putative uncharacterized protein
  Pfam annotation: Domain name=DUF296; Domain location=87-212; Score =77.5; E_value=4.3e-20; Accession=PF03479.6; Description=Domain of unknown function (DUF296)
  Subcellular localization annotation: CTP_CleavageSite=62; ConfidenceScore=5.37e-01
MTTNSMAISISQNSFSSDLDSTSSWDYLTGSSSQFPRCPPSPIANQPLENLPIATPPTKKPRGRPPGSKNKPKTTSFPVGQPAEPSMKLVIVNVTPGSDIIESILDVARRGHVSLTILSASGTISKVTLHNSIHGVAALTLRGPFTLLSLNGSYLHNNHYTLHPGATPPPPLSFGISFSTSQGQVFGGAIGGRVIAGDDVSLTISTFKNPVMYKYVPTDKERNGDDNNNNHYNNISKNFNGGNELLGFNMVGCRVRGW

SEQ ID NO: 160777 - protein, 164 aa, Glycine max
  Coding DNA Sequence Number=SeqID_69092
  Pfam annotation: Domain name=F-box; Domain location=9-56; Score=17.9; E_value=0.037; Accession=PF00646.24; Description=F-box domain
MKTYRRRTKKTVHLSQELINEILLRLPVKSLVRFKCVSEGTERLVFFEPSAPEIRSIDFNASLYDDSASVALKLNFLPPKPYDVRIRGSCRGLVLLECCQSLWMTTWWLKCSATLAQLLVLTDTEAEAANTTTGTAVTKPKTKVQVEEKPKRKITKPSYLNHYF

SEQ ID NO: 160778 - protein, 386 aa, Glycine max
  Coding DNA Sequence Number=SeqID_69093
  Gene Ontology: Mol. function=hydrolase activity; Biological process =metabolic process
  Homolog annotation: Hit_ID=A7NWB1; Match level="QueryCoverage=75%, HitCoverage=84%, E-value=1e-117, Identity=48%"; Hit description =Chromosome chr5 scaffold_2, whole genome shotgun sequence
  Pfam annotation: Domain name=IU_nuc_hydro; Domain location=111-386; Score=-101.9; E_value=0.0005; Accession=PF01156.10; Description =Inosine-uridine preferring nucleoside hydrolase
MGSPTSRIVFRIVVVALLLLLLFYIGRPLYWKISATVHDIRNNKQTVRQGLSQIVIEAQKSVGWYHDESDSGHSHITFTVGGGSSGPPRSTIYLFVVVLIIIGGCAEGSRPHRILVDTDVDTDDFFALLYLLKFNASQFQLEGISISANAWTSAGHAVNHIYDLLYMMGRDDVAVGVGGEGGILQNGTILPNVGGYLPIVEQGMTTVGGCRYRGAIPVGLGGRLDIDANYGIRKAFLPQQPTAQQVLIEKISAGPITLLVIGAHTNIAIFLMNNPHLKKNVEHIYIMGGGVRSSNPTGCCPKNASSTCVPMQCGDRGNMFTDYNTNPYAEFNIFGDPFAAYQVIHSGIPVTLVPLDATNTIPINEEFFDAFEKSQDTYEAHYIFKS

SEQ ID NO: 160779 - protein, 318 aa, Glycine max
  Coding DNA Sequence Number=SeqID_69094
  Homolog annotation: Hit_ID=Q38848; Match level="QueryCoverage=91%, HitCoverage=94%, E-value=8e-68, Identity=50%"; Hit description=LRP1
  Pfam annotation: Domain name=DUF702; Domain location=102-266; Score =309.8; E_value=5.1e-90; Accession=PF05142.3; Description=Domain of unknown function (DUF702)
  Subcellular localization annotation: CTP_CleavageSite=27; ConfidenceScore=5.05e-01
MAPHHDIFVVAPASSFHHHHDHNDAVLSDPNNGSNNSNNNPGTALGVNVFPLLTATPCLESEGIMGNISHHRNRIQLWEDHESSPPQQQQGHVERDTCGDGGLGGSGTNTCQDCGNQAKKDCSHRRCRTCCKSRGFDCATHVKSTWVPASRRRERQLMTVAAARSSGDTSGAKKPRLVASQTTSHTSTSNNTNTTPPRSFDTGSSHQDVGFKESLPCQVRAPAVFKCVRVTAVDDGGEDEYAYQAVVKIGGHVFKGFLYDQGVEDKEGYPNLSELHLGGGNGVSSSSPMVDPSHDVYAASGGGLLLGGSSNYGNHPIN

SEQ ID NO: 160780 - protein, 154 aa, Glycine max
  Coding DNA Sequence Number=SeqID_69095
MVSPQGRNTWTVDDLVPYVKKLAIISEEQERITEPVSHGPASECEFPTQEFHILQSSVETRGIGRRSEPVEAEEYSQQMMERGHGMYYTPTTFSQYPSQMYQYHFEGPHTDTSMSEHSYGGVAETQAHFSWPTMTPSQQQDASMATPNAPFALQ

SEQ ID NO: 160781 - protein, 134 aa, Glycine max
  Coding DNA Sequence Number=SeqID_69096
  Homolog annotation: Hit_ID=A5C203; Match level="QueryCoverage=70%, HitCoverage=9%, E-value=3e-07, Identity=34%"; Hit description =Putative uncharacterized protein
MVEESTKGNMQNGGFHSRIWNSMTYWLNSITNCSYKKEQLKAKIHRLQALYHEFSLLLQHASRPNDDNASSNDDMREVEHNTSTRKHKSKKRCRTDEMGDSLAAWAEASKAKAETYRKIVNKEDYYSYQVCEYR

SEQ ID NO: 160782 - protein, 287 aa, Glycine max
  Coding DNA Sequence Number=SeqID_69097
MHGSHGEGDRGESRSNGDAIKLDKKDDTMISGGIGEKPPESNVHVDDSLGANKGNATQSCNLWRILEMPIFEGEDLMGWLTKTASDGCHGWRSSRVVPMVGILEPKPLVFKIAISQRFQVSNLGNPFQALFALEQEETMQELIGQFEKHIRMVKGMEEPFMVEVFPKGLKEEINTEVVGPINVAKTGSSRWQGRRNFHNLSPMEVNEKMRKGECFTCEEKYNPAHVVFPRHDLENKVHLEGGGVLIDEEMGMLGNILGRAKSLSNCQLGGENLKLIYILSWVLEAPQ

SEQ ID NO: 160783 - protein, 162 aa, Glycine max
  Coding DNA Sequence Number=SeqID_69098
  Homolog annotation: Hit_ID=A7NU16; Match level="QueryCoverage=59%, HitCoverage=58%, E-value=1e-19, Identity=48%"; Hit description =Chromosome chr18 scaffold_1, whole genome shotgun sequence
MAARHFLLHRLRLRSFQGFTVAAPKGHRLWCSATSAPEEAASNAEVDDPEWRKKEEKIVRDVEPIVSLTMQILYSSRYMNGEILTMEDERAVVENILIYHPDYEDKIGSGLNSIMEYRMSTKYTKMKGKTATQRKLIGTKGFPSVRVLITFTLGSDCKYAKC

SEQ ID NO: 160784 - protein, 435 aa, Glycine max
  Coding DNA Sequence Number=SeqID_69099
  Gene Ontology: Mol. function=kinase activity; Cellular component =nucleus; Biological process=cell division
  Homolog annotation: Hit_ID=Q9M4K9; Match level="QueryCoverage=77%, HitCoverage=93%, E-value=1e-134, Identity=72%"; Hit description =Cyclin A3.1
  Pfam annotation: Domain name=Cyclin_C; Domain location=226-351; Score= 146.0; E_value=1.1e-40; Accession=PF02984.10; Description=Cyclin, C -terminal domain
  Pfam annotation: Domain name=Cyclin_N; Domain location=95-224; Score =217.9; E_value=2.4e-62; Accession=PF00134.14; Description=Cyclin, N -terminal domain
  Pfam module annotation: Pfam domain module=Cyclin_C::Cyclin_N; Domain location=226-351::95-224
MATSENNSSARPQREAKKRAAAAISQIHGNAAKKKRVVLGDVTNVSSSDVAVSVSKKPVQTHKNVKLEKPAAPVATPEKVEERHDPQLCGPYVSDIYEYLRGMEVDPSKRPLMDYVQKIQRDVNANMRGVLVDWLVEVAEEYKLVSDTLYFSVAYIDRFLSLNILSRQRLQLLGVASMLIASKYEEIKPPEVEDFCYITDNTYSKEEVVNMEAEILKALKFELGGPTVKTFLRRFSRVGQEGVDTSDLQFEFLSCYLAELSLLDYNCIKFLPSLVAASVVFLARFMFSTKTHPWNSALHQLTRYKPADLKECVLNLHDLYLSRRGASLQAVREKYKQHKLHWVFWYSSNVWQQHHLLPRYLFLFLNLRGRFLGNCNLAILGMALVSTIGRKVFPNTRDESFRHFVALVCREREVLARNAATTYYAGLTDFVIELV

SEQ ID NO: 160785 - protein, 690 aa, Glycine max
  Coding DNA Sequence Number=SeqID_69100
  Gene Ontology: Mol. function=transcription initiation factor activity; Cellular component=transcription factor TFIID complex; Biological process=transcription initiation
  Homolog annotation: Hit_ID=A5ARH4; Match level="QueryCoverage=80%, HitCoverage=66%, E-value=1e-110, Identity=42%"; Hit description =Putative uncharacterized protein
MQNPSSLDHPLFANRVQFSRTIIFLVPFALSWLGSRTVEVEHVSNRDNECGEVAMDPSIMKLLEDDEDEAMHSGVDVEAFQAALNRDIGGDVSTSQFSGSDAVLSQGSNNTSSQSLSQWPTSNHDSQTDCQKQESKTAQQQDQPSSGVELKQRGSLAEQLHHVASQDINNPHLSQKQSQDECHQAPALQVSLHNSQAIGIQNSGKDPVLNNEVVKNHNPSSESQYAKLQQMSNQQATVSEQPSSQGNRSTSKQVPFGMLLPILLPQLAKDRAMQLQTLFAKLKKEEIPKDSFVRLMKGIVGDQMLRLALAKVQVQPQTRPNQASAGQQHPMRMPTVGSGASQLNDPHALAEMHQRSMNAAVDQSRMGSSAGQTMESNARKSQELDVKIESQGLQPSQLTSSSSNKIAQETERTSVHIQGLNKQQQQHLHFPSAYGNSGGNYNPFSGTTSSSTSSIKSQSHDSHMSQISYQSIGSNHHLGGSTHGLNVIGMSKLEQQNSFNDPKRLPGGSVSPAVNNTVSQQTKNAWQPSTNKEQNLGLLSSVSYVKKEPSDLSTEQQNRHNLSKLHGYSSVNSAQLEQGGASQGTVKDEFSRGLPAPPSKPPTSTGLLPQSSSSPSVMTQLGPGVSVYVLAIFLIWNTGLKIDIFGSSTVCSCLAQVRVMSYLSPHNELNWVKPSVLSTFNDPNKEFQIA

SEQ ID NO: 160786 - protein, 1260 aa, Glycine max
  Coding DNA Sequence Number=SeqID_69101
  Gene Ontology: Mol. function=nucleic acid binding
  Homolog annotation: Hit_ID=A7NU83; Match level="QueryCoverage=86%, HitCoverage=80%, E-value=1e-178, Identity=46%"; Hit description =Chromosome chr18 scaffold_1, whole genome shotgun sequence
  Pfam annotation: Domain name=RRM_1; Domain location=654-720; Score =12.0; E_value=0.011; Accession=PF00076.13; Description=RNA recognition motif. (a.k.a. RRM, RB
MRVVDTNFFEPVGSENHTIHARPDPTRPVVIPHFRRSAPNSWTACRLPSTVHSSLPMASAEQPLKKRKLYEPLPEPPPFSPPQPPPPESEATPSSPQTLPTPSSTPPLSQEEILAKRRNKDEIRSVYEGYKRIKRCLLRKDAPSSMSELEQSYLALITSSRGCMSVQRIVADLIPRYACHCPTALEAAAKVVINMHNLSLALISRGEDSSGIAFETARACICGLADVCCDASSVAPTLAVIRGICEAVFQNVLTFFIALFEGKDVLQMVDKNFLNMQDTPEAFSELKQKILDEDESSLTKLSKLRVLCLLRIFFSCPKDLLAACLDLFGSATKEATNAEGQRFLSLVTSTFDDDKAVHLFERAIGGSKSCTDSTGSGIRDNEAGEAIMTEDNHVSGGDSSVGKSCLLMQVLDKDPLLRKWMLCRCKKLLDLLSDVSLEITSVLQGILGMFPRQTDLEDCQADSDEDKSDSSIYMNRNYMVPRISEEHESIGESSGKGSSLRVHVGSSDGFTDKYVMDHSSAVPLDHVPVLKVGSHYDNGVSKPMSIGVGEEGNMPTPRDSVSHQMFSPAVRTPVDFRSNSFEGRNDFLNVEKNHVLNMNFNSPPLRSSSGSVSNSLASPNHHFMSPTASTKGQIVWCCDGDPAAMDIVSASKQLWIGYVGPDVPENHIRFHLERFGTIEQFIFFPVKGFALVEYRRIIDAIKTRHCLPGCFPCRVKFMDIGLGTRGAMNGVAVGSSSHIYVGNIPSQWARDEIMHETRKVIHKGPLAFIDLSCEFALLMEFETPEEAATVMLHLRQLRRERSNYNQHFGPGTVNVGIGHAYMDGGRPIPAPPPPPPPPNLDLKVNNPAGSPHARTLSGSPADSSRTRMSHLSTLLASLRTKYNINQNLGLSDNYTIGNNCPPMREEDMVPSSTLCITIPRSSSLFLTDDELMAICNLAIGNSGSIVQLTQTNLQMGCSWFVECSNVDGAVSVLKNLRGCPGLFFQIEFSKPGNQIAVPFSVKPENNSMELVSPRINSENHNLPQSNWHFPGSREMSELGARKPDGYDNLSQDPHQGGIVPHSHSGAHGPSIPPPQQIQSSPFVRPVYVPPNGPWDRRGINNHLPVSQFKTGVMPNNFHGNAVVSPFIPASVTPLAQIQGTPMHPYNQQVPPSIIPPPLSSLPPPQPEMPPPLPPSPPPLPQVQPPLVPPLPSSPPPPPPPPLPVQEAVDMECSGQSLLYQWQGNLCKSGVDMGSHHLSPMSKVGHLEPGDCRTDLGKSWS

SEQ ID NO: 160787 - protein, 111 aa, Glycine max
  Coding DNA Sequence Number=SeqID_69102
MAQDMWGMKRWFFKRLRKQALRTMKLLRSAFKGKKLYSPLSFMDYVIFKIMSAFDTIVLMESNGTLPSAPEINTIKSDSGNERAMQTTFNNNKPYPTRIMPFQLDFKGREE

SEQ ID NO: 160788 - protein, 196 aa, Glycine max
  Coding DNA Sequence Number=SeqID_69103
  Gene Ontology: Mol. function=phosphatidylinositol binding; Cellular component=Golgi apparatus; Biological process=clathrin cage assembly
  Homolog annotation: Hit_ID=Q8S9J8; Match level="QueryCoverage=50%, HitCoverage=15%, E-value=6e-36, Identity=76%"; Hit description =Putative clathrin assembly protein At4g32285
MGKEPLLVEVEAEVDLEGEKANKAPNFALIVDFLLGIAPKTQKNNDSSINLVASSMDVSTDLGHKSASELFTPDQYQSLLALIQQNHKPSSSDVHASNMTSIGIAKVASNMASKMEFKIVKAMSHNDDPTNDKYIREILNLMSHSRGYIHACVTAVSKQLGKTRDWIVALKALMFVHRLMNEGPPLFQEEILYATR

SEQ ID NO: 160789 - protein, 161 aa, Glycine max
  Coding DNA Sequence Number=SeqID_69104
  Gene Ontology: Mol. function=pectinesterase activity; Cellular component=cell wall; Biological process=cell wall modification
  Homolog annotation: Hit_ID=A7PEG1; Match level="QueryCoverage=36%, HitCoverage=16%, E-value=1e-18, Identity=74%"; Hit description =Chromosome chr11 scaffold_13, whole genome shotgun sequence
  Pfam annotation: Domain name=Pectinesterase; Domain location=73-154; Score=-260.8; E_value=0.074; Accession=PF01095.10; Description =Pectinesterase
MASKLLLITVFVFYLIAFGLAVAAEQRKSISSVVTDNEFWQVDASVAGSLLTLEAQGPGVFHHSRGVLVGWISGKFLSHQVHDNLRGGWEKVNISPFKSFITIQGEGADKTIVQWGDTAQSQPLGTYGSATFAVNSPYFIAKNITFKAEFVEGSRTRFKES

SEQ ID NO: 160790 - protein, 385 aa, Glycine max
  Coding DNA Sequence Number=SeqID_69105
MEERKKHPSFPSNYLTLAQLQERWLKQQNQINQPQPQPQPQPQEQHNHHHRQQPHQELVLVPRNGNAYRSRSQFQYVAKNRNDSETRRRATKVAVASDDNCKSEAVAGIGDETADLNGKSSESKKNQNNRRNGKGTWKTKTEKRGARGDGSGTGAQGKEEAEKKATIEKKNELEKNGGSASVDEVGQRVRVLSINSGDEKKKKKKKNGGSVTAEEVVEQSVRILSINSGNGKQNNGRLGKMNNGFGTAAHGKKEAEKTTIENELKEKKNGGSVTVEEVEQRVRVSSKNEEEEKKNGGSVTVEEMEKRVGVSSSNNSGNGKQNGRLGKMSNSFRHSESQRKYYGGEASYGYGYGNRGNGHYSKVGVQKTTEKKMVWVKKDEIVGGN

SEQ ID NO: 160791 - protein, 106 aa, Glycine max
  Coding DNA Sequence Number=SeqID_69106
MAKRMNGKGGLSLSSLVSGMVKCKCENQVLVDFFNGLVIQRLAIMCLQKGVSWCAKTKAKEIIDLRKIIVAQKEECHASSEQVVYFKNLVVERNKVKLLGFVVVVL

SEQ ID NO: 160792 - protein, 159 aa, Glycine max
  Coding DNA Sequence Number=SeqID_69107
MVVTIRYSKAAPDQVKNWFQSNPEFLKPADPETSLFLNQKSQLAAFLASSKSKESLAQNLKEVLQLVQQEVEEEPSKKEAESSETNDDQEDDPFYQNEDDCFDEWQRNGERKRERRCHFKEKMSLEEAHHHRRPWIRAWRKKEMNEERGREEHEILCSK

SEQ ID NO: 160793 - protein, 105 aa, Glycine max
  Coding DNA Sequence Number=SeqID_69108
MRDNNIKFIHTINIVTIVYRSYTAQWNASKLPHDKRKSQWSCILWQMEVEESLLGLWLPLHYRADKEGWCFVLDVQQVDFVADLGVAFVDDWAFLVARVVCNGKD

SEQ ID NO: 160794 - protein, 84 aa, Glycine max
  Coding DNA Sequence Number=SeqID_69109
MEGIQQDEEIRRIQRENKAREIMDVCVVRCSAVQRVSEAIYPFGVGPTPIQSFLIYCDYQLEWVGATQSYIPSPHIVMDTEFIS

SEQ ID NO: 160795 - protein, 91 aa, Glycine max
  Coding DNA Sequence Number=SeqID_69110
MRLGVYEQFEQRDPCWSFIQLFNYFKLTLLDETKELMSLFQGHRLSLETFLLFSSHSLPGDPLLLRGWPRPRTLGSWVLSPWRAILPSEGE

SEQ ID NO: 160796 - protein, 259 aa, Glycine max
  Coding DNA Sequence Number=SeqID_69111
  Gene Ontology: Mol. function=dihydrodipicolinate reductase activity; Cellular component=cytoplasm; Biological process=lysine biosynthetic process via diaminopimelate
  Homolog annotation: Hit_ID=A8G9M8; Match level="QueryCoverage=92%, HitCoverage=87%, E-value=1e-117, Identity=90%"; Hit description =Dihydrodipicolinate reductase
  Pfam annotation: Domain name=DapB_C; Domain location=132-259; Score =234.4; E_value=2.6e-67; Accession=PF05173.5; Description =Dihydrodipicolinate reductase, C-terminus
  Pfam annotation: Domain name=DapB_N; Domain location=6-129; Score =232.7; E_value=8.4e-67; Accession=PF01113.11; Description =Dihydrodipicolinate reductase, N-terminus
  Pfam annotation: Domain name=Semialdhyde_dh; Domain location=7-117; Score=-25.6; E_value=0.076; Accession=PF01118.15; Description =Semialdehyde dehydrogenase, NAD binding domain
  Pfam module annotation: Pfam domain module=DapB_C::DapB _N::Semialdhyde_dh; Domain location=132-259::6-129::7-117
MSDTQIRIAIAGAGGRMGRQLIQAVQQAEGVVLGAALSRPGSSLIGVDAGELAGIGALGVKVSDSLEKVANEFDILIDFTRPESTRGYLDFCVAHHKAMVIGTTGFDDAGKQAIRDAAQHIGIVFAANFSVGVNLVLKLLEKAAQVMGDYTDIEIVEAHHRHKVDAPSGTALAMGEAIAGALGRDLKSCAVYAREGHTGERDPKSIGFATIRAGDIVGEHTAMFADIGERVEITHKASSRMTFASGAVRAAAWLRNRDK

SEQ ID NO: 160797 - protein, 87 aa, Glycine max
  Coding DNA Sequence Number=SeqID_69112
  Gene Ontology: Mol. function=chloramphenicol O-acetyltransferase activity; Biological process=response to antibiotic
  Homolog annotation: Hit_ID=A6P250; Match level="QueryCoverage=85%, HitCoverage=77%, E-value=2e-38, Identity=97%"; Hit description =Chloramphenicol acetyltransferase
  Pfam annotation: Domain name=CAT; Domain location=3-77; Score=3.2; E _value=2.4e-13; Accession=PF00302.9; Description=Chloramphenicol acetyltransferase
MWRVTVKTWPISLKANPWVSFTSFDLNVANMDNFFAPVFTMGKYYTQGDKVLMPLAIQVHHAVCDGFHVGRMLNELQQYCDEWQGGE

SEQ ID NO: 160798 - protein, 92 aa, Glycine max
  Coding DNA Sequence Number=SeqID_69113
  Gene Ontology: Biological process=transposition, DNA-mediated
  Homolog annotation: Hit_ID=Q1J7G7; Match level="QueryCoverage=35%, HitCoverage=47%, E-value=1e-11, Identity=96%"; Hit description =Transposase
  Subcellular localization annotation: CTP_CleavageSite=22; ConfidenceScore=5.57e-01
MVKVGTSYVPINVSFSPKVGPRASRVSTGTPGFYLFLRSDLPSQVLQWLLFLSAVPPVQLLTGWCVTAKAPPDISAGKCSGHAARNHHTRRA

SEQ ID NO: 160799 - protein, 187 aa, Glycine max
  Coding DNA Sequence Number=SeqID_69114
MAPKKLSTKRSRRDATGEGSNAAPEERRVQLREDEYTDFQEEIAHRRWTPLVTPMAKFDPEIVLEFYANAWPTEEGVWDMRSWVRDQWIPFDADALSQFLGDLLVLEEGQQCEFIQRRNRADGFDEEAIAQLLCTPGQDFTQTLVGRRVQIMRTSMTTLTQTWMTLLLSNVLPSNHNSDHPLPKCQL

SEQ ID NO: 160800 - protein, 459 aa, Glycine max
  Coding DNA Sequence Number=SeqID_69115
  Gene Ontology: Mol. function=nucleoside-triphosphatase activity; Cellular component=plasma membrane; Biological process=peptide transport
  Homolog annotation: Hit_ID=Q6D3K5; Match level="QueryCoverage=62%, HitCoverage=84%, E-value=1e-95, Identity=54%"; Hit description =Putative ABC-transporter, ATP-binding protein
  Pfam annotation: Domain name=ABC_tran; Domain location=318-459; Score= 86.6; E_value=7.8e-23; Accession=PF00005.18; Description=ABC transporter
  Pfam annotation: Domain name=ABC_tran; Domain location=48-256; Score =76.4; E_value=9.4e-20; Accession=PF00005.18; Description=ABC transporter
  Pfam annotation: Domain name=oligo_HPY; Domain location=259-318; Score=-15.7; E_value=0.062; Accession=PF08352.3; Description =Oligopeptidedipeptide transporter, C-ter
  Pfam module annotation: Pfam domain module=ABC_tran::ABC_tran::oligo _HPY; Domain location=318-459::48-256::259-318
VIQPNFWWLLLLTVIFGWMSLPHHAAPHVAQRHGCHAHLSAVYPVRFDHHVDLTGFSRLRPAGGLAVAGRTAAAGKKQFTGTVAWPFRLLRPRPAAVAADFYRIWRWRSGRAAWWKISRCASTPANAGAGGRIGIGQERDCAVDYASAAAAAGADGITQSAAQRGKAAAATRLQDFPHQLSGGERQRVMIAMALLTQPKLLIADEPTTALDVTVQAQILQLLRELQRELNMGMLFITHNLNIVRQLAHSVTVMRNGREVEHNRCDVLFRQPQQPYTRELLAAEPDGAPVGFPIRRGLLKRTVAEKTALHNLSFTLRRGESLGLVGESGSGKSTTGLALLRLIAARGEIWFDGQPLHQLSAKQLLPLRQRIQVVFQDPNSSLNPRMTVQQVIAEGLAVHQPQLSAAEQEARVIAVMEEVGLEAASRSRYPAEFSGGQRQRIAIARALILQPQLIVLDEPT

SEQ ID NO: 160801 - protein, 213 aa, Glycine max
  Coding DNA Sequence Number=SeqID_69116
  Gene Ontology: Mol. function=structural constituent of ribosome; Cellular component=ribonucleoprotein complex; Biological process =translation
  Homolog annotation: Hit_ID=A8AQJ8; Match level="QueryCoverage=77%, HitCoverage=99%, E-value=3e-83, Identity=95%"; Hit description=30S ribosomal protein S5
  Pfam annotation: Domain name=Ribosomal_L30; Domain location=164-209; Score=54.4; E_value=3.9e-13; Accession=PF00327.11; Description =Ribosomal protein L30pL7e
  Pfam annotation: Domain name=Ribosomal_S5; Domain location=10-76; Score=146.2; E_value=9e-41; Accession=PF00333.11; Description =Ribosomal protein S5, N-terminal domain
  Pfam annotation: Domain name=Ribosomal_S5_C; Domain location=85-158; Score=149.8; E_value=7.5e-42; Accession=PF03719.6; Description =Ribosomal protein S5, C-terminal domain
  Pfam module annotation: Pfam domain module=Ribosomal_L30::Ribosomal _S5::Ribosomal_S5_C; Domain location=164-209::10-76::85-158
MAHIEKQAGDLQEKLIAVNRVSKTVKGGRIFSFTALTVVGDGNGRVGFGYGKAREVPAAIQKAMEKARRNMVNVALTHGTLQHPVKGAHTGSRVFMQPASEGTGIIAGGAMRAVLEVAGVHNVLAKAYGSTNPINVVRATIDGLGNMKSPDMVAAKRGKSVEEILGSIGRLPKHKATLVGLGLRRIGHTVEREDTPAVRGMINAISYMLKVEE

SEQ ID NO: 160802 - protein, 234 aa, Glycine max
  Coding DNA Sequence Number=SeqID_69117
MYTGARFARTAVGRRLRIMRTNRTTLTQIWMTLLLSNILPSDHNSDLPLPKCMAPTKHPLDPDKSNRALGFPALITGLCQSFCVPITPSKVIRPPITRAFIEKYCTQRQVQGDAPPAADAPPPYQADPAGLFDMEQYLRHLVRQQAANHRAHVQTHDCLYQMSLSLQGQGFTSFPCLTPYQFRAEVAWPGDWPEARAGEPPAEAPVEAPDEADEAREDEEMTDLLDFLGGSGAT

SEQ ID NO: 160803 - protein, 253 aa, Glycine max
  Coding DNA Sequence Number=SeqID_69118
  Gene Ontology: Mol. function=heat shock protein binding; Biological process=protein folding
  Homolog annotation: Hit_ID=O82368; Match level="QueryCoverage=65%, HitCoverage=53%, E-value=5e-30, Identity=43%"; Hit description =Uncharacterized protein At2g29880
MGDSQENNKGKSRDKDNYVSWTMEDTNELLHLLVDAMNRGLRDANGSLSKQNVERIILPQLNAKTKFPKTYSHYLSRMKWFRNQYNMMSTLMRNNSGFGWDPIGKTFTAHEDVWKDYLKSHPSHSKLRGKSMVDYEYLKIVVGGGVSSGNNSISVDPDDTDATTFEPENRTVGIEEFSYDPNSDTFITPNNYEPAYHPPSPNQPSPPSHPPLDSEVPIEKQNCHKRRRSEYGGSSSAVGINNQGNVLEKANMK

SEQ ID NO: 160804 - protein, 76 aa, Glycine max
  Coding DNA Sequence Number=SeqID_69119
  Subcellular localization annotation: CTP_CleavageSite=30; ConfidenceScore=5.16e-01
MSDSTRRQIMVIRTLLLSVFHSRRPKTFKSSDARNSSLLGRDDRVQWGREVSWLSNFVVFKTLKFVDASDAFFFSF

SEQ ID NO: 160805 - protein, 95 aa, Glycine max
  Coding DNA Sequence Number=SeqID_69120
  Subcellular localization annotation: CTP_CleavageSite=26; ConfidenceScore=5.12e-01
TYQGNPCGVYPDLSSFTGSGVYPDLSSFTGSGVYPDLSSFIGSGVYPDLSSFTGSGVYPDLSSFTGSGVIQISVTCIKRSAPTQVHIIWYQSFGS

SEQ ID NO: 160806 - protein, 90 aa, Glycine max
  Coding DNA Sequence Number=SeqID_69121
MRIQGTNRLRILCPNILEGTSFVVQVEGISTWVVSQRALRGRARARLTGALSKGGKMRGVATNVYLWKTSEKPMETVQDENSKFGSCIYA

SEQ ID NO: 160807 - protein, 57 aa, Glycine max
  Coding DNA Sequence Number=SeqID_69122
MAQDNASKKVSLSYHKSTESAIRNLEVQVGKLAKQLTETSTSSFAANSENNPKEEYK

SEQ ID NO: 160808 - protein, 214 aa, Glycine max
  Coding DNA Sequence Number=SeqID_69123
MAAQVAPPMVEREMVTMMVDTLPVFYYEKLVGYMPSSFADLVFARERIKVGLKRRKFNYVYSTSANGRRIGATGAKRKEGDTHAVTSTPAWVKPPQISHEGGPPSSGFDHDSPDQQCPPWRRFQRSKELSPKANSRIRPDPDDVQRPLAIPHRQPNGCDISRKDLLASFPEVVQTLKGRNDPQKVYLGGPTKGGRDSPRWAREGFLSDASRRAT

SEQ ID NO: 160809 - protein, 80 aa, Glycine max
  Coding DNA Sequence Number=SeqID_69124
MISAFDQQNGRAIIEMNVEVDTVSYSNIPLPGGAVSSRMSNDDDNYIMSNSFTKETSKEEDEIDGDFFDTNDKAMSIETS

SEQ ID NO: 160810 - protein, 99 aa, Glycine max
  Coding DNA Sequence Number=SeqID_69125
  Subcellular localization annotation: CTP_CleavageSite=25; ConfidenceScore=5.08e-01
MTGVIVLNRGQQPKLGPHQSHFFAVARNVNVFWLTATATAILNHDRSLWGFGNSDVVKKASLWWRDLAKVPSQTNNVIFRGANVDWEAVLCARKGSGKT

SEQ ID NO: 160811 - protein, 173 aa, Glycine max
  Coding DNA Sequence Number=SeqID_69126
  Gene Ontology: Mol. function=chitin binding; Cellular component =extracellular region; Biological process=chitin metabolic process
  Homolog annotation: Hit_ID=UPI00006A17C9; Match level="QueryCoverage =55%, HitCoverage=100%, E-value=5e-11, Identity=37%"; Hit description= UPI00006A17C9 related cluster
  Subcellular localization annotation: CTP_CleavageSite=38; ConfidenceScore=5.31e-01
MCSPLEVRACSPLKVRAYSPLLARTCSPLKVRACSPLKARMCSPLEVRACSPLKVRAYSPLLARTCSPLKVRACSPLLARTCSPLKARTCSPLKIDCPFEKGDNSCNLILSFCKSLREFPQSEGTYWVRTSNLPLGSLEAHARCPSFPQCKALRYQSLSCFHSLVVRKNERSS

SEQ ID NO: 160812 - protein, 328 aa, Glycine max
  Coding DNA Sequence Number=SeqID_69127
  Gene Ontology: Mol. function=DNA binding; Biological process=DNA recombination
  Homolog annotation: Hit_ID=A1JUC1; Match level="QueryCoverage=83%, HitCoverage=98%, E-value=4e-65, Identity=51%"; Hit description =Putative resolvase/recombinase
  Pfam annotation: Domain name=Phage_integrase; Domain location=88-292; Score=62.1; E_value=1.9e-15; Accession=PF00589.13; Description=Phage integrase family
MGIALTKPCMSSGRRRVRVYTRKYVPRPRKAENEKLRGLPRELTQNSRSDASAHNVTGASATRYFDYASALALRNLAAHYGTAMPRYLLAPEVALLLDAERDQRKRLLIETFWNTGGRLNEVLPLTPEDFVLDGPDGRALDAPFAVLHTLKQRRDEEKQKQRGRGRPTREEQAAQREAEANPPRAVPLTDPGYVRRLREYLATVRLRKGERIWKIDSPDTVRTWIRTAVQAAERDGVTFTIRPITTKTFRDSFAMHLVQHGVPKKVIQSMMGHKDEKSTEWYTQVMALDVTRQLGVRFSMTPEDARALVMPGERLTLVRQNYDQGEGG

SEQ ID NO: 160813 - protein, 426 aa, Glycine max
  Coding DNA Sequence Number=SeqID_69128
  Gene Ontology: Mol. function=DNA-directed DNA polymerase activity; Cellular component=cytoplasm; Biological process=response to DNA damage stimulus
  Homolog annotation: Hit_ID=A6TIC9; Match level="QueryCoverage=99%, HitCoverage=99%, E-value=1e-178, Identity=72%"; Hit description =UmuDC operon protein-like protein
  Pfam annotation: Domain name=IMS; Domain location=7-355; Score=505.2; E_value=7.9e-149; Accession=PF00817.11; Description=impBmucBsamB family
MPMFGLADVNSFYASCEALFRPDLRGRPVVVLSNNDGCVIARSAGAKKLGIKMGAPWFQIRGQDFAERVHVFSSNYALYHSLSNRVMMALEEMTPKVEQYSIDEMFLDLTGIDGCEDFEHFGRRLRAHVLATTGLTVGVGMGPTKTLAKSAQWASKEWPQFRGVLALTPDNPKRTATLLENQPVEEIWGVGRRIGKRLNLMGIENALQLSRAHPALIRKNFSVVLERTVRELNGESCIPLEEFAPAKQQIVCSRSFGERITTKVAMQEALCQYATRAAEKLRKERQFCRRISVFIRTSPHAQGEVFYGNSAGENLTLPTQDTRDVIGVAMRSLDRIWLDGRRYMKAGIMLDDFTPNGVSQLNLFDEDKPRANSAQLMKVLDGINQSGLGHMWFARQGVSNEWQMKREMLSPAWTTRWEDIPVARVL

SEQ ID NO: 160814 - protein, 313 aa, Glycine max
  Coding DNA Sequence Number=SeqID_69129
  Gene Ontology: Mol. function=DNA-directed DNA polymerase activity; Biological process=DNA replication
  Homolog annotation: Hit_ID=Q1R1W9; Match level="QueryCoverage=56%, HitCoverage=62%, E-value=7e-27, Identity=38%"; Hit description =Putative uncharacterized protein yccB
  Pfam annotation: Domain name=DNA_pol3_theta; Domain location=1-74; Score=119.8; E_value=8e-33; Accession=PF06440.2; Description=DNA polymerase III, theta subunit
  Pfam annotation: Domain name=DUF1281; Domain location=135-287; Score =92.6; E_value=1.3e-24; Accession=PF06924.2; Description=Protein of unknown function (DUF1281)
  Pfam module annotation: Pfam domain module=DNA_pol3_theta::DUF1281; Domain location=1-74::135-287
MSYNLAARSREERDRVNVDLAASGVAWKERMNLPVFPGEVERQQPEELREYFRERLAFYRIEALKFPRGTDPVYQKETPCLHFSRAASQTREAVAGLLTRSPPCAGHSVRSGGACGLRVRPCLLSWSPGFCGGTVIGSSSDIERVRTFFNGGNRPEYVRATAEGIQLFLAGCAGLLQPVGDVRYPPYPALTVRDGCDTPENRAFTQWLSYLKSGAELTKDTCGELHTLWIACGISSWPWDALNAGQQAVIAALWKRKAYDWQFAFGEGEPGEMWNRLCRHTFMPEAALPFDMLQLIAPRLDVESRLYGRLLEG

SEQ ID NO: 160815 - protein, 69 aa, Glycine max
  Coding DNA Sequence Number=SeqID_69130
MRSWVRGQWIPFDANALVLKEDQECEFSQRRNRADGFDEEAIAQLLCAPSQDFSQTAIGRRVFHPPGTL

SEQ ID NO: 160816 - protein, 181 aa, Glycine max
  Coding DNA Sequence Number=SeqID_69131
MSKKLLSVEYALASVFNYEVSIYYGIHSDIRVKIYCRLNLLRASGFNYERLDILRETIGHTVKSYCRLNLLRAFVFNYERLDILRYSDIRVKSYCRLNLLKASCSITIASIYYGIHSGIRVKIYCRLSLLRASGFNYEGLDILQETIGRTSKKLLSFEFAQSFCFQLRASRYITGFIRTFE

SEQ ID NO: 160817 - protein, 80 aa, Glycine max
  Coding DNA Sequence Number=SeqID_69132
MVEGQLIIVSGEEDILVSCPSSTPYMEAAEESLEKAFQAFEVVSNAYVESPPVQPRSSDAALMVARVMLGHGYELGMGLG

SEQ ID NO: 160818 - protein, 133 aa, Glycine max
  Coding DNA Sequence Number=SeqID_69133
MTGRLLAGRILLPKSSNLAQVSEEDLIVMWAFHKGLKIDWAHLIRYRMHKSLRLNAPLPYPHLVTFFLQHFNIPLDSEPYVPIKRSFLIGTAVIASFGYQKEHNGSWVKKGARHVDEEGHGARRFLSSSKDFG

SEQ ID NO: 160819 - protein, 181 aa, Glycine max
  Coding DNA Sequence Number=SeqID_69134
MHTTNSTKVQSLLKPFRKNRSVTSTTIHVEVLHIITAFHIQEATIHLHHFQHKPIATYAIEKINQLIKCTQLLTHITRSSTNIILTSHHHTFTSEKPKMSTSSSTASTKIRYPIVRPPAIMQFRVAFHNDQRYPHFTMNNGHPITYTKFGSNTMEQPTQYGSNNTEADIFLQMDSETSGQI

SEQ ID NO: 160820 - protein, 161 aa, Glycine max
  Coding DNA Sequence Number=SeqID_69135
  Subcellular localization annotation: CTP_CleavageSite=56; ConfidenceScore=5.71e-01
MTDPLLTNPPASTPSPSDASASPSAVKRTRKASRLRSLSTRPPGVERLVVHVDPVTGKADGPHRKKLRTYLGIVARDKVDVTYENWKETEFDILEAFDSRTKRKLLQIVGERWRQFKSDLTREWALAADQDGVEDTVCEKYGISKEKWAQFCQTRRDPSWE

SEQ ID NO: 160821 - protein, 153 aa, Glycine max
  Coding DNA Sequence Number=SeqID_69136
  Homolog annotation: Hit_ID=A5AF53; Match level="QueryCoverage=63%, HitCoverage=11%, E-value=5e-09, Identity=35%"; Hit description =Putative uncharacterized protein
MEFLCPFCGKVEEEASHLFIHCTKIQSIWWETLSWMNISSVLPLNPRCHFLQHSFVQVAGIRVKRWQCWWVVVVWSIWQMRNRIVFSNESFNGNKLMEDAINKHILILVRLTMMRIMKLAKYRLKAQVEKNEGPSGEGQSPRVEKDEGPSGEG

SEQ ID NO: 160822 - protein, 163 aa, Glycine max
  Coding DNA Sequence Number=SeqID_69137
  Homolog annotation: Hit_ID=A5BSZ8; Match level="QueryCoverage=56%, HitCoverage=9%, E-value=2e-17, Identity=48%"; Hit description =Putative uncharacterized protein
MDLGLSILEEKLATIIDSSSNEEKSHYKAWERSNRLSLIFIRMIVADNIKTIIPKINSANKFMGLVGEHSQTNDKSLAGTLMSTLTTTKFDGSFQKETRLKNQGSHSVHFVSHQGNQEVGKKFVKKHGKGKGPLKINDYSLQIHKKASKSNNCHVYGKSGVLI

SEQ ID NO: 160823 - protein, 418 aa, Glycine max
  Coding DNA Sequence Number=SeqID_69138
  Gene Ontology: Mol. function=sucrose-phosphatase activity; Cellular component=cytoplasm; Biological process=metabolic process
  Homolog annotation: Hit_ID=Q9FQ10; Match level="QueryCoverage=100%, HitCoverage=100%, E-value=0.0, Identity=82%"; Hit description =Sucrose-phosphatase
  Pfam annotation: Domain name=Hydrolase_3; Domain location=12-245; Score=-22.8; E_value=7.3e-05; Accession=PF08282.3; Description =haloacid dehalogenase-like hydrolase
  Pfam annotation: Domain name=S6PP; Domain location=8-261; Score =539.4; E_value=4e-159; Accession=PF05116.4; Description=Sucrose-6F -phosphate phosphohydrolase
  Pfam annotation: Domain name=S6PP_C; Domain location=262-393; Score =269.7; E_value=5.9e-78; Accession=PF08472.1; Description=Sucrose-6 -phosphate phosphohydrolase
  Pfam module annotation: Pfam domain module=Hydrolase_3::S6PP::S6PP_C; Domain location=12-245::8-261::262-393
MDRLKSSPQLMIVSDLDHTMVDHHDSENWSLFRFNALWEAHYRQDSLLVFSTGRSPTLYKQLRKEKPLITPDIAIMSVGTEITYGKSMVPDDGWVRCLNQKWDKDIVIEETSKFPELKRQAETEQRPHKVSFYVEKDKAKHVTETLSKVLEGRGLDVKIIYSGGVDLDVLPKGAGKGQALAYLLKKFETEGKPPVNTLVCGDSGNDAELFSIPGVYGVMVSNAQEELLQWHAENAKDNPKILHASERCASGIIQAIGHFKLGLNLSPRDVSDIGQNVENGSPGLEMVNFSLLLESWRRAEVEKTELFISGLKATTLPSGFFIHPSGADHNIKEYVNILRKVHGDKQGKQFRIWVDDLLATPLGSDTWLVKFDKWELSGEERQGCVVTAIISKKDSDWFTWVHVHETWLENSEQGLWIL

SEQ ID NO: 160824 - protein, 171 aa, Glycine max
  Coding DNA Sequence Number=SeqID_69139
  Homolog annotation: Hit_ID=A8C977; Match level="QueryCoverage=66%, HitCoverage=16%, E-value=6e-22, Identity=47%"; Hit description =Forisome
MAVGHDHGSHIEDQAPPRRNEHHRVSSTVAIKEVKKVEPQISKVDSNSANEEEINCGFSWDAKALIAIVGFSLYGEFWRLDRVQAVDQFGNSLRKLNQVQISRRVPVDMIDPVAVFREMLNYINLWAKWFSMDYNTEAVHSLQAGMQDIPLVVYWTIASTVASIGNLVDIS

SEQ ID NO: 160825 - protein, 76 aa, Glycine max
  Coding DNA Sequence Number=SeqID_69140
MAAEWRRKRERRRHFKEKMSLEKAHHHRRPWIRAWRKKEMNEGRGREEHEILCSKRALKSEPTNPRSIPRFSTKCA

SEQ ID NO: 160826 - protein, 138 aa, Glycine max
  Coding DNA Sequence Number=SeqID_69141
  Gene Ontology: Mol. function=nucleoside-triphosphatase activity; Cellular component=integral to membrane; Biological process=transport
  Homolog annotation: Hit_ID=A7Q050; Match level="QueryCoverage=86%, HitCoverage=17%, E-value=4e-16, Identity=42%"; Hit description =Chromosome chr8 scaffold_41, whole genome shotgun sequence
MEKANTSLVRTKSDQLLESMVAGLKSPPSSDHSANGVVDSRKSSRWLTGASPGRGGKNTHIRKSRSAQISQMKLELDDVSSGAALSRASSASLGLSFSFTGFTMPPEEIADSKPFSDDDIQFHSQRFTLTFNQDLQHY

SEQ ID NO: 160827 - protein, 210 aa, Glycine max
  Coding DNA Sequence Number=SeqID_69142
  Subcellular localization annotation: CTP_CleavageSite=19; ConfidenceScore=5.49e-01
MATPPASPSPTPPTDASTSPSTLKQTRKATWLRSLATRPPWAEKPVVNIDPATGKADDPYKKKLRTYLEIVAPEFEIPEAFHTRTKKKILHIVSERWRQFKSDLTRKWALAANKDEQKLMVEKTKKRLKEAAKSGSIEGIIDLPSPIRRHVKWKMARTKKTGQMTFETAKEITDRIESVTRIVRPPWTSGYPDCCHWATRAPGCVRAVGA

SEQ ID NO: 160828 - protein, 414 aa, Glycine max
  Coding DNA Sequence Number=SeqID_69143
  Gene Ontology: Mol. function=translation initiation factor activity; Cellular component=mitochondrion; Biological process=translational initiation
  Homolog annotation: Hit_ID=A7QUD4; Match level="QueryCoverage=100%, HitCoverage=100%, E-value=1e-149, Identity=64%"; Hit description =Chromosome chr11 scaffold_177, whole genome shotgun sequence
  Pfam annotation: Domain name=DUF794; Domain location=22-414; Score =378.7; E_value=9e-111; Accession=PF05634.2; Description=Arabidopsis thaliana protein of unknown function (DUF794)
MLPRHVQTIGSLLERVMQVHVAQLRGINTHFCLWYSSVSTCNELPRKLNKYERKPPVTSFNELKRQARLERKERQKVHENKLQPPENGLLVEHLIPIAHEVYAARCHTITLVFFIVVVQAFSMLPVDILFNYDICLCGEVHVGHPPHQIRTCDVRGSPSSKEHSWVKGGVEHVLPLVESFHLYDRIGRAVSHNEMLEVDRIPAIVELCIQAGFDIPEYPTRRRSFPVYCVAGRIIDFEKRFPKEISLGEDIEAHGFWFKKKRVDVNTNSMAMQSDDIQAIAVRGMKAWEKMHGGASKLMEKYAVQTCGYCPEVQVGPKGHRGRNCQAFKHQMRDGQHAWQEARIDDLAPPVYVFHIRDDQPRKPLVNELKKYYGMLPAVVELFAQAGAPVDKSYACMMREDVVIPQMDEEKWVV

SEQ ID NO: 160829 - protein, 86 aa, Glycine max
  Coding DNA Sequence Number=SeqID_69144
MSEEVDMNDENEDEVGVNEEYVDCSYAFNTSQTKLMWIALVVSVGLGRKILSEKILAVGNVGVLLSFVGNQWLEANDGCEVNVWES

SEQ ID NO: 160830 - protein, 107 aa, Glycine max
  Coding DNA Sequence Number=SeqID_69145
MELLKFNLKSHDPSKYNCVIDYQKHREIPLGSSICIIHSKGGKSLCSSQKVSCNQETGCLLDCESCNQETGCLLENLEHKGEGFQGVFKVCKGFTEIVEISSGLLED

SEQ ID NO: 160831 - protein, 330 aa, Glycine max
  Coding DNA Sequence Number=SeqID_69146
MSSSTTEDGSSIRDRFLVGREENEEKNKRELEGNFRKVKRQKRDNAIVGGKKFRKNREGKFSLITIPRYEWVSTMVNSYPTQFQTHDLIERFKRGIDMTIFDDVELLIVEPNNVEEGIFMRVSNGEADFVYMYEDVFKEMDESSKSNLGKGSTTPVEEQVEGNHTNVGILYVSQTKGEKKGLEDEAKKRKSNGDKEPTEKLENEKIERKKQRKKKRKRWKSLRSWPKLKKRRGQTHKSTLLMSKDNPSSRTVQTNRDMMDYVGPVESLDAIEIFLSRSFVVVHHWQETVSKAYEKSKVMFVQMKAIKVEIARESQFYFESDKEEKIERRG

SEQ ID NO: 160832 - protein, 298 aa, Glycine max
  Coding DNA Sequence Number=SeqID_69147
MASISLSVFLPIKAKELALTKGGHQVHVASVQDISETALVDKDPVHHEVRYDDGDNHRVILVDGVDALEVPFLGLIGLSSIGKAASDGLDYTSDVLGSFCAAPLDVLWVLVLLGGCLGCVMLVPGPFGEKLMLVWPVPLVQLVQVDLGVYFSLVALLSGLADFILESEHFFHLDVALGSFAQFVRELARGLLVYLSQTGQGGQGHAVRPTSGVLRTESFDKGVKVVYGSRFACVRKASRCSSGSVVPSYRSRLSGFHPKGMSTSIMRSTKGCRWTFDATRWQGVGGFLIALGTSDIGL

SEQ ID NO: 160833 - protein, 509 aa, Glycine max
  Coding DNA Sequence Number=SeqID_69148
MSEESKASICCNETRMSEKERGTCLLPCAECESKLCRGDSSLEEQRVTGLSSPQSVDESCPVSSVTTLTRSALKTNVTSIFYNRHMRHTLCTLPYVSLIELARIGMVAIPHLRILTEVLPTASPPRVRGEPVSVTMILPLQRRKQDLVDVEVLPNSGVAVRLVELGPLTMVVVAAACERTKRKYVPRADLGFCQNVYHGQTLGFGDVSTKGGLWVFDKPGWDLVMERASPRVNLGFVEPWTRDVFVLGFVKPMEMCQGLPRMGLGFCRRIRIGKRRAWWDSPRADLGFCEPFGGLTKELSNLGFGHRALAYMPLFMVERTRDVLWVSYTRDLVGCSCAHVVGARTGDLVYALAYMSLVVGDMYWSHSDDMFFHGARVCMSIAMGGTHWRLIRVLVHDSNMLLHVCHSSGVVYTGGLACAQMSSVAHTGSLVECSVLVRTCHSSRVACTGVTVICYCIYASYKVACTRSCLLVNGSSVSTGIMAFVPYVSRALRMTPLTAFAYPLVWDVR

SEQ ID NO: 160834 - protein, 144 aa, Glycine max
  Coding DNA Sequence Number=SeqID_69149
  Gene Ontology: Mol. function=alpha-amylase activity; Cellular component=chloroplast; Biological process=carbohydrate metabolic process
  Homolog annotation: Hit_ID=Q5BLY1; Match level="QueryCoverage=41%, HitCoverage=6%, E-value=3e-23, Identity=80%"; Hit description =Plastid alpha-amylase
MPESCDRRVTIVVSHLSTKTLRLSVPFQESLTLAVEEFTLLPTPRKYHNLLCNMIEDVFCYALCFQHGTLGSDSSALFFVTDRKIDELKNSVKRFDEIGIKVLGDAVLNHHCAHYRNQNGIWNIFGGPLNWDDRAVVADDPHFQ

SEQ ID NO: 160835 - protein, 316 aa, Glycine max
  Coding DNA Sequence Number=SeqID_69150
  Gene Ontology: Mol. function=hydrolase activity; Cellular component =nucleus; Biological process=metabolic process
  Homolog annotation: Hit_ID=A7Q038; Match level="QueryCoverage=97%, HitCoverage=93%, E-value=1e-101, Identity=60%"; Hit description =Chromosome chr8 scaffold_41, whole genome shotgun sequence
  Pfam annotation: Domain name=Abhydrolase_3; Domain location=84-305; Score=262.6; E_value=8.3e-76; Accession=PF07859.4; Description =alphabeta hydrolase fold
MAFPPHVVEDCMGLLKLLSDGTVLRSNINFQEQPQPTQHDNLVQFKDFVFLKKFNLHLRFYKPKFEDNDDDDNENNNKKLLPVVMFLHGGGFCFGSRAWPHMHSCCVRLATSLRAAVVAPDYRLAPEHRLPAAVDDGVEAVRWLQRQKGHHGGDEWVTRGVDFDRVFILGDSSGGNIAHHLAVQLGPGSREMDPVRVRGYVLLGPFFGGVVRTRSEVGPPEQMLTLELLDRLSIPIGETRDHPLANPFGPNSPNLGHVKLDPILVIVGGNELLKDRAADYATRLREQGKNIEYVEFEGKEHGFLTHDSHSEAAEEL

SEQ ID NO: 160836 - protein, 144 aa, Glycine max
  Coding DNA Sequence Number=SeqID_69151
  Gene Ontology: Mol. function=RNA-directed DNA polymerase activity; Biological process=RNA-dependent DNA replication
  Homolog annotation: Hit_ID=Q2HRM6; Match level="QueryCoverage=63%, HitCoverage=27%, E-value=2e-09, Identity=33%"; Hit description=RNA -directed DNA polymerase
MKVDGEITNEYEISEEKVEKKLEDEATQGDMLMEVVPMLQVPDEEVKVTQQVEVCLTIGRYNDRVLCDVIPMEHHEQKIILKPLSPREVCDDQIRMREKREQEKDKSEEAKRNRKQKSDTRKGKSDTHEKKSDTHERKFNCLAE

SEQ ID NO: 160837 - protein, 267 aa, Glycine max
  Coding DNA Sequence Number=SeqID_69152
MAFIISKSCIHFSIQRFMQKSVLDASRSLTVKCGPWIPGCPQQPPRPSECPQQPGPQEPHLPPKRKVGLQVKPLAPDTPACIGTIGSLLGTEGLTGAGMGSGGQFFQMYAKLMVGLKDSKVRESDITPLAKHKAVMRAGKPNREELDWIRGMRSESKVGVGKDTPGLCKGGQVLPQKLSGSPLSEYAEYLSLGSSTTGVSRKVFNVAASNLMVLVLLAALQFPKEFIIMRVGQLHILLGEDVPVLNIGLILLPSKAPGAKKMMHVSF

SEQ ID NO: 160838 - protein, 441 aa, Glycine max
  Coding DNA Sequence Number=SeqID_69153
MGLSQMPLLKKRFYQVKIKGLEVTSLQELRELMGQLQWQAFRKAYGKIWNLAMIEAFAKAIASLTQHYDQPLRWRKPYLFSGFYPSMSRIARVVRISAQELDRVKQNRNGVAGIPRKCLEERARALASQNEWPPFIDILALLIFEVVLFPNVDDLVDLAAIDAFLAFHHNKESPVVAILANIYDTFDRRRFPNVPLIGTRGCINCNPILAIRQLGYPMRGALLVESLTSFVTRGFSDPNARVVESLHTRSRLAPEAESTKEEEAEASEESKVVQALKAKLEKAQAVKERFKTTAVRIRRENDELRDINTAIAKVLEQETKRSKKSLSQQLSEIEANMLAIIGKYKEELDLATSHEHKVADEYAQVYMEKNARGRMIDALHPEATMWMDRFALTLNGSRDLPRLLTKAKAMADLYSTPKEIHGLLSYCQHIIDLMAHIIRNR

SEQ ID NO: 160839 - protein, 49 aa, Glycine max
  Coding DNA Sequence Number=SeqID_69154
MTEWWCLELGGDDNGMATNMAMMTPNKVEIEDGEPPGMFANKKSHVDIY

SEQ ID NO: 160840 - protein, 216 aa, Glycine max
  Coding DNA Sequence Number=SeqID_69155
  Homolog annotation: Hit_ID=UPI00016621D1; Match level="QueryCoverage =80%, HitCoverage=40%, E-value=3e-17, Identity=33%"; Hit description =UPI00016621D1 related cluster
GWRLLSPLLLCVPLHLHGGKSPLKDLIEAQRSSLHRSPTSKLPSCTFTFRGLHVLASRGLHVLAIRGLHVLAFRGLHVLTFRGLHAFAFVGLRVLTFRGLHALTFRGLHVLTFRGLDVLAIRGLPALTFRGLHILTFRGLHAFAFVGLHVLTFRGLHAFTFVGLHVLNVRGLHILAFRGLHALTIRGLHILTFRGLHVLTFRGMHALTFRRLHAFV

SEQ ID NO: 160841 - protein, 704 aa, Glycine max
  Coding DNA Sequence Number=SeqID_69156
  Gene Ontology: Mol. function=glutamate carboxypeptidase II activity; Cellular component=integral to membrane; Biological process =regulation of inflorescence meristem growth
  Homolog annotation: Hit_ID=A7Q033; Match level="QueryCoverage=99%, HitCoverage=98%, E-value=0.0, Identity=58%"; Hit description =Chromosome chr8 scaffold_41, whole genome shotgun sequence
  Pfam annotation: Domain name=PA; Domain location=147-237; Score=14.9; E_value=0.0097; Accession=PF02225.13; Description=PA domain
  Pfam annotation: Domain name=Peptidase_M28; Domain location=333-523; Score=49.4; E_value=1.3e-11; Accession=PF04389.8; Description =Peptidase family M28
  Pfam annotation: Domain name=TFR_dimer; Domain location=567-702; Score=65.9; E_value=1.3e-16; Accession=PF04253.6; Description =Transferrin receptor-like dimerisation domain
  Pfam module annotation: Pfam domain module=PA::Peptidase_M28::TFR _dimer; Domain location=147-237::333-523::567-702
  Subcellular localization annotation: CTP_CleavageSite=8; ConfidenceScore=5.55e-01
MVPSNTVTAFTAKPSPLLTFVMLIVLGVVGFYSLHFPPRPTTSPDPSRFRHVFVSSSSNSTVASYLRALTVHPHLSGTKPASLTARYVVNHFTTLGFQTKTVQHSALLSYPVRSSLAAHFSDGTSFEFQLTEPDTEKEVVAPYHAYSPSGAAEAAAVFVNYGREEDYRQLVAAGVEVAGCVVVARGGALPRGAVVEAAERHGAAAAAVFVERDTWREGFERGHVMRGGIGDPLSPGWSGVEGGESLGLEDSEVLKRFPKIPSLPLSAEAAERILESLGGAPLPLDWRGTLKSSKVKNVGPGPTILNFTYQGELKVATIENVFAIIKGREEPDRYVLLGNHRDAWTYGAVDPNSGTAALLDIAGRFSILLRLGWTPRRTIILCSWDAEEFGMIGSTEWVEQNLVNLRSKAVAYLNVDCAVQGPGFFAGSTPQLDDLLVEVIKQVKDPDTEGTTIYENWAAAGGNSNVGLLVYWPMIQRLSGVDSDFAPFVQHAGVPSVDVYYGKDYPVYHTAFDSYNWMTKFGDPFFQRHEAVTGIWGLLALRLADDSIIPFNYLSYANQLQVYNNILSNLLDKQITLHPLNTSIQEFASAAKEANDESKKLKWQEASDRSIDMKMRALNDRLMLAERGFLDVDGLQGRQWFKHLVFGPPSDHESKLDFFPGIADSLSGMDKMSEKERLAAIQHEIWRVARAIQRAASALRGDLA

SEQ ID NO: 160842 - protein, 127 aa, Glycine max
  Coding DNA Sequence Number=SeqID_69157
MDKLLKDDVIIHIVDPLSYKMFITSHDDELVDFRGLGKIEKAFVPLQEKYVSRQKFHNQGCYNMDDDAFIQLKRKWEENVTALEIKMKRLLTKMTKIEVVLKTTREVDLVQVVQDFEGCNYLDVELG

SEQ ID NO: 160843 - protein, 99 aa, Glycine max
  Coding DNA Sequence Number=SeqID_69158
  Homolog annotation: Hit_ID=A2I5F8; Match level="QueryCoverage=67%, HitCoverage=4%, E-value=3e-07, Identity=45%"; Hit description =Integrase
MASSNFPFLEGNSIDRPLMFNGEGYHYWKTRMQILIEAIDLNIWEAIEVGPFIPTKGEGRHKRIQAVSPSFFWKREKRDTKRIQAVSPWRILFGKGRRK

SEQ ID NO: 160844 - protein, 321 aa, Glycine max
  Coding DNA Sequence Number=SeqID_69159
PRVGSRAPGHYYHGYYRPEPKEGKERTKARSSLAIHSEGGWGSTSFMTHGPIETRFSDMDFFEMVNHFFNREREVIQNPLAPVQNRWKFPTPIPQQPGITAGIEVSRTQGDAFLVLDKLLGNNLFLISSFFPMTTRNGQIKNFTSNFGPQHPAAHVRHEAADAESAPMPLAMPCLVPRHGGGQKGEGCEGGLVIHTSALAGPGVPVKGASAYPGVIITTCTSHLGTAERVTRLLSHSTTFVPVIHSLTERSSEGQPAHTQPAGRMALLAKTVRRKRRSAKRGRPVPGEHSIGRKGSQDGGRARGAGSFDGNGSFSPIREAL

SEQ ID NO: 160845 - protein, 499 aa, Glycine max
  Coding DNA Sequence Number=SeqID_69160
  Gene Ontology: Mol. function=L-arabinose isomerase activity; Biological process=carbohydrate metabolic process
  Homolog annotation: Hit_ID=Q1C7J3; Match level="QueryCoverage=96%, HitCoverage=96%, E-value=0.0, Identity=70%"; Hit description=L -arabinose isomerase
  Pfam annotation: Domain name=Arabinose_Isome; Domain location=1-489; Score=1094.0; E_value=0; Accession=PF02610.6; Description=L -arabinose isomerase
MEQKVWFVIGTQHLYGAETLRQVEQHARQVMDGLNQAGTLPVPLELKPLVKSPDEALALCREANHDSQCVGIITWLHTFSPAKMWIGGLSILHKPLLQFHTQFNAEIPWDSMDMDFMNLNQTAHGGREFGFIGARMGLQHSVVTGHWQDKTSQQRIARWINAALAKQASQQLKVARFGDNMREVAVTEGDKVAAQIQFGYAVNGWGVGDLVEVVNSVSDGDVNALVDEYESQYLFSAAASVNGDKRQNVLDAARIELGLKRFLDSEGCKAFTTNFQTLHGMTQLPGLAVQRLMAQGYGFAGEGDWKTAALLHILKVQAGTRAGGTSFMEDYTYHFAPGNELVLGSHMLEVCPSIAKEEKPLIDVQFLGIGGKADPARLIFSTPAGRAVNASVIDMGDRFRLLVNVVDTIEQPQALPKLPVARALWRAQPSLATASEAWILAGGAHHTVFSQALDVEDMYLYGELHGIEVLVIDDETRLPAFQRCAALERRVLPPETLIA

SEQ ID NO: 160846 - protein, 79 aa, Glycine max
  Coding DNA Sequence Number=SeqID_69161
MSAARPDVLSAALTMVVKSKRFHIIFIPLKGVCCRGTNALQAWRNCAKTSATHLTKQNELKGLRVSACQTADSAYGQNA

SEQ ID NO: 160847 - protein, 110 aa, Glycine max
  Coding DNA Sequence Number=SeqID_69162
MNNCLFAKSMNTLEVSSLLKSLQVWAHIRDLAPFHRRFTSLLRITDSLIKGRSTSGVQGKLRCLAIAITVYCIWLSRNKLIFEDYQFSVIEVISKIKFLMYRQAHLLHFL

SEQ ID NO: 160848 - protein, 23 aa, Glycine max
  Coding DNA Sequence Number=SeqID_69163
MIQENTMNSLSAPAALSEFIDIH

SEQ ID NO: 160849 - protein, 309 aa, Glycine max
  Coding DNA Sequence Number=SeqID_69164
  Gene Ontology: Mol. function=motor activity; Cellular component=cell projection
  Homolog annotation: Hit_ID=UPI00016621D1; Match level="QueryCoverage =82%, HitCoverage=40%, E-value=2e-23, Identity=35%"; Hit description =UPI00016621D1 related cluster
MPAYHVASPLEDYTSSPLEDCMSLPSEGYKSSPSEGYKSSPSEGYTPSQTELHVLTFRELHILAFRGLHALAFRGQHVLAFRGLHVLDFRLLHVLAFRGQHVLTFRGVHILAFRGLHVLAFRGLQVLAFRGLQVLPFRGLHALAFRGLHVLAFRALHVLAFRGLDILAFRGLHILAFRGLHVLTFRGLHVLAIRGLNVLTFRGLHALVFRGLHVLPFRGLHILAFRGLHVLAFRALHVLAFGGLDVLAFRGLHILAFRGLHVLTFRGLQVLAIRGLNVLTFRGLHVLAIRGLNVHTFRGLHALVNRGLD

SEQ ID NO: 160850 - protein, 89 aa, Glycine max
  Coding DNA Sequence Number=SeqID_69165
MEVNEPEIDTTTQITFLEKESGQRKRGVFAQDPTSITTRVAKLKDLSGLERESELFYKATRLMKKRANKITFVALEESELQLGWIKSDT

SEQ ID NO: 160851 - protein, 193 aa, Glycine max
  Coding DNA Sequence Number=SeqID_69166
  Gene Ontology: Mol. function=citrate CoA-transferase activity; Cellular component=citrate lyase complex; Biological process=acetyl -CoA metabolic process
  Homolog annotation: Hit_ID=A4WEA4; Match level="QueryCoverage=100%, HitCoverage=38%, E-value=7e-98, Identity=95%"; Hit description =Citrate lyase, alpha subunit
  Pfam annotation: Domain name=CitF; Domain location=1-191; Score=47.6; E_value=5.6e-23; Accession=PF04223.3; Description=Citrate lyase, alpha subunit (CitF)
GLIEKLLDTQCFDGQAAASLARNPNHVEISTNVYANPGSKAASCDQLDVVILSALEIDVDFNVNVITGSDGVMRGASGGHCDVAAAANLTIVVAPLLRSRIPTVVKRVTTRLTPGESIDVLVTDHGIAVNPARPEVRERLMAAGLKIVDINALYERAISLTGVPKPIEFTDKIVGVIRYRDGSVIDTVRQVKE

SEQ ID NO: 160852 - protein, 192 aa, Glycine max
  Coding DNA Sequence Number=SeqID_69167
  Gene Ontology: Mol. function=chitin binding; Cellular component =extracellular region; Biological process=chitin metabolic process
  Homolog annotation: Hit_ID=A7K9I5; Match level="QueryCoverage=62%, HitCoverage=21%, E-value=2e-10, Identity=40%"; Hit description =Putative uncharacterized protein Z575R
MLVRMIRTHFFAAARDQGMAQELIKGNYWPLKLSSGADVESTQGESKVRTYSPLTVRTCSPLKARACSPLKARTTGSPLKVRACSPLKARTCYPLKARTCSPLKVRTCSPLKVRAYSPLKARTCSPLNLRTSSPQKVRTCSPQKVRRLALLARTCSPLKVIGTSTLRVQPYEEARDGLIERASHPKFTRFGH

SEQ ID NO: 160853 - protein, 350 aa, Glycine max
  Coding DNA Sequence Number=SeqID_69168
  Homolog annotation: Hit_ID=Q6WAY4; Match level="QueryCoverage=94%, HitCoverage=63%, E-value=3e-32, Identity=29%"; Hit description =Putative uncharacterized protein
MGTNQTGKRFYQVKIKGLDVTSLKELGRLMGPLQMQAFRKAYGKILDLTIAEIFTEAVVSLTQYYDQPLRCFTFGDFQLVQTVEEFEEILGCPLGGRKPYLFSGFLPSLRKIAIMVRDSARELDCVKQTQNGVVGLPRKYLEGKARDMPNQEEWVPFMDQREPGVAILADLFDTFDRRCEKSSAQIICCLPALSVWLVSHLFQQDIRHACPLRSHRSCVEKRRVDWDQHLAGIGGRTTNWFTRWKEGNEGVLFSCGDYPNIPLIGTRGCFNYNPALAIRQLGYLMRGAPTKESLFPFLVRDFDAQSFKVIQRVHKAWESPLGKDKEFRGIRNGIIGGYHEWLKVRTRGLD

SEQ ID NO: 160854 - protein, 55 aa, Glycine max
  Coding DNA Sequence Number=SeqID_69169
SHLFRFFRSFPQINVGGDSARIPFVEHASRESRVALPPKGRLRRLATPLGRATLE

SEQ ID NO: 160855 - protein, 340 aa, Glycine max
  Coding DNA Sequence Number=SeqID_69170
  Homolog annotation: Hit_ID=A3XJL8; Match level="QueryCoverage=34%, HitCoverage=63%, E-value=2e-35, Identity=63%"; Hit description =Putative uncharacterized protein
  Pfam annotation: Domain name=DUF1599; Domain location=57-118; Score =106.2; E_value=9.9e-29; Accession=PF07659.2; Description=Domain of Unknown Function (DUF1599)
MVEESEEDEFIAIVNYSIIGLIQLEKGLSNDFNENNDEILSLYDKYASEAQALMERKNHDYGEAWRDMRISSITDLIYQKVLRTKQIEDNQGKTIVSEGLDANYFDMLNYAVFFIFILSGFVKAVDLKRIRPERRIQQHNENTYGQGIMHEPLIDFRDYKIGTDIKAEKDKISKNPSEYKTFYSLKNQKTGEVLKVNQDDYIKETKYWADGSPWKIEEGKNESVIVKEGYKSEIVKFKIEDPTGLEVTDEIIKAPKAVLVFSYHPKELSQELIQKVEAKVNAQKGAVIYGVSTDPNTFKTIKNAMMDGTAIKTIARSNPFVLILQNGKIVDKQPAKDYIK

SEQ ID NO: 160856 - protein, 230 aa, Glycine max
  Coding DNA Sequence Number=SeqID_69171
  Gene Ontology: Mol. function=chitin binding; Cellular component =extracellular region; Biological process=chitin metabolic process
  Homolog annotation: Hit_ID=UPI00006A17C9; Match level="QueryCoverage =60%, HitCoverage=100%, E-value=9e-11, Identity=28%"; Hit description= UPI00006A17C9 related cluster
  Subcellular localization annotation: CTP_CleavageSite=65; ConfidenceScore=5.60e-01
MVRTCNPLKARKSSPLKMRMFGPLKARACSLLKMRTFSPLKMRACSPLKARTCSPLMVRACGPLKAKARTCCHLKVRMCSPLTVRPCSPRKVRTCSPLKARTCSSLEARTCSPLEARTCSPLKVKVHDPLKVRACSPLKIDCPFEKGDNSCNLVLSFVNLSGNSLRVDGVATYPSAGGRRVTRGMRVPRKEYARSRHQRLFEENVEKTGKDAIYELVLAPHTSVPRDGSL

SEQ ID NO: 160857 - protein, 79 aa, Glycine max
  Coding DNA Sequence Number=SeqID_69172
MNKSLKRAFAKRDTQWLSARKNPEEDELSGSLSAPLQVIKRTASAHPLSERSALSQKSLMCTKRSIRALSARARTRPPI

SEQ ID NO: 160858 - protein, 139 aa, Glycine max
  Coding DNA Sequence Number=SeqID_69173
MPGLVEMGYLFCAIAQSPPSTTYDGVVPGDMSRGLGGRQGVWETLEGNERCRFCGTIRLTATSLVHPEQPARTLQQLDLEEDPEELPPEPAMDAPDLPEDDEDPLPDVDSPEDIMSASEADSTEESGPGGTAISDDSSS

SEQ ID NO: 160859 - protein, 21 aa, Glycine max
  Coding DNA Sequence Number=SeqID_69174
QEDKVYKLNKALYGLKQAPRA

SEQ ID NO: 160860 - protein, 165 aa, Glycine max
  Coding DNA Sequence Number=SeqID_69175
LEGVPSVVELTILAAVSLMKNQIMKSIIWGTSQDKISCRPQQQGPSLYDRTMNLEETLAQFMKVSMSNQKSTESAIKNLEVQVGQLAKLLANRPSRSFSANTEKNPKEECKAVMTRNRMAIQVDEGKEVPYPLVPSKKDKERHLARFVDIFKKLEITLPFGEALQ

SEQ ID NO: 160861 - protein, 46 aa, Glycine max
  Coding DNA Sequence Number=SeqID_69176
MEVEEPWLGLWLPLNYQVDMGASHHRTPELGPTLILSAGEDQIRKT

SEQ ID NO: 160862 - protein, 37 aa, Glycine max
  Coding DNA Sequence Number=SeqID_69177
MKNVEERLKIFAKIPTEALWKRLGSDFLHGTNFSLIS

SEQ ID NO: 160863 - protein, 94 aa, Glycine max
  Coding DNA Sequence Number=SeqID_69178
  Gene Ontology: Mol. function=aspartic-type endopeptidase activity; Biological process=DNA integration
  Homolog annotation: Hit_ID=A5BPN8; Match level="QueryCoverage=64%, HitCoverage=6%, E-value=1e-14, Identity=63%"; Hit description =Putative uncharacterized protein
KEKWSLNELISYFVQEEERLKREKGLKVLMLLSFNSNIVGTGSLLVNDNLYLLDTVASYGESFNAELCGTKRRIDNTNSGALWHKHLGHISKKN

SEQ ID NO: 160864 - protein, 249 aa, Glycine max
  Coding DNA Sequence Number=SeqID_69179
  Homolog annotation: Hit_ID=UPI00006A2D9E; Match level="QueryCoverage =90%, HitCoverage=97%, E-value=3e-14, Identity=16%"; Hit description =UPI00006A2D9E related cluster
MIGPLNESISCFLKRVDPWVLEPIAFKGLHVLIIRGLNALTFRGLHALTIRGLHVLAIRGLHVLTFRGLHVLAFRGQHVLALGTSTPTFKGLHALAYKRLHVLTFRGLHVLAFRGQHALAFRGLHILVFKGLHVLAFRGLHAIAIRGLRVLAFRGLRALAFVGLHALTFRGLRVPAFRGLHTLDIRGLHILAFGGQHFLAFRGLHALAFRELHVLAIRGLHVLAFKGLHALRLQKTAHRHLQRTTRSRL

SEQ ID NO: 160865 - protein, 169 aa, Glycine max
  Coding DNA Sequence Number=SeqID_69180
VDDQGDEREEGIGVVGAPEGSWRRWPAAAVVEEDPLHFFDDSKVRGDDGQQQRWWRKILCVSSMILLFDEVLMNFNLWVNSGGGGGVFVASYCDASPCACLGNRQRPVIRARTLGPYWTSSGPLDVLRARSLQIVDGIRDQLSHVHTYLCHDGINQLTLRQGEIGVVVA

SEQ ID NO: 160866 - protein, 104 aa, Glycine max
  Coding DNA Sequence Number=SeqID_69181
MDIYEDTDIPVILGRPFIQACSRTKCLLIGNGSGLRGSGGENQNMMSPIKPCAKRIFVHGLSLDSHALSGKPLHPRLIWSTKLAKAELSQFRLDLNSAKRWPNH

SEQ ID NO: 160867 - protein, 205 aa, Glycine max
  Coding DNA Sequence Number=SeqID_69182
MASSLWTGRVACKQPAWLATSLNVDLATPTGEYIMNLVITVLYFNGRVHEENDGVIFEGSKKAIQIKREISFNALKKKIGDKAQSPRNVSNLHGDEDDDDDDDDLVSNSYVEESLDEDDSIDGISDIDDEVTDMIQPVRIVHPTQGVQGIQNPFWNDALHYNNINCSHPDEEDICGLEMPSSFNVGQELYGDMDFDSKDAVKNAV

SEQ ID NO: 160868 - protein, 170 aa, Glycine max
  Coding DNA Sequence Number=SeqID_69183
  Homolog annotation: Hit_ID=Q1RSH0; Match level="QueryCoverage=48%, HitCoverage=45%, E-value=6e-08, Identity=34%"; Hit description=H+ -transporting two-sector ATPase, alpha/beta subunit, central region, related
MREGVSKKLFSGVSIGKNQVEVDLLQFVDDTLFFAKSSMDNVMTLKSILRGGGGDRYSNASFWWSDVEKGCGNREYGEWFDENIVTVSMLDVREQVRDGWRWKTSDSGLYSISEGYKVLQHQSFAGEMDNCSDSIWKMATPSNVKAFTWKALLDRIQSKANYAEELINGW

SEQ ID NO: 160869 - protein, 211 aa, Glycine max
  Coding DNA Sequence Number=SeqID_69184
  Homolog annotation: Hit_ID=Q9LVB6; Match level="QueryCoverage=90%, HitCoverage=71%, E-value=7e-41, Identity=45%"; Hit description =Similarity to embryo-specific protein 3
  Pfam annotation: Domain name=ATS3; Domain location=30-183; Score =185.4; E_value=1.4e-52; Accession=PF06232.2; Description=Embryo -specific protein 3, (ATS3)
  Subcellular localization annotation: CTP_CleavageSite=47; ConfidenceScore=5.19e-01
MIKFVLFLFCFASALTLSVSESKSASVQPHAAESFSVGYIQMKTAANCSYLVVISTSCSSPKFTTDKIGITFGDANGNQRYSSFVSCVNWIRKLWAIYSLNCKVYEPRLDDPISRTFEQCSSDTFQIDGACASPICYVYLYRSGAEEGWEPESVKIYGYNSEPITFDFNTSIPNGTWYGYNLCETPSSSYQLSPQKWFMSLVLGSVLSFWL

SEQ ID NO: 160870 - protein, 205 aa, Glycine max
  Coding DNA Sequence Number=SeqID_69185
  Homolog annotation: Hit_ID=A7QGV8; Match level="QueryCoverage=57%, HitCoverage=60%, E-value=6e-21, Identity=45%"; Hit description =Chromosome chr16 scaffold_94, whole genome shotgun sequence
  Pfam annotation: Domain name=ATS3; Domain location=38-167; Score =57.2; E_value=5.8e-14; Accession=PF06232.2; Description=Embryo -specific protein 3, (ATS3)
MAMKLQVLLLLLLCIASELTTHSVSNSLERCDAETEYNSYGYIDERKKALNDSSCTYQVVIGASCSSPNFTMGDIIIRFGDPLRNQVYEEKLIVPRSRTIEQCSRDIFQLNGACVSSICFVELYSYGAMDGWKPERVQIYDMMNILPTTNFKLIPLRGRWWIGYNWCLTKFLFNYLGHFNDNKKKVIGSKMVSFVVETLVNKSGS

SEQ ID NO: 160871 - protein, 161 aa, Glycine max
  Coding DNA Sequence Number=SeqID_69186
  Gene Ontology: Mol. function=hydrolase activity; Cellular component =anchored to membrane
  Homolog annotation: Hit_ID=A9PAS0; Match level="QueryCoverage=29%, HitCoverage=23%, E-value=2e-14, Identity=78%"; Hit description =Putative uncharacterized protein
  Pfam annotation: Domain name=X8; Domain location=18-89; Score=34.6; E_ value=1.6e-08; Accession=PF07983.4; Description=X8 domain
  Subcellular localization annotation: CTP_CleavageSite=22; ConfidenceScore=5.45e-01
MAALALALLLLAFSGTSNSCVLCSSNRVYTFINAKAISFSPSYMPNTVRAHCNYAVNSYFQRKGQGSCDFAGTATVTASDPSSGGTCVYPSSVRSNSDSSSDSEAMSSQVFFGNDPSWVDHPVLEGEKTLFGDGSGRANLKPFSRPLPSRMEALATLGGMT

SEQ ID NO: 160872 - protein, 57 aa, Glycine max
  Coding DNA Sequence Number=SeqID_69187
MKVVLCSGRQRIRDERRRHLLGNKPWKKELHHQECALDKKLGDDASMEEKKEREKER

SEQ ID NO: 160873 - protein, 98 aa, Glycine max
  Coding DNA Sequence Number=SeqID_69188
  Subcellular localization annotation: CTP_CleavageSite=51; ConfidenceScore=5.08e-01
MATFVNTSGHHRNTSSHGLASGHGCVSGHGRISHLHYGCMSRLRPWSHLASLAMLSSPSCNIEEADKGKVEEKLDNLIGSHELIYIVGSVNSANGYIS

SEQ ID NO: 160874 - protein, 84 aa, Glycine max
  Coding DNA Sequence Number=SeqID_69189
  Homolog annotation: Hit_ID=A5B715; Match level="QueryCoverage=76%, HitCoverage=12%, E-value=2e-14, Identity=59%"; Hit description =Putative uncharacterized protein
MDIEYAIRKDKPLAITNESNLVVVALYERWERSNQLNVMFIKIKISVGIRGFVDQHEKDMQNLRRPVGSEQSILTGNKLGCEGY

SEQ ID NO: 160875 - protein, 76 aa, Glycine max
  Coding DNA Sequence Number=SeqID_69190
MVQPTNPRSSPRFSTKSHEPEIYPKAHENPKVFSCISDPIYLESSIQCPCEVGLHHIVTQVAPIRRLPPGGLSRGH

SEQ ID NO: 160876 - protein, 221 aa, Glycine max
  Coding DNA Sequence Number=SeqID_69191
  Gene Ontology: Mol. function=nucleic acid binding; Cellular component= nucleus; Biological process=mRNA processing
  Homolog annotation: Hit_ID=A7QGU1; Match level="QueryCoverage=47%, HitCoverage=7%, E-value=1e-28, Identity=58%"; Hit description =Chromosome chr16 scaffold_94, whole genome shotgun sequence
MSFAAYKMMQCPTGIDNCAAGFLTHSRSDFVPLQPDDLDAAEWPSRPRHHVGPLPNLVVTAANVLEVYAVRLQEDQQPKDASDDSRRGTLLDGIAGASLELECHYRFRLCPLAEIVEVAITFSEMVSVRHLSCGRCVDLPEFRMCSTNKGWVLQKGLLLSMWQTKIWLFSALLVQNLLKELSVEHLMLQCKSNCVATAGAYSVKFANIYVSLNIDLQLDID

SEQ ID NO: 160877 - protein, 1150 aa, Glycine max
  Coding DNA Sequence Number=SeqID_69192
  Gene Ontology: Mol. function=nucleic acid binding; Cellular component= nucleus; Biological process=mRNA processing
  Homolog annotation: Hit_ID=A7QGU1; Match level="QueryCoverage=99%, HitCoverage=87%, E-value=0.0, Identity=65%"; Hit description =Chromosome chr16 scaffold_94, whole genome shotgun sequence
  Pfam annotation: Domain name=CPSF_A; Domain location=808-1084; Score =96.5; E_value=8.1e-26; Accession=PF03178.6; Description=CPSF A subunit region
MWNLGFSQYTASRLALLGLDVWITMVGSGLVGDDDAFGSSGAVAARIESSYMINLRDLDMRHNLPHDAYKLLAVPSPIGGVLVIGANTIHYHSQSASCALALNNYAVTLDSSQEIPRSSFNVELDAANATWLLSDVALLSTKTGELLLLMLVYDGSRLGDSMLVQFSCGSGVSMMSSNLKEEVGDIEVDAPSKRLRRSPSDALQDMVSGEELSLYGSATNRTESAQKSFSFAVRDSLINVGPLKDFSYGLRINADANATGIAKQSNYELVCCSGHGKNGSLCVLRQSIRPEVITEVELPGCKGIWTVYHKSTRSHNADSSKMADDDDEYHAYLIISLEARTMISFLAIGEAFNWSASANEICVLIFMVLETADLLSEVTESVDYYVQGKTLAAGNLFGRRRVIQVYERGARILDGSFMTQDVSFGASNSESGSASESAIALSVSIADPFVLLRMSDGSIRLLIGDPSTCTISVTSPASFESSKGSVSSCTLYHDKGPEPWLRKTSTDAWLSTGVGEAIDGTDGAAQDHGDIYCVVCFDNGNLEIFDIPNFNCVFSVENFMSGKSHLVDALMKEVLKDSKQGDRDGVVNQGRKDNIPNMKVVELAMQRWSGQHSRPFLFGILSDGTILCYHAYLYESPDGTSKVEDSASAGGSIGLSSTNVSRLRNLRFVRVPLDAYPREDTSNGSPCQQITIFKNIGSYQGFFLSGSRPAWVMVLRERLRVHPQLCDGSIVAFTVLHNVNCNHGLIYVTSQGVLKICQLPSGSNYDSYWPVQKVLKPLNQVISLVDQDFNHQNESQNMNPDEQNRFYPIDEFEVRIMEPEKSGGPWQTKATIPMQSSENALTVRMVTLLNTTSKENETLLAIGTAYVQGEDVAARGRILLFSLGKITDNPQTLVSEVYSKELKGAISALASLQGHLLIASGPKIILHKWNGTELNGIAFFDAPPLHVVSLNIGAQLSLLAKDFGSLDCFATEFLIDGSTLSLMVSDDNRNIQMSESWKGQKLLSRAEFHVGAHVTKFLRLQMLSTSDRAGSVPGSDKTNRFALLFGTLDGSIGCIAPLDEITFRRLQSLQRKLVDAVPHVAGLNPRAFRLFRSNGKAHRPGPDSIVDCELLCHYEMLPLEEQLEIANQIGTTRSQILSNLSDLSLGTSFL

SEQ ID NO: 160878 - protein, 93 aa, Glycine max
  Coding DNA Sequence Number=SeqID_69193
MTSLVHLTRPPHDIIFVHVQRVYLKDHCPLPPPALLWSSNCYSQEKLAVGRLSTQGWLSFFQMDQLFTMILAFTSKLQLRCPFEYQTAVILQA

SEQ ID NO: 160879 - protein, 126 aa, Glycine max
  Coding DNA Sequence Number=SeqID_69194
MCSDVWWLRLKTKVLPREEPSFAHVEGEVGYCSERRSSSAGSCGRKVKRFFRGFRQKKAKKVLPLDPAEEGSAGNMFSADPAEEPAKPSSACNFSWSRKNLRNLLPQATYHSRGRTCETSSTDHDV

SEQ ID NO: 160880 - protein, 77 aa, Glycine max
  Coding DNA Sequence Number=SeqID_69195
MKVKVPTLSVAVVGGGKRGTQMVMDGDEWMYEIMSERADMDCENTESCGANEPHADCLDAFKTSLVFECQGDVLRWA

SEQ ID NO: 160881 - protein, 189 aa, Glycine max
  Coding DNA Sequence Number=SeqID_69196
  Homolog annotation: Hit_ID=A5BEV8; Match level="QueryCoverage=96%, HitCoverage=22%, E-value=5e-08, Identity=24%"; Hit description =Putative uncharacterized protein
YALNQIAAEFERVYYAGKNPSRCGCIMRTTHNLACAYQRLSEPEVNITEEMKTISKRFEELDVCSIVTIKSKLWEIDYYDLNSLCPPLEKYVDVFHYVQNSNSSVKRSASLSEQVIPRRIMPMLDQFHPCIHDSIENIIDVKADSNCGYRAITTLLGICEDSWALVHNHLLKELVKWSDEYINLLSGKY

SEQ ID NO: 160882 - protein, 119 aa, Glycine max
  Coding DNA Sequence Number=SeqID_69197
MSYLGGDLVLITSLNKEKANEFAKFEDDNFLSIFTSIEILRDNMVTTNRLMWLKYMAEETKSLSKVDAAWVWVFILCSQSMKTKVTVKINGLLCNVRLMEENILLYLKVDAIVGWNLKE

SEQ ID NO: 160883 - protein, 203 aa, Glycine max
  Coding DNA Sequence Number=SeqID_69198
  Homolog annotation: Hit_ID=Q9T090; Match level="QueryCoverage=33%, HitCoverage=15%, E-value=2e-07, Identity=52%"; Hit description =Putative uncharacterized protein AT4g27680
  Subcellular localization annotation: CTP_CleavageSite=72; ConfidenceScore=5.51e-01
MSPYTPRLSFLKCLNNGQHSSVPSTTSSKWPVLLLIESFSTTMQLTYPSGTTATVETHSMKPPPPLPPQPPPSSLRQDCSTTEKACTKVGSEVVLGSRETLLRFIDVFMVVSSLCGREDETTPLLATFTRDVIACDVINLDDIDVEFNSIGGLETIKQALFKLGQFKQHFAEEEVEGVGVEQRARSLIPHDAMKYLDTFPRCS

SEQ ID NO: 160884 - protein, 90 aa, Glycine max
  Coding DNA Sequence Number=SeqID_69199
MENDGWDLGFGFDADVEGGDPGGEDTGEAFAGERVEKVEARLGEAVEATPLLDHADAGLSNATTEEAERVPHPCKPPNNNHLLLFLLLCC

SEQ ID NO: 160885 - protein, 164 aa, Glycine max
  Coding DNA Sequence Number=SeqID_69200
MAVYPYEGGRPVMKSRDKSCHGAVGTGFWQNPNVRQLAIMVLDPRMGSGIGANLLKLILKRRTSGKMFVHGIDEDEDGEGMAEELLLPFADGGGYGMELADLGVTMLSLNNTHSHAGSICLNGKWAGEIGPRNLHKDWVVKGMGQDAMASSFEGLGAIPLADTI

SEQ ID NO: 160886 - protein, 492 aa, Glycine max
  Coding DNA Sequence Number=SeqID_69201
  Gene Ontology: Mol. function=protein serine/threonine kinase activity; Cellular component=integral to membrane; Biological process=protein amino acid phosphorylation
  Homolog annotation: Hit_ID=A5BKB5; Match level="QueryCoverage=84%, HitCoverage=77%, E-value=7e-33, Identity=36%"; Hit description =Putative uncharacterized protein
  Pfam annotation: Domain name=DUF26; Domain location=145-199; Score =94.9; E_value=2.5e-25; Accession=PF01657.8; Description=Domain of unknown function DUF26
  Pfam annotation: Domain name=DUF26; Domain location=260-314; Score =72.9; E_value=1.1e-18; Accession=PF01657.8; Description=Domain of unknown function DUF26
  Pfam annotation: Domain name=DUF26; Domain location=375-423; Score =24.6; E_value=5.2e-06; Accession=PF01657.8; Description=Domain of unknown function DUF26
  Pfam module annotation: Pfam domain module=DUF26::DUF26::DUF26; Domain location=145-199::260-314::375-423
MASYKILFLFTLVSFLNFATIQAQEEESSTPVYLFHNCSGGNTTAYSTFQLNLWTLLSSLTSNAVSSTGFYNTTVIEANPSNSVFGLFMCRGDVPPQLCQASCDLESFMRLLFDAMNETADEAARPTTGNKFATRQTNISGFQRLYCLAQCTPDLSPNDCRTCLRTVIGDLPWCCEGKQGGRVLYPSCNVRYELYPFYRSEGEWVPSDSQFSEDSNYLYHNCKTNVTGSAFKMNLETLLSYMSSNAMNRMDYYEGVEDIVYGLFMFRRDLPSRLCQQCILNATQKISTECNSFQEAVIWYNHCMLRYSNRHFFSQVEKNPTFEILNLITTSDPASDQDFFTYTLTKTLVNVTEAARDRNERYVTKSTKLNDLQTLYTLAQCTQDLSTDNCVGCLDDINGKIPWSRVGIGGRVLYPSCNLSVVEYQHRLKDRLRMGTVLHRLCNYSRCRMNGCDFYIGLQSTDVEWVGMEDFYIGYQSTDVELKGFLPRLSVN

SEQ ID NO: 160887 - protein, 54 aa, Glycine max
  Coding DNA Sequence Number=SeqID_69202
MYNTTITHIGLHCSAHWQMVVILPKENLIVCALKELDDTPQPKSKAGARWIVVK

SEQ ID NO: 160888 - protein, 152 aa, Glycine max
  Coding DNA Sequence Number=SeqID_69203
  Homolog annotation: Hit_ID=Q6WAY4; Match level="QueryCoverage=83%, HitCoverage=23%, E-value=4e-12, Identity=33%"; Hit description =Putative uncharacterized protein
MGSSQAPSLKKRFYQVKVKSLGVTSLKELGQLIGQLQRQAFRKAYGKIWDLAMAEVSTEAIASLAQYYDRPLRCFTFGDFQLSPMVEEFEEILGCPLGGRKPYLFSGFYPSLARISKIVQISMQELDYRKQVENGVVGVPRKYLEAKARILA

SEQ ID NO: 160889 - protein, 41 aa, Glycine max
  Coding DNA Sequence Number=SeqID_69204
MAILIASTSTTFHRDESLGNINGFMIPTWLAHEENARIMHE

SEQ ID NO: 160890 - protein, 97 aa, Glycine max
  Coding DNA Sequence Number=SeqID_69205
  Subcellular localization annotation: CTP_CleavageSite=67; ConfidenceScore=5.53e-01
MGPKSTLRLMRILGPSLASLVQSSWSLLSNALGPTPNLPRFSLNSTKLAIPSLFRPKPLEAMTCKIILMMPKNQELRKFQRIRLQESSLKESRFKNS

SEQ ID NO: 160891 - protein, 64 aa, Glycine max
  Coding DNA Sequence Number=SeqID_69206
MAHQNPPYLAFCTPGQNETKSKIQGYQRETNKNIYIFLNEHLGMKGIGCNEAKDKVGKKYGISS

SEQ ID NO: 160892 - protein, 84 aa, Glycine max
  Coding DNA Sequence Number=SeqID_69207
  Subcellular localization annotation: CTP_CleavageSite=67; ConfidenceScore=5.34e-01
SWAKLSSWAKRISIAKCNFSMLSAKENQAEHQHQSRALSTRSVCLAQQVPSARVSSRLALSPISLTRAKREGGAKHNATNSESI

SEQ ID NO: 160893 - protein, 725 aa, Glycine max
  Coding DNA Sequence Number=SeqID_69208
  Gene Ontology: Mol. function=peptidase activity; Cellular component =integral to membrane; Biological process=nitrogen compound metabolic process
  Homolog annotation: Hit_ID=A4THD6; Match level="QueryCoverage=45%, HitCoverage=68%, E-value=1e-138, Identity=76%"; Hit description =Modulator of DNA gyrase
  Pfam annotation: Domain name=CN_hydrolase; Domain location=128-325; Score=34.5; E_value=8.3e-08; Accession=PF00795.13; Description =Carbon-nitrogen hydrolase
  Pfam annotation: Domain name=PmbA_TldD; Domain location=420-718; Score=376.4; E_value=4.5e-110; Accession=PF01523.7; Description =Putative modulator of DNA gyrase
  Pfam module annotation: Pfam domain module=CN_hydrolase::PmbA_TldD; Domain location=128-325::420-718
APYDVDFDLYWRGAPWQPQVNTLSGALQVKMGKGEIDSMGGGRAGQLLRLVSFDALLRKLQFDFSDTFGKGFYFDSIRSTAWLKDGIMHTDNLLIDGLAADIAMSGQIDLARRRIDMEAVVAPAISATVGVATAFVVNPIVGAAVFAASQVLGPLWSKISLIRYHISGDLDQPKINEVRDNLAQIEQQIKQLNAGPIANRRKTGRWPAAERGARTGAPLWRVVAGGLDALDQPRNPELITTSSLLFDDQGEIRARYDKLHMFDVDINDAHAHYRESDTYQHGQHLTVVDTPVGRLGMTICYDLRFPALFQALRAQGAELISVPAAFTRVTGGAPRADPPHLGPHAGCRRLGQGAGREPGRRGGAEGARGHHKPAAPAATDAGAAAQPIPDVADGALLATNKLSHQDLYQVLGQLAERRIDYADLYFQSSYHEAWVIEDGIIKDGSYNIDQGVGVRAVSGEKTGFAYADQITLNALQQSAQAARSIVREQGDGRAHTLGEIGYRALYPLLDPLQSLPREEKIALLHRVDKVARAADARVQEVNASITGVYEQVLVAATDGTLAADVRPLVRLSVSVLVEQDGKRERGSSGGGGRFGYDYFLETVDGDVRAEAYAKEAVRMALVNLGAVAAPAGNMPVVLGAGWPGVLLHEAVGHGLEGDFNRRGTSVFSGHMGELVASELCTVVDDGTLQGRRGSLAIDDEGVPGQYNVLIENGVLKGYMQDKLNA

SEQ ID NO: 160894 - protein, 295 aa, Glycine max
  Coding DNA Sequence Number=SeqID_69209
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIAHGDPRLQQPGMEPQRVGLQVGHIAGKDRRVGKIVDHRPHLHGGAYRVRPQQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 160895 - protein, 124 aa, Glycine max
  Coding DNA Sequence Number=SeqID_69210
  Subcellular localization annotation: CTP_CleavageSite=22; ConfidenceScore=5.09e-01
MSSLMTDVCGANTFPMRKYNSRAFHLKVHRLHLVRFFRRFPQINVGGDSARIPFMEHASRESRVALPSKGWLRQLCFKHVPEQIRKKLDDKAEPMILIGYHPTSAYGRRSESAPNRSSSIKRVD

SEQ ID NO: 160896 - protein, 84 aa, Glycine max
  Coding DNA Sequence Number=SeqID_69211
  Pfam annotation: Domain name=zf-CCHC; Domain location=20-37; Score =19.1; E_value=0.002; Accession=PF00098.14; Description=Zinc knuckle
MERCHNFDNGKRSQEGSSTLKCYKCNRPGHIKAHFPIKLIDTVDLEGGPVGKPVVPAALMNRANARGEAVCGIWALAECILAYY

SEQ ID NO: 160897 - protein, 196 aa, Glycine max
  Coding DNA Sequence Number=SeqID_69212
MASKKRKAPATPSHVRYDRSRFTSPEAWERYTDIIVPRKLLPERNLVRVRGHLIKFDEDTLNTFLKTPVIIEEGETLSAYSRFALLRPNPQELAAKLCIPRRGFELNADGQPLKILKKNMTTLAQTWSVLSYSNLIPTSHTSDITLDRAKLIYGIIMKMDMNLGYLISHQISIIAQHDSSRLGFPAITTALCKARG

SEQ ID NO: 160898 - protein, 77 aa, Glycine max
  Coding DNA Sequence Number=SeqID_69213
MVEDARTTLGNQFVGLWTRWMHEQRLAINSWGYGLDGGGCMNDNQFMGLRIRFDGGRCTNSARQLFRGAPDSIVEDA

SEQ ID NO: 160899 - protein, 110 aa, Glycine max
  Coding DNA Sequence Number=SeqID_69214
  Subcellular localization annotation: CTP_CleavageSite=52; ConfidenceScore=5.04e-01
MGTSEPYTGVMKGTMQKLQGGPLGTSTLTFRGLHALTFRGLHSLAFRGLHVLAFRGLHALAFRRLHALAFRGLHALAIRGLHALTFKGLHALTFRGLHVLAFRGATRPRL

SEQ ID NO: 160900 - protein, 343 aa, Glycine max
  Coding DNA Sequence Number=SeqID_69215
  Homolog annotation: Hit_ID=Q5XM22; Match level="QueryCoverage=20%, HitCoverage=40%, E-value=3e-17, Identity=60%"; Hit description =Resistance-like protein HAAS-2
VTITLDDVASLLHLPIIGTFHSFETLHVDEAVLLLVELLEVSADEARVEIVQCHGAYVQLSWLRDTYRSKCDVAHWTVAARAYLLQLQGCTLFANKSAIHVHVTFLDAFRDFTQSGSYTWGAAALALPVSTYRKRLDRLASDGVCWMPYGDHCAVRDFVLISLFFGHIQWGPSIVIHRPERVVRKFGYVYSIPPHSPASRLCLEDIDDRWMHFSKYLALVGQICVVLGQYATDYINWFYMMYHPFIRPAQPRDPARHPPVFQDDTYVELDIPQYLMVTTTMEEAPADAPSHVEQSRHAVDACQAIAERLKRLLNMRIMTKSIEAYSVMEDCLRIARGVTVKRN

SEQ ID NO: 160901 - protein, 62 aa, Glycine max
  Coding DNA Sequence Number=SeqID_69216
  Subcellular localization annotation: CTP_CleavageSite=55; ConfidenceScore=5.09e-01
MSPPPLEPHNHSQTHLKLSGRLPLQSPFSGGLRTAKSLKTLWHFAPGIRMTIIIYAVSIVRL

SEQ ID NO: 160902 - protein, 80 aa, Glycine max
  Coding DNA Sequence Number=SeqID_69217
MQFKDTIGSIQRAFKSAKIQVGKLVEEVTQAMNRREQEIVEVDTQEESPVNKHDLEEEDEEKAQQWEQCLQTHTQQEDNS

SEQ ID NO: 160903 - protein, 145 aa, Glycine max
  Coding DNA Sequence Number=SeqID_69218
  Subcellular localization annotation: CTP_CleavageSite=44; ConfidenceScore=5.20e-01
MLLVQASHTFLLQCNNNNNNSQQQQQRQQSTETPSQPSLEELVRQMTIHNMQFQQETRASIQSLTNQMGQMATELNQAQSQNSDKLPSQAVQNPSNVSAITLRSGKQTKVPIPVAEPTPERENEIDAQLFHPPDHVGPTSSNSDV

SEQ ID NO: 160904 - protein, 136 aa, Glycine max
  Coding DNA Sequence Number=SeqID_69219
  Homolog annotation: Hit_ID=A5AHJ1; Match level="QueryCoverage=91%, HitCoverage=45%, E-value=1e-10, Identity=33%"; Hit description =Putative uncharacterized protein
MRTREGTSLVDQFKWSVHPLGCSKRTREDDELNIKILNCLTRTWEPKITVIKESKDLASMSMEALFRELLAYEHELIQQSHVEETKKKRKGIALKVSSSKEDCKESSSDGKDVENFILMVKKLGKFSQYIQRQKIF

SEQ ID NO: 160905 - protein, 266 aa, Glycine max
  Coding DNA Sequence Number=SeqID_69220
MARRDKLWSFCTLLSSRGGGPDDMRRQIMVIPHPFAIQTQSCSMARRDKLWSFCTLLSSRGGGPDDMRRQIMVIPHPFAIQTQSCPMARRDKLWSFCTLLSSRGGGPDDMRRQIMVIPHHLLPFRHSRFRWHAETNYGHSAPFCHPEAAGPMTCEDKLWSFRTPLPFRHSRVRWHAETNYGHSAPFCHPEAAGPMTCGDKLWSFRTPFAIQTQSCPMARRDKLWSFCTLLSSRGGGPDDMRRQIMVIPHPFAIQTQSCPMARRDKL

SEQ ID NO: 160906 - protein, 58 aa, Glycine max
  Coding DNA Sequence Number=SeqID_69221
MGVQIAPRPIWALQKVPPEGAEALPKRFRNVFREESRKGFVRSSTFFIRSSSFFDLQR

SEQ ID NO: 160907 - protein, 113 aa, Glycine max
  Coding DNA Sequence Number=SeqID_69222
  Pfam annotation: Domain name=G-patch; Domain location=1-42; Score =23.4; E_value=0.00028; Accession=PF01585.14; Description=G-patch domain
MVARVMLGHGYEPGMGLGKNNGGRTSLVRTRGNCGKFGLGYKPTYADIRKNISERKNKGQGPRSGQRNKEAPPCHINRSLVSVSFRREGQVAAICDDDSPRRSDLVQPCPPSF

SEQ ID NO: 160908 - protein, 74 aa, Glycine max
  Coding DNA Sequence Number=SeqID_69223
MPGLGRDWSSLVLGNSTPPDVPKVSSLLDYGVPVICGTRWRSGDGANQISHFHKSNMNPSSPVAHLQLSSRTPM

SEQ ID NO: 160909 - protein, 115 aa, Glycine max
  Coding DNA Sequence Number=SeqID_69224
  Homolog annotation: Hit_ID=A7PII8; Match level="QueryCoverage=51%, HitCoverage=15%, E-value=6e-18, Identity=69%"; Hit description =Chromosome chr13 scaffold_17, whole genome shotgun sequence
MDIDYAIKKDEPPAITETSEPDAVDLYEKWERSNRLSVMFIKTNISASIRGSVDQHDNMIVETEPFGSDENDEDEEEEEVVEICVPDRGSTHNRKGEVDVRGKDATTRRLCGTDD

SEQ ID NO: 160910 - protein, 73 aa, Glycine max
  Coding DNA Sequence Number=SeqID_69225
  Subcellular localization annotation: CTP_CleavageSite=33; ConfidenceScore=5.29e-01
MGATTGGSKILRTAPFSLFIGKRGRRLPPSSPRVMGILRKHYGCPGSPEIPFLTKWGRWLPPSSPRRARLLPP

SEQ ID NO: 160911 - protein, 139 aa, Glycine max
  Coding DNA Sequence Number=SeqID_69226
GYIYLGLTENKRGYISCGSVLVEGTSIRFKENKGGPLDPTEGVRDMRSWVRGQWIPFDKDALSQFLGDPLVLKEGQECEFSQRRNKAKGFDEEAIAQLLCTPGQDFARTAAGRWVRIMHTSMDHLDPNVDDIAAQQCLA

SEQ ID NO: 160912 - protein, 96 aa, Glycine max
  Coding DNA Sequence Number=SeqID_69227
MWGYRMVTRTFRQPGANEPIDAQRLTSSSTPFAIQGQRVRWQAEIPYGHPHLSSTEGNEFDGFTLVVRKHSSPTMREILLCWAGAIKCDGVPLVGI

SEQ ID NO: 160913 - protein, 346 aa, Glycine max
  Coding DNA Sequence Number=SeqID_69228
  Homolog annotation: Hit_ID=UPI00006A2939; Match level="QueryCoverage =57%, HitCoverage=100%, E-value=4e-12, Identity=29%"; Hit description= UPI00006A2939 related cluster
CMPSPSEGLHTVTFRGLHILTIRGLHALAIRGLHVLAIRGLHTLAFRGLYALAFKELHVFAIRGLHALTLRGLHALTFRGLHVLAIRGLHALAIGGLHVLTIRGLHVLAIGRLHALAFRGLHVLAFRGLHILTSKGLHVLAMRGLHPSPSEDYRLCIDTFKGLHALVFRGLLVLTFRGLHALTFRELHAFAFRGLHICALRELKGLEVCFYQFLGHPQYFRATNCASTTREGGYRATTMHIGARFHPDRHRETSADHAHYHNSDLPLPKDHVRKTPSGPEEVQQGPGVSSSDYGPLSVLRSARCPQQGRRRARHHCHLRSPLAHLQRLERCLQPVADQQATKSKAK

SEQ ID NO: 160914 - protein, 827 aa, Glycine max
  Coding DNA Sequence Number=SeqID_69229
  Homolog annotation: Hit_ID=A5BWY2; Match level="QueryCoverage=33%, HitCoverage=36%, E-value=4e-92, Identity=54%"; Hit description =Putative uncharacterized protein
  Subcellular localization annotation: CTP_CleavageSite=31; ConfidenceScore=5.09e-01
MGLSSASDISLLLLALTCIAAIAKLGPSRVSCSQFFSMITEISGSLMDMMVGLIPWGSEEVVFWVNLAQKQLQQAIDKEKIWSRLTTSESIEVLEKDLAVFGFFIALGRSTRSFLLTNGFDTLDDPIEDFISVTKQSHMHRSKHEGPPNAEAVRQAFDVCSHWMQSFIKYSTWLESPSNVKAAEFLSTGHKKLMECMEELGMIRDKALETEGKKAAHRRRSTVQSTIKESGSFDEALKSVEETVVRLEKLLQELHVSSSSSGKEHLKAACSDLEKIRKLWKEAEFLEASFRAKADSLQEWIPIGTRLGTGMDNDKVTFELTGEARMTYNHSTSPDSLRMRRRKNCGFISKSLVMDGRRAQLRKEARQHHLQWAEDTPIPENDSRVVARNNRHPAPMGRPGSQNHSREGSWSSVYLDLTTTGIKWLKETWVERLKNLSMFNRVEDDLLWGIEADISPKYMGDDIVLLLGLTDDRAQQMVEEEIEGGVSSFHSLEKWNPKLRPGCQLTWVNCWGIPLVAWDTEQIRKIVVGIGEVVDVDDDVEMLRRLDRARVLIKTPWKPLIQHTVNVHIQGEVYGVHLVEEGGICSEMHHCRRGSEYGSSEEIETDVSDVGMPLKEDRRRSALEDGLTVNPTENQAQTVAPEFVQVAHKGAQLAHAAHGVAKVADVMTDETGMTKTSACKPGKKEAQWIPYWAWTQNERHTNQCGLRSTIQRKVAKKRGNLDGRRKRNVTTTWKRKVYSRTRRFQKKSQVECAIAEAHEIESQLKAVVEIADQGENMKQAATDIWNIAKQLGVTGAADQGRFVEKILIMEERDRKEAERLGKKSDNP

SEQ ID NO: 160915 - protein, 157 aa, Glycine max
  Coding DNA Sequence Number=SeqID_69230
MRISIRFDVDRHEMTKAIWGGVCKVGGGGEVAEGWAGAGVSQSRVWSLPTIMRRVVVGVEARDQVQRVVVSQEEQNLRKPQAVTMGPLVLAVVAQPLVAEDFHFLDPVHVGLKGNASYDDDPIIYPPVAVLAQPPEAETEGEELELPDEAPGLTLRR

SEQ ID NO: 160916 - protein, 226 aa, Glycine max
  Coding DNA Sequence Number=SeqID_69231
  Subcellular localization annotation: CTP_CleavageSite=63; ConfidenceScore=5.88e-01
NLTSFFLPPSQMNQITATTPTSATTFVDLKVLQSPTSTAINSSVTSTLRHCSCSPSLPPGCASCTMVVANQLDLLEQAIKDGIVVSRSERGRVVIIFVAAGEGLRCWLLVGFLVLGGEDAMCLLLVGGRDEDKRTNVRAVEKLKIKDVTNGIRADLSPNMIWFEDKPGESWWACNTPIESHQNEKDSKMGDLLEVSRKVSQKWLPTKDFDRWRVLTNKDVERSVTT

SEQ ID NO: 160917 - protein, 123 aa, Glycine max
  Coding DNA Sequence Number=SeqID_69232
MVQANRQWDWRVAAADWTRHWQQRYAHAQEQNASEAGDIGGRYTMNSVITVLYFNGRVYEDNDGIIFEGSKKAIQIKRGISFSALKKKIGDKCRENILSCKSAMMKTLKRCWKVLNNNKKCQF

SEQ ID NO: 160918 - protein, 170 aa, Glycine max
  Coding DNA Sequence Number=SeqID_69233
  Homolog annotation: Hit_ID=A7PPA4; Match level="QueryCoverage=88%, HitCoverage=91%, E-value=3e-42, Identity=58%"; Hit description =Chromosome chr8 scaffold_23, whole genome shotgun sequence
  Subcellular localization annotation: CTP_CleavageSite=58; ConfidenceScore=5.59e-01
MACSSSTMQSVYPRVSGANFHVPLSSPSLVPIYNNNLSFSKLRNSIHLAAVPLPPLTKASAGNGGPTDEGVSLGTMKLPLDTDLQRFDSLLFQVDKIPGGARLGFITIGDGKTEVLVHIDCLVFPPTENSAPIFRAIRNGPLKDKAPPGEPRIMRSLLQALQKSVEIARL

SEQ ID NO: 160919 - protein, 77 aa, Glycine max
  Coding DNA Sequence Number=SeqID_69234
MGRVLETETYTGSDEDITKSKGKDPLEGLGGPMTRARARKAKEALQQGLSILFEYKPKFQGEKSKVVSCIMAQMEED

SEQ ID NO: 160920 - protein, 219 aa, Glycine max
  Coding DNA Sequence Number=SeqID_69235
MDFWLVRTIEETGIEMMLSWVSNACAHVNTKESCVDPSGNDPETGDSDKCGLVGVEEVKDAEASVPVPTDEVMWDATVFGVFNQNFSLYIKHEDLSEIAHGGQCLSISVIQFYIKSWMQSSKRDVYLGAYLNGHLQMVIIPPKENLVVWFCSLHNMPDNYLKGIINSALKGLDDTPQPKSKATAWWIVVKCNRQKGSTECDYYVMHWMSTIILGTFNNN

SEQ ID NO: 160921 - protein, 72 aa, Glycine max
  Coding DNA Sequence Number=SeqID_69236
MVSFFLTHLLLEVASPIIFLPSPFRCHDLQEAKDSIDKEDPGLTSSPWSYIMWYQEHLRLSDILLLPLSFCS

SEQ ID NO: 160922 - protein, 482 aa, Glycine max
  Coding DNA Sequence Number=SeqID_69237
  Homolog annotation: Hit_ID=A7PPB9; Match level="QueryCoverage=92%, HitCoverage=97%, E-value=1e-145, Identity=56%"; Hit description =Chromosome chr8 scaffold_23, whole genome shotgun sequence
  Pfam annotation: Domain name=AATase; Domain location=19-441; Score= -210.6; E_value=0.025; Accession=PF07247.3; Description=Alcohol acetyltransferase
MAQNSNTEAQSPPTPEARPVGGTEFSWCKAVPAGTGVTVLSLLLSKPPQIAVVQNALHKLQNSHPILRSKIHLDPSNNTFHFLTPPTPTVQIHPFDITSTATIIQSQSNGHDPFHALLEHEMNQDTWRDYTIPSAGADVLHAAVYNISHDRFAVFLRLHTAACDRAAAVALLKELLRLVTGGAGDEASREKVNSPIEDMIPEGKMNKPFWARGLDVLGYTLNAFRFSNLSFIDVGSPRSSRIIRLQLNVDETKNLLAGCKSRGIKLCGALAAAGMIAAWTSKCLPNYQREKYAVVTLVDCRSLLDPVLPSNNAGFYHSAILNTHDVCGETETLWELAKKSYTAIVNAMNCNKHFTDMSDLNYLMCKAIENPGLTPSSSLRTALISVFEDPVFDDSAEMLGEFGLEDYVGCASAHGVGPSIAVFDTIRNGKLDCACIYPSPLHSREQIQGLVDHMKRILVEGCNSENQQIEPYSTSEAEQMVI

SEQ ID NO: 160923 - protein, 51 aa, Glycine max
  Coding DNA Sequence Number=SeqID_69238
MSKGRGREGARNFVPQMGIASPWSGIRFKKKDSGTQSKFLVRGSMNRSRRS

SEQ ID NO: 160924 - protein, 136 aa, Glycine max
  Coding DNA Sequence Number=SeqID_69239
  Gene Ontology: Cellular component=intracellular; Biological process =signal transduction
  Homolog annotation: Hit_ID=O82458; Match level="QueryCoverage=60%, HitCoverage=16%, E-value=7e-22, Identity=69%"; Hit description=Rac GTPase activating protein 1
MADPLTALMHVVQVMNFLKTLEMKTLREREGSTVKSNTVSDLNSFGDDNHQSSSQLKLKDGSENGSDFSEEDKAPDVTVEPSDDVKNPSSNWQFVVLELAGSHYAAVCIEQDGTDAGNGSIPINLTLRKTIPYVED

SEQ ID NO: 160925 - protein, 134 aa, Glycine max
  Coding DNA Sequence Number=SeqID_69240
  Homolog annotation: Hit_ID=A5ATR3; Match level="QueryCoverage=46%, HitCoverage=16%, E-value=5e-10, Identity=44%"; Hit description =Putative uncharacterized protein
MELKRLNQHEENDKKKKGIALKVSSSIQEESDKEDSIEIDKDDDLSLFAKKACITWDDNDKDSSEDSENEIVNLSLMSKSYESDEEVSLKKNWYIDSGCSKHMTGDASKFTHISPKKRGHVTYGDNMRQNVFSK

SEQ ID NO: 160926 - protein, 54 aa, Glycine max
  Coding DNA Sequence Number=SeqID_69241
MCFACYYRGQLSSERFEGFKEKIRPVSYLLFPNDASSVPNTPLDARGSSGASNP

SEQ ID NO: 160927 - protein, 309 aa, Glycine max
  Coding DNA Sequence Number=SeqID_69242
  Gene Ontology: Mol. function=drug transporter activity; Cellular component=membrane; Biological process=multidrug transport
  Homolog annotation: Hit_ID=Q10PS3; Match level="QueryCoverage=40%, HitCoverage=26%, E-value=3e-38, Identity=53%"; Hit description=HEAT repeat family protein, expressed
  Pfam annotation: Domain name=MatE; Domain location=7-164; Score= -31.1; E_value=0.089; Accession=PF01554.9; Description=MatE
MWVVAGPAIFTRFSTFGIMVVSQSFIGHIGSTELAAYAIVMTVLVRFANGALSKNKIIAYLAAVSISIHVLLSWLLTVRFKFGLNGAMTSTLLAYRIPNIGQLLFIMTKCPDINYGSFYSLEIWYNTVLILLTGNMKNAEVSINALAICLNISGWEMMIALGFFAATSIEEFIPLLRERMNVLNPYVRQFLVGWITVLDSVPYIDMLGFLPDFLDVLLLKSVDYGRMAEILVQRAGSLDEFTRLTTITWVVRETNEELRALKADPAEAFDVGAILSIARSMRNKSECTPHESREPSGHDQETNDKVDTK

SEQ ID NO: 160928 - protein, 70 aa, Glycine max
  Coding DNA Sequence Number=SeqID_69243
MKRAPEGEDVGLDGAAGRTVVEGAGDAPGSSPRTVGAHDEGRGRRLEERVKTFAYFLIFLETHYELLPRD

SEQ ID NO: 160929 - protein, 550 aa, Glycine max
  Coding DNA Sequence Number=SeqID_69244
  Gene Ontology: Mol. function=ubiquitin thiolesterase activity; Cellular component=intracellular; Biological process=ubiquitin -dependent protein catabolic process
  Homolog annotation: Hit_ID=A5BFT1; Match level="QueryCoverage=100%, HitCoverage=100%, E-value=0.0, Identity=67%"; Hit description =Putative uncharacterized protein
  Pfam annotation: Domain name=UCH; Domain location=242-546; Score =69.2; E_value=1.3e-17; Accession=PF00443.20; Description=Ubiquitin carboxyl-terminal hydrolase
  Pfam annotation: Domain name=zf-UBP; Domain location=133-208; Score =20.4; E_value=0.00066; Accession=PF02148.10; Description=Zn-finger in ubiquitin-hydrolases and other protein
  Pfam module annotation: Pfam domain module=UCH::zf-UBP; Domain location=242-546::133-208
MTSKREREAGDRVEDEGLDNESKRQRLDEDSSPSPPPVSVANPLSGLANNYADIDEEEDDVRRERGSVNERSNDGSHHNGHNKYGEADDSDEEDDDSHEQFTGRNRQVEVRKDCPYLDTVNRQVLDFDFEKFCSVSLSNLNVYACLVCGKYYQGRGKKSHAYTHSLEAGHHVYINLRTEKVYCLPDGYEINDPSLDDIRHVLNPRLEPWLGLFVDRFTAKEVEQLDKNKQWSRALDGSSYLPGMVGLNNIKETDFVNVTIQSLMRVTPLRNFFLIPENYQHCKSPLVHRFGELTRKIWHARNFKGQVSPHEFLQAVMKASKKRFRIGAQSDPGELEVVKEIPNKVISDKKENSENQNNAEKLSDGVNERYAFVKETSKMPFLMLGLDLPPPPLFKDVMEKNIIPQVPLFNILKKFDGETVTEVVRPHIARMQYRVTRLPKYMILHMRRFTKNNFFVEKNPTLVNFPVKNLELKDYIPLPTPKENEKLRTKYDLIANVVHDGKPGEGFYRVFVQRKSEELWYEMQDLHVSETLPHLVALSETYMQIYEQQQ

SEQ ID NO: 160930 - protein, 240 aa, Glycine max
  Coding DNA Sequence Number=SeqID_69245
MRTSMTTLTQTWMTLLLSNVLPSDHNSDLPLPKCQLVYAILTRMSIHVAQVIADAIYLFAGMPPTRHPLDPDKSNRALGFPALITGLCQSFGVPVTPSKVIRPPITRAFIKKYCTPRQAQGDAHQAANAPPPPHQADLAGSLGMERYLQHLVCQLAANHHGQVQIHECLYRFSRSQQGQSSTPFVCPTPEQFAAEVTWPGDWPDAQAGEEPAGSPGRMDEPRMDEDMTDLFDFLEGSGAA

SEQ ID NO: 160931 - protein, 616 aa, Glycine max
  Coding DNA Sequence Number=SeqID_69246
  Gene Ontology: Mol. function=hydrolase activity, acting on ester bonds; Cellular component=extracellular region; Biological process =lipid metabolic process
  Homolog annotation: Hit_ID=A7QDN0; Match level="QueryCoverage=52%, HitCoverage=92%, E-value=9e-82, Identity=48%"; Hit description =Chromosome chr10 scaffold_81, whole genome shotgun sequence
  Pfam annotation: Domain name=Lipase_GDSL; Domain location=31-343; Score=150.7; E_value=4.1e-42; Accession=PF00657.13; Description=GDSL- like LipaseAcylhydrolase
MKIFIIFSITFTCGIFGNVNSNVNPLPYEAIFNFGDSISDTGNAAAYHHVPKDGKSPYGSTYFKHPSGPEAYGLPMLPAYLDLTKGQDIRHGVNFAFAGAGALDMNYFTNNRLKAPATNNSLSVQLDWFKKLKPSLCKNKKECNNYFKKSLFIVGEIGGNDINAPISYNNISKLREIVPPMIEEITKATIALIEEGAVEVVVPGNFPIGCNSGVLTVVNSGNKDDYDQFGCLAAYNVFIKYYNWRLNQAIEALRQQKNHVKIIYFDYYGDARRLFQAPQKYGFSSSKNETFRACCGTGEPYNVDEHAPCGSLTSTICSDPSKHINWDGAHFTEEAYKLIAKGLVEALSSSFVVGWYVSRCHCSVLPLPDFRTTMSFPPSSYLKSVEMKLELRQYIVMGHMYAYHGYERFIIANVRDLSQSRNYAWGAAALVYMYGNLNDACKSDVLDYEYFPYIVEAFTDQDYDERSPRACHWTSMKASTKALPASTYRKRLNQLKTVDVVTPYGNHHAVREFDLISCYFGPIRWGPVVIIHRPERVVRQYGNVQMIPPHSLGSRLCLEDIDDRWMHFSDYLAPVSQICVVLGQCAPDYMDWLDMILNPFMRPTQLRDPAIHPLIM

SEQ ID NO: 160932 - protein, 76 aa, Glycine max
  Coding DNA Sequence Number=SeqID_69247
MALGLNSPKRAGYFTPKLFGGPGEPGFRKRLKMTILPSLSIFFVFLIKTLNDHLFRTVTGVQHHKSTNKDQKINKR

SEQ ID NO: 160933 - protein, 313 aa, Glycine max
  Coding DNA Sequence Number=SeqID_69248
  Gene Ontology: Mol. function=inositol or phosphatidylinositol phosphatase activity; Cellular component=intracellular; Biological process=abscisic acid mediated signaling
  Homolog annotation: Hit_ID=A7NWR3; Match level="QueryCoverage=97%, HitCoverage=52%, E-value=1e-105, Identity=64%"; Hit description =Chromosome chr5 scaffold_2, whole genome shotgun sequence
  Pfam annotation: Domain name=Exo_endo_phos; Domain location=22-306; Score=-20.9; E_value=0.1; Accession=PF03372.14; Description =EndonucleaseExonucleasephosphatase family
MRTTKTIKRYHRSSFTPQEEHVECETQSWYQEVSKLKAKYDSLQRTQRASDYSRPSDYSRWGSSDDDNGLGDSPSTVSPLSYGGPASTEDGYGMPGRSRYCLLASKQMVGIFLTIWVRSELKDHVRNMKVSCVGRGLMGYLGNKGSISISMSLHETSFCFICSHLTSGQKEGDELRRNSDVMEILKKTRFLRVHDADNEKSPETILEHEYEFTCIHLSITNTLNMFIRIIWLGDLNYRIALSYRFAKALVEMQNWRALLENDHLRIEQKRGRAFVGWNEGKVYFPPTYKYSTNSDRYAGDDMHPKEKRRTPAW

SEQ ID NO: 160934 - protein, 337 aa, Glycine max
  Coding DNA Sequence Number=SeqID_69249
  Gene Ontology: Mol. function=DNA binding; Cellular component=nucleus; Biological process=regulation of transcription, DNA-dependent
  Homolog annotation: Hit_ID=A7PP88; Match level="QueryCoverage=74%, HitCoverage=80%, E-value=6e-61, Identity=55%"; Hit description =Chromosome chr8 scaffold_23, whole genome shotgun sequence
  Pfam annotation: Domain name=B3; Domain location=72-181; Score=126.8; E_value=6.5e-35; Accession=PF02362.12; Description=B3 DNA binding domain
MSINHYSMDLPEPTLWWPHPHHQQQQLTLMDPDPLRLNLNSDDGNGNDNDNDENQTTTTGGEQEILDDKEPMFEKPLTPSDVGKLNRLVIPKQHAEKYFPLSGDSGGSECKGLLLSFEDESGKCWRFRYSYWNSSQSYVLTKGWSRYVKDKRLDAGDVVLFERHRVDAQRLFIGWRRRRQSDAALPPAHVSSRKSGGGDGNSNKNEGWTRGFYSAHHPYPTHHLHHHQPSPYQQQHDCLHAGRGSQGQNQRMRPVGNNSSSSSSSSRVLRLFGVDMECQPEHDDSGPSTPQCSYNSNNMLPSTQGTDHSHHNFYQQQPSNSNPSPHHMMVHHQPYYY

SEQ ID NO: 160935 - protein, 43 aa, Glycine max
  Coding DNA Sequence Number=SeqID_69250
MSEEVDMDFQNEEDCGVNEEHVDCSDAFNTSQQRKNCICVNWV

SEQ ID NO: 160936 - protein, 110 aa, Glycine max
  Coding DNA Sequence Number=SeqID_69251
  Gene Ontology: Mol. function=transferase activity, transferring glycosyl groups; Biological process=metabolic process
  Homolog annotation: Hit_ID=A4F1R6; Match level="QueryCoverage=37%, HitCoverage=8%, E-value=5e-12, Identity=75%"; Hit description =Putative glycosyltransferase
MRVYQPTNCRYICKEWEIGIEIDTNVKADEVEKLVNDFMAGEKGNKIRKKIVELKKKAGEATTNNTVEIAPDKVQKTRTPQKKQHHPNHTHQKLKQRLKALLMTIGDKEH

SEQ ID NO: 160937 - protein, 79 aa, Glycine max
  Coding DNA Sequence Number=SeqID_69252
  Homolog annotation: Hit_ID=A5AGY8; Match level="QueryCoverage=44%, HitCoverage=27%, E-value=2e-10, Identity=85%"; Hit description =Putative uncharacterized protein
MEKKTERRRRNISRYGGEGEEVETCDDARVRRTRCSDADRDVMLDEHGIIIRNKARLVAKGYNQEEGIDYEETYAPVAD

SEQ ID NO: 160938 - protein, 238 aa, Glycine max
  Coding DNA Sequence Number=SeqID_69253
  Homolog annotation: Hit_ID=A7R1J8; Match level="QueryCoverage=35%, HitCoverage=26%, E-value=6e-13, Identity=46%"; Hit description =Chromosome undetermined scaffold_359, whole genome shotgun sequence
MTNANCPQESLHSVSNGNLRFDTAQTLVSRFFQSPVESDETKVQTWSSQHYRNEPVVVVAAPRLQKYSSFDDQSGEKPLLLPIQSFKSRLSKEVIDVQSQNMSMSSKRFSSYSNRKAEVKAVDVDVDVQYLNRSTTFKRSTISQGFSSNSNRKAEVIMLSSNTYVIMLSSNAEDSVRKKGFYKSCPPPPPPPPPTMFQKSVFMKPRFDGSSNEAPSFNKELKRSFTSERTTPSGKEKS

SEQ ID NO: 160939 - protein, 259 aa, Glycine max
  Coding DNA Sequence Number=SeqID_69254
  Homolog annotation: Hit_ID=Q84VH5; Match level="QueryCoverage=100%, HitCoverage=37%, E-value=1e-93, Identity=71%"; Hit description =Envelope-like protein
  Subcellular localization annotation: CTP_CleavageSite=21; ConfidenceScore=5.13e-01
MATSPKDTSSPGSPAVPSSPSSTKAPSIQEQPDFHIQPIQMIPGQAPVPEKLVPKRQQGVKISENPSLATSPREVDTEMDKKIRSIVSNILKNASVPDAEKDVPTSSTPNVSVPDVDKDVPTSSAPNAEALPSPSEEESTEEEDQATEKTPSPRAPEPAPGDLIDLEEVESDEEPIANRLAPGIAERLQSRKGKTPIKRSGRIKTMAQKKSTPITPTSSRRSKVAIPSKKRKEISSSNSDDDVELDVSTSKRAKKSGKK

SEQ ID NO: 160940 - protein, 87 aa, Glycine max
  Coding DNA Sequence Number=SeqID_69255
MEQYLRLWFASRRPTTEHMYRPMISQGFASFSCPTPDQFRAEVAWPGDWPEAQAEEAPPEAPGGGEEAHEDEEMADLLDFLGGSGDT

SEQ ID NO: 160941 - protein, 144 aa, Glycine max
  Coding DNA Sequence Number=SeqID_69256
MTTLTQICMTLLLSNILPSDRNVDLPLRKYQLVCAVPTYGSRQQDTQWTQRSPARPWGFQLWLRASISPKGCPYPPTRDRARKTLVNPEKSNRVLGFPALITSLCQFYGVSVTPSKVIKPPINRAFSKKYCAPQVGARRDTITA

SEQ ID NO: 160942 - protein, 151 aa, Glycine max
  Coding DNA Sequence Number=SeqID_69257
KILHERNVMLYYIEFDEFTEELERRNWHKELTNFMDGSIDVAIVKEFFANLYHPEDKSPKQVRVIGHLVKFDADTLNTFLKTLVIIEEGENRPAYSRLIYGIIQTMDMNVGHIISSQISVIAQHDSSGMGFPALITALCKARGVTSDSLSF

SEQ ID NO: 160943 - protein, 203 aa, Glycine max
  Coding DNA Sequence Number=SeqID_69258
MNLEIEATLRRNRAERRRKLLQDRTVASILEEEAHFFYSTSSDSPSSRESMTYLPEAVIMANEHQQRVTLEDYSSSSVPQFFTSITRPEVQAHNINYPHSLIHLIQGNLFQGLPNEDPYAHLATFIEICNTEKPRGGSTHLRTTNQAIARCFSRGKIKLKTLEEAIELIENMSASGHAILRDKVHQPTEKSLLELSSHDALLA

SEQ ID NO: 160944 - protein, 164 aa, Glycine max
  Coding DNA Sequence Number=SeqID_69259
MVPTRHPLDPDKSNRALGFPALITGLFQSNGVPVTPSKVIRPPITRAFIEKYCTPRQVQGDAHQAAGAPPPPRQADPAGPLGVERYLQHLVHQQVANHHGQGQGSTPFICLTPKQFGAEVAWPGDWTDAQAGEEPAGSPGEADESRIDEDMTDLLDFSGGSEAT

SEQ ID NO: 160945 - protein, 106 aa, Glycine max
  Coding DNA Sequence Number=SeqID_69260
MGLNQFIFFNMVHDILIKVKLEVTRTSTVLNVFGSRRSSDRKMQGSCMSEHENKRYVVCRTKTEKSVDLLGGGVGVHHCFGLGQQLGKFFTAVQSKSKSVHPHCAS

SEQ ID NO: 160946 - protein, 109 aa, Glycine max
  Coding DNA Sequence Number=SeqID_69261
MMTRSKRFMEAKDEDSVVYKKKAAEKKGTDEKKDDVIGESNHEKEKQIMNEEKNRSEQVREKKTEKAVNEGVEVPYPMVPSKKEKDLHLARFLDIFWKLEMTMPFGEAL

SEQ ID NO: 160947 - protein, 81 aa, Glycine max
  Coding DNA Sequence Number=SeqID_69262
MVREAELTLNLTVSSKSWFRPVTRATICCTAPALAQASQKLMEIAQQQHAQQQAGGADAQESSAKDDDVVDAEFEEVKDKK

SEQ ID NO: 160948 - protein, 103 aa, Glycine max
  Coding DNA Sequence Number=SeqID_69263
MEKSDKMNFKEKKEKKGYITWEDNVINYSSDSEKKIISLGIMMKDYANGEEQSRYIDSNFSKHMACIKVVVIIKKGENVNHEDFDDVKKNLLEKGGECKSCKL

SEQ ID NO: 160949 - protein, 254 aa, Glycine max
  Coding DNA Sequence Number=SeqID_69264
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=98%, HitCoverage=24%, E-value=1e-138, Identity=95%"; Hit description=DNA -directed RNA polymerase subunit beta
  Pfam annotation: Domain name=RNA_pol_Rpb2_3; Domain location=42-111; Score=135.4; E_value=1.6e-37; Accession=PF04565.7; Description=RNA polymerase Rpb2, domain 3
MVRGTICGAIRHKLIPTPQNLVTSTPLTTTYESFFGLHPLSQVLDQTNPLTQIVHGRKLSYLGPGGLTGRTASFRIRDIHPSHYGRICPIDTSEGINVGLIGSLAIHARIGSWGSIESPFYEISERSKRIRMLYLSPSRDEYYMVATGNSLALNRDIQEEQTVPARYRQEFLTIAWEQVHLRTSLIPFIEHNDANRALMSSNMQRQAVPLSQSEKCIVGTGLERQVALDSGVSAIAEHEGNIIYTNTDRIFFIW

SEQ ID NO: 160950 - protein, 80 aa, Glycine max
  Coding DNA Sequence Number=SeqID_69265
MEWFYMISHPFMTPAQPEDPPKQLVATATPNEVDVDVHRPRHAVDGYVAIAHKLERLLNLRILIEGTEAYTIAEECLSIA

SEQ ID NO: 160951 - protein, 60 aa, Glycine max
  Coding DNA Sequence Number=SeqID_69266
PFAKRKPRAKRIFVHALSHESQALSDQLLHLRLIWSAKLAKAELSQLQFDLNSFKLQPDC

SEQ ID NO: 160952 - protein, 97 aa, Glycine max
  Coding DNA Sequence Number=SeqID_69267
  Subcellular localization annotation: CTP_CleavageSite=35; ConfidenceScore=5.35e-01
MEKDSKKIFQFLDATSATNLVTSKQIAPQTSNGLRRMRRKVMKKEDPRRCILHGMTMTHPMVRRRRLTFYQKTMRVKRTSLKGIKIKMANLISISFQ

SEQ ID NO: 160953 - protein, 40 aa, Glycine max
  Coding DNA Sequence Number=SeqID_69268
MTNANCPQESLHSVSNGNLRGRRQVALTDTMCPFCCKEEE

SEQ ID NO: 160954 - protein, 78 aa, Glycine max
  Coding DNA Sequence Number=SeqID_69269
MRDGKRSSYVIGIGVNSGVGLAVKFLIVLEPVPKWALSAGRIVVGAGAWGASLWIGAGALGCMGAELEESPTRAEKFR

SEQ ID NO: 160955 - protein, 146 aa, Glycine max
  Coding DNA Sequence Number=SeqID_69270
  Pfam annotation: Domain name=Transposase_23; Domain location=41-96; Score=1.8; E_value=0.00075; Accession=PF03017.5; Description =TNP1ENSPM transposase
MQSQMQSQGLALPPELMVGPSSPHVITKESYVDPSGNDPETGDSDKCGLVYEGSTVHKIPLLPGQVKVGVEEVKDAQAPVPIPTDEVTLVGQALNTFLAWPTHLMKHLSEQVAVSPAKPPQRPDLEVNDPLYLLTLTIPELFLKPF

SEQ ID NO: 160956 - protein, 222 aa, Glycine max
  Coding DNA Sequence Number=SeqID_69271
MIVGKVVISSFHQFPNESLSGALETFRSLLWKTPTHGFSEPIQLNIFIDGLQPQSKLHVAHFVVELMGQACVFPLKKHLIKLITWETSLDKILMQVDFLNFSMANLTSSIINGELTLLAKQLAEKSSSTFGANTEQNAKEECKAVMTRGRKVTMEEENKKEKMVEDDKQQLIIKLAPKPVQPFCELIKEEEEEEDEQMRETPIILSEKEINEKEKKEKEKEE

SEQ ID NO: 160957 - protein, 25 aa, Glycine max
  Coding DNA Sequence Number=SeqID_69272
ARLTGALSKGGKMRGVADRGRTRIK

SEQ ID NO: 160958 - protein, 80 aa, Glycine max
  Coding DNA Sequence Number=SeqID_69273
MGDANSNFENLKLGLPKYFRSWIASGGSNPARLGELGGNLLPFFPINRLKGAVLRVPDPPDFQPFFVIHCSFFIVLRSST

SEQ ID NO: 160959 - protein, 178 aa, Glycine max
  Coding DNA Sequence Number=SeqID_69274
MEENHTSNASTLTRNIRITVLLNNLQEVNDICQKKMTKEIYSDFEKKYGQIKDFLYATSQLMTLFIEENILPWIDVNHILISRCFDPCTKCGGHITLLVHKTSSIEKPRIFFINGFLCFLEDEWQRNGERKRERRRHFKEKMSLEEAHHHRRPWIRAWRKKEMNEGRGREEHEILCSK

SEQ ID NO: 160960 - protein, 434 aa, Glycine max
  Coding DNA Sequence Number=SeqID_69275
  Gene Ontology: Mol. function=isochorismate synthase activity; Cellular component=chloroplast; Biological process=biosynthetic process
  Homolog annotation: Hit_ID=B0CN79; Match level="QueryCoverage=81%, HitCoverage=63%, E-value=1e-115, Identity=59%"; Hit description =Isochorismate synthase
  Pfam annotation: Domain name=Chorismate_bind; Domain location=273 -416; Score=-181.3; E_value=0.00093; Accession=PF00425.9; Description= chorismate binding enzyme
MATVHKWLTHFYDTKKCSNILVPLGSKGQQSIPHHRCYLSMNGCREGQHQHARTRNNPVGTIETRTLAAVASPAMAMYSLNMAISELKSDALFGTSSGIVRVQVPIEEQVEAIDWLHSQNHLLLPRCFFFGRKQCSSPCCINGEEKLVSVAGVGSAVFFSQPHPFSYWDWISIRRCPLIRAYGAIRFNAKAKVSSEWLAFGSFYFMIPQVEFIELEGGSMLTITIAWDNDLSWSWENAINALQETLCKVSSSIVKFPKQTPPTLISSSQNIPSKVDWDLAVNRALQMIGQNDSLLTKVVLARSTRVVPTVDIDPLAWLSCLKVEGENAYQFLLQPPNAPAFIGNTALAGTRARGASQALDLQIELDLLTSPKDDIEFTIVRETIRRKLEGNRKTAVYTTTLNHNIQSIAQGMAQALHTSEHLRRVMDSDGCSPN

SEQ ID NO: 160961 - protein, 216 aa, Glycine max
  Coding DNA Sequence Number=SeqID_69276
MIDQEACRIALVKLFVALELFFHTVEHEAFREFFSIVAPFSCCHLMHYFGFKEDILAICRVHAAIKCVKSSPSRLSKFNECVAHVTSTMYTFEAFGIGMKIREMSTSRGVNMSVRTVTVHMKEKYYWGNIDRINMLLMISLVLHPSYKLKFMNWLIAEIFYGEWGELTCKLRDKVESSLRSLFEEYSSDGDEFEVSSHEARAQPSEKVENDPYGYS

SEQ ID NO: 160962 - protein, 396 aa, Glycine max
  Coding DNA Sequence Number=SeqID_69277
  Gene Ontology: Mol. function=transporter activity; Cellular component= membrane; Biological process=oligopeptide transport
  Homolog annotation: Hit_ID=Q7XJQ3; Match level="QueryCoverage=72%, HitCoverage=45%, E-value=6e-42, Identity=52%"; Hit description =Putative peptide/amino acid transporter
  Pfam annotation: Domain name=PTR2; Domain location=1-370; Score= -86.0; E_value=0.01; Accession=PF00854.12; Description=POT family
MSFFNWWSCGLCSGFILGSTVIVYVQDHVNWGVADIILSVVMAVSLLIFLIGRKGPITRTMSKRLQEDWARAAEECPRVLMNLRTHLLLEVASPLSLPFSIPLSFIFQEAKESFDEEDPRPTSSNGACIIVAAISKRKLPYPSDPTQLYEVSKSKGNRERFLPQTMKLKFLEKAAILENEGNLAEKQNPWKLTTVTKVEELKLTINMFPIWVFTLPFGICTAQTATFFIKQSAIMNRKIGNKRLTGNERGISILQRIGIGMFFSIITMIVAALVEKKRLEAVEINGPLKGSLSTSVFCPPNLFQKNDDLGLIHRWIVVKFEHHVRNTVSSILPVGNFYIIEKKESHEDSPNGGFNPFYVSLTFGNSIRAIGGETGGILGNRSRCCYRCRKTRKSAY

SEQ ID NO: 160963 - protein, 27 aa, Glycine max
  Coding DNA Sequence Number=SeqID_69278
MDKGVSYPNFVRGPLLDDMRPFFGPCE

SEQ ID NO: 160964 - protein, 233 aa, Glycine max
  Coding DNA Sequence Number=SeqID_69279
MDMNLGHIISCEISLIAQHYSSRLGFPTLITDLCKARGVTSDSLTFESLSPAINVAYVKKNCWNLDDLAVTFKGPCKAKGKMSEAPSSSDIPLILALSTSTSPLVPAPPTGPSSITSETLFAMLQSLHKGQVAWPGVQPSPSGGGEASATQEPEPVEDDVPPESFIIETDPVPQEEVAAQEPSSPIPVSPAPVIDDSHPSALALEPEQPIVQDPPAAPVLDLNEHAEDHPQED

SEQ ID NO: 160965 - protein, 298 aa, Glycine max
  Coding DNA Sequence Number=SeqID_69280
  Homolog annotation: Hit_ID=Q6WAY6; Match level="QueryCoverage=59%, HitCoverage=35%, E-value=6e-23, Identity=34%"; Hit description =Putative uncharacterized protein
GSIPSLARISKIVQISAQELDHRKQVENGVVGIPRKYSEAKARILVGKGEWAPFIDILALLIFGGVLFPNVDGLVDLAAINAFLTYHNHKESSVVAMLVDIYDTFDRRCEKSNTRIVCCTPALYVWLVSHLFRQDEGRTGVLISCGGFPNVPLMGTRGCISYNLVLAIRQLGYPMRGAPLEEELAPVISRGFNKTNMETFQKLKAHVQGLDWLPSLRTAKRKEVEAPEEDEEVQALRTELEQAQTVKERFKSAALKIRKENVELRDIKCVSYPNFVRGPSVVGMRPSFDHFEVFGTHR

SEQ ID NO: 160966 - protein, 128 aa, Glycine max
  Coding DNA Sequence Number=SeqID_69281
MELIENMAASDITILRDRAHIPTKRSLLELSSQDALLAQNKLMSKQLEALTKTLSKFPAQLHSAQSLPSTILQVDFPNSSMDSNTTNNRDNGGTTLGINSIETRVDRPQGRNNKGLVSMSVQRSWKRL

SEQ ID NO: 160967 - protein, 74 aa, Glycine max
  Coding DNA Sequence Number=SeqID_69282
MAESTHSKSNMDCIEDTIAKLTTTQLHLTATQNSMSMKLDDLLQKMASSKLVGLHQHHPWLLPTRSYHLTTRIE

SEQ ID NO: 160968 - protein, 97 aa, Glycine max
  Coding DNA Sequence Number=SeqID_69283
MFLQKAIASGGSNLARLGELGGKLLPYFPINRGRSEGEKGSTLLLRRFRNDSVGDFAKIFNRSSTFFVHSSSFFGLQPTCEVLIPSPRVNTTPEPFT

SEQ ID NO: 160969 - protein, 135 aa, Glycine max
  Coding DNA Sequence Number=SeqID_69284
  Subcellular localization annotation: CTP_CleavageSite=46; ConfidenceScore=5.64e-01
MATPSNSPPLASAPSPSMSKRTRKATWLKSLSARPVGVERPLPDVVLDAISRNRTPVEPKVAPSSTHVSTKGSCVDPSGIYEGSTIVHHIPLGNDLVKVGVEEVQDVDARSPIPTEEAVSPLNLCKGETKDILGG

SEQ ID NO: 160970 - protein, 54 aa, Glycine max
  Coding DNA Sequence Number=SeqID_69285
MKKILGLQAPMELTSWLHYMRWSRLSARRTRNEEWCGGWWSAKEGGRVVKGKDE

SEQ ID NO: 160971 - protein, 204 aa, Glycine max
  Coding DNA Sequence Number=SeqID_69286
MGKGITTRGVPRSLLELSHVQTRGYECGYYVMHWMWNIVSEGLKNERRMWFGDGTTLDMEHKNGVIKHFVYFSKSIKAGMIFSVVATCYKCNLKELRLHLQEKLNVLGGGGKISIPCLGRLLEEDLKVEKFTLDPNKKFVSQQLHETDKEESDWEDEVKPRKNIFPKGNVKNFVQPKNHKGGETDLSNKKRVKYAKAASEDKRD

SEQ ID NO: 160972 - protein, 52 aa, Glycine max
  Coding DNA Sequence Number=SeqID_69287
MSVKNLVGRLGVHDKTNHTIISQVTLTRLKGALKPCEPQGLHSEESVRASPS

SEQ ID NO: 160973 - protein, 76 aa, Glycine max
  Coding DNA Sequence Number=SeqID_69288
MTAEWRRKRERRCHFKEKMSLEEVHHYRRPWIRAWRKKEMNEGRGREEREILCSKRTLKSEPTNIRSSPRFSTKSA

SEQ ID NO: 160974 - protein, 116 aa, Glycine max
  Coding DNA Sequence Number=SeqID_69289
  Homolog annotation: Hit_ID=Q6WAY3; Match level="QueryCoverage=62%, HitCoverage=3%, E-value=4e-07, Identity=35%"; Hit description =Gag/pol polyprotein
MGQQQRPPVKEAHPCHINKSFVNAGWRSNDESGEGTNTEDPDIDFERIASQVEDGEDEDIGFSLELERMVSQENREMKSHQEEMEIVNLGVCEERKEVKVDTSMTTWVRDELVVLL

SEQ ID NO: 160975 - protein, 128 aa, Glycine max
  Coding DNA Sequence Number=SeqID_69290
MQQQQQQSQQRQQATEAPPQPSLEELVRQMTIQNMQFQQEIRASIQSLTNQMGQMATPMNQAQSQNSDKLPSQTVQNSKNVSTITLRFGNQIQEPPTIVAPTPENEDEIVAQKRKLHNQKFSCRWTFF

SEQ ID NO: 160976 - protein, 106 aa, Glycine max
  Coding DNA Sequence Number=SeqID_69291
MGPDGCKKMRGTGTREVARKPRQNFSIQKKLFSSPSHVAFLFFFLSIEASIKAPNFAHHFYSKLQKEAIFGVLKRTSTLWDFEFQVSVDFFSHEFRGYWVFGRYDG

SEQ ID NO: 160977 - protein, 132 aa, Glycine max
  Coding DNA Sequence Number=SeqID_69292
  Subcellular localization annotation: CTP_CleavageSite=13; ConfidenceScore=5.10e-01
MSCLAITTPTSLCLSASWCMAPTRHPLDPNKSNRALGFPALITGLCQSYGVPVPPSKVIRPSITRAFMENYCTPRQVQGDAHQAADAPPPPQQADPAGSLGVERYLQHLVRQQAANHCGQVQIHEYLYRMKI

SEQ ID NO: 160978 - protein, 62 aa, Glycine max
  Coding DNA Sequence Number=SeqID_69293
  Subcellular localization annotation: CTP_CleavageSite=20; ConfidenceScore=5.09e-01
MTVVATYPSAKGRHGAHGCVFQGRKARGVATNIYSRKTSEKPERVFSSLLRILNCNEEIRPT

SEQ ID NO: 160979 - protein, 360 aa, Glycine max
  Coding DNA Sequence Number=SeqID_69294
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=70%, HitCoverage=88%, E-value=1e-130, Identity=93%"; Hit description=Beta- lactamase TEM precursor
  Pfam annotation: Domain name=Beta-lactamase; Domain location=5-254; Score=188.7; E_value=1.5e-53; Accession=PF00144.15; Description=Beta- lactamase
  Pfam annotation: Domain name=Peptidase_S11; Domain location=3-237; Score=-122.1; E_value=0.031; Accession=PF00768.11; Description=D -alanyl-D-alanine carboxypeptidase
  Pfam module annotation: Pfam domain module=Beta-lactamase::Peptidase _S11; Domain location=5-254::3-237
TLVKVKDAEDQLGARVGYIELDLNSGKILESWRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFE

SEQ ID NO: 160980 - protein, 86 aa, Glycine max
  Coding DNA Sequence Number=SeqID_69295
MGKWLRRNSPQRGLEETPQEKGPVPPPSLIVIVSWFWRKASNVSSARGGTGPTGSMRKPLPSYCAHRGWISPGPLQGGECGSCAPA

SEQ ID NO: 160981 - protein, 51 aa, Glycine max
  Coding DNA Sequence Number=SeqID_69296
MHVPLNPNLNNLTCCFHICLIMNREHLAVSIGEIALAYVEHLAPAPSGTAA

SEQ ID NO: 160982 - protein, 85 aa, Glycine max
  Coding DNA Sequence Number=SeqID_69297
AANYRGQVQIHECHYRFSLSQQEQGFAPFACHTPEQFGAEVAWPRDWHEAQAGEEPAGFPGEAEEARMDEEMTDLLGFLGESGAM

SEQ ID NO: 160983 - protein, 50 aa, Glycine max
  Coding DNA Sequence Number=SeqID_69298
MTQCVCLCVWVSVCVCGSGSKGSLNCKHHQPHDEGSSIKSMLYKLFGGEQ

SEQ ID NO: 160984 - protein, 108 aa, Glycine max
  Coding DNA Sequence Number=SeqID_69299
MKELLPQMEAQPLSRIPKRMGLPQLKCVPSLNCPINLGPIRRRIMVLDLEILTHFLHHFIVQIGGIISDNLPGGYIYLDLTENKRGCISCGSVLVEGTSTRLFKENKG

SEQ ID NO: 160985 - protein, 57 aa, Glycine max
  Coding DNA Sequence Number=SeqID_69300
  Subcellular localization annotation: CTP_CleavageSite=44; ConfidenceScore=5.34e-01
MDESSRSSQAPSHGTKIAKKYPKCVHMKLSLRKTRQQVSRSPYRAQATPPPPPWGST

SEQ ID NO: 160986 - protein, 152 aa, Glycine max
  Coding DNA Sequence Number=SeqID_69301
  Subcellular localization annotation: CTP_CleavageSite=17; ConfidenceScore=5.02e-01
MPSQFPTRKLAGGGTPRYSTTRSRRDATGEGSSTASEFDSHRFQNAKHQQRFEAIKGWSFHRERRVQLREDAYPDFQGEIDPRHWARLVTPMAKFDPEIVIEFYVNAWPTEEGVQDMRSWVRGHWIPFDADAISQFLGDPLILEEDQQCEFS

SEQ ID NO: 160987 - protein, 367 aa, Glycine max
  Coding DNA Sequence Number=SeqID_69302
  Homolog annotation: Hit_ID=Q6WAY4; Match level="QueryCoverage=60%, HitCoverage=39%, E-value=8e-25, Identity=33%"; Hit description =Putative uncharacterized protein
KIKSLGVASLKELGQLMGQLQRQAFCKAYGKIWDLTMVVVSMEAIASLTQYYDQPLRCFTFGDFQLTPTVEEFEEILGCPLGGRKPYLFSGFYLSLARISKIVKISTHELDRGKQVKNGVVGVPRKCLEAKARVLASQDEWAPFMDILALLIFEVVFFPNVDGLVDRAAIDAFLAFYDRKESPIVAILADLYDTFDRRCEKNNARIICCTPALYEGRTGILILCGKFPNVPLMGMRGAPSEEGLTPFITRDFNSTNAGMLQRVHKAWEMSQRKDKELRGSSNGPIGGYYRWLKAYAQDLNAELRDVNIATTKALEQETKRARREEHGRNKFRGALWGNNSELKLQREERDQSRVVGLILNDELKTCL

SEQ ID NO: 160988 - protein, 90 aa, Glycine max
  Coding DNA Sequence Number=SeqID_69303
MHQRPRVSIRGSSSSPSPFSAFFPGIASSTCIHLSTPGLAWLDAEIHSYGTTTHYGEHAQAVPAPADGSTAHHSRGLSSAGRLARRPTLH

SEQ ID NO: 160989 - protein, 52 aa, Glycine max
  Coding DNA Sequence Number=SeqID_69304
MTKVNKEPFLGVFCLCPVFLAVIVSYPNFVQGPLLDDMRPFFGPCEVLGTHH

SEQ ID NO: 160990 - protein, 278 aa, Glycine max
  Coding DNA Sequence Number=SeqID_69305
  Gene Ontology: Mol. function=motor activity; Cellular component=cell projection
  Homolog annotation: Hit_ID=UPI00016621D1; Match level="QueryCoverage =98%, HitCoverage=44%, E-value=8e-13, Identity=32%"; Hit description =UPI00016621D1 related cluster
TLTFRGLHALTFRGLHALTFRGLHVLVIRGLHALSIRGLHVLVIRGLHALTLRGLHVLAFRGLHTLPFRGLHVLALRTTRPHLQRATRPHLQRTNRPCLEDYKSLPSEDYTSLPSEDYTSLPSEDYTSSPSEGYTPSPSEDYTKLHAVTFGALHVLTFRGLHALAFRGLHILAFRGLHVLAFRGLHVLAFIGLYVLAFRGLHILDITGLHALTFRRLHVLTFRGLHALTFRGLCALTFKGLHALAIRGLQALTFRGLHVLAIRGLHTLAFRGLQVLAI

SEQ ID NO: 160991 - protein, 132 aa, Glycine max
  Coding DNA Sequence Number=SeqID_69306
MECLEGVWETLEGNERCRFRGTIRLTATSLVHPEQPARTLQQPVEWVLPTPTPYRLVESVKVIEVSSSEEDLEEDPEELPLAPTMDAPDLPEDDEDPLLDVDSPEDIMSASEADSIEESGLGGTANSDDSSS

SEQ ID NO: 160992 - protein, 265 aa, Glycine max
  Coding DNA Sequence Number=SeqID_69307
  Gene Ontology: Mol. function=adenylate cyclase activity; Cellular component=cytoplasm; Biological process=cAMP biosynthetic process
  Homolog annotation: Hit_ID=P0A1A8; Match level="QueryCoverage=100%, HitCoverage=31%, E-value=1e-130, Identity=85%"; Hit description =Adenylate cyclase
  Pfam annotation: Domain name=Adenylate_cycl; Domain location=1-265; Score=-104.9; E_value=6.9e-08; Accession=PF01295.9; Description =Adenylate cyclase, class-I
MGPAFQQVYSLLPTLLHYHHPLMPGYLDGNVPRGICLFTPDETQQHYLNELELYRGMPPQESPTGELPITGVYTMGSTSSVGQSCSSDLDIWVCHQSWLDNEERQLLQRKCSLLESWAASLGVEVSFFLIDENRFRHNESGSLGGEDCGSTQHILLLDEFYRTAVRLAGKRILWNMVPCDEEENYDDYVMSLYSQGVLTPNEWLDLGGLSSLSAEEYFGASLWQLYKSIDSPYKAVLKTLLLEAYSWEYPTPRLLAKDIKQRLHD

SEQ ID NO: 160993 - protein, 105 aa, Glycine max
  Coding DNA Sequence Number=SeqID_69308
MAEVNEVQERMKADMEAMKEQMVTMLEAMMSMKKIMEVNAAAQGYTFFPSEGCTPSTSEDFTPLPSEDCTSSPSEGYTPSPLEDYTSSPSEDYTSLPSEGYTSSP

SEQ ID NO: 160994 - protein, 151 aa, Glycine max
  Coding DNA Sequence Number=SeqID_69309
MVILHLLSSIGGEPDDMRRQIMVIRTPFRHPDTIESNGTQTQIMVILHLLSSRGGEPDDMRRQLMVIRTPFCHPETIESGGTQRQIMVILHLLSSRGGEADDMRRQIIVIRTPFAIQRRSSPVARRDKLWSFCTFCHPEAASPMTCGDKLW

SEQ ID NO: 160995 - protein, 172 aa, Glycine max
  Coding DNA Sequence Number=SeqID_69310
MAPRKLASKRSRKDKAAKGTSSAPEYDSHRFRSAEHQQRFEAIKGWSFLRERRVQLRDDEYADFQEEIVRRRWASLVTPMAKFDPDIVLEFYANTWPTEEGVRDMRCWVRGQWIPFDADAISQFLGYPLVLEEGQECKYGQRRNRSDGFDEEAIAQLLCIPGRILPGLLQGG

SEQ ID NO: 160996 - protein, 416 aa, Glycine max
  Coding DNA Sequence Number=SeqID_69311
  Homolog annotation: Hit_ID=Q6WAY6; Match level="QueryCoverage=76%, HitCoverage=61%, E-value=1e-26, Identity=26%"; Hit description =Putative uncharacterized protein
MGSSQIPWLKKRFYQVKIKSLGISSLKELGQLMGQLQRQAFRKTYGKIWDLTMAEVSTEAIASLAQYYEILGCPLGGRKPYLFLGFYPSLARISKIIKISIQELDRGKQVENGVVGVPRKCLEAKARVLASQDEWAPFMDILALLIFGLVLFPNVDGLVDRTAINAFLAFYDRRKSPVVAILADLYGTFDRRCEKNNARIATAHAPRKKKANWDRLLASKEGASVNWFPRWKEGRAGILISCGEIPNVPLMGTRGCINYNPVLAIKQLGYPMRGAPSEEGLTPFIARGFNSTNAGVIHRVRKACHSVGVVPSTLHQKLKFVVEGHLVIISGEEDVLAAPPIRCGNNGGPDDVGAQLRAQNGFGQEQQQQDRPGYKPTQADIWQNISERKNKGQGPRSGQQAKEAPPCHISRSFVSA

SEQ ID NO: 160997 - protein, 31 aa, Glycine max
  Coding DNA Sequence Number=SeqID_69312
MEDSYKDFQRKVSVAKVGILIPIPLPFILKI

SEQ ID NO: 160998 - protein, 31 aa, Glycine max
  Coding DNA Sequence Number=SeqID_69313
MGWWRIVLSGEGGGFGVWVSEERFENFKSWW

SEQ ID NO: 160999 - protein, 520 aa, Glycine max
  Coding DNA Sequence Number=SeqID_69314
  Homolog annotation: Hit_ID=A7PZQ7; Match level="QueryCoverage=96%, HitCoverage=82%, E-value=1e-129, Identity=51%"; Hit description =Chromosome chr15 scaffold_40, whole genome shotgun sequence
  Subcellular localization annotation: CTP_CleavageSite=13; ConfidenceScore=5.06e-01
PASSACSLRRHVAASPVQHHRSVEGNGCALQPVSPACYSSSEEVTSYKCALTPTSSVDFKGRTGESSYNLKTSTELLKVLNRIWSLEEQQASNISVVKTLKTELNSSQAQIKELLRENQMNRQEVENLIKEITIDKLIRKNKEHGRIKAAVQSIREELEDERRLRQHSESLHRKLARELSEVKSSFSGCLRNLERERKARILLENLCDEFAKGIRDYEQEVHSLRRSSENGQGHVKGNDSLDRLILHISEAWLDERMQMKLAQSDSGLIERNSIVDKLGFDIETFLHAKRSVDLKKYGYSSPKELKEIQPCQHSLDSFPLKVAGSAPQNMAQEDSVDTDFFEPKRANGEGLHNLSSRLQANMNRNISYDGNERFFADRKSSEVGEDNTAILNEEAKHDPQESDRHWILRMNTSHKPDILVGNSSLSSVGDKVYPESIFKEDSCVQSAVTANGSPARLWKSKLSVSDFNKSEFSTKLPKGVKENTLMAKLLEARLEAQKSRSRAYKSTSGSTREAYNENME

SEQ ID NO: 161000 - protein, 682 aa, Glycine max
  Coding DNA Sequence Number=SeqID_69315
  Gene Ontology: Mol. function=microtubule motor activity; Cellular component=microtubule associated complex; Biological process =microtubule-based movement
  Homolog annotation: Hit_ID=A7PZN7; Match level="QueryCoverage=99%, HitCoverage=87%, E-value=1e-173, Identity=52%"; Hit description =Chromosome chr15 scaffold_40, whole genome shotgun sequence
  Pfam annotation: Domain name=Pox_A_type_inc; Domain location=117-139; Score=0.2; E_value=79; Accession=PF04508.3; Description=Viral A-type inclusion protein repeat
  Pfam annotation: Domain name=Pox_A_type_inc; Domain location=173-195; Score=5.1; E_value=15; Accession=PF04508.3; Description=Viral A-type inclusion protein repeat
  Pfam annotation: Domain name=Pox_A_type_inc; Domain location=357-379; Score=15.6; E_value=0.19; Accession=PF04508.3; Description=Viral A -type inclusion protein repeat
  Pfam annotation: Domain name=Pox_A_type_inc; Domain location=405-427; Score=0.9; E_value=62; Accession=PF04508.3; Description=Viral A-type inclusion protein repeat
  Pfam annotation: Domain name=Prefoldin_2; Domain location=275-362; Score=-9.0; E_value=0.098; Accession=PF01920.11; Description =Prefoldin subunit
  Pfam module annotation: Pfam domain module=Pox_A_type_inc::Pox_A_type_ inc::Pox_A_type_inc::Pox_A_type_inc::Prefoldin_2; Domain location=117- 139::173-195::357-379::405-427::275-362
MAFQDHIFKLNKENSSLKQNLEATNAALRVSRIEGSGASTNGTYTVKGSSDQSPNRQHKLNTQRKNRYAINNGTMSALESDAIQSEMEIKHSNLQRNHQELADLVDGYTTVAVQHAPEMQKLRLELEQERNQLANIQLKFQEEQRLNKSFQEELNILKLERDKASKEMNKIHTELNEKVSEIKHLQLELTRQENEGGEAVDSLKRLIKTLEKENTTLKMERNEIEAELENSRKSLTDKMMSDASHIQKKDSSILGDMPDHSKRFPGKEEMERSLQKLSKDLKETQQDRDKVVQELKRLKQHLLEKASEESDKMDEDSKIIEELHDSNNYLRAQVSHLERTLKQALASQEELKMENYSEILKSKEAINDLNKKLANCMSTIDAKNIELLNLQTALGQYYAEIEAKEHLERELAHAREEIAKLSQLLKEADHRADVSRNEKEEILAKLSQSEKVQTEWRSRVSKLEDDNAKLRKVLEQSMTRLNRMSVDSDYLVDRRIVIKLLVTYFQRNHSREVLDLMVRMLGFSDEDKQRIGGAQQGSGKGVVRGVLGLPGRLVGGILGGSSTDAAANAGSDNQSFADLWVDFLLKETEEREKRESSENTGKATANSSNKSPNTIPVTPSFSNRRFDAGTPSALQITPTNQNISPPPRGYFQHSEHLDSEFSTVPLTSSDGKTTCSNLHPRY

SEQ ID NO: 161001 - protein, 356 aa, Glycine max
  Coding DNA Sequence Number=SeqID_69316
  Gene Ontology: Mol. function=methyltransferase activity; Cellular component=Golgi apparatus; Biological process=metabolic process
  Homolog annotation: Hit_ID=A7PZK7; Match level="QueryCoverage=87%, HitCoverage=71%, E-value=1e-152, Identity=76%"; Hit description =Chromosome chr15 scaffold_40, whole genome shotgun sequence
  Pfam annotation: Domain name=Methyltransf_11; Domain location=207 -302; Score=12.3; E_value=0.0059; Accession=PF08241.3; Description =Methyltransferase domain
  Pfam annotation: Domain name=Methyltransf_12; Domain location=207 -300; Score=8.1; E_value=0.071; Accession=PF08242.3; Description =Methyltransferase domain
  Pfam module annotation: Pfam domain module=Methyltransf _11::Methyltransf_12; Domain location=207-302::207-300
MVCQSLNPEVPNGNQNEVLMKTVEMRLINKMKAIISKMVVSTKKKQSDEPADYFLREEIRKYVRIKPNRLGKQNFMGENASFTSIGHTCFAMKEELEEYMDYDVGEICNDDWKLAQKLMVHGCDPLPRRRCFSRSPKLYKQPFPVNESLWKLPDDRNVRWSQYQCKNFACLAGNATRKGFFKGVDCFNLTNHEMPRWTAQQIFLIGLDLSVGTGIFAARMREFNVTIVSANINFGAPFNEMIALRGLVPLYLTINQRLPFFDNTLDLIHTTRFLDGWIDLVLLEFILYDWDRVLRPGGLLWIDSFFCLKVDLYDYLQAFKMLRYKKHKWVVVPKLDKDEQEMFFSAVLEKPHRPFR

SEQ ID NO: 161002 - protein, 67 aa, Glycine max
  Coding DNA Sequence Number=SeqID_69317
MNASKVSRFLRKGTIQEFSEPLEASSPRDSKGNTFSSGKWKVSLKEPRRITSFSKLGTRCRNTLDSI

SEQ ID NO: 161003 - protein, 377 aa, Glycine max
  Coding DNA Sequence Number=SeqID_69318
  Gene Ontology: Mol. function=transporter activity; Cellular component= mitochondrial inner membrane; Biological process=transport
  Homolog annotation: Hit_ID=A7PZS6; Match level="QueryCoverage=100%, HitCoverage=100%, E-value=1e-162, Identity=78%"; Hit description =Chromosome chr15 scaffold_40, whole genome shotgun sequence
  Pfam annotation: Domain name=Mito_carr; Domain location=165-257; Score=131.2; E_value=3e-36; Accession=PF00153.18; Description =Mitochondrial carrier protein
  Pfam annotation: Domain name=Mito_carr; Domain location=268-373; Score=116.9; E_value=6.1e-32; Accession=PF00153.18; Description =Mitochondrial carrier protein
  Pfam annotation: Domain name=Mito_carr; Domain location=40-153; Score= 85.6; E_value=1.6e-22; Accession=PF00153.18; Description =Mitochondrial carrier protein
  Pfam module annotation: Pfam domain module=Mito_carr::Mito_carr::Mito_ carr; Domain location=165-257::268-373::40-153
MASENVKTGDSAVTTIVNLAEEAKLAREGVVKAPSYALASICKSLVAGGVAGGVVCGLDRQGTVEIEAFGFLISEWSRTAVAPLERLKILLQVQNPHNIKYNGTVQGLKYIWRTEGFRGLFKGNGTNCARIVPNSAVKFFSYEQASKGILHLYQQQTGNEDAQLTPLLRLGAGACAGIIAMSATYPMDMVRGRITVQTEASPYQYRGMFHALSTVLREEGPRALYKGWLPSVIGVIPYVGLNFAVYESLKDYLIKSNPFGLVENSELSVTTRLACGAAAGTVGQTVAYPLDVIRRRMQMVGWNHAASVLTGDGRGKVPLEYTGMVDAFRKTVQHEGFGALYKGLVPNSVKVVPSIAIAFVTYEVVKDILGVEIRISD

SEQ ID NO: 161004 - protein, 27 aa, Glycine max
  Coding DNA Sequence Number=SeqID_69319
MAIGFLVFQRGLVEEQPLWLNYGKFWR

SEQ ID NO: 161005 - protein, 261 aa, Glycine max
  Coding DNA Sequence Number=SeqID_69320
  Gene Ontology: Mol. function=protein-tyrosine kinase activity; Biological process=protein amino acid phosphorylation
  Homolog annotation: Hit_ID=A5AHW7; Match level="QueryCoverage=99%, HitCoverage=62%, E-value=4e-39, Identity=54%"; Hit description =Putative uncharacterized protein
  Pfam annotation: Domain name=DUF1221; Domain location=5-133; Score= -72.0; E_value=1.6e-05; Accession=PF06760.2; Description=Protein of unknown function (DUF1221)
MEQFRQIGEALGGLKFVMNLKFEEKNGKWKVLEHPFREIHKIFGEEEAYIRHCMETKDWRNIRVGSRGDAKEETYQLQQVQEGIWRHESFPLEIWEAVPHHSLSATDMIRNLERSESLVGRLLPSSTLVGSKDYQSNLVHLPNTATHIKEIHGPRKRIPFLLHVAIDLMLQIARGMEYLHSKKVYHGELNPSSILVKPRGTSPEGYLHAKVTGFGLTSVKDLNQKGNTNQNGTPPFIWYSPEVLEEQDHSGGAANSKYTEI

SEQ ID NO: 161006 - protein, 263 aa, Glycine max
  Coding DNA Sequence Number=SeqID_69321
  Gene Ontology: Mol. function=actin binding; Cellular component =integral to membrane; Biological process=actin cytoskeleton organization and biogenesis
  Homolog annotation: Hit_ID=A2Q5W8; Match level="QueryCoverage=60%, HitCoverage=15%, E-value=8e-20, Identity=44%"; Hit description=Actin- binding FH2
  Subcellular localization annotation: CTP_CleavageSite=74; ConfidenceScore=5.87e-01
SPPNPKYPFSTTPNTNASSSTPFFPTYPSPPPPPSPSAFASFPANISSLILPQTQKFKSSSKKLLAVAIAAVACAAAVVALSAFVYCRRRRKNYSADDKTLRSDSSIRLFPREASTTSGAASRKARNTSSTSSEFLYLGTIVNSRGGVDELSDPRAAALNPRKMDSPELQPLPPLARQTSRLREESTATVEDDEEEFYSPRGSLNNGREGSAGAGSGSRRVFGNAIAGENLVGRSSSESSTSSYSSSSSASPDRSHSISLSPP

SEQ ID NO: 161007 - protein, 1028 aa, Glycine max
  Coding DNA Sequence Number=SeqID_69322
  Homolog annotation: Hit_ID=A7PMI6; Match level="QueryCoverage=86%, HitCoverage=93%, E-value=1e-113, Identity=46%"; Hit description =Chromosome chr14 scaffold_21, whole genome shotgun sequence
  Subcellular localization annotation: CTP_CleavageSite=57; ConfidenceScore=5.61e-01
MSMTTTTILINSGGVTTTTTIKVKLMVMIAMKIVVIMLTMVVTTIVVMKFTSFSRRRSSTLRGCRVPMAAFDHFGNMYDVAFKPRLLQTLIRDHLPDEKRPFSNPSELSKVVSLIKTHSLLSESFADSTRPKLIEAWKSALASWLNLIYSLLSTTMPDKCWAGISLLGVTCEECSSERFLESYSVWFQKLLSFLQSSNQLEARGSCYLVDTKQVSKQAVAYHIHRSQVLQPSCHIARVADLQGLQFAAWRFAGGTIGVNGDWSKGIFKLQNYGHHERGKLELAATCTNSLLQNRLGGYPKIKKDSSSCAVKVVQPTLKILNDENSEAIWPYPCICKEAVSGFEPMTNRSPRHNFTAAPGLALNHGKKVESAIALKLLSGGCSLDMSKKLAHCLTLLPKSKGDEESWSVMMQKILVLINDQLNLAFHGLEEETLRNEVTRLLVLPGKHPPPPLGGYILAEKVLNKASKTSEQSLMSNASRLMFGCCLLLKNSYPVKRILMVNGSLPQMSLPFMTAKQQENICSELPVLHLSSLELLTAIIKAMGSQLLPHAAYIVRIITKYFKTCKLPELRIKVYSVTRNLLITMGVGMALYLAQEVINNAFADLSIIEHKNSGILNGSNSNASAGALLLPIHRKRKHSSTTGSLQEHGEGGLSVEVPKNRPLTPVSLRIAALETLESLITVAGALKSEPWRSKVDSLLLVTAMDSFKEGSVSEERSVFQQKEPAATTTELQLAALRALLVSLLSFARVRPPYLAQGLELFRRGRQQTGTKLAEFCAHALLTLEVLIHPRALPMVDYAYANNSSFGEAHSNLQHGYFGWSHNTPYGLPQVPPDYDDDLCARWLENDNEVGESLDKNTKYTQEPSEACRASDPEVLFVHVSSDTNIQERIEMVSETATCADVEMKTVEDETNFKSDQPGESVVQFQETVSCTTNIPVVETRGDVADDKVSEKIVSDNSIPHNEASHMESRHGSSVNKDFKFSSPSSSLWHRTSGSNIFEEFAFQLEHDKALADEDDFPDIVDGDPDSDTE

SEQ ID NO: 161008 - protein, 70 aa, Glycine max
  Coding DNA Sequence Number=SeqID_69323
MAPSRFLWFTFGFASTYFVVLKNLRRKCHALAYHMERDFRILEDRLSKFEESSFSVPLPIDQGLQFVVDA

SEQ ID NO: 161009 - protein, 184 aa, Glycine max
  Coding DNA Sequence Number=SeqID_69324
  Gene Ontology: Mol. function=phosphogluconate dehydrogenase (decarboxylating) activity; Cellular component=nucleus; Biological process=valine metabolic process
  Homolog annotation: Hit_ID=A7R5T2; Match level="QueryCoverage=83%, HitCoverage=71%, E-value=4e-64, Identity=79%"; Hit description =Chromosome undetermined scaffold_1050, whole genome shotgun sequence
MHMQRVAQCTRFLPGGVLGKMYAVLPPHEDGHKALYDEVLPAFDVLGKKSFFLGEVGNGAKMKLVVNMIMGSMMNAFSEGLTLAERSGLNPGTLLDVLDLGAISNGMFKLKGPTMLQNSYSPAFPLKHQQKDMRLALALGDENAVSMPVAAAANEAFKKARSMGLGDLDFSAVHETLKAPDHSS

SEQ ID NO: 161010 - protein, 212 aa, Glycine max
  Coding DNA Sequence Number=SeqID_69325
  Homolog annotation: Hit_ID=A5BEV8; Match level="QueryCoverage=64%, HitCoverage=12%, E-value=3e-08, Identity=30%"; Hit description =Putative uncharacterized protein
MRLKSASRKRLRPYLKGLRNLMCVANNSSVKRSASCSEPPQPTRIIPMLDQFAPFIQGFILDTVDVKVDSNCGYRSIATLLGMGEDSWPLVHNELIKEFGRWSHEYINLFGGTERFEQLKLSLLRWPLVHNELIKEFGRWSHEYVNLFGGTERFEQLKLSLLVDGFSKVSVDKWMDITKMGYVIASRLFERHCPLPPLALLWSSNFYSQAKQ

SEQ ID NO: 161011 - protein, 75 aa, Glycine max
  Coding DNA Sequence Number=SeqID_69326
MVVTVRPERDDYEGYEVIAERLERVLNLRMVTAGTKLHDIMQDCLTTARGVLVQMEVLGLDRDDAQTIDYCFYVL

SEQ ID NO: 161012 - protein, 137 aa, Glycine max
  Coding DNA Sequence Number=SeqID_69327
  Subcellular localization annotation: CTP_CleavageSite=39; ConfidenceScore=5.38e-01
MTRQLMLSFSQMQSQFQSQMQSQGLPLPPEPKVVPSTACVSTKERCVDPSRNDPATGDLDKYGLYIEENPPCLVALGRFYEGSTTVHNIPLLHDQVKVGVEEVRDADALILVPTEEVKLVGQTLNTFLAWPTHLVKR

SEQ ID NO: 161013 - protein, 142 aa, Glycine max
  Coding DNA Sequence Number=SeqID_69328
MKLTDLNEKGPITDCHADAEKGIEGEHEKALPLEVSMPHNNILNITNPSMVYAASGQHDLKVASEEMGQQTCGPTLSATKVYVRRKEVLRSNSKAQQFEKSIVDFNPTSITDPLPSLHEDFIELQCALLKEMGLTYGEDDNQ

SEQ ID NO: 161014 - protein, 49 aa, Glycine max
  Coding DNA Sequence Number=SeqID_69329
GSPALDFLEGDEDPLPEVDPPEEVMSASEADSTEDSGPGEMAISGGSSS

SEQ ID NO: 161015 - protein, 71 aa, Glycine max
  Coding DNA Sequence Number=SeqID_69330
GVSSLSSFSIPLPFIFQEAKESIDEEDPRPTSSNGACVKVGDEIAERLERHLSLGVVTPGSSTHEVIEECL

SEQ ID NO: 161016 - protein, 16 aa, Glycine max
  Coding DNA Sequence Number=SeqID_69331
NLLKEASQEGELSYER

SEQ ID NO: 161017 - protein, 48 aa, Glycine max
  Coding DNA Sequence Number=SeqID_69332
MTSKWISPHIQTVLLKRQPSRINQALYFVLEGHTLLYGMPRNTTVIGA

SEQ ID NO: 161018 - protein, 125 aa, Glycine max
  Coding DNA Sequence Number=SeqID_69333
  Gene Ontology: Mol. function=nucleic acid binding
  Homolog annotation: Hit_ID=A5B1B1; Match level="QueryCoverage=83%, HitCoverage=34%, E-value=7e-12, Identity=38%"; Hit description =Putative uncharacterized protein
MEKSDRKTFKDKKEKKAYITWEDNDMDSSKESENEVVNLSLMAKNYESKEEITSSNNNLSISYDELKDAFNDLHKESFKLAKLDYLKKNQYIDSGCSKHMTGDASKFTHISPKNNGHVTYDDNNK

SEQ ID NO: 161019 - protein, 184 aa, Glycine max
  Coding DNA Sequence Number=SeqID_69334
MLLDPARNLRNCLGVGGLTAEDKMLDYLITYILTLRSSNHAQMNWVLLIEDIMLKSDHLVDYEFLYVILASRFIDYFIVDVSNKIMDFGKATSEITKRHLKKLGIRFVDYEWIMTREPTTRNFNQLEEDAEAEAPQEPVHQWSPFKSPMIQKMEAMLHLHQEHSVEVHSSLENITTRLENIKLG

SEQ ID NO: 161020 - protein, 101 aa, Glycine max
  Coding DNA Sequence Number=SeqID_69335
MNNNKENKLSHQAPRREANHCQASCKGCFMLNFTPTVDKNPSMLMFILMRIMKLAKYRLKAQVEKNEGPSGEGQSPEWRRVKAQVEKDEGPEAETLSRLLI

SEQ ID NO: 161021 - protein, 66 aa, Glycine max
  Coding DNA Sequence Number=SeqID_69336
MSTRKMTISLLNEHLEETLGSTKIEENHSKCINLTWGKVHGELGPWLKACRMDGYDICQGVGLVQG

SEQ ID NO: 161022 - protein, 147 aa, Glycine max
  Coding DNA Sequence Number=SeqID_69337
  Subcellular localization annotation: CTP_CleavageSite=32; ConfidenceScore=5.17e-01
MPISPCGSISWSVSSRHRDRDHKAPSGPGGVRQGLGVSSSGYGPLSVLQDARPPSKGSRPQDILWTRRSPTGPWGFQLWLRASVSPTGCPFPPARSCHRDIGIAPARHPSGPGEVNRVLGFPALITGLCQFYRVPVAPSKVIRPPTN

SEQ ID NO: 161023 - protein, 175 aa, Glycine max
  Coding DNA Sequence Number=SeqID_69338
  Gene Ontology: Mol. function=ubiquitin-protein ligase activity; Cellular component=ubiquitin ligase complex; Biological process =protein ubiquitination
  Homolog annotation: Hit_ID=Q2HVY1; Match level="QueryCoverage=82%, HitCoverage=36%, E-value=4e-59, Identity=75%"; Hit description=U box
  Pfam annotation: Domain name=U-box; Domain location=5-80; Score=52.1; E_value=1.9e-12; Accession=PF04564.6; Description=U-box domain
MDEIEILAHFLCPISLQLMRDLVTVCTGITYDRENIERWLFSCKNNTCPVTKQCLLDHGLTPNHTLRRLIQSWCTLNASLGVERIPTPKSPIGKTEIVKLLTEAKGFPEKQLKCLTRLRSVAFEGQRNKTCLESVGVIEFLATTMNISAPILWGKDLVHMGVIICEYFTHLFTLF

SEQ ID NO: 161024 - protein, 75 aa, Glycine max
  Coding DNA Sequence Number=SeqID_69339
DKAGRYRRHLLMQSYPAKALGKRLQVDWARDPREGPRVLMRLREVSLAIRELLNEVFSKKLLKEVFSRKLLKEAT

SEQ ID NO: 161025 - protein, 80 aa, Glycine max
  Coding DNA Sequence Number=SeqID_69340
MFNTHRGGIRNVPRCFREKPAKNTKMGLYLAKWLNTHRGGIRKVLGCFRKKTTKNTKAVVNLSNTGGALRKLHPKHLEGG

SEQ ID NO: 161026 - protein, 75 aa, Glycine max
  Coding DNA Sequence Number=SeqID_69341
MSHVLLIFVFPPSPLKTLSFSRIPPNLSQKNDDLKLIHRWIVVKFKHQVRNSIPRLLTIGNYEKMSNLREIHFAS

SEQ ID NO: 161027 - protein, 105 aa, Glycine max
  Coding DNA Sequence Number=SeqID_69342
MTLNICHTLISSGDLCLMTCDLSLVLVRCLVPIIRQFVKFQDMPENQKNIDAQSHPGPLGPSRIFLQKAVASGGSNLARLGELSSPGRAELAWASWAATTSPILL

SEQ ID NO: 161028 - protein, 119 aa, Glycine max
  Coding DNA Sequence Number=SeqID_69343
  Gene Ontology: Mol. function=two-component response regulator activity; Cellular component=cytoplasm; Biological process=two -component signal transduction system (phosphorelay)
  Homolog annotation: Hit_ID=Q6DB90; Match level="QueryCoverage=83%, HitCoverage=45%, E-value=5e-37, Identity=75%"; Hit description=Two -component system response regulator
  Pfam annotation: Domain name=Response_reg; Domain location=21-119; Score=70.4; E_value=6.1e-18; Accession=PF00072.15; Description =Response regulator receiver domain
MTLYKRASASYKPPGNREKRMRILLIEDDTLIGDGLKVGLTKLGFSVDWFVSGEAGFQALNAAPWDAVVLDLSLPQRDGLDILRQWREQGADVPVLILTARDALDERVQGLQLGADDYL

SEQ ID NO: 161029 - protein, 327 aa, Glycine max
  Coding DNA Sequence Number=SeqID_69344
  Gene Ontology: Mol. function=transferase activity; Cellular component= cytoplasm; Biological process=D-ribose metabolic process
  Homolog annotation: Hit_ID=A7MMV8; Match level="QueryCoverage=87%, HitCoverage=92%, E-value=2e-84, Identity=59%"; Hit description =Putative uncharacterized protein
  Pfam annotation: Domain name=HK; Domain location=126-326; Score= -151.5; E_value=0.08; Accession=PF02110.6; Description=Hydroxyethylthi azole kinase family
  Pfam annotation: Domain name=PfkB; Domain location=29-316; Score =285.1; E_value=1.4e-82; Accession=PF00294.15; Description=pfkB family carbohydrate kinase
  Pfam annotation: Domain name=Phos_pyr_kin; Domain location=136-313; Score=-114.0; E_value=0.00031; Accession=PF08543.3; Description =Phosphomethylpyrimidine kinase
  Pfam module annotation: Pfam domain module=HK::PfkB::Phos_pyr_kin; Domain location=126-326::29-316::136-313
  Subcellular localization annotation: CTP_CleavageSite=45; ConfidenceScore=5.28e-01
KHGNAPPRGGATSWITPYEQKRKTGRYSAASTPTTSSTSPIFPVPGETVIGKQYQVAFGGKGANQAVAAGRAGADIAFIACVGADDIGERIRQQLQQDQIDTAPVETVAQEATGVAMIFVNGEGENNIGIYSGANAALTPACVERHQQVIRSADALLMQLESPLDSVLAAARIARASHTQVILNPAPATQLSDELLALIDIITPNETEAEILTGIAVNDDDDAARAAQALHAKGIDTVLITLGRRGVWLSEQGQGQRIPGFSVQAVDTIAAGDTFNGAFITARLEGVAMQDAVRFAHAAAAIAVTRPGAQPSVPWRTEIDAFLQQQG

SEQ ID NO: 161030 - protein, 819 aa, Glycine max
  Coding DNA Sequence Number=SeqID_69345
  Gene Ontology: Mol. function=catalytic activity; Cellular component =cell surface; Biological process=carbohydrate metabolic process
  Homolog annotation: Hit_ID=A5FK34; Match level="QueryCoverage=97%, HitCoverage=84%, E-value=0.0, Identity=48%"; Hit description=Alpha amylase, catalytic region precursor
  Pfam annotation: Domain name=Alpha-amylase; Domain location=378-756; Score=-4.1; E_value=2.6e-09; Accession=PF00128.15; Description=Alpha amylase, catalytic domain
  Pfam annotation: Domain name=Isoamylase_N; Domain location=236-318; Score=14.6; E_value=0.0031; Accession=PF02922.9; Description =Isoamylase N-terminal domain
  Pfam module annotation: Pfam domain module=Alpha-amylase::Isoamylase _N; Domain location=378-756::236-318
MKKFYFFILLLINFFVFGQINYTITPGQFNETDQITLTVPGDQIDESTWNVSNHAIYIWAWSLDTNYMNSQNCPTNGNWNNSDDQNKLNYNSTTDTYSLTFTPTTFFGRTGIGRFGFLLKDKAGTHQTSPDIFVNVGVLNLTLTNPLPNSLTSVPSGGSVSISATTNVAANFQLKANGVVVNSTSTPSVSYSYTYMVSADADMELIATDNSGTKNAKFIIQIPRNVISQAIPSWIRQGINYHPTDNTKVGLALYAPHKNFVHVIGSFNSWTVNDNYLMKRDTTNPDLYWIELDGITPQQLYTFQYRTNDLKKVADPFSPQILSSYDDQWIPSSTYPNLPPFPAGQNFEVSMFKTGQPNYNWQVTNFQRPDKEDLIVYELLLRDFTQEKNWQSLINKITYLKNLKINAIELLPIMEFEGNLSWGYNTSFHYTLDKAYGTPEKFKEFVDLCHQNGIAVILDVAFNHATGRSPLVRLWNIDPDGDGYGDIATNNPYFNQVPKHSYNVFNDFNHTSSATRYYVERTLQQWLTEYKIDGFRWDLTKGFTQNCSENDENCTNAYQQDRVDILKYYADKQWAIDPNSYMIFEHLGTDAEEQQWANYRVAEGKGVLLWNKQTEPYNQNTMGYKENSNFDRMNHQLHGFTKMNAVGYGESHDEERLMFKNLEYGAINGAYSVKNLDTALERMKAFGATFFTIPGPKMIWQFGELGYEFSINRCADGTINNGCRTDEKPIAFTLGYDNNPNRKAVYDTWAQIITIRNTYPVFKSKTYTVESNNLSNDPDGLITRIFVYDNLLNNGMKNVVVLANYNTTTKNVIPYFPYT

SEQ ID NO: 161031 - protein, 154 aa, Glycine max
  Coding DNA Sequence Number=SeqID_69346
  Gene Ontology: Mol. function=serine-type endopeptidase activity; Cellular component=periplasmic space; Biological process=proteolysis
  Homolog annotation: Hit_ID=A8GK06; Match level="QueryCoverage=99%, HitCoverage=33%, E-value=5e-52, Identity=69%"; Hit description =Protease Do precursor
MKKPARLLSALALSIGMSLAATPGAMATLPAQIQGQALPSLAPMLEKVLPAVVSVHVEGTDSGQQGQDIPEPLKRFFGQAPGQSQPQPFEGLGSGVIIDAAKGYILTNNHVVNGADKISVQLSDGNEYDAKLIGHDEQTDIALIQVEGAKNLTQ

SEQ ID NO: 161032 - protein, 263 aa, Glycine max
  Coding DNA Sequence Number=SeqID_69347
MPFRGLKSARKRAAFSGKHNELAKRACCTKRVHQYSLYMSSRKRKSIGARPTAQYDSRRFHSFEAWTRYTDNVLGRNILPEKKVKLYHTELDDFKAELERRNFHKRLTNLAYGSIDLALVKEFYANLYSSEDRPPKQSRVRGHLVKIDADSLNKFLETPVIKQRKLNITSVPPAIADRMRSNAYTNPKVAEIKVECGRKIDQIQKTEFPKNCNVKNRKRERGTLDSREKPITNNVRKTQIAKSRTKHGERACKEKGKKETGVL

SEQ ID NO: 161033 - protein, 135 aa, Glycine max
  Coding DNA Sequence Number=SeqID_69348
MSLCQSYWVSVPPTRSRHRDLGIAPARHPVDPEKSNMVLRFLALITSLCQFYGVPVAPSKVIRPILTELSSRCTAPPGRRRARHHSSLGMAGSGQQTHCRHLQSPSAHLQKLERCLQPVVDLQATKSKAKGKQKY

SEQ ID NO: 161034 - protein, 110 aa, Glycine max
  Coding DNA Sequence Number=SeqID_69349
  Homolog annotation: Hit_ID=A5C693; Match level="QueryCoverage=60%, HitCoverage=30%, E-value=3e-11, Identity=43%"; Hit description =Putative uncharacterized protein
ATRSNKWYQSRFLVESLTTSRLMASLDSLSFKSIFRNRLFQDHDEDQVNLCLMTKSDENNKEDSTRKKWYIDSGCSKHMAGDVSKFTTISPKKSGHVTYGDNNISKISEE

SEQ ID NO: 161035 - protein, 313 aa, Glycine max
  Coding DNA Sequence Number=SeqID_69350
  Gene Ontology: Mol. function=catalytic activity; Biological process =trehalose biosynthetic process
  Homolog annotation: Hit_ID=A7QTV8; Match level="QueryCoverage=89%, HitCoverage=95%, E-value=2e-95, Identity=61%"; Hit description =Chromosome undetermined scaffold_171, whole genome shotgun sequence
  Pfam annotation: Domain name=Trehalose_PPase; Domain location=47-292; Score=256.2; E_value=6.9e-74; Accession=PF02358.7; Description =Trehalose-phosphatase
MIPVSLEKSDENGELRSYASWLGKHPSALGNFEEVMSIAEGKQIVVFLDYDGTLSPIVDDPDKAYMSDVMRAAVCEVANCFPTAIVSGRSKDKVYEFVKLENVYYAGSHGMDISTPSGSSKYEEQEHQIKAVDEKGNPVVHCHPAIEFLPTIQEIVKVLKENTRRIKGSMIEDNTFCVTVHYRCVKNEEEVGVLKKMVKTIMKAYPDFYISGGRKVMEIRPTVNWDKGRALTYLLDTLGFDNFSNVLPMYLGDDRTDEDAFKVIRHIGCGFPIVVSSIAKETEASYSLRDPADVLTFLIRLAKRKKNELVTEN

SEQ ID NO: 161036 - protein, 157 aa, Glycine max
  Coding DNA Sequence Number=SeqID_69351
  Gene Ontology: Biological process=response to biotic stimulus
  Homolog annotation: Hit_ID=Q5MJ53; Match level="QueryCoverage=90%, HitCoverage=75%, E-value=3e-74, Identity=97%"; Hit description=AT -rich element binding factor 3
MNYCLMWFGYFPSQVWSLVRRFDQPQKYKPFVSRCIMQGDLGIGSVREVNVKSGLPATTSTERLEQLDDEEHILGIRIVGGDHRLRNYSSIITVHPEVIDGRPSTMVIESFVVDVPDGNTRDETCYFVEALIRCNLSSLADVSERMAVQGRTDPINH

SEQ ID NO: 161037 - protein, 139 aa, Glycine max
  Coding DNA Sequence Number=SeqID_69352
MSWFLESLNRITTEVAVDTALPQHGGFVVTAIVDVSTTASELQLWLIPQRQSFLCQCNCITTAIAAASIIFLHNFPQQQGCHCNRIMTEIAANTVASSFLESLQDCNCCGHCNCITTAIAADGSIEVFRVTATASRPQL

SEQ ID NO: 161038 - protein, 1395 aa, Glycine max
  Coding DNA Sequence Number=SeqID_69353
  Gene Ontology: Mol. function=nucleotidyltransferase activity
  Homolog annotation: Hit_ID=A5B8P4; Match level="QueryCoverage=90%, HitCoverage=79%, E-value=0.0, Identity=57%"; Hit description =Putative uncharacterized protein
  Pfam annotation: Domain name=NTP_transf_2; Domain location=110-204; Score=5.1; E_value=0.07; Accession=PF01909.14; Description =Nucleotidyltransferase domain
MGEHEGWAQAPSGLLPNGLLPNEAASVIQVLDSERWLKAEQRTAELIACIQPNPPSEERRNAVADYVQRLIMKCFPCQLKVVVTCDQLRHHYCMMKVLNNTIMLLQVFKLSGARSEIPVCSEKVFTFGSVPLKTYLPDGDIDLTAFSKNQNLKDSWAHQVRDMLENEEKNENAEFHVKEVQYIQAEVKIIKCLVENIVVDISFNQLGGLCTLCFLEEVDNLINQNHLFKRSIILIKAWCYYESRILGAHHGLISTYALETLVLYIFHVFNNSFAGPLEVLYRFLEFFSKFDWENFCVSLWGPVPISSLPDVTGLSCVLIAFLPSLTLSTAEPPRKDGGDLLLSKLFLDACSSVYAVFPGGQENQGQPFVSKHFNVIDPLRVNNNLGRSVSKGNFFRIRSAFAFGAKRLARLLDCSEDELFSEVNQFFFNTWERHGSGERPDVPSIDLRHLSLSSHDQLQRFENLRNNNHKIGSASNHESNEEEHVSQSGLSQYSNLSSEKTTRNVVSTVSHSQNQKSYGSQNNSRTFDQVRRETNSNPGPHVDKVQRNVKADNLVSDVQGRFLFARTCSSPELTDSYGDVSTQGRRTKATESSKGQTSFAKLENSRRKHVEPDVAVRMDESSARLISSHQVLENAADSNSNHDESRSGVMGEEFASVVGADGMQMMHQEEQDLLNMMASPTAQGFSGQTHVPMNIAPGHLPFHFPPSILASMGYAQRNMGNIPFIEAPWGTNMQFPQGFVPPLTPYFPGIGMTSSPQDLLETNNENFSSVEMNIAEADNNYWHEQERGSASEVEVDNGNFEMLPEDRQQSTSDSYNNSAPLSRVGSSNSNSSARVQQKFTKENRGSTREEHVDNFHYQDGRRNEVYFDDRTANSELSSAPPLSSFKSRTSSESSWDGSSAKSSKSTRERRGRKNTSSIASPVYAKGKNVSETSSNRVDDENREWTPLSTMASNISERSIWPTSSTSMHVPRNQISGFETAQTSGSDSPLPISPVLLGPGSRQRDNSGVVPFTFYPTGPPVPFVTMLPLYNFPTESSDTSTSNFNLEEGADNSDSSQNFDSSEGYEHPGVSSPSNSMTRVAIESSEHKSDILNSDFVSHWQNLQYGRFCQNSRLPPSMTYPSPGMVPPVYLQGRYPWDGPGRPISGNMNIFSQLMNYGPRLVPVAPLQSVSNRPANIYQRYVDDMPRYRSGTGTYLPNPKVSARDRHSTNTRRGNYNYDRSDHHGDREGNWNTNSKLRGTGRGHNRNQNEKPNSKTERLSSSESRAERSWGSHRHDNFIPHQNGPVGSNSLQSNPSNVAYGMYPIPAMNPSGFSSNGPTMPSVVMFYPYDHNTGYGSPAEQLEFGTLGPMGFSGVNELSQANEGTQSSGAHEDQRFRGGHSQRSSPDQPSSPHVSR

SEQ ID NO: 161039 - protein, 49 aa, Glycine max
  Coding DNA Sequence Number=SeqID_69354
MEKILVGKIEEKKQAELLTFQEKLKRVNGFLAALFFLLPKIALSITYFC

SEQ ID NO: 161040 - protein, 107 aa, Glycine max
  Coding DNA Sequence Number=SeqID_69355
  Gene Ontology: Mol. function=hydrolase activity, hydrolyzing O -glycosyl compounds; Cellular component=cell wall; Biological process= carbohydrate metabolic process
  Homolog annotation: Hit_ID=Q84JB9; Match level="QueryCoverage=90%, HitCoverage=36%, E-value=7e-33, Identity=61%"; Hit description =Putative xyloglucan endotransglycosylase
  Pfam annotation: Domain name=Glyco_hydro_16; Domain location=1-100; Score=9.0; E_value=4.5e-08; Accession=PF00722.12; Description =Glycosyl hydrolases family 16
MQLRSKGSFWDELDFEFLGNLNGDPDTVHTNLYTHKKKVTDPTTDFRTYSFLWNPALVVFYVDGRPIREFKKLEGVGVEYPKNQSMKLYTSKWNVDDWAKERRASED

SEQ ID NO: 161041 - protein, 116 aa, Glycine max
  Coding DNA Sequence Number=SeqID_69356
  Gene Ontology: Mol. function=oxidoreductase activity; Cellular component=extracellular region; Biological process=lignin catabolic process
  Homolog annotation: Hit_ID=A7QWG2; Match level="QueryCoverage=50%, HitCoverage=10%, E-value=4e-18, Identity=65%"; Hit description =Chromosome undetermined scaffold_203, whole genome shotgun sequence
MCSVLQQESHFFHYSMFATAKRAFGAAEGHLLLASSCFLDKRNSLWCHDCVSKDRSTIPIKFPYQEHIIILGEYWLQDLQQVENATIASGGPPPVADAYTITDHPGPNYNCSTNGI

SEQ ID NO: 161042 - protein, 224 aa, Glycine max
  Coding DNA Sequence Number=SeqID_69357
  Homolog annotation: Hit_ID=A7QWF6; Match level="QueryCoverage=63%, HitCoverage=5%, E-value=3e-52, Identity=69%"; Hit description =Chromosome undetermined scaffold_203, whole genome shotgun sequence
  Pfam annotation: Domain name=WD40; Domain location=8-48; Score=4.5; E_ value=8.9; Accession=PF00400.23; Description=WD domain, G-beta repeat
  Pfam annotation: Domain name=WD40; Domain location=84-122; Score =33.6; E_value=7.3e-07; Accession=PF00400.23; Description=WD domain, G-beta repeat
  Pfam module annotation: Pfam domain module=WD40::WD40; Domain location=8-48::84-122
MSCHITNLACLFEGGAHTVSVFDNHVGGGSVSPLIVTGGKGGDVGLHDFRYIVTGKAKRHKRADNIGQGSVSSLTCDKDPNVDGMLWYIPKAHSGSVTKVVTIPNTNLFLTGSTDGDVKLWDAQSTKLIHHWSKIHEKHTFLQPSSRGFGGVVRLMPWAVVALSNSWPLKKKYPSVIRLFTMRKYGRGSLYVALSLLMQGGCFRIQTHDQLVRHNFTVIPGLAL

SEQ ID NO: 161043 - protein, 177 aa, Glycine max
  Coding DNA Sequence Number=SeqID_69358
  Pfam annotation: Domain name=DUF1723; Domain location=66-116; Score =13.9; E_value=0.012; Accession=PF08330.1; Description=Protein of unknown function (DUF1723)
MVKTRELCWTLVKVLGRASGTEVSGEADEVPRRRRMTSFARRQRAATPITKDGEHLDHAADGVHEQPQEPIIDDVCADVQDFLGSSFHLPVGKVTITLDDVTSLLHLPITGAFHTFDALHVDQVVDLLVELIEVSSQEARDETFQCHGGICSTILIVGSRSIFLLLFLLLPSKIIMR

SEQ ID NO: 161044 - protein, 427 aa, Glycine max
  Coding DNA Sequence Number=SeqID_69359
  Gene Ontology: Mol. function=aspartic-type endopeptidase activity; Cellular component=extracellular region; Biological process =proteolysis
  Homolog annotation: Hit_ID=Q8L9B9; Match level="QueryCoverage=96%, HitCoverage=85%, E-value=1e-160, Identity=68%"; Hit description =Chloroplast nucleoid DNA binding protein, putative
  Pfam annotation: Domain name=Asp; Domain location=83-424; Score= -49.8; E_value=1.2e-10; Accession=PF00026.14; Description=Eukaryotic aspartyl protease
  Subcellular localization annotation: CTP_CleavageSite=70; ConfidenceScore=5.06e-01
MEEKLKIRPGPDPFSLSVHLNHIDALSPNKTPSQLFHLRLLRDGARVKTLNSLAAATNQTRPTNTGSGFSSSVVSGLSQGSGEYFTRLGVGTPPKYLYIVLDTGSDVVWLQCKPCTKCYSQTDQIFDPSKSKTFAGIPCSSPLCRRLDSPGCNTKNNLCQYQVSYGDGSFTVGDFSIETLTFRRAEVPRVALGCGHDNEGLFVGAAGLLGLGRGGLSFPTQTGTRFNNKFSYCLTDRTASAKPSSVVFGDSAVSRTARFTPLVKNPKLDTFYYVELLGFSVGGAPVRGISASLFRLDSTGNGGVIIDSGTSVTRLTRPGYVALRDAFRVGASHLKRASEFSLFDTCYDLSGLSEVKVPTVVLHFRGADVSLPASNYLIPVDNDGTFCFAFAGTMSGLSIVGNIQQQGFRVVFDLAGSRVGFAPRGCA

SEQ ID NO: 161045 - protein, 420 aa, Glycine max
  Coding DNA Sequence Number=SeqID_69360
  Gene Ontology: Mol. function=dopamine beta-monooxygenase activity; Cellular component=integral to membrane; Biological process =histidine catabolic process
  Homolog annotation: Hit_ID=A7PZX7; Match level="QueryCoverage=88%, HitCoverage=89%, E-value=1e-117, Identity=55%"; Hit description =Chromosome chr15 scaffold_40, whole genome shotgun sequence
  Pfam annotation: Domain name=COPI_assoc; Domain location=273-412; Score=-53.1; E_value=0.038; Accession=PF08507.1; Description=COPI associated protein
  Pfam annotation: Domain name=Cytochrom_B561; Domain location=217-399; Score=-63.7; E_value=0.027; Accession=PF03188.7; Description =Cytochrome b561
  Pfam annotation: Domain name=DOMON; Domain location=89-202; Score =1.5; E_value=0.038; Accession=PF03351.8; Description=DOMON domain
  Pfam module annotation: Pfam domain module=COPI_assoc::Cytochrom _B561::DOMON; Domain location=273-412::217-399::89-202
MANSRSWTQTWPCFVKLGVLNLVLVFKITALGDVSGSVTAENTCKNTNYQSFLPPPYQNMSQMICTPVWHTYELRTAYNYPPCSFAERRASSIRYFQNGDTTTIILSAPYTIGWVGIGFSRDGMMVGSSAMVGWITKHGHANMKQFYLRGRKSSEVKIDKGELPLNNIPSAVATNGAEIHMAFQLQMTTPFQKQPILLAFGSKYPQNHHLSKHEDKTAIVFDFSAGSTGPVSRELIQMRTNHGILAIIGWGLILPVGAIIARYFRHKDPLWFYLHAIIQFVGFTFGLGTVILGLQLYSKMQVHIPAHRGIGIFALVLSILQVLALFLRPNKDSKIRKFWNWYHSWFGRMALVFAAINIVLGMQAAGAGSDWKIGYGFVFGIMVVAAIVLEILAYLKRSEMRSLPPNFQLDPVGGATFPSK

SEQ ID NO: 161046 - protein, 134 aa, Glycine max
  Coding DNA Sequence Number=SeqID_69361
  Gene Ontology: Mol. function=nucleotide binding; Cellular component =cytosol; Biological process=translational termination
  Homolog annotation: Hit_ID=A7PH23; Match level="QueryCoverage=98%, HitCoverage=51%, E-value=2e-19, Identity=80%"; Hit description =Chromosome chr17 scaffold_16, whole genome shotgun sequence
MAYILNTNEEERVKGKTVEVGKAHFETETTRFTILDAPSGKCYVLLKTARAWDKLNMIGGFFAQNVEQFHHDPSGPFRMPIIDRVKDMGAVVMGKVESGTVRVGDSLLLMPNKDQVKVVAIFIDEDRVKCAGVS

SEQ ID NO: 161047 - protein, 273 aa, Glycine max
  Coding DNA Sequence Number=SeqID_69362
  Gene Ontology: Mol. function=histone-lysine N-methyltransferase activity; Cellular component=nucleus; Biological process=DNA mediated transformation
  Homolog annotation: Hit_ID=A7QEQ4; Match level="QueryCoverage=85%, HitCoverage=35%, E-value=1e-63, Identity=57%"; Hit description =Chromosome chr16 scaffold_86, whole genome shotgun sequence
  Pfam annotation: Domain name=SET; Domain location=145-255; Score =74.3; E_value=3.9e-19; Accession=PF00856.19; Description=SET domain
MAENIPLDGIPEQLDQQQMPNSSPPRMLWGKESSGFYFLGGALKPTDVEMLWVHVTCAWFRPQVVFQNHEAMEPATGILKIPPNSFVKGCFRGSRLISSKNIELNESSTTEKDIVEPLSAARCRVYQRSPNKDADESKVFTSFKERLHHLWEMEKFRVCFGKSGIHGWGLFARRDIQEGEMVVEYRGVHVRRSVTDLREEKYRSEGKDCYCMPNCYARIMSMGDQGSRIVLIAKTNVSAGEELTYDYLFDPDERDELKVPCLCKAPNCRRFMN

SEQ ID NO: 161048 - protein, 76 aa, Glycine max
  Coding DNA Sequence Number=SeqID_69363
MAVEWRRKRERRRHFKEKMSLEEAHHHRRPWIRAWRKKEMNEGRGRQEHEILCSKRALKSETTNPRSIPRFSTKCA

SEQ ID NO: 161049 - protein, 16 aa, Glycine max
  Coding DNA Sequence Number=SeqID_69364
KWIRYPDTVPCDTTKN

SEQ ID NO: 161050 - protein, 40 aa, Glycine max
  Coding DNA Sequence Number=SeqID_69365
MATIQHLAIANKKTRPIICMIKLELNRTSKETTKATEVAQ

SEQ ID NO: 161051 - protein, 64 aa, Glycine max
  Coding DNA Sequence Number=SeqID_69366
MPVSAETQSRYSRTKNPSRPTLLKAQVEKDEGPSGEGQSPQVEKDEGPEAETLSRQLIVAEGPN

SEQ ID NO: 161052 - protein, 179 aa, Glycine max
  Coding DNA Sequence Number=SeqID_69367
MRPTYSDIGCKLALEDKERVAFRRRQRHEHVDATRHAKPCNCSSLASQQQKACVCFFIKLPCRICHQALRCARKWACYGSKNNRLKNPLPFNLSFCITGWVCEFLGFCKIRRILSCWSWTCENFLKLCPAYRCPLSWYVMARVCSSSKQDLGKMEGICIPASYLYYQIPNENDLGIVAM

SEQ ID NO: 161053 - protein, 79 aa, Glycine max
  Coding DNA Sequence Number=SeqID_69368
MDGQWIHKQDIPPNASNERTPSPPPQRDPSSSLLNDVLSELQDLGAFASDRFDIMDSRITQLEDDMNFIRQCFDPPANP

SEQ ID NO: 161054 - protein, 202 aa, Glycine max
  Coding DNA Sequence Number=SeqID_69369
  Gene Ontology: Mol. function=structural constituent of ribosome; Cellular component=ribonucleoprotein complex; Biological process =translation
  Homolog annotation: Hit_ID=Q2PMP9; Match level="QueryCoverage=55%, HitCoverage=92%, E-value=9e-56, Identity=99%"; Hit description =Chloroplast 50S ribosomal protein L14
  Pfam annotation: Domain name=Ribosomal_L14; Domain location=80-202; Score=220.5; E_value=3.9e-63; Accession=PF00238.10; Description =Ribosomal protein L14pL23e
  Pfam annotation: Domain name=Ribosomal_L16; Domain location=1-106; Score=125.4; E_value=1.7e-34; Accession=PF00252.9; Description =Ribosomal protein L16
  Pfam module annotation: Pfam domain module=Ribosomal_L14::Ribosomal _L16; Domain location=80-202::1-106
MKGISYRGNHICFGRYALQALEPAWITSRQIEAGRRAMSRNVRRGGQIWVRIFPDKPVTVRPTETRMGSGKGSPEYWVAVVKPGKILYEMADNSGARELMCIRILGASNRRYAYIGDIVVAVIKQAVPNTNLERSEVIRAVIVRTCKELKRSNGIIIQYDDNAAVVIDQEGNPKGTRIFCAIARELRQLNFTKIVSLAPEVL

SEQ ID NO: 161055 - protein, 254 aa, Glycine max
  Coding DNA Sequence Number=SeqID_69370
  Gene Ontology: Mol. function=oxidoreductase activity; Cellular component=integral to membrane; Biological process=electron transport
  Homolog annotation: Hit_ID=A6ETS3; Match level="QueryCoverage=100%, HitCoverage=96%, E-value=1e-120, Identity=79%"; Hit description=Fe-S oxidoreductase, possible dehydrogenase subunit
  Pfam annotation: Domain name=CCG; Domain location=161-227; Score =51.0; E_value=4.1e-12; Accession=PF02754.7; Description=Cysteine -rich domain
  Pfam annotation: Domain name=CCG; Domain location=38-99; Score=59.0; E_value=1.6e-14; Accession=PF02754.7; Description=Cysteine-rich domain
  Pfam module annotation: Pfam domain module=CCG::CCG; Domain location =161-227::38-99
MAEYAAEGKAPEVLFWVGCAGSFDDRAKKITKAFCKILNKIGVEFGVLGQEESCTGDPAKRAGNEFVFQMMALTNIEVLNAYEVKKIVTACPHCFNTLKNEYPSLGGHFEVVHHTQFLKSLMEEGRLKIEGGAFKGKKITFHDPCYLGRANNEYEAPRILLEKLDAELVEMKRCKTNGLCCGAGGAQMFKEPEKGNKDINIERTEEALSFEPKVIATGCPFCNTMMTDGVKHFNKNDEVAVKDIVELLAEAEDL

SEQ ID NO: 161056 - protein, 71 aa, Glycine max
  Coding DNA Sequence Number=SeqID_69371
MGEEVAAQLAQESSARPGELGCFHQKAPPSVGIPWKAQTFTDYLTMGVKYLEEVKRRLHAAKQWSPDEITV

SEQ ID NO: 161057 - protein, 107 aa, Glycine max
  Coding DNA Sequence Number=SeqID_69372
MERKDKELRGSNNGVIGDYHKWLKARTQGITWLPKLKDLSGKEAEVLKESEEVQALKPELERMRVVKEKLKTTVTRVRKEFDEAQKEEWSRNKFRGALWGSNNELKL

SEQ ID NO: 161058 - protein, 111 aa, Glycine max
  Coding DNA Sequence Number=SeqID_69373
MTNLSEGSIDVAIVKEFYANLYVPEDKEPNQVRVRGHLIKFNADSLNTFLKTPVVLEQGESLPSYSRFYRLRPDPQELAARLCILGRGFVLNAEGLPWKLLRKDLTTLAQT

SEQ ID NO: 161059 - protein, 251 aa, Glycine max
  Coding DNA Sequence Number=SeqID_69374
  Homolog annotation: Hit_ID=Q6WAY4; Match level="QueryCoverage=52%, HitCoverage=24%, E-value=4e-10, Identity=32%"; Hit description =Putative uncharacterized protein
LEVSNLQELGLLMDQLQCQAFRKTYGKIWDLAMIEVSVETIASLTQYYDQPLRCFMFGDFQLVPTVEEFEEILGCLLGGRKPYLFFGFYPSVARIAKVVKISVQELDRVKQNRNGVVGIPRKHLEEKAKPLADQVINAFLAYHHSKECLVVAVLADAYDTFNRRCEKSGTRIGHPLIGSPDGRKEESGFCPHDKELRGSSNRIVGGYHTWLKVRTKELDWLSKLKVSGEEEAETPEESKEVQALKAEQERA

SEQ ID NO: 161060 - protein, 171 aa, Glycine max
  Coding DNA Sequence Number=SeqID_69375
MACTKKTRQMTSDVAKEIADKIASQDSFVAHGRQDVLIAAIGRLEHPGRVRAAGAGVTIKQYFRPTPRTSCTSFSMAPEDLEQLTQMQSHFQSQMQSQGLTLPPKPKVGPLDAHVSTKESCVDPSGNDPDTGDSDKCVLYINENPPHLVALGRVMRDPQSFTTFLCCMIKS

SEQ ID NO: 161061 - protein, 63 aa, Glycine max
  Coding DNA Sequence Number=SeqID_69376
LEEATQLAWASWAATSSPFFPINRLKGAVLRIPDAPGEVSVSKSHEGFPPLFTILHPFFVLQR

SEQ ID NO: 161062 - protein, 118 aa, Glycine max
  Coding DNA Sequence Number=SeqID_69377
  Subcellular localization annotation: CTP_CleavageSite=11; ConfidenceScore=5.19e-01
YPHLQRATRPRLQRTTCPHLQRATRPHLQRTTRPRLQRAILPFRGLHILAFRGLSSPSEGYTSSSSEDYTSSPSENYTSSPSEGYTPSPLEDYTSSPSEDYTSSPSGDYTSSPLEDYT

SEQ ID NO: 161063 - protein, 136 aa, Glycine max
  Coding DNA Sequence Number=SeqID_69378
MTRGNLGDLEPFDLEIDRTFHRLVRHSVHPNHYVHFEHSEYSVAGDSEYSDFEHSTTNFHTENIAQPPPCERTLREMAALNFTYESLCIQYPDEGVPYVPKTGLIHFLPKFHGLAGEDPHKHLKEFHIVCSTHEAP

SEQ ID NO: 161064 - protein, 315 aa, Glycine max
  Coding DNA Sequence Number=SeqID_69379
  Pfam annotation: Domain name=Transposase_23; Domain location=123-195; Score=4.2; E_value=0.00041; Accession=PF03017.5; Description =TNP1ENSPM transposase
DRCDNQPILWQASRGSDTSSTSITQRQLAEIIHNLKEEWRKEVEEDNKNQQEAWRRKVEEENQRTLEIIKQELKQTIKLELSQIASYHSPPLQPPDIQVLGERVRMKGSCAEADTNPLGKDTSYVHADTIGLYVVAEQSTKLVALGKVYDSSSTIHNVPYADDVVRVSVVKVYHGDAQVPFPTSEIQFVRQAVGTFVGWPIHLVKPISDEDSQKRLPIPVKSAKIDNVVAAIDPLGELVKKLFDSYQNPIQLPWDGKKFGIPNVKDGFFITHIDVSEIILGDKCLNISILQLWLMFMNDWSTSIGYGSLYGFLEP

SEQ ID NO: 161065 - protein, 130 aa, Glycine max
  Coding DNA Sequence Number=SeqID_69380
  Gene Ontology: Mol. function=nucleic acid binding; Biological process= DNA integration
  Homolog annotation: Hit_ID=A5BKR0; Match level="QueryCoverage=86%, HitCoverage=12%, E-value=2e-25, Identity=42%"; Hit description =Putative uncharacterized protein
MDLDLALRIEKLLSPTDSNDITSAKELLAEIEKHFAKCDKAETSTLISNLISMKYQGKGNKWSLKEIISYYVQEEERLKQERIESAHVVSNSKDKGKRKITEEPENEAAKGPAQKKQNQGDNYFFCSKPG

SEQ ID NO: 161066 - protein, 86 aa, Glycine max
  Coding DNA Sequence Number=SeqID_69381
MSYNTYYISSTSRSANSVYEHGTDSVIPSENLKEIESSTVELCWRRQSGLTGSRGNIQIIHMILDHNELQLAMVIFNFKMIISARS

SEQ ID NO: 161067 - protein, 137 aa, Glycine max
  Coding DNA Sequence Number=SeqID_69382
  Gene Ontology: Mol. function=oxidoreductase activity; Cellular component=extracellular region; Biological process=response to oxidative stress
  Homolog annotation: Hit_ID=Q2HRD8; Match level="QueryCoverage=50%, HitCoverage=43%, E-value=2e-15, Identity=54%"; Hit description =Barwin-related endoglucanase
MVDTLVQMMLKSIRYIVFFQKYNASVVLAGDGFDTVIKANAAVDSVPRCQNKVSSADILAMATRDVALQYLSNDTPVVALSTGWFNNRSRCLHNITISANGKTGWPWWSYVTKTMIINNIVDASKAVWKILGVPHDQ

SEQ ID NO: 161068 - protein, 96 aa, Glycine max
  Coding DNA Sequence Number=SeqID_69383
MYSQIPKILPAASSRFVCGSKKTITLQRDLPKRTQWHITIHNDVPAIAKPWFNFIHENKMIPGDEVVFYYRFDEHAWEVLIRKDIEWDNEEINFDN

SEQ ID NO: 161069 - protein, 360 aa, Glycine max
  Coding DNA Sequence Number=SeqID_69384
  Pfam annotation: Domain name=UBX; Domain location=248-358; Score=3.0; E_value=0.038; Accession=PF00789.11; Description=UBX domain
MPMPMPMPKPKPMPEEQKMEYFMQVTEAPLSVAVQKLEKHGGNLNKALEEFYEKDSLQNPSQNEQHRSQKGLTVAEFLEAYPKKHGGSNLNKALEDFYEKDSLQNPGQNEQHRSQKGLTVAEFLEAYPKKKTLAELLDEGTEGSFSWQKWAASKIPLSHSQKTEAELLDEGTEGSSSWQKWAVPKILPSHSQKKQKAKWGQLPMSSSSKGPVKQKAIDPLTRPPKLPYSRIPDDKRREYLDRLWMDYSNAPNPIHITLHIPGGGCVGRIFVKSDTLEDVYGYLRLLGLGEYASESCRLVSASFPIHLISGLNLHVILLWHDFCQRCNEIPRRCYSIEDGSSTLDELGLGNGGDLYLEEKK

SEQ ID NO: 161070 - protein, 105 aa, Glycine max
  Coding DNA Sequence Number=SeqID_69385
MPKPMRMEEKIKYFMQVTDAPWSVAVRKLQKHGGNLSKALEDLHNHIHITIHMPGGGCLRCIFVKSDNLQDVYGYLWQLGLGEYASESYRLVSASFPIHMISVNG

SEQ ID NO: 161071 - protein, 343 aa, Glycine max
  Coding DNA Sequence Number=SeqID_69386
MLTLGKIKDATEKYPLSVQNVKFGSRLYVNTDIAEIQQFCPSLCVPFYCGGITHDKGGSHSQSSQSNLVEKFLHNARVVSTAEIYNLRQDCYCSTVETIDEIIIDAPWSYDSCPNCTTTFDPSKGGSAFRSCQNSVTDTVSRLAMIVFCTNYLLTRLTVLPNFADTAMDAKVGDDIKVFPTCVDEILSKTWAVRFKFRSQLRQSSVLDVSAEPHHIQTLTATLGLKEESSKGKAIVVELESSPPIFHPTMLITLRGMQLPEIYIAIFGVLPLLVTTIAIAYNHLSVAAHGVHIIDGKSQYLVVDLRHNNLMPQHEVVFYYHPNRGLWLIILSEDIGWDEKEST

SEQ ID NO: 161072 - protein, 114 aa, Glycine max
  Coding DNA Sequence Number=SeqID_69387
MPKPMPMEEKIEYFMQERSNIHITIHMPGGGCVRRIFVKSDNLQVVYGYLRVLGLGEYASESYRLVSASFPIHMISVNGATESRRRCYSIEDRWSTLDELGLGNGGDLYLEKKK

SEQ ID NO: 161073 - protein, 141 aa, Glycine max
  Coding DNA Sequence Number=SeqID_69388
  Gene Ontology: Mol. function=heat shock protein binding
  Homolog annotation: Hit_ID=A7PLM4; Match level="QueryCoverage=48%, HitCoverage=13%, E-value=7e-19, Identity=64%"; Hit description =Chromosome chr7 scaffold_20, whole genome shotgun sequence
MTETDLDITIIDGLGFAGWAVGGLEVEATMLGQVQNQVFIFDSNSKSCNAWPDPFRFSKESPLWHGSKLKIYTSQATVFKEMEVAEWLKWCRLTINNILAEKKMVVGSGYSDVFWRDFYSAIHAAYYGPKIQSMELLPDVV

SEQ ID NO: 161074 - protein, 70 aa, Glycine max
  Coding DNA Sequence Number=SeqID_69389
MAKLRDSSKSLVRTCSNRKERRIFKKEFPGSKKYLRSTKLRQERGLRAIGQFELVYGRVEVEAARVLDLA

SEQ ID NO: 161075 - protein, 434 aa, Glycine max
  Coding DNA Sequence Number=SeqID_69390
  Gene Ontology: Mol. function=ATP-dependent helicase activity; Cellular component=cytoplasm; Biological process=regulation of translation
  Homolog annotation: Hit_ID=A7QIS9; Match level="QueryCoverage=87%, HitCoverage=73%, E-value=0.0, Identity=87%"; Hit description =Chromosome chr2 scaffold_105, whole genome shotgun sequence
  Pfam annotation: Domain name=DEAD; Domain location=77-268; Score =204.0; E_value=3.7e-58; Accession=PF00270.20; Description=DEADDEAH box helicase
  Pfam annotation: Domain name=Helicase_C; Domain location=334-406; Score=83.9; E_value=5.3e-22; Accession=PF00271.22; Description =Helicase conserved C-terminal domain
  Pfam module annotation: Pfam domain module=DEAD::Helicase_C; Domain location=77-268::334-406
MAVIALLSGGLNGGCGYSVLPSVLNSQDWKARLKIPPADTRYKTEDVTATKGNEFEDYFLKRELLMGIYEKGFERPSPIQEESIPIALTGSDILARAKNGTGKTAAFCIPALEKIDQDNNVIQGLMSSSSPLGLSFSHDSHSLVERTAFVILVPTRELALQTSQVCKELAKHLKIQVMVTTGGTSLKDDIMRLYQPVHLLVGTPGRILDLAKKGVCILKDCAMLVMDEADKLLSPEFQPSIEQLIHCLPTTRQILMFSATFPVTVKDFKDRYLRKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNAETYLHRLRIDVLKDALLMTGWSFREVWAPGFSSELDYL

SEQ ID NO: 161076 - protein, 823 aa, Glycine max
  Coding DNA Sequence Number=SeqID_69391
  Gene Ontology: Mol. function=ATP-dependent helicase activity; Cellular component=cytoplasm; Biological process=regulation of translation
  Homolog annotation: Hit_ID=A7QIS9; Match level="QueryCoverage=50%, HitCoverage=84%, E-value=0.0, Identity=75%"; Hit description =Chromosome chr2 scaffold_105, whole genome shotgun sequence
  Pfam annotation: Domain name=DEAD; Domain location=461-677; Score =196.7; E_value=5.6e-56; Accession=PF00270.20; Description=DEADDEAH box helicase
  Pfam annotation: Domain name=Helicase_C; Domain location=707-783; Score=117.9; E_value=3e-32; Accession=PF00271.22; Description =Helicase conserved C-terminal domain
  Pfam annotation: Domain name=Mit_rib_S27; Domain location=12-90; Score=73.9; E_value=5.3e-19; Accession=PF08293.2; Description =Mitochondrial ribosomal subunit S27
  Pfam module annotation: Pfam domain module=DEAD::Helicase_C::Mit_rib _S27; Domain location=461-677::707-783::12-90
MASGSLKNMLSVAMNQGVVEARARIFGHQLNPTGMKTPHKLLRMKLFGEKVAQWYPHDIKKDDPLVMARQEQDRSLVKKSIAPARGNPDDEGERGVRAAKTLTGGGEQGADRAVQCDSTAGEPPGEWGVPREEGRIDNAVLAVHGEGEQDQGGEGGDHEGTGGADGGLRVEHGGQVGVRGECAGGGIGGEGGAGGGRRRAGAGGDRREEYHREDVADSGADGHVEVVCDGGVLVAGFLPQCGFQVGEDFSDENPAHVVAVDGENANLAALVLDYKDAIHGGEPEPEPEPEPEPESSRVPGSAAVPPPATTAAVCAEAFVAAAAAAAAAAVAEKGCQCRRRGREDRAVRTHGFEVSDCVGNDEMVKSVFENFNGLYSCIVEFLGIRTVSAMGVVVAACILQPYVISSKSLSQDWKARLKIPPADTRYRTEDVTATKGNEFEDYFLKRELLMGIYEKGFERPSPIQEESIPIALTGSDILARAKNGTGKTAAFCIPALEKIDQDNNVIQGSAGVAVTSRTFKFEGHINYFMVVDFLNKHDDWLYPCFELNVFNVFFCNAVVILVPTRELALQTSQVCKELGKHLKIQVMVTTGGTSLKDDIMRLYQPVHLLVGTPGRILDLAKKGVCILKDCAMLVMDEADKLLSPEFQPSIEQLIHFLPTTRQILMFSATFPVTVKDFKDRYLRKPYVINLMDELTLKVNRVELLAKKITELGYSCFYIHAKMLQDHRNRVFHDFRNGACRNLVCTDLFTRGIDIQAVNVVINFDFPKNAETYLHRVGRSGRFGHLGLAVNLITYEDRFNLIEQELGTEIKQIPPQIDQAIYCR

SEQ ID NO: 161077 - protein, 367 aa, Glycine max
  Coding DNA Sequence Number=SeqID_69392
  Gene Ontology: Mol. function=guanyl-nucleotide exchange factor activity; Cellular component=plasma membrane; Biological process =embryonic development ending in seed dormancy
  Homolog annotation: Hit_ID=Q2HTJ1; Match level="QueryCoverage=100%, HitCoverage=76%, E-value=1e-168, Identity=79%"; Hit description =Putative uncharacterized protein
  Pfam annotation: Domain name=PRONE; Domain location=1-366; Score =709.6; E_value=2.3e-210; Accession=PF03759.4; Description=PRONE (Plant-specific Rop nucleotide exchang
MMRERFAKLLLGEDMSGGGKGVCTAVTVSNSITNLYATAFGQNLKLEPLKPEKKAMWKREMNCLLSVCDYIVEFAPTAQYLEDGTIVEMMSSRPRSDVYINLPALQKLDTMLIEILDSFKDTEFWYAEQGSISGNSTRSRGGSFRRIVQRKDEKWWLPVPCVHPGGLSDKSRKHLNEKRDCANQIHKAAMAINSSVLAEMDIPETYMSNLPKSGRTSLGDTIYRYMYSTDKFSPDHLLDCLKISSEHEALELADKVESSMFTWRRKACLSHSKTSWNKVKDLMVDTDRSDKNYILAERAETLLFCLKQRYPELSQTSLDTCKIQYNRDVGKAILESYSRVLEGLAFNIVAWIEDVLHADKSMRNQNV

SEQ ID NO: 161078 - protein, 37 aa, Glycine max
  Coding DNA Sequence Number=SeqID_69393
MTRVKNEDEGKQTEHDECSGAKVARGGKGKFSTSVVL

SEQ ID NO: 161079 - protein, 23 aa, Glycine max
  Coding DNA Sequence Number=SeqID_69394
MKIHWIPPNVVNLVALKSSKPKC

SEQ ID NO: 161080 - protein, 99 aa, Glycine max
  Coding DNA Sequence Number=SeqID_69395
MNYVGLSFSSHSWIRRSKGSSSLHIEVNNALVTDAWGAIATYPFAGGRREGSQVDKNGALALTYPPSKRKSDLCSSFKRANQAILFTWKVVLLRRWTLK

SEQ ID NO: 161081 - protein, 157 aa, Glycine max
  Coding DNA Sequence Number=SeqID_69396
MAGIANHPLSKCGWAGGSSGNRRLPCLSHSKESPVFAVLADAYDTFDQRCEKKGARIVCCTPALLVLLVSHLFWHESRPVCPLQGHRMCAEKGKANSEQLFACMVGASVNWFTRWKEGRVRVLSSCEGFSNVPLMGMRGYINYNLILDAILPPKGIG

SEQ ID NO: 161082 - protein, 231 aa, Glycine max
  Coding DNA Sequence Number=SeqID_69397
MGLSQAPSLKKRFYQVKRQAFRKGSNNEPIGGYCRWLKAHMQDLDWLPSLRTTKGVEVEAPEEDEEVQALREELEQAQSVKERFKSAALKIRKENAELRDVNKATTKALERETKRARRDELKVCLRSKKSLSQRLCETETNMLAIISRYQEELNLATAHKHKVAEEYARVYAKKEAIGRVIGSLHQEATIWMDRFALTLNGSQELPRLLARAKEMADTYSTPEEIHGLLSY

SEQ ID NO: 161083 - protein, 146 aa, Glycine max
  Coding DNA Sequence Number=SeqID_69398
MVGYTPSSFTDLVFASERIKVGLKRGKFNHPALRNEKTGANEEDEKEGETHAVIAIPIRPSFPPTQQCHYLANNNPSPSPPPSYPQRPSLHQPQNLSTALPMTNTTFSTNQNTNQKGILQQKACRIHPKFRRPMLTCSYIHSIMQW

SEQ ID NO: 161084 - protein, 121 aa, Glycine max
  Coding DNA Sequence Number=SeqID_69399
MHVRQDLPIMVRTRGLGHALGRIIGKALGREDHHDLDDVPQGQRPTAFVRRQREVAPIAEDDPVLHEDVYAHAAEAIHDVEGFPSGPRDPSVLTNYGDHVAVIVWNGEERLELKLSSHGRK

SEQ ID NO: 161085 - protein, 90 aa, Glycine max
  Coding DNA Sequence Number=SeqID_69400
MGHLSDQGVFTNPKRIKVIPECPTPPSVEGRSLEFQEPLDLRSILFKKEGMIQSYPPRASDRRLQEDWARDAREGPRVLMNLRVDFGPMG

SEQ ID NO: 161086 - protein, 150 aa, Glycine max
  Coding DNA Sequence Number=SeqID_69401
MPSPLEDYTSSPTEGYTPSPLEDYTSSPSEDYTSSPSEDYAPSHQRTTRPHLQRTTRPHLRGLHVLTLEDCMSSPSEDYIGLHVLTFIGLHALTFRGLHVLANRGLHALTFRGLHVLTIRGLHVLTFRGLRALTSEDYTSSPLEDYASSP

SEQ ID NO: 161087 - protein, 126 aa, Glycine max
  Coding DNA Sequence Number=SeqID_69402
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=41%, HitCoverage=50%, E-value=8e-23, Identity=96%"; Hit description=LacZ protein
PGDPLVLERPPPRWSSNSPYSESYYNSLAVVLQRRDWENPGVTQLNPLAAHPPFASWRNSEKARTDRPSQQLRSLNGEWDAPCSGALSAAGVVVTRTVTATLASADVRRCFCRYSPPRQGLNKRDS

SEQ ID NO: 161088 - protein, 401 aa, Glycine max
  Coding DNA Sequence Number=SeqID_69403
MREGSAGRTHSFGGAGHRIRRRMALARRAGRAGCTRLSAWRLRRFPAAGAVLHRHAQPAADEFIVPVQRRPRRTRPAAGHPAAPGPKREYRFRRRAREPPGMTRRRQTGLTAGLHLGPQPGVELVGLRRVDRVREHLLGHIGRRVDGRVGTDRLIHQRGRSRHRVGVVDEVGVGRGNLRLQQIVDERVRGVRVLGILRDRQHVEPLRGAFLRDRIGHVHAVAGFLGAVAGLDDVTRPTDHQAGSTVGQRTHVLRGVEILHVRADRLQQVGRLLQLGRVTAVRVQAQVMQRDRNHVRRRVQDGHAAVLHLADVLRLEHHVPAVGDVGAAAEALLQHVHVVADAGGADHVRHAVLVARVWVAMRFITAGSRLARFGILLLSSGRNTPAWIWRPKKFSVGTTTS

SEQ ID NO: 161089 - protein, 158 aa, Glycine max
  Coding DNA Sequence Number=SeqID_69404
  Homolog annotation: Hit_ID=A5B4G8; Match level="QueryCoverage=60%, HitCoverage=11%, E-value=2e-07, Identity=34%"; Hit description =Putative uncharacterized protein
MTRGNPSDLQPFNPEIDRTFHRFVRHHFIPFDHPEHSITGESVHSVIGDFEHPDFEHYNFEHSDFEHSENMAQPPPRERTLREMAAPDFTYESLCIQYPDEDVPYVLKTGLIHLLPKFHGLAGEDPHKHRKEFHIVCSTMKPPDVQEDHIFLKAFLHS

SEQ ID NO: 161090 - protein, 110 aa, Glycine max
  Coding DNA Sequence Number=SeqID_69405
  Subcellular localization annotation: CTP_CleavageSite=86; ConfidenceScore=5.22e-01
GSRPQDTQWTRRSPIGSWGFPDLIMSLCQFTECLSPPARSSSPTLTKLSSRSTAPPRQAQGETPQQPRDGRQRAIDAPPPPPEPLSSSTKVGALPTTRGRPAGDQVQRER

SEQ ID NO: 161091 - protein, 158 aa, Glycine max
  Coding DNA Sequence Number=SeqID_69406
MEGREKLDLIEERLRAIKGINDYPFTDMAKLCLVPDVVIPPKFKRREALNAFFPRKLGRGGGHLYQYNTDMAPDRTQLQNMSKREHESFKEYPRDEGTWQHKTEVGLRRGKFDYASPASTSNRRFRASRAKKKEGDTRAVTLAPAWPKPQQTPHNPTY

SEQ ID NO: 161092 - protein, 152 aa, Glycine max
  Coding DNA Sequence Number=SeqID_69407
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=82%, HitCoverage=39%, E-value=2e-50, Identity=74%"; Hit description =Photosystem II D2 protein (Photosystem Q(A) protein)
  Pfam annotation: Domain name=Photo_RC; Domain location=22-152; Score=- 89.1; E_value=0.012; Accession=PF00124.10; Description=Photosynthetic reaction centre protein
MIKASRVRPIPENAMRCWEMVEVVELEDRYDYSSWLVRSITLPLRLFRLGGLVHSSYLEGCNFLTAAVSTPANSLAHSLLLLWGPEAQGDFTRWCQLGGLWTFVALHGAFALIGFMLRQFELARSVQLRPYNAIAFSGPIAVFVSVFLMYPL

SEQ ID NO: 161093 - protein, 70 aa, Glycine max
  Coding DNA Sequence Number=SeqID_69408
MARNVLALCPYFRDLYGRELKGILTIIPNVVISLLMVSRGIIPFEERIAAIGTTSNNMLSKRKTLDEGSL

SEQ ID NO: 161094 - protein, 225 aa, Glycine max
  Coding DNA Sequence Number=SeqID_69409
MDLEIEATLRRNRAERRRKLLQEHYKDNHYLYSTNNSGWRQELNPYNQYEEERTPDLESVFSEFMAYHASSKANYNSLQNQEIHFGKSYSLEDYQGELELQLYYQNEAGRSSNLDTLLMQFKDTIGSIEQEVTQVMSRREEEFVEVEAQEGSPVNEHDLEEEEEEKVQQREQCSQVHTQQENNLQVNTFPRQLIVKEERHEDHEVPIILGQPCLSIASCVLGMGK

SEQ ID NO: 161095 - protein, 91 aa, Glycine max
  Coding DNA Sequence Number=SeqID_69410
  Subcellular localization annotation: CTP_CleavageSite=53; ConfidenceScore=5.04e-01
MRRRCKKKARMQVAQIWSGMRLAVDGSLSTTVATCPFAGERRRGSRVDKSGTLAPMYPPSKRKSDLRSSSLCVNQAILFTLKGDHLKVLGL

SEQ ID NO: 161096 - protein, 193 aa, Glycine max
  Coding DNA Sequence Number=SeqID_69411
  Gene Ontology: Mol. function=protein serine/threonine kinase activity; Cellular component=plasma membrane; Biological process =protein amino acid phosphorylation
  Homolog annotation: Hit_ID=P28582; Match level="QueryCoverage=51%, HitCoverage=25%, E-value=7e-36, Identity=62%"; Hit description =Calcium-dependent protein kinase
  Pfam annotation: Domain name=Pkinase; Domain location=55-192; Score= -74.7; E_value=0.00039; Accession=PF00069.16; Description=Protein kinase domain
  Subcellular localization annotation: CTP_CleavageSite=39; ConfidenceScore=5.24e-01
MSSTSPFPYNLYLTTRNGKKTRTRGYPFESVLTLTGNTRVDRVWVWVQVFPDNQNRVSGTGMGRCWGVGVGDWGDNTRSCPTSLPCLLTATLTLEDNQSVHVVMELCAGGELFDRIIAKGHYSERATASICSQDDKGLLKAIDFGLSVFIEEVGSAYYVAPEVLHRSHGKEANIWSAGVILYILLSGVPPFWA

SEQ ID NO: 161097 - protein, 78 aa, Glycine max
  Coding DNA Sequence Number=SeqID_69412
  Subcellular localization annotation: CTP_CleavageSite=45; ConfidenceScore=5.38e-01
MNSLPCAVHVSSTNESGAPRIHCLALFDNSPFSTFIRSAMNLLPSAVHLSSTNESGAPRICCLALFANSLFSTFSGAP

SEQ ID NO: 161098 - protein, 144 aa, Glycine max
  Coding DNA Sequence Number=SeqID_69413
  Subcellular localization annotation: CTP_CleavageSite=35; ConfidenceScore=5.66e-01
MNVGALISGQITSMAQSNSSRLGFPALITALFTIRGARRARARPAEAPSTSAAPPPARTLAAPSTHLLQTFNLVAPPNSIPSIEQFNEWVAWPGTQPPLHREDEGLTAQVADPSTPKDRTTPVLSPNTSPPATLVLRLTDEEDV

SEQ ID NO: 161099 - protein, 113 aa, Glycine max
  Coding DNA Sequence Number=SeqID_69414
LYIEENPPRLVALGKVYEGSITVHNIPLLHDQVKVDVEEVRDADAPIPVPIEEVRLVGQTLNTFFAWPTHLIKHLSEQGAMGPSKPTDRPDHEVDDPLYLMTLTIPQLFLNPL

SEQ ID NO: 161100 - protein, 464 aa, Glycine max
  Coding DNA Sequence Number=SeqID_69415
  Gene Ontology: Mol. function=motor activity; Cellular component=cell projection
  Homolog annotation: Hit_ID=UPI00016621D1; Match level="QueryCoverage =60%, HitCoverage=40%, E-value=2e-19, Identity=34%"; Hit description =UPI00016621D1 related cluster
MRGLHAFAFRGLHVLTFRGLHVLAFRGLHVLAFVGLHALTFRGLHVLAIRGLHVLTFRWLHVLAFRGLHVLTFRGLHALTFRGLHVLTFRGLHVLAFRGLHTLSFRGLHALTFRGLRVLTFRGLHALAFRGLHVLTVRGLHALAFVGLYALTFRGLHVLIVRGRNILFFRGPNIVIFRGLHVLTVRGLHALASEGYIGLHVLAFKGQHVVAFAFVGLDALTFRGLHVFAFRGLHILTFRGLRVVIFKGLHVFTFGGVYILTFSGLHAFTFKGRHVLNFRGLRVLTFSGLHIHALNSFPLSVLFPGPPLDIGGGPTMQVQPKEEAIAQLLCISGQDFTRATAKRRVRIMHTNMITLTQIWMTLLLSNISSSDRNTDLPLRKYQGRAHKTPSGPREVQQGPGVFSSGYGPLGRVHKTPSGPKEVQQGLGASGSDYGPLSVLRSARHPQQGHQAPINRGFIEKYCAP

SEQ ID NO: 161101 - protein, 105 aa, Glycine max
  Coding DNA Sequence Number=SeqID_69416
GSSHEINVNFTSISEATVSLSRDRVLSEYHLLSEAAARLTSKKNLEGNLSCKHALSASSTRPTSHLSLLALSAPGSLSQISLTRAKCENGAKHAFEVKKPFLSLK

SEQ ID NO: 161102 - protein, 156 aa, Glycine max
  Coding DNA Sequence Number=SeqID_69417
MKIMEGGGKSYIGNEQPSSSSKRKVVGPSLNLIAQMVKDNLKINQVVKQVKTQNAKGDKNPQGGRGNEVSKGGKANFKKCNLLLLGLWSEFPITQVYIDQEAVTYVANKCELRETSIPHVDANVDHAIVIMDTNEEVKATQDDISSKIPNPTTHSS

SEQ ID NO: 161103 - protein, 222 aa, Glycine max
  Coding DNA Sequence Number=SeqID_69418
MVALDLKVEQQQLSAKEAGVGPCLEDEGYMVARRGLKHPGICRSMKQVFSEEESDIMWMMTKFYFFRKLPRGTNASFLALIPKKEFPEVNQLFGVGCNFLIVFMVANKVIHEAKSKKKATLVYKADFEKAYKVLTNNSFLYDVQNKDNMVSRYARLMNCTTLKLPLKYLGLLIGGNARKEEFWSEDKSSVAWLRWDLVCCKNKHGEPGMRYVGNFNKALISK

SEQ ID NO: 161104 - protein, 122 aa, Glycine max
  Coding DNA Sequence Number=SeqID_69419
  Homolog annotation: Hit_ID=A5BSR3; Match level="QueryCoverage=59%, HitCoverage=23%, E-value=3e-09, Identity=40%"; Hit description =Putative uncharacterized protein
MDEKREKKLKEVAQSRSTDTIIDPPSPIKRHVKWKLARTKKTGHMSSEVAKEIVDRIDSLEEKASQGSFVIHGRHDVLTVAIGQPKHPGSVRAAGASVTIKQYFGSASRTSCTSSSMAPEDL

SEQ ID NO: 161105 - protein, 153 aa, Glycine max
  Coding DNA Sequence Number=SeqID_69420
  Homolog annotation: Hit_ID=UPI00006A2D9E; Match level="QueryCoverage =84%, HitCoverage=85%, E-value=2e-13, Identity=18%"; Hit description =UPI00006A2D9E related cluster
MRGTVHEPQANLGADQKFSPRQCTSTLALRELHALAFRGLHALSFRGLHVLASRGLHALAFRGLHVLASRGLHALAFRGLHTLAFRGLHALAFRGLHTLSFRGLHALAFRGLHILTFRGLHALAFRGLHALAFRGLHVLTFRGLHILAFRGLH

SEQ ID NO: 161106 - protein, 183 aa, Glycine max
  Coding DNA Sequence Number=SeqID_69421
MRRYLMVIRTFCQPEASEPIDTQRLTSLSAPLSSRDGESNDMHRYLMVIRTFCQLEASEPVDTQRQMSSSAPLSSRDGESNDMRRYLIVIRTFCQLQASEPVDTQRLTSSSAPFSSRDGESDDIQRYLMVIHTFCQPEASEPVNMQRLMSSSTPFSSRDGESDDMRRYPSGYPYKHTSVNPDP

SEQ ID NO: 161107 - protein, 241 aa, Glycine max
  Coding DNA Sequence Number=SeqID_69422
  Gene Ontology: Mol. function=zinc ion binding; Cellular component =intracellular
  Homolog annotation: Hit_ID=A7QS33; Match level="QueryCoverage=98%, HitCoverage=99%, E-value=1e-102, Identity=75%"; Hit description =Chromosome undetermined scaffold_155, whole genome shotgun sequence
  Pfam annotation: Domain name=PLATZ; Domain location=25-135; Score =264.8; E_value=1.8e-76; Accession=PF04640.5; Description=PLATZ transcription factor
MELQLGHQKPAWLEALYAQKFFVGCSHHENAKKNEKNICCLDCCTSICPHCLPSHRCHRLLQVRRYVYHDVVRLEDLQKLIDCSNVQPYTINSAKVVFIKKRPQNRQLKGSANYCTSCDRSLQEPFIHCSLGCKVDFVLKHYKDLSPYLRTCKSLHLGPDFLIPQEMGDDETTRSTIVDFDEPMSSSSGSENMSMACTEIVRKRRSGWNVCATSMSNKVSHEDMVTSISRRKGIPHRSPLC

SEQ ID NO: 161108 - protein, 107 aa, Glycine max
  Coding DNA Sequence Number=SeqID_69423
MDCGGNLDDFVVLVQDHVSTNVSLRNQVEMDSKVKLLNIVQVEEISPHKEELTIVFKSLMQQGYTLVVAIGIISSFMDYDLYVVLVGAYFLKPHFGPPPAQVDNLPL

SEQ ID NO: 161109 - protein, 265 aa, Glycine max
  Coding DNA Sequence Number=SeqID_69424
  Gene Ontology: Mol. function=methyltransferase activity; Cellular component=chloroplast; Biological process=metabolic process
  Homolog annotation: Hit_ID=A7QS31; Match level="QueryCoverage=96%, HitCoverage=85%, E-value=1e-103, Identity=65%"; Hit description =Chromosome undetermined scaffold_155, whole genome shotgun sequence
  Pfam annotation: Domain name=Methyltransf_11; Domain location=133 -232; Score=54.0; E_value=5.1e-13; Accession=PF08241.3; Description =Methyltransferase domain
  Pfam annotation: Domain name=Methyltransf_12; Domain location=133 -230; Score=24.9; E_value=0.0003; Accession=PF08242.3; Description =Methyltransferase domain
  Pfam annotation: Domain name=Ubie_methyltran; Domain location=112 -264; Score=-144.7; E_value=0.053; Accession=PF01209.9; Description =ubiECOQ5 methyltransferase family
  Pfam module annotation: Pfam domain module=Methyltransf _11::Methyltransf_12::Ubie_methyltran; Domain location=133-232::133 -230::112-264
MEDECKNVLELGTQQDHAIEADIFACPVCYEPLIRKGPSGLNLPAIYRSGFMCKRCKKTYSSKDRYLDLTVTAGLRDYTEIQPARTELFSPLVSFLYERGWRQNFRQSGFPGPDEEFKMAQEYFESAEGGLLVDVSCGSGLFSRKFAKSGTYSGVIALDFSENMLRQCYDFIEKDDTLSTNNIALVRADVSRLPFSSGSVDAVHAGAALHCWPSPSNAVSAVSVTPQGYGYLTEEEIKDLCTSCGLTNYSSKIQQAFIMFTAQKP

SEQ ID NO: 161110 - protein, 92 aa, Glycine max
  Coding DNA Sequence Number=SeqID_69425
  Homolog annotation: Hit_ID=A5C3T2; Match level="QueryCoverage=88%, HitCoverage=8%, E-value=6e-27, Identity=70%"; Hit description =Putative uncharacterized protein
MDPASQTVSFSDIQCDVPEHKGDNYKIWKERILLQLGWMDIDCAIRKDESHAITDKSSPDVVALYEQWERSNQLNVMFIKIEISVGICGSIN

SEQ ID NO: 161111 - protein, 59 aa, Glycine max
  Coding DNA Sequence Number=SeqID_69426
  Homolog annotation: Hit_ID=A5BQH1; Match level="QueryCoverage=74%, HitCoverage=10%, E-value=4e-07, Identity=52%"; Hit description =Putative uncharacterized protein
MKDSFKQSWYIDSGSSKHMMGDASKLIHFSPKNNGHVTYGDNNKGFDDAKSIYLMKAHK

SEQ ID NO: 161112 - protein, 116 aa, Glycine max
  Coding DNA Sequence Number=SeqID_69427
  Subcellular localization annotation: CTP_CleavageSite=39; ConfidenceScore=5.42e-01
MMRCCTLIDWPNSLKTVPSGVANCRDLPFSRRATRKLMGASSKGGRRVESPPMFIRGKRQKNQDACGQRTLGVKGSGVVFTYGEGLREFYGSITESLEVVFNKTGEEVAAQLTQAS

SEQ ID NO: 161113 - protein, 190 aa, Glycine max
  Coding DNA Sequence Number=SeqID_69428
MLTSPERAQTTTLVSACQSNLGSPNDEVQITVRRLHMLPDSRSRPEDADISGKGADDHIDADNHKVSSHATRLSGHWIAKGVCGLPYRASPRATDLTGVDNRKVSPHAIGLSGRWIAKGVCGLPYRASPRATGLTGRGPLPVAVLFLFLLARDNSRVSNSTVSDSSFLGDPTVPSSKGKDGKSHPGSSFM

SEQ ID NO: 161114 - protein, 39 aa, Glycine max
  Coding DNA Sequence Number=SeqID_69429
MCFREENPTQGASVMLPRRFHEQFREDFPPFFTRSSVFN

SEQ ID NO: 161115 - protein, 232 aa, Glycine max
  Coding DNA Sequence Number=SeqID_69430
  Gene Ontology: Mol. function=structural constituent of ribosome; Cellular component=ribonucleoprotein complex; Biological process =translation
  Homolog annotation: Hit_ID=A9P8K6; Match level="QueryCoverage=67%, HitCoverage=98%, E-value=3e-71, Identity=83%"; Hit description =Putative uncharacterized protein
  Pfam annotation: Domain name=Ribosomal_S17; Domain location=92-161; Score=140.6; E_value=4.6e-39; Accession=PF00366.11; Description =Ribosomal protein S17
MVLSWPCINSLFIICFLNFGLQTEKAFLKQPKVFLCSKKGGKGKRPGKGGNRFWKSIGLGFKTPRDAIEGTYIDKKCPFTGNVSIRGRILAGTCHSAKMTRTIIVRRNYLHFIKKYQRYEKRHSNIPSHISPCFRVKEGDHVIIGQCRPISKTVRFNVLKVIPAGSSSGAKKAFTGITLNSSVEEDFVISFSITNLPYVVNGKVSVKGSWVGDEVAIVETKGCETEAIIEIV

SEQ ID NO: 161116 - protein, 226 aa, Glycine max
  Coding DNA Sequence Number=SeqID_69431
MWKLLKNSMQTYMSLRTKNQSKLGLRPDPQELAARLCIPRRGFVLNAKGLSWKLLRKDLITLAQTWSVLSYSNLAPTSHTSDLNLDRARLVYGLVMKMDMNIGALISRQISLIAQSNSSRLGFPALITALCKARGNLDDPSITFPGTQKSRARRSEASSPSATPTPPTSALPSAPAAPVLPEPAPGPAPDYAELARCGPTVTSYERGGVFAEGCLARSPAFSFGRG

SEQ ID NO: 161117 - protein, 353 aa, Glycine max
  Coding DNA Sequence Number=SeqID_69432
  Gene Ontology: Mol. function=protein dimerization activity; Cellular component=cellular_component; Biological process=alkaloid metabolic process
  Homolog annotation: Hit_ID=Q06YR2; Match level="QueryCoverage=98%, HitCoverage=97%, E-value=1e-125, Identity=63%"; Hit description=IOMT 4
  Pfam annotation: Domain name=Dimerisation; Domain location=27-75; Score=74.3; E_value=3.9e-19; Accession=PF08100.2; Description =Dimerisation domain
  Pfam annotation: Domain name=Methyltransf_11; Domain location=193 -286; Score=3.0; E_value=0.044; Accession=PF08241.3; Description =Methyltransferase domain
  Pfam annotation: Domain name=Methyltransf_12; Domain location=193 -284; Score=6.7; E_value=0.093; Accession=PF08242.3; Description =Methyltransferase domain
  Pfam annotation: Domain name=Methyltransf_2; Domain location=82-330; Score=333.2; E_value=4.7e-97; Accession=PF00891.9; Description=O -methyltransferase
  Pfam module annotation: Pfam domain module=Dimerisation::Methyltransf_ 11::Methyltransf_12::Methyltransf_2; Domain location=27-75::193 -286::193-284::82-330
MDNQNAIEFFEGQNLLYMQIFGNLRPVCLMWACELGIPDIISNHGKPITLLELVSALQIPPSKVGFVKRFMRFLAHNRIFDIHESQEDHHELAYALTPASKLLVNDSIHCLSPMLQFMTDPFLTNAYHHLGEWMRGDDPTLCETAFGTTLWGLLEKKPSYNSLFNQVMASDSRMVDLVLKNCTSIFEELDSIVDVGGGTGTTARIICETFPKLKCVVLDLPHVVANLTGSNRLSFVGGDMFKSIPQADAVLLKWVLHDWNEENCIKILKRCKDSISSKGNRGKIIIIDAVINEKLDDQDKTQTKLCMDIAMMIAFNGKERTEEEWKQLFIGAGFQHYKIYHTFGFRSLIEVYP

SEQ ID NO: 161118 - protein, 63 aa, Glycine max
  Coding DNA Sequence Number=SeqID_69433
METRFTTPKMPSFRDLEQKWAPKVEALLEFQWWRKKKEKSNVRERERASENVGLSEERERVAF

SEQ ID NO: 161119 - protein, 135 aa, Glycine max
  Coding DNA Sequence Number=SeqID_69434
MATSPTTIHRKNSLAHFFNRGKVCKNQIVLLSDKAGDDRANKIVHNNGVFRLRKKSKVVENQIFNVHHIMESAFFKSLPKIALFHTLSLDFRIFSFWEGMYIEQPMTLFFYTSSIKLLQPSWADHIFRNLKDEGN

SEQ ID NO: 161120 - protein, 172 aa, Glycine max
  Coding DNA Sequence Number=SeqID_69435
  Homolog annotation: Hit_ID=A5C922; Match level="QueryCoverage=57%, HitCoverage=36%, E-value=2e-10, Identity=35%"; Hit description =Putative uncharacterized protein
  Pfam annotation: Domain name=Retrotrans_gag; Domain location=109-172; Score=1.1; E_value=0.042; Accession=PF03732.8; Description =Retrotransposon gag protein
MTRGNPGDLQPFDPEIDRTFHRLVRHSVHPSHSVHFEHSEHSYEGDSEYSDFEHSTTNFYTENMAQPPPRERTLREMAVPDFTYESLCIQYPDGGVPYVLKTGLIHLLPKFHGLAEGVTKDWLYYLAPRSIFSWDDLKRVFLEKFFPASRTTAIRKDISGIRQLSGESLYEY

SEQ ID NO: 161121 - protein, 119 aa, Glycine max
  Coding DNA Sequence Number=SeqID_69436
MPSPRSGERLHGKVHPLQRWLRLTGNLLARLDKIVYRSRSGGLLDVLHDMDSPESAGTTAVHDFVERVGFQRVEAGVKGDVLHREVVLCHVVVAGLVVDVRRRRNMGWLLVVMCEEVHM

SEQ ID NO: 161122 - protein, 175 aa, Glycine max
  Coding DNA Sequence Number=SeqID_69437
  Homolog annotation: Hit_ID=Q2HUN6; Match level="QueryCoverage=31%, HitCoverage=4%, E-value=2e-07, Identity=47%"; Hit description=RNA -directed DNA polymerase (Reverse transcriptase); Ribonuclease H
MSIHSSISNPWMLVEDYNKIVKPSEVRREKFKASRVDLMLDMMDKCELLDMEAMGMRDTPGECPFRFHAAWVTHNQYDLVVHFAWAKGSPSVTGGLKQGITLLHILDEAREALIRPILKEEVCHAVMRMKSFKAPDPNGFKPFFFKCYWDVVGEDLWLMVREVIRIPKLPKYRNL

SEQ ID NO: 161123 - protein, 75 aa, Glycine max
  Coding DNA Sequence Number=SeqID_69438
MAPPKCAHSGPLAKVKAEHHRHINSEGDVGPRLVRSSGMRREWSLEDLAGQQQDKGIRTSSCITLREGETLVLIG

SEQ ID NO: 161124 - protein, 85 aa, Glycine max
  Coding DNA Sequence Number=SeqID_69439
MDKSHPVLLSIIKLADLHVKEAIGDIIVDPKWVVVMVEYQSDYVVVEVFKGMGLENWMEQLLVVEVGWVKVLFSQEFVMLSREKD

SEQ ID NO: 161125 - protein, 144 aa, Glycine max
  Coding DNA Sequence Number=SeqID_69440
MDRLLKLATPLGTFRELGHSVSVCHTLISSGDHPLLGYDPRLTTSRKFLQKVVASGGSNLARLGKLGGKLLPYFPINRGRSEGKKMVSPPGNSRSLEISEKNCFHEENPSRGASVTFPWVISRRFSTVLRRSSFILRRASVFYR

SEQ ID NO: 161126 - protein, 150 aa, Glycine max
  Coding DNA Sequence Number=SeqID_69441
  Homolog annotation: Hit_ID=A5B2J2; Match level="QueryCoverage=84%, HitCoverage=35%, E-value=5e-09, Identity=33%"; Hit description =Putative uncharacterized protein
MTRGNPYDLQPFDPEIDRTFHRLVRHHLEPFEHPEHSVIGDFEHPNFEHYSFEHSNFEHSENMTQPPPRERTLREMVAPDFTYESLCIQYPDEDVPYVLKTGLIHLLPKFHGLAGEDPHKHLTEFHIVCSTMKPPDVQEDHIFLKAFPHS

SEQ ID NO: 161127 - protein, 345 aa, Glycine max
  Coding DNA Sequence Number=SeqID_69442
MAPEELEQLTQQIRDQLEESITEKVTRQLMLSFSQMQSQLQSQIQSQGLALPLEPEVGPSAACVSTKGSCVDRSPTDLDMGDSDKFGLYIEENPSCLVALGRVYEGSTVVHNIPLLHGQVKVGAEEVKDAEALVPVPTDKVILVGQTINTFLAWPTHLVKRLSEQAAVSLAKPPDRPDHEVMWDATVFGVFNEHFPLYIKHEDFSEIAHSGQCLSISVIQLWILHLTETSMRAVNPDVYGFLEPQSIQRFRQSQFELESYMKSWMQSSKRDVYLGAYLNEPDNYLKGIINSALKGLDETPQPKSKVGAKWIVVKYFNDVRPLEAERLKALRIQLAQYYLKVRNQT

SEQ ID NO: 161128 - protein, 154 aa, Glycine max
  Coding DNA Sequence Number=SeqID_69443
MEKHRKLNIIQNDGQSQTKEQSIERFTKANQNNNPILDENAQFEREQHIQEESHVESHTSLGSASESSTKGKKRTKGYTHIRDVWDFPHGEFILVGLDHWGNPMDWGGKTLLNAVGSLVRRHLSQPTLRREGDARLTGASSKEGKCTESPPTFI

SEQ ID NO: 161129 - protein, 81 aa, Glycine max
  Coding DNA Sequence Number=SeqID_69444
MTENVSQFVILIVKECIDRIPESIIHRKLGSKQICPKFGGVIIKVKRGKNLEVLKGAFALSSPFGLSVHPTLSAASACLAQ

SEQ ID NO: 161130 - protein, 34 aa, Glycine max
  Coding DNA Sequence Number=SeqID_69445
QGVPFRINFWFRATFEDASSDGSLLVGLLWRMDL

SEQ ID NO: 161131 - protein, 373 aa, Glycine max
  Coding DNA Sequence Number=SeqID_69446
  Gene Ontology: Mol. function=arsenite transmembrane transporter activity; Cellular component=integral to membrane; Biological process=response to arsenic
  Homolog annotation: Hit_ID=A7KG13; Match level="QueryCoverage=50%, HitCoverage=43%, E-value=2e-69, Identity=73%"; Hit description=ArsB
  Pfam annotation: Domain name=ArsB; Domain location=1-225; Score =112.6; E_value=1.2e-30; Accession=PF02040.6; Description=Arsenical pump membrane protein
  Pfam annotation: Domain name=ArsC; Domain location=237-347; Score =165.9; E_value=1.1e-46; Accession=PF03960.6; Description=ArsC family
  Pfam module annotation: Pfam domain module=ArsB::ArsC; Domain location=1-225::237-347
MVPVNLAAVAATLVMLHLFFRKDIPRRYALTRLPIPQEAIRDRATFRAGWAVLALLLIGFFALEPLGVPVSLVAACGALVLLAVAKRGRAIDTGKVLRGAPWQIVIFSLGMYLVVYGLRNAGLTELLSGVLDALARQGLWAATLGTGFLSAFLSSVMNNMPTVLVGALSIDGSGAEGVIKQAMIYANEEHRHYLGLLFSRGAGDDAADPVRHPGRAGAAAVRLILIGETVMSSIKIYHNPACGTSRNTLALIRNSGVEPEVILYLETPPSRERLIALLAEMGMTPRALLRKNVEPYAELKLDETGWNDEQLIDFMLQQPILINRPIVVTPLGTRLCRPSEAVLDILPDPQRGAFSKEDGEPVIDAQGCRITKG

SEQ ID NO: 161132 - protein, 51 aa, Glycine max
  Coding DNA Sequence Number=SeqID_69447
  Homolog annotation: Hit_ID=A5BVC3; Match level="QueryCoverage=98%, HitCoverage=2%, E-value=1e-10, Identity=56%"; Hit description =Putative uncharacterized protein
MANFKAADNLLRRCVTSEEAKGILWHCHSSPCGGHYGRDKTAAKVLQSGFF

SEQ ID NO: 161133 - protein, 331 aa, Glycine max
  Coding DNA Sequence Number=SeqID_69448
  Gene Ontology: Mol. function=transferase activity; Cellular component= soluble fraction; Biological process=nitrate assimilation
  Homolog annotation: Hit_ID=A4WEC4; Match level="QueryCoverage=74%, HitCoverage=84%, E-value=1e-103, Identity=74%"; Hit description =Glutathione S-transferase, C-terminal domain
  Pfam annotation: Domain name=DUF1330; Domain location=249-329; Score =38.8; E_value=1.9e-08; Accession=PF07045.2; Description=Protein of unknown function (DUF1330)
  Pfam annotation: Domain name=GST_C; Domain location=106-208; Score =33.8; E_value=6.3e-07; Accession=PF00043.16; Description=Glutathione S-transferase, C-terminal domain
  Pfam annotation: Domain name=GST_N; Domain location=1-85; Score=16.0; E_value=0.021; Accession=PF02798.11; Description=Glutathione S -transferase, N-terminal domain
  Pfam module annotation: Pfam domain module=DUF1330::GST_C::GST_N; Domain location=249-329::106-208::1-85
HPLQLYSLGTPNGQKVTILLEELLALGVQEAEYDAWLIRIGDGDQFSSGFVEVNPNSKIPALRDHSITPPLRVFESGNILLYLADKFGHFIPSDVAGRTETLNWLFWLQGSAPYLGGGFGHFYHYAPEKIEYAINRFTLEAKRQLDVLDRQLADHRFLAGDEYTIADIATWPWYGNLVLNNQYGGGEFLDVQSYKNVVRWAKEIADRPAVIRGRKVNRAFGAEPQDQLLERHDASDFDTNTEDKHETLDKDELTTYSQKAGAARGDHHITPLAFYGDLEVLEGRDAEGVVVLQFEDAEAAKAWYFSPAYQEAKAHRLKGANYRVLLVNGVA

SEQ ID NO: 161134 - protein, 117 aa, Glycine max
  Coding DNA Sequence Number=SeqID_69449
PLGDYAYQQGPKNYDNIVIPPFNNKVVELKPALLSLIGSHPFVGMDHEDPYTHLSTFLEWELLMKMLKLSTLELDVSSIGACRPRIFFINGFLCFLEDEWQRKGEGRERGDATSRRR

SEQ ID NO: 161135 - protein, 69 aa, Glycine max
  Coding DNA Sequence Number=SeqID_69450
MGGLGIKDIKALNNALLIKWKWLMFQQSDQLWNRILNSKYRGWRGLEGGPPKPNFSHWWSDLRSINQHG

SEQ ID NO: 161136 - protein, 575 aa, Glycine max
  Coding DNA Sequence Number=SeqID_69451
  Gene Ontology: Mol. function=histidinol-phosphatase activity; Cellular component=cytoplasm; Biological process=histidine biosynthetic process
  Homolog annotation: Hit_ID=A8GIA8; Match level="QueryCoverage=28%, HitCoverage=82%, E-value=7e-75, Identity=83%"; Hit description=D,D -heptose 1,7-bisphosphate phosphatase
  Pfam annotation: Domain name=Hydrolase; Domain location=29-181; Score= 8.0; E_value=0.012; Accession=PF00702.17; Description=haloacid dehalogenase-like hydrolase
  Pfam annotation: Domain name=PNK3P; Domain location=28-173; Score= -55.4; E_value=0.00011; Accession=PF08645.2; Description =Polynucleotide kinase 3 phosphatase
  Pfam module annotation: Pfam domain module=Hydrolase::PNK3P; Domain location=29-181::28-173
MDGKASRRLNQSKSFNLPFSRSFYVANPVPAIFLDRDGTLNVDHGYVHEIDNFQFIDGTIEALQALKKMGYALVLVTNQSGIARGMFTEDQFMQLTEWMDWSLADRDVDLDGIYFCPHLPDATVVEYRQTCDCRKPQPGMLLSAQKHLNIDMAASYMVGDKLEDMLAAKAAGVGTKVLVRSGKPVTAEGEAAADWAAQQGVKRFTPPEKNAEKSTICVGTRRIDISVSGRKKYQVFAELNAGGRPNTCKSNGSTEELALWVASGGRVSNVWETARWRGITTGNATLELRHGPDSYGRQQWGILHNGRKPDAAMPQEAPANSVPAAAVIRRVQALIGITGRKAHAGGVAVKCVEIWRNTGVASGANALSRPPGEYGRKRCFGAFGNSETGAAWLSSARVVKCWVKSRNERNPYPLLPAARPGTQRRLPVINRRKVGMTSSHHGPYGQGYTRATMAHTKRSDLARASGPHKVRRSPDWSLQLDSMKSESLVIVDQNATVNTFPGLVHTARHTMGVTVGEPAVGSPPYLKIPSRERTPDKGEVGGSSPLRPTKSFLMLRYSAARIEDYASRHCALPEK

SEQ ID NO: 161137 - protein, 43 aa, Glycine max
  Coding DNA Sequence Number=SeqID_69452
MVTKGWSFVGQQWWRKKKEKSNVRERERELSENVGLTMPHVSI

SEQ ID NO: 161138 - protein, 65 aa, Glycine max
  Coding DNA Sequence Number=SeqID_69453
MCAVKKVIWTLRLPVTKDKTNIQRVRDDMMQMRKSATGGWTTSDNISSKRKTLDEVLLSSSKWET

SEQ ID NO: 161139 - protein, 269 aa, Glycine max
  Coding DNA Sequence Number=SeqID_69454
  Gene Ontology: Mol. function=oxidoreductase activity; Cellular component=plasma membrane; Biological process=metabolic process
  Homolog annotation: Hit_ID=P0AEK5; Match level="QueryCoverage=97%, HitCoverage=100%, E-value=1e-134, Identity=91%"; Hit description =Enoyl-[acyl-carrier-protein] reductase [NADH]
  Pfam annotation: Domain name=adh_short; Domain location=14-185; Score= -25.2; E_value=0.00056; Accession=PF00106.16; Description=short chain dehydrogenase
MTIRITAMGFLSGKRILITGVASKLSIAYGIAQAMHKQGAELAFTYQNDKLKGRVEEFAKELGSDIVLPCDVAEDESITALFTELAKTWPKFDGFVHSIGFAPGDQLDGDYVNAVTREGFKIAHDISAYSFVAMAKECRAMLNPNAALLTLSYLGAERAIPNYNVMGLAKASLEANVRYMANAMGPEGVRVNAVSAGPIRTLAASGIKDFRKMLAHCEAVTPIRRTVTIEDVGNSAAFLCSDLAGGITGEVVHVDGGFSIAAMNELELK

SEQ ID NO: 161140 - protein, 69 aa, Glycine max
  Coding DNA Sequence Number=SeqID_69455
MEALEEDYGDGNGKNESRQYIEGPPNLSPKNDDLGLIHRWIVVKFEHQVRNPILSILTVGNFDIMSELR

SEQ ID NO: 161141 - protein, 188 aa, Glycine max
  Coding DNA Sequence Number=SeqID_69456
MGEIEEVQERMKADMEAMKEQMATMMEAMMSMYKIMEVNATAVAVTSTVAEVDPNPPSGLNQNKHAFPPYGLPPNYKPLNVAHTPDENVNNSTPILIESQQPQSDHAHVSQPMGETHEVPHHNLAEFEPRLGNTVEGKGSEPLKGGGDYTFADMVELCLVPDIIIPPKFKPSPGTLIQNLPESILGRT

SEQ ID NO: 161142 - protein, 64 aa, Glycine max
  Coding DNA Sequence Number=SeqID_69457
MERIQKSTSSDNSQGWFQGLLVTMHHQKRKTLDEASLLSSESETQHDHRSTSTPYGSHRPGYRA

SEQ ID NO: 161143 - protein, 138 aa, Glycine max
  Coding DNA Sequence Number=SeqID_69458
MTGLNQTSDSELQHSISSVSLYYGTQSDIRVKSYCRLNWLRASTFNFERLDILRDSIRHPSKKILSFELARELQHSISSVSIYYGTQSDIRVKSYCRLNWLRASTFNYERLDILRASIRHPSKKLLSFELAQSFNIQF

SEQ ID NO: 161144 - protein, 128 aa, Glycine max
  Coding DNA Sequence Number=SeqID_69459
MDFIENMAASNIAILRDRAHIPTKNSLLELTSHDVAGCTICGGAHESGCCIPNEEQVTHEVNYMRNQPKNNFNAGVVSLCEEIDRKRLRIFFAIVYPSNVDLALSAQSSRTKPSLLVLSAQTPDWLAE

SEQ ID NO: 161145 - protein, 254 aa, Glycine max
  Coding DNA Sequence Number=SeqID_69460
MGEVEEVQEQIKTDMEAMKEQMATMMEAMMSIKKILEVNAAAIAATSTIVEVDLTPPYGLNQINHPTPYMVGLEGKELGGTGDPHLVRKTSMPSRHMACLPIIHHPMWRTLPMRMSITPLRYSLRANNLNLIMHMSLNPWGRHMKFPATIYPTSSLASDMPLKGKQLVIYPCKTLWRGLNFAPNHNPSMEKWWVTHLQGLRIWSSPVKGSKCESGSGNSQYQLLSLPTIQSSIKAIPKSTTMSVYRTSNDEHHL

SEQ ID NO: 161146 - protein, 67 aa, Glycine max
  Coding DNA Sequence Number=SeqID_69461
DDKGDDKKLKGQSMNEFKIFKIESRTLQDSREKLISRIKNQDSRDQDSRFKRSRFKTQDSREGLIKI

SEQ ID NO: 161147 - protein, 245 aa, Glycine max
  Coding DNA Sequence Number=SeqID_69462
  Homolog annotation: Hit_ID=UPI00006A16D8; Match level="QueryCoverage =99%, HitCoverage=96%, E-value=2e-12, Identity=27%"; Hit description =UPI00006A16D8 related cluster
GLHTLPFRGLHVLAIRGLHALTFKRQHVLTIRGLHALSFRGLRVFAIRGLHTLTLTGLHVLAMRGLHALTFRGLHVLTIKSLHALFFRGLHVLAIRGLHALTIRGLHVLAIRGLHVLACRGLHVLAIRGLHAITFRGLHVHAIRGLHAFALRGLHVLASRRLHAFTFRGLHVLTIRGHHALSYRGLHVLAIGGLQTLTFRGLHVLVSRRLHTLIIRGLHVLAIRGLHILAFRGLHVLALTFIGQH

SEQ ID NO: 161148 - protein, 457 aa, Glycine max
  Coding DNA Sequence Number=SeqID_69463
  Gene Ontology: Mol. function=motor activity; Cellular component=cell projection
  Homolog annotation: Hit_ID=UPI00016621D1; Match level="QueryCoverage =43%, HitCoverage=40%, E-value=1e-14, Identity=31%"; Hit description =UPI00016621D1 related cluster
GLHVLAFRGLHVLAFRGLHVLAFRGLHILTFRGLHILAFRVLHILAFRGLHVLAFRGLHALAFRGIHVVTFRGLHVFTFRGLHILTFRGLHILTFRGLHILAFRGLHVLAFRGLQALAFRGLHVITSEDYTTTCARLHRATRPRLQRATRPRLLRTARLHILAFRGLHVLVFKELHALAFRGLHVLAFRGLHVLTFRGLHICAFRGLKEGQLCEHNQREAIVQPRCILGQDFTRAAAKRRVWIMHTNMTTLTQIWMTLLLSNILPSDHNSNLPLQSVRITPTRHPVDPEESNRALGFPALVTSLYQSYRVPVPPARNRARKTPSGPGEVQQGPRVSSSTYGPLSVLQSARRPQQVHQAPTNQALIKKYCAPRQAQGETPQQAFIKKFWVHLLGLLTENKRGYISCGSVLVEGTSTRLFKENKGGHIPCGSLLVKGFLQRLKRNLKDRKVAWGLDVGT

SEQ ID NO: 161149 - protein, 219 aa, Glycine max
  Coding DNA Sequence Number=SeqID_69464
  Homolog annotation: Hit_ID=A7P5Q2; Match level="QueryCoverage=68%, HitCoverage=33%, E-value=1e-22, Identity=42%"; Hit description =Chromosome chr4 scaffold_6, whole genome shotgun sequence
  Pfam annotation: Domain name=DUF247; Domain location=2-208; Score= -44.4; E_value=4.6e-08; Accession=PF03140.6; Description=Plant protein of unknown function
MMHISVFPELSLDSLCIIRYLYIMDTASSSSSRHITFSHSASQLREADLKFKVSPNENECLLDLTYSNEGVLTMPILNIADDTEIFFRNIVAFEHCHLSDHTNIITQYQKILDFLINTEKDVNILVEKKIIVNSMDDANKVPTMVNNLDSNLIVPRFNSHYDSLCNSLNDFYENPRNKYKAIFIHEYFNTPWKIASTVAAIVLLLLTLIQTICSIISLF

SEQ ID NO: 161150 - protein, 207 aa, Glycine max
  Coding DNA Sequence Number=SeqID_69465
  Homolog annotation: Hit_ID=UPI00016621D1; Match level="QueryCoverage =98%, HitCoverage=39%, E-value=8e-20, Identity=35%"; Hit description =UPI00016621D1 related cluster
GLHALTFRGLHALAIKGLHVLTFVGLHALTFRGLHVLANRGLHALTFRGLHVLANRGLHALTFRGLHVLANRGLHVLTFRGLHALAIRGLHVLTFVGLHALTFRGPHVLTLRGLHALAIRGPHVVTFVGLHALTFRGLHVLTFRGLRALAFVGLHALTFRGLHVLTFRGLRTLAFVGLQALTFRGLHVLTFRGLRALAFVGLHALTF

SEQ ID NO: 161151 - protein, 170 aa, Glycine max
  Coding DNA Sequence Number=SeqID_69466
  Homolog annotation: Hit_ID=Q2HW90; Match level="QueryCoverage=55%, HitCoverage=19%, E-value=2e-08, Identity=29%"; Hit description =Putative uncharacterized protein
  Subcellular localization annotation: CTP_CleavageSite=63; ConfidenceScore=5.36e-01
MGVQIATRPPWAFQDVPPEGGCFWRKQPNSLGRAGKSKPRRFRNVSVDDFAKTFNRSSSFVVRSSLFFGLQPQQAFRKAYGKIWDLAMVEVSTEAIASLAQYYDQPLRCFTFGDFQLSPMVEEFEEILGCPLEGRKPYLFSGFYSSSARISKIVQISAQELDHRKQVENG

SEQ ID NO: 161152 - protein, 63 aa, Glycine max
  Coding DNA Sequence Number=SeqID_69467
MATIGNTMPLKACYTRHFQKPKKGLKLDGSDDNGDVPSMDMRLNLLSPKIIKLKNLRRLVRIS

SEQ ID NO: 161153 - protein, 127 aa, Glycine max
  Coding DNA Sequence Number=SeqID_69468
  Gene Ontology: Mol. function=metalloendopeptidase activity; Cellular component=proteinaceous extracellular matrix; Biological process =metabolic process
  Homolog annotation: Hit_ID=A7Q2J9; Match level="QueryCoverage=49%, HitCoverage=18%, E-value=1e-11, Identity=56%"; Hit description =Chromosome chr1 scaffold_46, whole genome shotgun sequence
MHTQGHLNHYRPRWNWNPWRCTRWGHLLGLGQSLMEEAIMFLKISSQKKVVLAREDIEGIQFLYGSNPNFNGSTATLALERDASDGANDEGRGGGMGCGGSGSNRGEGWEFEAKELTEGRLASPSRN

SEQ ID NO: 161154 - protein, 109 aa, Glycine max
  Coding DNA Sequence Number=SeqID_69469
  Homolog annotation: Hit_ID=A5BC01; Match level="QueryCoverage=97%, HitCoverage=20%, E-value=2e-09, Identity=41%"; Hit description =Putative uncharacterized protein
  Pfam annotation: Domain name=RVT_2; Domain location=1-71; Score= -179.3; E_value=0.0071; Accession=PF07727.5; Description=Reverse transcriptase (RNA-dependent DNA pol
MELEQIDVKNIILHGRLEEDILMQQPVGNLDAEINRDQAQEKFFLCQKEYVQKVLNRFGMTSAKQEVIDIGLVYHGDTSCALTGYLDFDYVANLDGRRSITGYTFTIPC

SEQ ID NO: 161155 - protein, 181 aa, Glycine max
  Coding DNA Sequence Number=SeqID_69470
  Gene Ontology: Mol. function=oxidoreductase activity; Biological process=metabolic process
  Homolog annotation: Hit_ID=A5C6J1; Match level="QueryCoverage=74%, HitCoverage=45%, E-value=7e-29, Identity=53%"; Hit description =Putative uncharacterized protein
MAPQHKDITGVKCTYLSDGGRRRHSGLTGTRRQIGAPAVGPRTQTTPIATSGKSSQHRNIPNGWPKEVLSDVENLREEKIDGVLNKFLEDSKEFIRNQRLLALSCAYMYYIKSCWAYTRILAKKYPSFCINVVPPGHVKTDINDNSGMLAPNEGAEAIVRLALLLDGGPSGLLELKKNHFD

SEQ ID NO: 161156 - protein, 117 aa, Glycine max
  Coding DNA Sequence Number=SeqID_69471
MTRTKGKEPLEGLGGPMPKAKIKKAKEALQQACGCLFDASSIGACRPRIFFINGFLCFLEDEWQRNEERKRERTRHFKEKMSLEEAHHHRRPWIRAWRKKEMNEGRGREEHEILCSK

SEQ ID NO: 161157 - protein, 234 aa, Glycine max
  Coding DNA Sequence Number=SeqID_69472
  Gene Ontology: Mol. function=oxidoreductase activity
  Homolog annotation: Hit_ID=A2Q3A0; Match level="QueryCoverage=67%, HitCoverage=46%, E-value=2e-28, Identity=50%"; Hit description =Putative uncharacterized protein
MENFPMINLENINGEERKTMLDQIQHACQNWGFFESNSLQPSFILISLKQLGKLDYFLGIEVNSMVDGSILVTKRCLREDLCSKKRSGSYSGETIKRQRGFDLERPAERDIFYGGYDEHEAGLTSYTTLERCKICSNNDDGYDEDMEVDLTLSIGGGSQVNNNKNSSSKKPYLLPLGCSDSPNRKTKDLNSSVSFQSYRVGDFSDPTTPMSSSSVTFDQERKGPHWLSQGLKLK

SEQ ID NO: 161158 - protein, 74 aa, Glycine max
  Coding DNA Sequence Number=SeqID_69473
MALLLPSWAFLLFASVLHVLLLLFLLQLVLLPYYSAVEAKLHDDDKGDDIKLNDQSKNNSSKSKSNQEQFKSSR

SEQ ID NO: 161159 - protein, 533 aa, Glycine max
  Coding DNA Sequence Number=SeqID_69474
  Homolog annotation: Hit_ID=A5B3H3; Match level="QueryCoverage=29%, HitCoverage=29%, E-value=6e-10, Identity=27%"; Hit description =Putative uncharacterized protein
MPYFGVIQEIWELDYDPSDSRWSVVLQGKISGIPNNIDASTLDVNEMPMFSPQMPSTNVENDEEDVHANFNDHDEGAMATPPSSPPPLDAPSATTKKKTRQTTRLRRLTSKSLDQPRPTVNFNPIIGKGSSHHKEKFHSYLGVVAQEKIPIVHPSWKVVPESLKNLIWDDILGKFDIPEGSTAKKKVMSTVATRRRQFKSSLTTKYEYVDKDGEDNHDPSTKYGLNLKTWEQFAKSQQTPNWQDSFVPNGRQDILNIALGRPDHPGRVRVAGHGVTISHYFGEASCGSNTSSATITPDQLVEMIGNLKEEWKREVEEENIRIDAPDPGVLATRVSTKGNCVEAAGNVVAEEPSAIDVITMGLYIAGEECTQLVALGKVFDSAATIHNVPHTDDVMRVPFPTSEILYVKEAINTFIGWPTHLVKPISNDSDHNMPKPVGRVDGCNAGAVEDPLGNLMKILYDVYQKPVELPLDGTKFGLPNEKARFFITHADVAEIIAGLWMTAVEVEVMVQCMVSLSLSLYTMLRIDCECMNT

SEQ ID NO: 161160 - protein, 64 aa, Glycine max
  Coding DNA Sequence Number=SeqID_69475
  Gene Ontology: Mol. function=7-dehydrocholesterol reductase activity; Cellular component=membrane; Biological process=cholesterol biosynthetic process
  Homolog annotation: Hit_ID=A2X4M3; Match level="QueryCoverage=78%, HitCoverage=27%, E-value=3e-19, Identity=86%"; Hit description =Putative uncharacterized protein
MEKAQSREKLHQKVWGLSRPSRYVPEILAAFFWTVPALFNHFLPYFYVIFLTIILFDRAKQDDD

SEQ ID NO: 161161 - protein, 313 aa, Glycine max
  Coding DNA Sequence Number=SeqID_69476
ECATLDVVYQPWSIQYLETEISYELNSRLTPLLPRFHGLAGEDRDQHLNEFHVVCFTIQVGQPFRPQQQQYNPYSNTYNPGWRDHTNLSSRPSLEELIKQMNINNIQFQQEVMATSKDLHTQIGQLVTTVNQLQRQGSDNIPTLPIINPKGNVSVDVLKSDKELPKPANVGAKIDDSAKIDSASVDICTDLLSDVFDFYEFDLGSFDCNCDNSDESANPPSLELKLLPEHLKYAKFLKDFSKKRKLKGNKQVKRFHDHKPYIVQKVLLFNSRLKLIFGKLRSRWDAFVITNVEKEFVANLSLVLPPILYYDVP

SEQ ID NO: 161162 - protein, 604 aa, Glycine max
  Coding DNA Sequence Number=SeqID_69477
  Gene Ontology: Mol. function=peptide-N4-(N-acetyl-beta-glucosaminyl)as paragine amidase activity
  Homolog annotation: Hit_ID=P81898; Match level="QueryCoverage=91%, HitCoverage=96%, E-value=0.0, Identity=64%"; Hit description=Peptide- N4-(N-acetyl-beta-glucosaminyl)asparagine amidase A (EC 3.5.1.52) (PNGase A) ...
  Homolog annotation: Hit description=(Glycopeptide N-glycosidase) (N -glycanase) [Contains: Peptide-N4-(N-acetyl-beta-glucosaminyl)asparagi ne amidase A light chain (PNGase A small chain) (PNGase A subunit B); Peptide-N4- ...
  Homolog annotation: Hit description=(N-acetyl-beta-glucosaminyl)aspara gine amidase A heavy chain (PNGase A large chain) (PNGase A subunit A)]
MDNYFFLFIIIIFLSLSLFHHPISASNLHKIKQLTPNFPLEPLSSNDPPPLPTEYFEVTTPIEHPKTKPCSHHILHHDFAYTYGHPPVLATYTPPSHCHFNTFSKIVLQWNATCKGRQFDRIFGVWLGGVELLRSCTAEPRATGIVWSVEKDITRYRSLLLSPQNQSFAVFLGNVVDKTYTGVYHVDVTMHFYPLGYFDGESSKIGVLAFGGGVHADLVLPISRNLPLNDGLWFAIQNSSDEGLKEFRVPQNTYRAVLEVYVSFHERDEFWYANPPDEYLIANNLSDVPGGGSFREVVVSLDGNVVGAVWPFSVIYTGGVNPLLWRPITGIGSFDLPSYDIEVTPLLGTLLDGKSHSVGFSVTNAVNVWFVDANLHLWLDGKSSRTEGGVVDLVAKPLVESLVSDFEGLNGKFWTSARRSVLSAGWVRSSYGNVTTSFVQDFVFNNSMVMGKNGNQQIVNQVILFNDSVHANLPSPFVKDTYRKFSLYLDTDEMDQGDDTYLSVSNVTLGFDVDKSTSSAFGFSKSSLKNVQDAQGTMVIKGNLVVRGLGETQQDYSYTSDGYCYSRKVGSSNYTILYDKVRHSCNKRSHSHLGPHSIKKLFIL

SEQ ID NO: 161163 - protein, 341 aa, Glycine max
  Coding DNA Sequence Number=SeqID_69478
  Gene Ontology: Mol. function=protein heterodimerization activity; Cellular component=soluble fraction; Biological process=regulation of GTPase activity
  Homolog annotation: Hit_ID=A7P201; Match level="QueryCoverage=99%, HitCoverage=74%, E-value=1e-150, Identity=75%"; Hit description =Chromosome chr19 scaffold_4, whole genome shotgun sequence
MIYPERVLKLRVRGTKKDLIQDTSSEEFCLIMSGVIARFDGSDIQNMLQKWFEEANSRFSDQNPKSQDSEDFENTDVKIPYQLWNIGKYGTCADAAITGIMPPPLMEQQQSNQRYYCAVAVGEDAVISAYRLSENKGRSLVGAILSKVVPATFSTISSFSKLIWRNERSSPKKSDLKPRPFARASPLTCLKDHPRKGEKLTLSPSGTLAAITDSLGRILLLDTQALVVVRLWKGYRDASCLFMEMLVNKDIASSSSSYSEPLKSDYCLCLAIHAPRKGIIEIWQMRTGQRLRTISCTKGSKMLQPSYRFGASVSSPYVPLEVFLLNGDSGQISVLNRTLDS

SEQ ID NO: 161164 - protein, 128 aa, Glycine max
  Coding DNA Sequence Number=SeqID_69479
  Gene Ontology: Mol. function=binding; Cellular component=spindle microtubule; Biological process=cell division
  Homolog annotation: Hit_ID=A7P213; Match level="QueryCoverage=67%, HitCoverage=15%, E-value=5e-34, Identity=75%"; Hit description =Chromosome chr19 scaffold_4, whole genome shotgun sequence
  Pfam annotation: Domain name=TPR_1; Domain location=34-67; Score =26.9; E_value=7.4e-05; Accession=PF00515.19; Description =Tetratricopeptide repeat
  Pfam annotation: Domain name=TPR_1; Domain location=68-101; Score =4.2; E_value=1.7; Accession=PF00515.19; Description=Tetratricopeptide repeat
  Pfam annotation: Domain name=TPR_2; Domain location=34-67; Score =24.7; E_value=0.00034; Accession=PF07719.8; Description =Tetratricopeptide repeat
  Pfam annotation: Domain name=TPR_2; Domain location=68-101; Score =6.0; E_value=5.4; Accession=PF07719.8; Description=Tetratricopeptide repeat
  Pfam module annotation: Pfam domain module=TPR_1::TPR_1::TPR_2::TPR _2; Domain location=34-67::68-101::34-67::68-101
MVVKKNVVERYKKAVWWFEKTLALVPTTLSEIWESTVVNLAHAYRKLKMYREAISYYEKALALSTRSVSTYAGLAYTYHLQDDFTTAIAYYHKVSNCACIHDNEPMMHSIQLLRPMNIVQEISAILRC

SEQ ID NO: 161165 - protein, 63 aa, Glycine max
  Coding DNA Sequence Number=SeqID_69480
MQKLQEKAQTPLQNLISSLNMWLSEGLKRCTYDPSLSANAQLILLSNSSSRSAKGCCAQRMAR

SEQ ID NO: 161166 - protein, 108 aa, Glycine max
  Coding DNA Sequence Number=SeqID_69481
MALKKLSAKRARKATAEEGSSVAPQAEIEFDRHHFRSEEHQCCLEVIKDWSFLKERRPMAKYDPEIVMEFYANAWPTKEGVMDKCSWRGNVVNALKKEAKSQVLMKRP

SEQ ID NO: 161167 - protein, 436 aa, Glycine max
  Coding DNA Sequence Number=SeqID_69482
IVLHDDTPDTYIWDPATDDVYNTRSTYKCGALEEDILHVLRDCNEAKITWRMLDLENNQDFFTLNFFFPQAFCLLVLADSFGGLGMTRFFKTRSNLSAWGRLLGGVPCFWYYTGWVQSEDVVDLLGRTNQDKDDGLEVVGMMPEEEDEEEAKEIEEIDALWKCCKTFRRLCEVSFSGSVKRMSWEWLWRLLFEVAMITRKWKEWRRCVQRHVIGNAKEAFRGGEFSVRETVQTEWTQISWSPPHPFKVKLKIDSSSLDNPGPLGFGGIIRDYFGAWLAGFFRIIDCESDSLVGLNHIAEDNEGIMCANALARRGSSSMDSLITWDSCPPFVSSRLLADALGGFFRHRHCGVTASLKTELFALMHGLRKAWNLGYRNIMCHTDSKLALDLLETSSRLTGMSPFIIRCGKLTPAPTASPNMVPCITMQCSLGIIVLHL

SEQ ID NO: 161168 - protein, 275 aa, Glycine max
  Coding DNA Sequence Number=SeqID_69483
VDVACQAPNPGQVLSGCFCQVVYDGHVFGVSDVTFVCYCKHVWHTRNTLAYVSPTEWAYTGVVVRARVGECRGAFDSESFSSERVRALGRIGGGISHPCGRAWPSAAIEELVPITVILPFFVSGGVRIGSGGGDVRASPRVDDVLKYKSSLTSAASFATLQRQVKLAKLVKPEDSCKLVVQGCRSDDFPFLRAVPGIILLLNVFQCALLKHLNMSPSQFHPNSGAIVRAFEILCSFFNIQPSLSDRFFKVLATGVVVDAMPLMFNRDKEPRFPFY

SEQ ID NO: 161169 - protein, 34 aa, Glycine max
  Coding DNA Sequence Number=SeqID_69484
ASLAFLALALVIGPPSPSSGSLGLALGHVLINWT

SEQ ID NO: 161170 - protein, 123 aa, Glycine max
  Coding DNA Sequence Number=SeqID_69485
MKWFYMISHLLMSQTQPGDPPRHPSMVHNDTFIEPGPPQQPVAATAMPEPLAHALADVDMSRHAVEACQWIAERLEHLINMRIVTAGTEAYTVTEQCQGITRGVTEQQNIYVRLRRRRHTPDA

SEQ ID NO: 161171 - protein, 101 aa, Glycine max
  Coding DNA Sequence Number=SeqID_69486
  Subcellular localization annotation: CTP_CleavageSite=45; ConfidenceScore=5.42e-01
MTTFKDVAELSKTVLTPTTSLKVGFQRRCLHQQHLRMPTFKDVAKVMTKSSKVNQRMSSRKIESRKNEFKIESRTLQDSRIKLPRIKIKIQDSRFKNQEKT

SEQ ID NO: 161172 - protein, 71 aa, Glycine max
  Coding DNA Sequence Number=SeqID_69487
  Subcellular localization annotation: CTP_CleavageSite=57; ConfidenceScore=5.07e-01
MDKARKNCWNPNDHMVTFSRTRKAWAQGSEAPSSSAPPAPAPPPAPPAPAPATPVPSGSSAQTAEILVLML

SEQ ID NO: 161173 - protein, 338 aa, Glycine max
  Coding DNA Sequence Number=SeqID_69488
  Homolog annotation: Hit_ID=A2Q6B4; Match level="QueryCoverage=51%, HitCoverage=86%, E-value=4e-12, Identity=26%"; Hit description =Ribosomal protein L33; Nucleic acid-binding, OB-fold
MARIPNKIKNINGSKETLKLAVRITDLWFVGTSNKSEQAEMVIVDSDGDEIHVVCKQDQLKSWKLDLKENFTVVRQSNLDGLPYKKFKFAEFSNVIVGHFQPGLLVDIIGVVDEVIFRHVSSRSTRIVFKLNDLSDQLLSSTLWDAYCLQFLQYLVEIENDGPISVLLTNARIKEGFYPPSISNSLKASKLLINQPVVEIQEFNQRYFSHTPRGQGSSQLSGSTQLSSKDVFLSKAEAKSLSEINNISEVQPKFKNVVVLKYSNDLSLINTMMDMLPDADQSLSVTVDHDPLLGLCRNVPFCGRAKARLTGALSKGGKMRGVATNVYLWKMSEKPKET

SEQ ID NO: 161174 - protein, 84 aa, Glycine max
  Coding DNA Sequence Number=SeqID_69489
  Pfam annotation: Domain name=RNA_pol_Rpb1_R; Domain location=13-26; Score=7.3; E_value=14; Accession=PF05001.4; Description=RNA polymerase Rpb1 C-terminal repeat
  Pfam annotation: Domain name=RNA_pol_Rpb1_R; Domain location=60-73; Score=9.3; E_value=5.9; Accession=PF05001.4; Description=RNA polymerase Rpb1 C-terminal repeat
  Pfam module annotation: Pfam domain module=RNA_pol_Rpb1_R::RNA_pol _Rpb1_R; Domain location=13-26::60-73
  Subcellular localization annotation: CTP_CleavageSite=45; ConfidenceScore=5.50e-01
MVSEQVLPGGVVSVASPRFMVTSPDSRGRVASPTSGGDLSGAWPNFNMVSEKVMHGGVDSAASPRFVVTSPGSRGRVANPTSGD

SEQ ID NO: 161175 - protein, 45 aa, Glycine max
  Coding DNA Sequence Number=SeqID_69490
MSFRERIAPIVKPEASISRKNEMVKSGRWNDPWDNIEKTTSKCWR

SEQ ID NO: 161176 - protein, 439 aa, Glycine max
  Coding DNA Sequence Number=SeqID_69491
PFDMTAVAARTADFGSAAIEHRPYVHASSQHSTSKEGRGRGLVFGPASDIPHRCTRTSGKATAGAEDAARHGELRRALELLGRTDQSRQFGAIPESGVVHREELSAGAQDTRGGLEQTGGRAGVDTRPEVERRIQQHGVHTRVRKLGRGVVVHDRDPLRDSVRRRGRPRRRRGRRRPVGRDDHGVGVGERVGHRERTGSATEIEHPGGCEAVGAVGRGSVLRPAGPCAWPIGGVRRAMCPVEAENLQQHSGADVEPCTRERAAVGDQGQPVVLRRHRVRRIDRHVARLRGDDQPGLPLGALGLHLREAAAQHVVLSEGHVLHAAARDEHRVRGRPPCDGVRDLLELRERLRQLQQHEPGTGQQLGVEVVRAEAGEPELLGVTSECPAAGHEVLMHTDAGPSRRDERQRDRPVLVSDHDGLRPRCSERECTLDQQHVGRV

SEQ ID NO: 161177 - protein, 200 aa, Glycine max
  Coding DNA Sequence Number=SeqID_69492
MTTLTWMTLLFSNILPGNHNANLPLQMYRDRTHKSPSGPEEVQQGPGISSSGYGPLSVLQGARSPSEGSCPQDAQWTRRSPTGPWGFQLWFRASIVLQGARFPPADGSGSCPQDTQWTQRSPTGSWSCQALITGLCQFYGVPITSSKGIRPPTNQAFIKKYCVPRQAQGETPQQPGDGRQRATDASPSPLEFTSAHPQKG

SEQ ID NO: 161178 - protein, 212 aa, Glycine max
  Coding DNA Sequence Number=SeqID_69493
MALRKLASKRSKKDKAAEGTSSAPEYDSHRFRSAVHQQRFEAIKGWSFLRERRVQLRDDEYTDFQEEIGRRRWTSLVTPMAKFDPEIVLEFYANAWPTEEGVRDMRSWVRGQWIPFDADAISQLLGYPLVLEEGQECEYGQRGNRSDGFDEEAIAQILCIPGQDFARTAAGRRVRIMRTNMTTLTQIWMTLLLSNILATNHNSELPLPKCQL

SEQ ID NO: 161179 - protein, 99 aa, Glycine max
  Coding DNA Sequence Number=SeqID_69494
MAKFDPDIVLEFYANAWPTKEGVRDLWSSVRGQWIPFDADALNQFLGYPLVLEEGQECEYGMPPTRHPLDPDKSNRALGFPALITGLCQSFGVPVTASK

SEQ ID NO: 161180 - protein, 79 aa, Glycine max
  Coding DNA Sequence Number=SeqID_69495
MRVHCYQASRRPSMITDSPPLYMFPWTRWSLQLSQPTLRREGDARLTGASSKKGKCAESPPTFIRGKRRKNRKGVVYEL

SEQ ID NO: 161181 - protein, 100 aa, Glycine max
  Coding DNA Sequence Number=SeqID_69496
MESGDMRGYCMVTRTFCQPGANEFVDAQRLTSSSAHFAIQGQRVRWQAEIPYGHLHLSSTKGNEFDSIRMMFLPSSSGDIQAQQRVRLFSAGRGRSSAMA

SEQ ID NO: 161182 - protein, 63 aa, Glycine max
  Coding DNA Sequence Number=SeqID_69497
MAARRQAPVKTFLLVWWVWVGICDAILPPQGYWIEDSKKIGARDAREGPKVLMSLGVDFGPMG

SEQ ID NO: 161183 - protein, 113 aa, Glycine max
  Coding DNA Sequence Number=SeqID_69498
MALEWWSQRKHHVPVRVPGQATLSRNCSMEGMDPGGATTSAEVDVGVGVADVEGRSAGLALALALLAPRIETVRSSGFQQFFLIDKSRNPSLEELDWAIEVIWQEMSAPMFMS

SEQ ID NO: 161184 - protein, 99 aa, Glycine max
  Coding DNA Sequence Number=SeqID_69499
LLVIFVVTIAVAAAILEEEHMACLDQQHSGKEGQAVVVVEDLSISDLDDSSNLDCIYCLKGHNYSVVVGFTAEEIAAKKDRDLYGDLQKNIDHRLLQQV

SEQ ID NO: 161185 - protein, 143 aa, Glycine max
  Coding DNA Sequence Number=SeqID_69500
MNKALRLNAPLPYPQLVTLFLRHFEIPLDSESYIPIKRSFLIGATAIVSFGYHKERDGSWVKKGTQPADEEGNLPDEDNSTLLRRLMDKFDGLQTFVGDKFDAMELQVDMRFDAMESRITRVEEDVSFIRTCFDPPPPSPSSS

SEQ ID NO: 161186 - protein, 178 aa, Glycine max
  Coding DNA Sequence Number=SeqID_69501
MMVVRQWLQRSFSLRRQGRRPLEKDPVRPHKRIWNLTDTGFGVRNTNTALKQSRVGLSSRRDEVQLREGEYVEFQEEIAKRQWTQLAGSMAKYDPKIVMEFYDNAWPIEEGVRDKRSGCGANGSPLMKMPLISFWGIHWSWKRGNIASSVRRGAKPQDLIRRPWASCYAFQDRTLHRV

SEQ ID NO: 161187 - protein, 76 aa, Glycine max
  Coding DNA Sequence Number=SeqID_69502
MCLSGKEKEALGSTKIEENHSKCINLTQGKDYGELGFWLKACRTAGHDTCQDLANGSGIKGMSPHYSHDTHATNDD

SEQ ID NO: 161188 - protein, 77 aa, Glycine max
  Coding DNA Sequence Number=SeqID_69503
VTGCTICGEAHETGQCNPTDNNTQEIHFMGNQQRQGTTQEGFLGFLQGPYNQQGQWRTHPGNQFNKDQGGSSNRPIQ

SEQ ID NO: 161189 - protein, 137 aa, Glycine max
  Coding DNA Sequence Number=SeqID_69504
EREESKEFSDCVVLNSLTWEKGDTKEFRRLLLCSFGKGRRETQKEFRRLVLGKFFLAKGEEMKRMNSTSFQGLENQKTLESFWHKEEEEVQRDSKIEKDCIVKVVQDTRNAKQSLAFIDSSCLVKTTIRRVMTFRKT

SEQ ID NO: 161190 - protein, 191 aa, Glycine max
  Coding DNA Sequence Number=SeqID_69505
  Gene Ontology: Mol. function=RNA-directed DNA polymerase activity; Biological process=regulation of transcription, DNA-dependent
  Homolog annotation: Hit_ID=A5ANM4; Match level="QueryCoverage=100%, HitCoverage=11%, E-value=1e-39, Identity=40%"; Hit description =Putative uncharacterized protein
MEPKYWDKNPFKATAKVFPQGFHYRPIALNKTRKFYEFILVDTNSVSIKHFKDSKDPSLNTHSTIQILKVMQPRHYGTNLNQPKRFSAPFDPAGYTYWDYIDAWTNVFWHQNNKFKHSWLIYFKNNTVYNFPNWFLQWWTYFGPIPQLFPEEVQQGFQQFNRLFNNQESRIPADLMYFSSFALSWIFSWPY

SEQ ID NO: 161191 - protein, 268 aa, Glycine max
  Coding DNA Sequence Number=SeqID_69506
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
WNSYVPINVSFSPKVGPGLPGINRDTRIYLFCEVIFRHRYLFGAKVRRWLLFLSAVPPVQLLTGWCVTAKAPPDISAGKCSGRVPFAIQAAQLLGRAIGAGLFAITPAGERGMCCKAIKLGNARVFPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 161192 - protein, 101 aa, Glycine max
  Coding DNA Sequence Number=SeqID_69507
MTTLTQIWMTLLLSNILPSDHNSDLPLPKCQLVYAILTRMSIHVAQLIADAIYIFVGMAPTRHPLDADKSNGALGFPALITGLCQSFGVPVAPSKLITGQS

SEQ ID NO: 161193 - protein, 371 aa, Glycine max
  Coding DNA Sequence Number=SeqID_69508
  Gene Ontology: Mol. function=enzyme regulator activity; Cellular component=membrane; Biological process=capsule polysaccharide biosynthetic process
  Homolog annotation: Hit_ID=Q46631; Match level="QueryCoverage=94%, HitCoverage=48%, E-value=1e-150, Identity=76%"; Hit description =Putative tyrosine-protein kinase amsA
  Pfam annotation: Domain name=CbiA; Domain location=177-371; Score= -4.0; E_value=8.8e-05; Accession=PF01656.14; Description=Cobyrinic acid a,c-diamide synthase
AQLNKKISAMPQTQQEILRLTRDVQAGQEIYMQLLNRQQELGISKASTVGDVRIIDRAETSTSPVAPKKLLIIVAGLIVGLMLSVGLVLLKALFHHGIDNPEQLEELGMNVYASVPLSEWQRKKDTEALARRGSKEKSDPHNTLLALGNPTDLSIEAIRSLRTSLHFAMMEAKNNILMITGASPGIGKTFICANLATLVSKAGQRVLFIDGDMRRGYTHELLGADNKTGLSNVLSGKSEFSPAMIQKGVYGFDFLPRGQVPPNPSELLMHRRMQELLDWASKNYDLVLIDTPPILAVTDASIIGKLAGTSLMVARFETNTTKELDVSYKRFAQNGIEIKGVILNAVVRKASNAYGYGYDYYNYEYGKESKS

SEQ ID NO: 161194 - protein, 153 aa, Glycine max
  Coding DNA Sequence Number=SeqID_69509
  Subcellular localization annotation: CTP_CleavageSite=60; ConfidenceScore=5.56e-01
PQQQHRTEGPARQSLQRSPRWRKTAARRGRQRAASIAPRRRPAAARSGPQPAQSVSSRPRAQHQPAEDGLHHIKDGEFDIAQSRADHQQIGQRRAEHAAGQQQRYLSRGGGGTPRRSFNAGEYQSGEMRAADDNQFPDRTASVKMPARKAAGR

SEQ ID NO: 161195 - protein, 167 aa, Glycine max
  Coding DNA Sequence Number=SeqID_69510
  Gene Ontology: Biological process=transposition, DNA-mediated
  Homolog annotation: Hit_ID=Q1J7G7; Match level="QueryCoverage=19%, HitCoverage=47%, E-value=9e-11, Identity=96%"; Hit description =Transposase
MVKVGTSYVPINVSFSPKVGPGLPGINRDTRIYLFCEVLQWLLFLSAVHPVQLLTGWCVTAKAPPDISAGKCSGHAARRVPFAIQAAQLLGRAIGAGLFAITPAGERGMCCKAIKLGNARAVLKLVDHPGSRISIHYAWLQTRGWRMPERKRNSWGSEKGVENGELH

SEQ ID NO: 161196 - protein, 328 aa, Glycine max
  Coding DNA Sequence Number=SeqID_69511
MLVATPRVFLSWNTHPASLASPSRRRKFPGCHISQFSSRIILDPKYLDIDFFNDETFDCYQVFQNSGLIDFMSLKLPYYLELVKVFYSNLKIRDGIISSEVHSISMIIDQSLFFSLTKLPSQGAPFEGIIVDDWKFDYSSHDARRMVCNDQAEMTGRLLAGSLTFDNCIMHYIIVRILLPRSSNLAQASEEDLILMWAFLTGHQIDWAHLVRYQMHKELRANAPLPYPQIGAGAITSFGYHKDRNGQWLKKDALPPQDECTPPPPPPQRDDSALMTEVLSELRALRTYVGERFDSLDNRFARMDIRLTQLEEDVGYIRQSFDLPSPPS

SEQ ID NO: 161197 - protein, 64 aa, Glycine max
  Coding DNA Sequence Number=SeqID_69512
  Homolog annotation: Hit_ID=A0PAV3; Match level="QueryCoverage=43%, HitCoverage=14%, E-value=7e-07, Identity=89%"; Hit description =Restriction endonuclease
MPQNVFTMPLGYINGVGTSYVPINVSFSPKVGPGLPGINRDTRIYLFCEVIFRHRYLFGAKCVG

SEQ ID NO: 161198 - protein, 145 aa, Glycine max
  Coding DNA Sequence Number=SeqID_69513
  Gene Ontology: Cellular component=membrane
  Homolog annotation: Hit_ID=A7NUD9; Match level="QueryCoverage=40%, HitCoverage=8%, E-value=1e-13, Identity=65%"; Hit description =Chromosome chr18 scaffold_1, whole genome shotgun sequence
  Subcellular localization annotation: CTP_CleavageSite=60; ConfidenceScore=5.03e-01
MTVGGNKLATINSLDYLTSVWKFVNQVVAGYLPSVILVLFLCAVPPVIILFSSVEGSISRSERKKSACFKVLLLSLQLTFYHLVGQVWQLKLCKFSLYYAIFSRDSYSGLRKMHGMEAYLFRTIQKFQESYCLDSLGSLVLFWHP

SEQ ID NO: 161199 - protein, 202 aa, Glycine max
  Coding DNA Sequence Number=SeqID_69514
MAMISPGKIYQPPFPKWSNPDATYAGWLTFQEDWPNMKTNPLANHGGGAVNAVESGRPRRSKPLKDVTTPRSGGPVATDDRSRPAGSRRLGEDIAPQTPRYPSEVKPVPFPHRNSHAVPWRYAPPSERKEEATDISTLSAKVTNITGLSGVTRSGRVFAPPDLSTQPANVKGKAKIAEEQNDKTIPTLNEDIPVKGLPEKRD

SEQ ID NO: 161200 - protein, 193 aa, Glycine max
  Coding DNA Sequence Number=SeqID_69515
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=41%, HitCoverage=67%, E-value=5e-24, Identity=71%"; Hit description=LacZ protein
MSKYPNISGHFEEFLNVKVVSVQVFSMTKYPNIGESFEEFLNDKVVSVRIFDMAKYLNTDGSFEEFLNVKVINVPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 161201 - protein, 417 aa, Glycine max
  Coding DNA Sequence Number=SeqID_69516
  Gene Ontology: Mol. function=iron ion transmembrane transporter activity; Cellular component=integral to membrane; Biological process=iron ion transport
  Homolog annotation: Hit_ID=A7QFH5; Match level="QueryCoverage=91%, HitCoverage=73%, E-value=1e-120, Identity=57%"; Hit description =Chromosome chr8 scaffold_88, whole genome shotgun sequence
  Pfam annotation: Domain name=FPN1; Domain location=266-373; Score =3.2; E_value=0.039; Accession=PF06963.3; Description=Ferroportin1 (FPN1)
  Pfam annotation: Domain name=MFS_1; Domain location=26-385; Score= -16.8; E_value=0.068; Accession=PF07690.7; Description=Major Facilitator Superfamily
  Pfam module annotation: Pfam domain module=FPN1::MFS_1; Domain location=266-373::26-385
MEENVKLKESPFTGQQEKPSALITYLYIGHFLARWGARMWEFSVGLYMINIWPESLLYAAIYGAVESAAIAVFGPIIGRWVDKLSCVRVLKLWLVTQNLSFVIAGGSVVALLVHSSLKSTNFSIFILLVIIINVCGGIGVLSTLAGTILIEREWLLVISEDQPPELLTKMNSVTRRIDLSCKLLVPVISGFIISFVSLKASAITLALWTTVSVWVEYWLFTSVYHGIPALVQSSQRRMERLIQCDMEMNNQTMEKDSLLPVTDDGSELADRKARKKISERILEIPYIAAWRVYLQQEVVLPGLALALLFFTVLRVIDEIPITCLSFGTLMTATLEWEGIPEYIIGISRGISAVIGIAATVVYPVLQSRISTIRTGLWSIWSQFPPSMCGCNMDPKWLSIIIYFDGKCSHIAAWIVDV

SEQ ID NO: 161202 - protein, 143 aa, Glycine max
  Coding DNA Sequence Number=SeqID_69517
  Gene Ontology: Mol. function=carbon-nitrogen ligase activity, with glutamine as amido-N-donor; Cellular component=chloroplast
  Homolog annotation: Hit_ID=Q9MUK5; Match level="QueryCoverage=84%, HitCoverage=20%, E-value=8e-37, Identity=65%"; Hit description=Toc64
MMHRVAEALDANVKRWSRQVLKHINLGDYLSPRVPSLKGCFGQKPNGEVKASSLKLLAHIMQFLQRHEFRLKHDDWMNTAKPDLHPGVSAQLHEKFEVSDAEIENSKSVRSEMCAAVNSLLKDIRVIQICHHEQVRATTRFKE

SEQ ID NO: 161203 - protein, 339 aa, Glycine max
  Coding DNA Sequence Number=SeqID_69518
MRRGVDNHQGMTKGRLTSYFSHFPDNFKEMDFWPILKQYGKNVLAIKSMTRSFELVSRLRVIFHKNYFGIIDKKWLGLVGGGFVILEVMKDWVLRTLEILMKLCLGNGDGVYVRREWIFGKMVVGDGRNISFWKDVWVGKDTLKAKFSRLFLLSEQQEAKVIDMGFWEEGEWSWNFRRYGKVSGVQSRGTYGIVDTTLFRFGPMGCQPDLMSTRSSIRLATPNEAHIIFESSDPCIHGIETLTHKSSEVVELCEYFSQKKVESSLYGGGDGENNVDDRGDERDGGTSAGVSANFDRWLWKRIEKDEDWALFEAIWLTKLERYADLKIGEGFAPSHERGE

SEQ ID NO: 161204 - protein, 70 aa, Glycine max
  Coding DNA Sequence Number=SeqID_69519
KLKSKWLEPFVIKEVRPHGVVELVDPTVDTLEKGRIINGQRLTIYNGGQYQLAKPRFRLSENEQSRWDNG

SEQ ID NO: 161205 - protein, 220 aa, Glycine max
  Coding DNA Sequence Number=SeqID_69520
  Gene Ontology: Mol. function=transition metal ion binding; Cellular component=chloroplast; Biological process=cellular iron ion homeostasis
  Homolog annotation: Hit_ID=Q94IC4; Match level="QueryCoverage=72%, HitCoverage=57%, E-value=1e-69, Identity=85%"; Hit description =Ferritin-2, chloroplast precursor
  Pfam annotation: Domain name=Ferritin; Domain location=4-143; Score =122.7; E_value=1.1e-33; Accession=PF00210.15; Description=Ferritin -like domain
MCTHALFAYFDRDNIALKGLAKVFDFVWCFVENRFFKESSEEEREHAEQLIKYQNIRGGRVVLHPITSPPSEFEHSEKGDALYAMELALSLEKLTNEKLLHVHSVAERNNDPQLADFIESEFLYEQVKSIKKIAEYVAQLRLVGKGHGVWHFDQKLLHDEDHENVLKGCVGTIVYGKSKKLLVELRTMSLSLRRFMTLPNIVQTDYQPRSFQDKTIQITI

SEQ ID NO: 161206 - protein, 629 aa, Glycine max
  Coding DNA Sequence Number=SeqID_69521
  Gene Ontology: Mol. function=helicase activity; Biological process =viral genome replication
  Homolog annotation: Hit_ID=Q2A9E0; Match level="QueryCoverage=36%, HitCoverage=20%, E-value=9e-44, Identity=37%"; Hit description =Putative uncharacterized protein
MWHINKHDGKQAIEMVFMDQTIGATLWQDLFPEFEAKLHCGSTYVIQNIKVVENHSEYKVSRIPFLVYLVKITSIKEAKCPEIPPNVNVITRFANIIAEVAPRDTLVDVVGVVVEVIEHICHLSDGEMIMTIWEEYALQLNDAIEKNHFDRKLLVVMLTLAKIKDPKVMIDTPWSYDSCPYCTTTFDPLKYGSTCCLCQNQVTDGSKSGDEIKVFLPCVDELLGKTWVAMFKYHVRMRQSSMLDVTEDEDLIQTMTSTIGLLDEPSIGKGKVVAAETSSQDYHPTPSLSQPTDYDPGLSAFVTPAKRMSISKPVMNSKYSFDNITPTDDDVDSRNDSNDHHTTYDYENTGATYNDIGDPVWKCKHYNAMMWYDERINKDKQSKNPRASSYWKPLTYDTENEVKNRLAQNSNKNILDEDIIIGIKNMLDKHNLYAQKQSDGRLYNLPNTAEVAALIIGDKHTGEDDYRPNILHKDNPNSHVAKRKKVTMREYFCFRMQSRDNEAQTILHSKRLFQQWIVDGYTTIESQKLNYVTEHQQELRVDKYMNLNACNNEPETHGNEKGKRIILPSSFVGSRRYMEQLYFDGMAIFGHIGFPDLFLTLTCNPAWLEIQQKVRKYNLRPDDFPDVVS

SEQ ID NO: 161207 - protein, 522 aa, Glycine max
  Coding DNA Sequence Number=SeqID_69522
  Gene Ontology: Mol. function=helicase activity; Cellular component =chromatin; Biological process=viral genome replication
  Homolog annotation: Hit_ID=A2Q378; Match level="QueryCoverage=99%, HitCoverage=33%, E-value=1e-127, Identity=44%"; Hit description =Putative uncharacterized protein
  Pfam annotation: Domain name=DUF889; Domain location=308-522; Score =239.5; E_value=7.3e-69; Accession=PF05970.5; Description=Eukaryotic protein of unknown function (DUF889)
MMLSSAKGSQSYKDIRTVKKVVYGTFREACFAKGFLGNDQEFIGALREAITRGSAHFLRKLFVKLLFINTMDRSQFVWEQTWQLMADDIVFNHRIQGIQLFVKETKHLCLSEIENLLQGNRKSLRDFPSMPYLIGYAANTHGNKLIFNEMAYDKELLHAEFNNYYHSLTDEQDAIFDKTIRVVASQSSGVYFLYGYGGTGKTFIWKTLSSDIRSNGGIVVTVASSGIASLLLPGGRTTHSKFSIPVPTTHNSTCNILQGSDLAELLKMTKLIICDETPMCHMFSFEELDKSLKDIMHNDRPFGGKVIVFCGDFRQILPVVPRGCWSDIVHASINASYILDHCQILKLTKNMCLQTNVANTNSDDLKQFFDWLLDIGDGKLGELNDGYGEISILDEFLIKDFNDPIQAIVETTYPNLLQDYSNGDFLQKRVVLVSSKDVVDSINDYVMSLIPSEEKEYCSVDSVDKSDELLNPALGFLTPEFLNLLKTSRIPNHKLKIKVGTPIILLRNLDHANGLCNGTRLL

SEQ ID NO: 161208 - protein, 50 aa, Glycine max
  Coding DNA Sequence Number=SeqID_69523
MGEVGDIVEILGLDGKGFLLATSAVITMGAEFLLFVRLKDSNIGDWVTLI

SEQ ID NO: 161209 - protein, 76 aa, Glycine max
  Coding DNA Sequence Number=SeqID_69524
MVIASHHCGVEERLSAMVLGGCCSGVWVDSGIGWRRKLRGRVKGICVHSGLFGGAGSKKGDAGSNSLLDNRLFWVQ

SEQ ID NO: 161210 - protein, 95 aa, Glycine max
  Coding DNA Sequence Number=SeqID_69525
MSLSLRRFVTLPKIVQADYQPRRPQDKTAQITENYICRGFKHWTFGTFTIPIVSFISSFVNNAIDSYKGVELWNKDRDESVGGAQGGALAFGVRN

SEQ ID NO: 161211 - protein, 164 aa, Glycine max
  Coding DNA Sequence Number=SeqID_69526
  Homolog annotation: Hit_ID=A5AV98; Match level="QueryCoverage=40%, HitCoverage=9%, E-value=1e-09, Identity=53%"; Hit description =Putative uncharacterized protein
MRVYSQDVEIKEVRVCCSKNNKEEQHNNELMIHNEPIVEELQEVALRMSQRERRPTISNDYVVYLHEIEIDLSINDNDSVLFSQTNCQRIVRELVVSGSSRLNVNLMETLNVTSLDLLLRDLLRMMILRDVFIFLTKGFLQDYHDISSPLRLGATSDECENCVS

SEQ ID NO: 161212 - protein, 130 aa, Glycine max
  Coding DNA Sequence Number=SeqID_69527
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7NV71; Match level="QueryCoverage=36%, HitCoverage=6%, E-value=2e-14, Identity=65%"; Hit description =Chromosome chr18 scaffold_1, whole genome shotgun sequence
MENVQPARREGRYTWSNGNEYVGEWKNDTISSNSVLVWKSGNHYEGCWENSVPKGRGWDWEVKNLDDGDGEAWRFRIIVETVMRNDGHGEAVIIPIFLLHGSHRKELIETSKIAMLDSLCGTKIANNASH

SEQ ID NO: 161213 - protein, 41 aa, Glycine max
  Coding DNA Sequence Number=SeqID_69528
MAAKRCEWRMKQPRTKSGTEFEKVVIVTEVTMKNTNRLDSA

SEQ ID NO: 161214 - protein, 56 aa, Glycine max
  Coding DNA Sequence Number=SeqID_69529
MDVGAAIDVGGKLEPPVATAASMHTAIPPGGTCSEKPTTTACERYKISNVGLSFQL

SEQ ID NO: 161215 - protein, 144 aa, Glycine max
  Coding DNA Sequence Number=SeqID_69530
  Gene Ontology: Mol. function=transcription regulator activity; Cellular component=nucleus; Biological process=regulation of transcription
  Homolog annotation: Hit_ID=A7QFK2; Match level="QueryCoverage=98%, HitCoverage=94%, E-value=6e-45, Identity=67%"; Hit description =Chromosome chr8 scaffold_88, whole genome shotgun sequence
MDSRRRGKNASMQRKLQQLRSVNKASIIVDATRYIEELKQKVDGLNSELGTAESSISQDELPMVTVETLERGFLINVFSERNCPGMLGAILDAFEELGLDVLDARVSCEDTFQLEAVGGESQENESIDAQVVKQAVLQAIQNMD

SEQ ID NO: 161216 - protein, 91 aa, Glycine max
  Coding DNA Sequence Number=SeqID_69531
MWDWVETRLERLMARRWRLLGGVGIGVKRKRVGMFIWVREKKGLVDEGKEPYFFIIALELFEVVKLNLESSHLVDDGIEVEVFHGSKLMKT

SEQ ID NO: 161217 - protein, 168 aa, Glycine max
  Coding DNA Sequence Number=SeqID_69532
MLKRDEISQLARSKTLLHSLFSFSSHPKSAENYSVDTHIAPHSFQYCRKPLVGTHITSYRRKVEENPTLLLELWVEENPRLLLEQSWVLKAQSFVRCQLTSFTWFSKLFSFNLTSELDSRLSSKQKDLRIEDRITVASRKNSTTKLIIGGSALYRCEDEATLAPISID

SEQ ID NO: 161218 - protein, 187 aa, Glycine max
  Coding DNA Sequence Number=SeqID_69533
  Subcellular localization annotation: CTP_CleavageSite=22; ConfidenceScore=5.11e-01
MLEEPWMNIGSTDFLNKSSTAKANRFVDRGASTYCGSISTTTHFEKQSKEFQRPPTAFGGLNYKGNVYVLGTLSKRFRCSKSAPSTSIAPVEDQIEEMRETINKLNVEFLAKTNKERTLKEKMLQLIENHDHQSQEMRQQMQEQNEQICQQNEQVQPPSPSTIIADGIEHHVDDAQVDRPHVMLKDH

SEQ ID NO: 161219 - protein, 283 aa, Glycine max
  Coding DNA Sequence Number=SeqID_69534
  Subcellular localization annotation: CTP_CleavageSite=80; ConfidenceScore=5.38e-01
MAKRTSTEANENPKATSKALKNAYLTVLCSISLSPNRVVFKLPSTKNPRKSMNYTINVQSRKLSPSTPMDQEVYPSTTTRESAMSPQVYENPKRCCAASDSNENACNGAAEEVAIRIIEAGKQESDSSPSSLRGRGGELGGEEAVVGRSEILSYRWRMAEERVSLVSLDDGARDSSSSSSSSTYQRVLNKSEEANGGSTGESRDHPILTDTEKTEKHTKLCVEHNTSLQRFMKLCWIRAAAVVVVMRPYLITGGPVDLGTSPLMKGLPCTSYDLRDWNNNIIT

SEQ ID NO: 161220 - protein, 137 aa, Glycine max
  Coding DNA Sequence Number=SeqID_69535
MASCKNMDNSCNILKIEFNLQRPQQWLTLELIKFEGATCKEGLGNQNTLGGASRAKSEIQVPRFRGKELRRKMKLGSVANKEDGDGDGEGASGDEEVAVGKTGGATIVVVSHDDLDEHARDWAAEPDEGGPNVGNPQ

SEQ ID NO: 161221 - protein, 20 aa, Glycine max
  Coding DNA Sequence Number=SeqID_69536
VCQTRKDPSWEDVRIKAQAI

SEQ ID NO: 161222 - protein, 201 aa, Glycine max
  Coding DNA Sequence Number=SeqID_69537
  Gene Ontology: Mol. function=unfolded protein binding; Cellular component=cytoplasm; Biological process=cellular protein metabolic process
  Homolog annotation: Hit_ID=Q9SF16; Match level="QueryCoverage=46%, HitCoverage=16%, E-value=3e-42, Identity=93%"; Hit description =Putative T-complex protein 1, ETA subunit
HVDPATEKVDSGYEKKLRTYLEIVARDKVDVTYETWKEVPAAQKDSIWKDIQAEFDIPEASNGRTKKKVLQTVNERWRQFKYDLTRKWTLAADKDSVDDTVKNTALPQLVSNINACTAVADVVRTTLDPRGMDKLIHDDKGTVTISNDGATIMKLLDIVHPAAKILADIAKSQDSEVGDGTTNVVLLAAEFLREAKPFIED

SEQ ID NO: 161223 - protein, 207 aa, Glycine max
  Coding DNA Sequence Number=SeqID_69538
  Gene Ontology: Mol. function=transketolase activity; Cellular component=chloroplast; Biological process=metabolic process
  Homolog annotation: Hit_ID=Q42676; Match level="QueryCoverage=98%, HitCoverage=43%, E-value=5e-83, Identity=71%"; Hit description =Transketolase, chloroplast
  Pfam annotation: Domain name=Transket_pyr; Domain location=1-93; Score=-49.5; E_value=0.008; Accession=PF02779.15; Description =Transketolase, pyrimidine binding dom
  Pfam annotation: Domain name=Transketolase_C; Domain location=85-199; Score=0.2; E_value=0.0021; Accession=PF02780.11; Description =Transketolase, C-terminal domain
  Pfam module annotation: Pfam domain module=Transket_pyr::Transketolase _C; Domain location=1-93::85-199
MPFVFTDYMRAAIRISAPCEARVIYVMTHDSIVLREDGPTHKPIDHLASFRAMPNTLMLHPADGNETVGSYKVVVVNRKRPSIVALYNSSSNKPNVILIGTGSELEIVVVAAEDLRKEGKAVTIVSFVSWELFDKQSDEYNESVLPTSVTTRVSIEVGSTFGWHNIVGSKGNAVGIDRFGESAPAGKIYKEFGITKEAVIVAAKELS

SEQ ID NO: 161224 - protein, 82 aa, Glycine max
  Coding DNA Sequence Number=SeqID_69539
MKEVKREKHASYSSLNSCKSLSEELRDYYEGRHRKHITSQCLTKKTMIMRSQDIYSSQDEATTSPSSSESEEAKWEESSEEI

SEQ ID NO: 161225 - protein, 106 aa, Glycine max
  Coding DNA Sequence Number=SeqID_69540
MVATERLKLFFVPLRERTRAWDDESQNLTEGELTYLHVIDMSLLSGAIYKKRGEQLRSIFTMEHNRNLQRSNMLLIAKLTFVPMLYVFLICYHCTEHNKGKGAASM

SEQ ID NO: 161226 - protein, 172 aa, Glycine max
  Coding DNA Sequence Number=SeqID_69541
  Homolog annotation: Hit_ID=A7PP90; Match level="QueryCoverage=47%, HitCoverage=22%, E-value=2e-19, Identity=64%"; Hit description =Chromosome chr8 scaffold_23, whole genome shotgun sequence
  Subcellular localization annotation: CTP_CleavageSite=85; ConfidenceScore=5.07e-01
MTFFWAVSFSPQECQGSDFQRWLFHHSASTWWTSSLIHQSHPPKNVLTTTTTTTTTPYPTRWGRLHGSTSAIMFYQIYKHSRSSREALKSVEETVIRLEKLLQELHVSSSSFGKEHLKAACSDLEKIQKLWKEAKFLEASFRAKADSLQEVQLLTLTNLLDQFFGTIFYKKI

SEQ ID NO: 161227 - protein, 292 aa, Glycine max
  Coding DNA Sequence Number=SeqID_69542
  Homolog annotation: Hit_ID=A5BSR3; Match level="QueryCoverage=40%, HitCoverage=39%, E-value=4e-08, Identity=31%"; Hit description =Putative uncharacterized protein
  Pfam annotation: Domain name=Transposase_23; Domain location=153-223; Score=-3.9; E_value=0.0032; Accession=PF03017.5; Description =TNP1ENSPM transposase
MKWKLACTKKTGDMTSEAAKEIADKIDALEEQGSQGSFVTHGRHDILTATIGRPKHPGRVRVVEAGITIKQYFGSTSRTSSVAPEYLQQLTQQIKDQLEDSITEKVTRRLMLSLSQMQSQGLALPPEPDVGPSAARVSTKESCVDPSGNDPDTSDSYKCGLYIEEYPSRLVAVGRVYEGSTTIHNISLLHDQVKVGVEEIRDADAPIPVPTKEVKVMGQALNTFLAWLTHLVNRLSEQGAVGPAKPADRPNDEVDDPLYLMTLTIPQLFLKPLQVMWDATLFGLFNENFPCT

SEQ ID NO: 161228 - protein, 191 aa, Glycine max
  Coding DNA Sequence Number=SeqID_69543
  Gene Ontology: Mol. function=cation transmembrane transporter activity; Cellular component=nucleus; Biological process =multicellular organismal development
  Homolog annotation: Hit_ID=A7PM43; Match level="QueryCoverage=53%, HitCoverage=60%, E-value=4e-37, Identity=75%"; Hit description =Chromosome chr14 scaffold_21, whole genome shotgun sequence
  Pfam annotation: Domain name=DUF260; Domain location=10-108; Score =149.1; E_value=1.2e-41; Accession=PF03195.5; Description=Protein of unknown function DUF260
MASSSYSNSPCDACKFLRKCMMDCIFSPYFPPKEPQKFANMHKIFGACNVSKLQNEVQPYQREDAVNSLAYEAEAWIEDPVYGCVGAISVLLKVQILHQHRERTFVQILGRPWIFSLSLLGLAPLAKRVNFLTEQIVYYTGPTVGGLLNATYGNAKISKCKLIAFDVGVAMPFAAITAQICLSRGISFHSH

SEQ ID NO: 161229 - protein, 356 aa, Glycine max
  Coding DNA Sequence Number=SeqID_69544
  Homolog annotation: Hit_ID=Q5XM22; Match level="QueryCoverage=13%, HitCoverage=27%, E-value=6e-11, Identity=65%"; Hit description =Resistance-like protein HAAS-2
  Pfam annotation: Domain name=DUF1723; Domain location=30-79; Score =38.7; E_value=2e-08; Accession=PF08330.1; Description=Protein of unknown function (DUF1723)
MAKFKRSDPEIEGLVAASGLSPLIACSLDTGNRGLMSAFVECWHKETNSFHLLVREVTFTLDDVASLLHLLVVGAFHSFELLHVDDAVDMLVELLEVSAVEVRAETIQCDGSYVRLLWLRDVYQTKIKACDWIVAVRAYLLHLLRCTLFANKSATHVHVCWIYEHFSFVGSVVPVEDYDERRPRACRWTSGKALLVSTYHKRLDRLTPDVTISPHPAASSLSVEEIDDRWMQLSEYIAPIGQLRVVPGHCSPDYMDWFYMISHSFMSSAQLGDPPRVSPVQQYDTFVKPDVYQQLMAAAAPNEANVDVHHVQHAVDGFVAIADKLERLLNLRILTEGTQAYTVAEECLGIIRSYIS

SEQ ID NO: 161230 - protein, 606 aa, Glycine max
  Coding DNA Sequence Number=SeqID_69545
  Gene Ontology: Mol. function=protein binding
  Homolog annotation: Hit_ID=A7QFK9; Match level="QueryCoverage=87%, HitCoverage=86%, E-value=1e-120, Identity=50%"; Hit description =Chromosome chr8 scaffold_88, whole genome shotgun sequence
  Pfam annotation: Domain name=DUF827; Domain location=70-444; Score =318.6; E_value=1.2e-92; Accession=PF05701.2; Description=Plant protein of unknown function (DUF827)
MEASLNSRHIVLLPLTHKPDLRGLWWAPANQGFENQGKDFGVSKCFFMEEVPDTAANRSEPGLRAEIDTSAPFESVREAVTRFGGVGYWKPILNGLSNKHFAATEPHHTEELDPEKLEEQATVLEKELILKERETLDVLKELESTKRLVENLKSKLQKEESEANLNFQTSVCENILSVKEDEKEDKENGMSNVVQDSKEGCTPYTSSSPGLILMELKQAKFNLNRTTSDIADVRASVESLNKKLEKERLSLEKTRKRLTQNSSKICSLEEELNQTKLKLLVAKDADLDNPSDITRELQRLSSEAEHFKKMGEAAKSEVMKAISEIEQTKAMIKTAEIRLVAARKMKEAARAAEAAALAEIKALSHHENSPGDCVEKHDGVTLSFEEYTALTCKVREAEEQSKKRVVDAMLLVDEANVSKMDILKKVEEATEEVKISKKALDDALERVEAANQGKLAVEEALRKWRSEGHKRRSSIHNSIKFKNAYPSHHWKESRLIDVNGLNLVNDEVKPVLKPTLSIGQILSRKLMMPEEYEASGMIRERSSAKRKVSLGQMLGKQNGDSSFDRQAEKENGQKPFSAKRKKFGFGRFSLLLTKQQKKKKPTLNLR

SEQ ID NO: 161231 - protein, 587 aa, Glycine max
  Coding DNA Sequence Number=SeqID_69546
  Gene Ontology: Mol. function=ubiquitin-protein ligase activity; Cellular component=ubiquitin ligase complex; Biological process =protein ubiquitination
  Homolog annotation: Hit_ID=A7QFL9; Match level="QueryCoverage=93%, HitCoverage=81%, E-value=1e-130, Identity=49%"; Hit description =Chromosome chr8 scaffold_88, whole genome shotgun sequence
  Pfam annotation: Domain name=U-box; Domain location=272-346; Score =90.2; E_value=6.5e-24; Accession=PF04564.6; Description=U-box domain
MAISPETFPTRKRRPENMASFMSPKINDLNVLCSLLQLTDQICSLNLTTTLLNRVSSSTIRKTQLLGVVFEELVRVSNLNSNSSVLFLCLEEMYIVLHNIKILIEDFSNGSKFNLLMQIETVADNFHRLTGELSTLLDVLPLQELDLNDDVRELALLVRKQGSEAKAFIGAEQISLRNDVVFVLDRIKNEIVPDQAHLASIFEKLEIRDASSCRAEIESLEEEIHNRSEEQPKTDLVALIGLVRFAKCVLYGASTPSQKTVTMRRNQSLELTIPADYRCPISLELMRDPVVVATGQTYDRASIKLWMDSGHNTCPKTGQTLSHTELIPNRVLRNMIAAWCREQRIPFKVETVTGKHNSGVTNKAALEATRMMVSFLVNKLKGNGHGKEDNDNVNVPLSVEDANGVVYELRVLAKTDSGSRACIAEAGAIPLLVRFLNAEENPKPAANKTKIMETDGALNGVAEVLISGATWEAKANAAATVFSLSGVAAHRRRLGRDTCRERVGGVGEDWARGGKVREAGSMNWADRETVARLVEGGCGRDGGEVMARRGEGYLGAHGSWECQGAAEGGDVVEDYAAVGGRDRWWRE

SEQ ID NO: 161232 - protein, 442 aa, Glycine max
  Coding DNA Sequence Number=SeqID_69547
  Homolog annotation: Hit_ID=Q5XM22; Match level="QueryCoverage=24%, HitCoverage=79%, E-value=7e-19, Identity=40%"; Hit description =Resistance-like protein HAAS-2
  Pfam annotation: Domain name=DUF1723; Domain location=104-151; Score =27.3; E_value=5.5e-05; Accession=PF08330.1; Description=Protein of unknown function (DUF1723)
MDANNSIKREKWTQTTEERFWHEGRRPIASARRQREVAAVAEDAPHVDDAAEEVFQHPEEAGVDAQGFPNRPHETSVLTAYVDHAAIIERPELKLSSDGRKVQKFGRPAAEIEGWNKETSSFHLLVGEVTITLDDVAYLLHLPIIGVFHSFDTLHVEEAVLMLVELLEAGHWTVVAQVYLLHLLGCILFANKSTTHVHVVFLDAFRDLSQSGSYAWGAAAQLHMYDNLNDACKSYNRQLAGYITLLKHFSSIVEAFTDSDYDERSPCAYCWTSKKALPTSTYWKHLDRLTTADVCWMSYGDHRVVRKYVQTIPPHCPGSRLCFEDIDDKWMHFSNYLALVGQICVVPEQCALYYMDWFYMVLHPFMRPTQPSDPPRHPPVMQDETYVEPDILEYLVTATTMEEAPAQALSDVEQPRHAVVACQAIAQRLERLLNLRIVTKGT

SEQ ID NO: 161233 - protein, 385 aa, Glycine max
  Coding DNA Sequence Number=SeqID_69548
  Gene Ontology: Mol. function=transcription repressor activity; Cellular component=cytoskeleton
  Homolog annotation: Hit_ID=A7QFM0; Match level="QueryCoverage=98%, HitCoverage=98%, E-value=3e-55, Identity=39%"; Hit description =Chromosome chr8 scaffold_88, whole genome shotgun sequence
  Pfam annotation: Domain name=DUF623; Domain location=325-384; Score =121.1; E_value=3.3e-33; Accession=PF04844.4; Description=Protein of unknown function, DUF623
MGNHRFKLSDMIPNAWFYKLRDMRDMGRGRDSRKHSTTPSRKKKQTSPPSTTHSSKPNQPHQQYNNNISRKSYYFTRDLKTSPSNTPKIISSPRKSTKLRTKRRTPRTPKLVSSGCSCRTTLESVWTKSDSHSPQEHSSSSPFDTSPESQSPEIRTDRILLPCSSSFDEMVSLSTTSCASCRLNTNINTTTNNDTIIDVDKNFIARKDNKLDGYYNYNTNNNGYDDTFSELELPPIITKPSKLLKKRELKQGSLKVRIVKEQDSEMKEQRNSGSLKRLSLSSPGGRLRIHSPRIAGRRGRKSVSSTASSGSRRSLSDSFAVVKSSFNPQKDFMESMMEMIVENNIRASKDLEDLLACYLSLNSDEYHDLIIKVFKQIWFDLTQPR

SEQ ID NO: 161234 - protein, 263 aa, Glycine max
  Coding DNA Sequence Number=SeqID_69549
  Homolog annotation: Hit_ID=Q5XM22; Match level="QueryCoverage=38%, HitCoverage=56%, E-value=7e-21, Identity=50%"; Hit description =Resistance-like protein HAAS-2
EFHNFELLHVDDAVEMLVELLEVNATEARAETIQCHGSYVQLSLLRDVYQLKIETCHWIIAARAYLLHLLGCTLFANKSVTHVHVIFLDTLRDLTQSGGYFWGVVALVQMYDNLNDASKSTVRQLVGYITLWGPLTVINRPERVVGQFGYIQTIPPHPVASLFFVEKINDRWMQFGEYITPPGDPPRVPPVQQYEEFVEADMYQQLMAVAAPNEADVDVHHDDIVAIGDKLERLLNLRIKEQKHILLLKNVWASQEATLPNQL

SEQ ID NO: 161235 - protein, 63 aa, Glycine max
  Coding DNA Sequence Number=SeqID_69550
  Homolog annotation: Hit_ID=A7PKK5; Match level="QueryCoverage=63%, HitCoverage=8%, E-value=7e-09, Identity=72%"; Hit description =Chromosome chr7 scaffold_20, whole genome shotgun sequence
YIALEQLLVKYGGLSKDGEFGNIDAVTKITVRPAAKHTVDARVFYVVARRNDLETTCFYDVAG

SEQ ID NO: 161236 - protein, 147 aa, Glycine max
  Coding DNA Sequence Number=SeqID_69551
  Subcellular localization annotation: CTP_CleavageSite=17; ConfidenceScore=5.06e-01
MTTRKGATMLKNSRKTSCSTIRKESSNATNNLTSAIQHASWSAMEEEEGVMIYVSSIFGQDVLDIVSDIVDPAASILHLTFILPCALCSNSSIFGQDVLDIVSDIVDPAASILHLTFYLALCIVQPDLIPLHNVGHHVQQLQLSFIV

SEQ ID NO: 161237 - protein, 55 aa, Glycine max
  Coding DNA Sequence Number=SeqID_69552
MARVSTTPLELEGLGFSSSMDSFASWKMNDSGMEKKEREKMPLQGEDESRSSSPP

SEQ ID NO: 161238 - protein, 82 aa, Glycine max
  Coding DNA Sequence Number=SeqID_69553
MKKHKNGTFKRNKIAPTESNLLQFLVSQHALLRASEVRLTGALSKGGKMHGVATNVYLWKMSKKPKETGQKEYSKFGSCIYV

SEQ ID NO: 161239 - protein, 609 aa, Glycine max
  Coding DNA Sequence Number=SeqID_69554
  Homolog annotation: Hit_ID=A7QFM8; Match level="QueryCoverage=100%, HitCoverage=100%, E-value=0.0, Identity=70%"; Hit description =Chromosome chr8 scaffold_88, whole genome shotgun sequence
  Pfam annotation: Domain name=MACPF; Domain location=197-346; Score =43.5; E_value=7.4e-10; Accession=PF01823.10; Description=MACPerforin domain
MGEHVAAVHTATNALQALGRGFDVNFDTRLLYCKGVSGSRVVEIDEEHRRELWLYEDVAVPDVSRDIGCYQEAMVRQSSGVRSFKEGFVAFLILWEIADKCADEATIATTEISKTLTLWQKLQSWTYRGHIFGVFDEFNSGYELLFMIVDKRWSWCNEIEMVEYFNERANVSGKFPIGSFNSAFSFTGSKHVDEAATKTLSSDGFYIPLAKVQLQKSHLRLQGNVKKAVPVNWDPLSLASFIENFGTHVITSITMGGKDGVDPFSFNSQGVYPQPTTATYPIGKEDVTVIFRRRGGDDLEQNHSKWLSTIKSSPDIIEMTFCPITDLLDEIPAKEHLTRAIGLYLEYKPPIEELRYFLEFQIPCVWAPLQDKIPGQQRKEPVCPSLQFSIMGQKLYVSQEQITVGRRPVTGLHLCLEGSKQNRLSVHVQHLVSLPKILHPYWDSHVAIGAPKWQGPEEQDSRWFEPVKWKNFSHVSTAPIENLETFIGDFSGVYIVTGAQLGVWDFGSRNVLYMKLLYSRLPGCTIRRSLWDHIPNKPPKTVNAGNTSNLDNSTLKENATGNKLVKYVDLSEMTKGPQDPPGHWLVTGGKLGVEKGKIVLRVKYSLLNY

SEQ ID NO: 161240 - protein, 149 aa, Glycine max
  Coding DNA Sequence Number=SeqID_69555
  Homolog annotation: Hit_ID=A5AIH8; Match level="QueryCoverage=67%, HitCoverage=13%, E-value=1e-19, Identity=43%"; Hit description =Putative uncharacterized protein
MPRRRSISTEKFLSKEESRIQAQTKPSKEQHKIQTPTKKANANGTVEEPEKSSNLRTSIGKKSAEVSNSGLPGNLVKVTLSNRKVIDASVQWASPLSSISKIGRYATVATYPSAGGRRVTRGCVFQERNTRGVATNVYLRKTLEKPEKT

SEQ ID NO: 161241 - protein, 135 aa, Glycine max
  Coding DNA Sequence Number=SeqID_69556
  Gene Ontology: Mol. function=transferase activity, transferring glycosyl groups; Biological process=metabolic process
  Homolog annotation: Hit_ID=Q8S9A1; Match level="QueryCoverage=84%, HitCoverage=30%, E-value=8e-10, Identity=35%"; Hit description =Glucosyltransferase-8
MAKIKDRVARDFEGGLIVSALEGEFLVGANLVEDVPVLLLQPSDLLHELILVEIELQLRLDLVGSGGFFSSISSRKHRFGLDESARTMVAVGFKIGASLPPLETKELGTATVTPRAVEGEGMLSSSSSSSYSSSS

SEQ ID NO: 161242 - protein, 74 aa, Glycine max
  Coding DNA Sequence Number=SeqID_69557
MRLGRVLGKVIDERQSTFVGGRFMLDGVMVANEVVDECIAEIKECREEEDKHKSFILVRQQPVPTSTPQATCGP

SEQ ID NO: 161243 - protein, 143 aa, Glycine max
  Coding DNA Sequence Number=SeqID_69558
  Gene Ontology: Mol. function=aspartic-type endopeptidase activity; Biological process=DNA integration
  Homolog annotation: Hit_ID=A5BY76; Match level="QueryCoverage=83%, HitCoverage=14%, E-value=3e-17, Identity=37%"; Hit description =Putative uncharacterized protein
MYIKSNHYKLKLIITNGDIPIIRPEAEWTGANHVIMELNTKACYTLACVLSNNEYNKICRLKIAKDIRDSLSINYEGKKDVQLRKTTTLMRHYESFSMKEGEFLDNIFGRLQVLWKGFKALGHTFTKAKINLKNLDNFPKVHE

SEQ ID NO: 161244 - protein, 437 aa, Glycine max
  Coding DNA Sequence Number=SeqID_69559
  Gene Ontology: Mol. function=phosphoinositide phospholipase C activity; Biological process=intracellular signaling cascade
  Homolog annotation: Hit_ID=A7UQU7; Match level="QueryCoverage=70%, HitCoverage=61%, E-value=1e-32, Identity=29%"; Hit description=IMP dehydrogenase/GMP reductase, putative
  Pfam annotation: Domain name=DUF1723; Domain location=106-155; Score =40.8; E_value=5e-09; Accession=PF08330.1; Description=Protein of unknown function (DUF1723)
MGSCPIAEDEPVVAADKPVVVVDVHALGADAGHDAEGFLGGSRDPSVLTEYADHVAISVWNEEDQPELKLSSHGRKVQKFGRPASKVEGLVAVTGLSPLIACSIDIGDRGLISAFVERWHRENSSFHLLVGEVSITLDDVESLLHLPIVGAFHTFEPLHVDEAVLMLVELLEVSKEAGHWTTTTRAYVLRLLGYTFFANKSATHVHCVLLDALGNLCQTGSCAWGAAALVHMYNHLNDACRSSNRQLAGYITLLQHFHLVAECVADPNYDKVSPRACHWIATKATLKIPNVRWMPYGEHRPVQEFDLISCFSDQLRWGPVAVRHQPERVMRQFGYVQSIPVEDADSWVSFEEIDDRWMHYLDHLAPTGEICLVPGQCVPEYMDWFFVLKPLAAPTHARSDVDQPRHVVRLLNLRIVTAGTETHEVMKECIRIARGVT

SEQ ID NO: 161245 - protein, 170 aa, Glycine max
  Coding DNA Sequence Number=SeqID_69560
MVFSLEEDYKGALFEGPYILVDQYLLVKRWRLFFLSNVKELIGYHAEEKEGIHKIVAVEDISHSDNGDIRGLQKEDEAMVNADVKEDNSYSTRVQNAQRGQESTKTEKLIKPNMKEEREVSKKQVSYDGPIKGKGLDPKFEVSFGEGEGGGVHCYGGWFDIDGKRGTHFC

SEQ ID NO: 161246 - protein, 157 aa, Glycine max
  Coding DNA Sequence Number=SeqID_69561
METITKRFKELDVYGKVTLKIKLREISYPDLNSLCAPPKKVKTKGAQKQPMTKHQRSTKCDPSYWEYVDALHSVQNSNSSVKRSASSSDQAKPRRIMPMLDQFHPRIHDSIENIVDVKADGMGEDSWFWFATIYLKNLQNGLMSISTCLVALTDLRN

SEQ ID NO: 161247 - protein, 262 aa, Glycine max
  Coding DNA Sequence Number=SeqID_69562
  Homolog annotation: Hit_ID=A7UQU7; Match level="QueryCoverage=43%, HitCoverage=20%, E-value=4e-13, Identity=38%"; Hit description=IMP dehydrogenase/GMP reductase, putative
  Pfam annotation: Domain name=DUF1723; Domain location=175-224; Score =41.7; E_value=2.6e-09; Accession=PF08330.1; Description=Protein of unknown function (DUF1723)
MGACMRDMGDRVELQEINDGLRLTMTLSKRLRRYLLHSLCLLLSSLPPPLVPSVTPSQSSSYSPFAAQHEVAPIAEDVEHVYHVADEVHEEPVETAVDDVVTDVEGFPGGPHDKSVLMDYVYHMTVTIWNRGERPELKLSSYERKVEKFGRLAPDIEGLVAATGLSPLIACLLDTGDQGLISTFAERWHKKTSNFHLPIGDETITLDDVASLLLLPITGTFHSFEALHVDDVVFLLVELLEMSFEEARAETVQCHGAYVRLS

SEQ ID NO: 161248 - protein, 563 aa, Glycine max
  Coding DNA Sequence Number=SeqID_69563
  Gene Ontology: Mol. function=cysteine-type peptidase activity; Biological process=proteolysis
  Homolog annotation: Hit_ID=A5C1W1; Match level="QueryCoverage=67%, HitCoverage=83%, E-value=2e-57, Identity=38%"; Hit description =Putative uncharacterized protein
  Pfam annotation: Domain name=DUF1723; Domain location=65-115; Score =27.0; E_value=7.2e-05; Accession=PF08330.1; Description=Protein of unknown function (DUF1723)
  Subcellular localization annotation: CTP_CleavageSite=28; ConfidenceScore=5.62e-01
MRKSTRISAIGLSNPPEGPEPTKPFSTRFSLRSYARRVQLLTPQQRSAVSRTGFGNLLLVPNHTLLNKVFLTELMDAWSRERRPFVLRSGEEIRMTLLDAALILGLPVAGSPVSFTEEEPFSDLEESYGATKAKRKVAMSFLENRLDWIGEDVSEDFVRCFLLYTIGTFLASNDGKVDSRFLRFFEDLDEVSGFAWGAAVVDDLCQWLDKRKEHNVRLVRPQLQDHDLTFPRVCRWDNTKSKRGTSWFKDLDDDQVIWKLEPTSGELQIEVIKEALDLLGDNKELQSVESSSISTPSSLNFFYYNAPDVNSGLQLSIEKEVHRVDEDDLENQVVEDTPTKLSTCDEEYREQINPENLMVLDTPPDLTICDKVGREQEMNLENLAVVVEDTPTTTSIADKVGGDQEVNSEKLIVEDTPLNYICDKVCREQEMNLENLEVLVDDAPTTISIANEGGGDQEFNGEKLIVEDTPPELSFYDDDITKKNVMLEVENTELKMKIDQVMEENELLYTQILSNTRFEEQNNELKKELDLLREENRILRLSISSFADRIDRHILDFESNATK

SEQ ID NO: 161249 - protein, 664 aa, Glycine max
  Coding DNA Sequence Number=SeqID_69564
MHVEMNNWTSCFIDGQTKFALMRAKDGGDGLKTFGKPYTTLLKDEVMTIVLNVAAKVHEGGIAEKLLFKFLQKKGSLEQLAEKIGEGWLFVAVRGHRLLHWISWHDSELCSHCLVIVSGSIAVQVGNGGELPYVRGGTKELRTEGFAEEDDWVDWGTTQSFLQTEEGCASISVLVEGVLSEESRFEGIEELANSGQLRSLSAPVPLLGTTRYARDIPPEKLQRSTSKASEKIGVSSGLRRPCGGSATKLVEELINCWDRESILDHDGVQGPVVYTKPPGAVLLLNQEHRVAVWSDGDWRCVGLKEDGVISRPRRGKGVWLLEQGCELGEQGGDIRVGGCGGSGGRRDPYVKEFTGTIGLDQSSELRCGDGFQVLGSITLELNDRAAMDKFHGQGVIVSGEGVALDVNGGGWADVVALNFVAIADEDTEGRVADQSGLHKVVRAPAVDEDHDRLVGDAAQQAERFWSGLTRQRFFLLLFICDEEKEMRGAAVPAGKPLIAVEAKAALLPGNNGGRDGGSEGGAMGVATVEWATLFRKFVLLKACQTESLNEVSEAGVNGLQKSRPSGKLVVAGHPLELSQGGSFHGEGSNGLGEEDEGEAVEWLGFSRLATRRRRSSNFSVTKIWLEASWEIASLMCSNGDLARGESAMEARNESTRFVKDQRTT

SEQ ID NO: 161250 - protein, 891 aa, Glycine max
  Coding DNA Sequence Number=SeqID_69565
  Gene Ontology: Mol. function=zinc ion binding; Cellular component =mitochondrion; Biological process=regulation of transcription, DNA -dependent
  Homolog annotation: Hit_ID=A7QFN8; Match level="QueryCoverage=99%, HitCoverage=100%, E-value=0.0, Identity=53%"; Hit description =Chromosome chr8 scaffold_88, whole genome shotgun sequence
  Pfam annotation: Domain name=B3; Domain location=325-442; Score=73.0; E_value=1e-18; Accession=PF02362.12; Description=B3 DNA binding domain
  Pfam annotation: Domain name=zf-CW; Domain location=609-654; Score =56.0; E_value=1.3e-13; Accession=PF07496.6; Description=CW-type Zinc Finger
  Pfam module annotation: Pfam domain module=B3::zf-CW; Domain location= 325-442::609-654
MESRSCMNVACATSTTIRWRKGWALRSGEFADLCDKCGSAYEQSTYCDMFHSNDSGWRECTSCDKRLHCGCIASMSQLELLDTGGVSCISCGRNSGPQPIASNEKPNGSGTSKVQNVSTQQQCTSLANQLTVRGMQVGHYAENDELQCWFKTHNVETDGPFAEMKPEILPSVGELGNTLISQFHCESNGSSKASKAENCKPETEMRDIYESLAQTNLSMTLAAPLGNSNPFHSAVVDEREQSKTSPLLLGSRSHHLLPKPARSTIGTSLEANAGMVSQIRVARPPAEGRGRNQLLPRYWPRITDQELQQISGEYPTFSNSTIVPLFEKMLSASDAGRIGRLVLPKACAESGNLLKLKEETIVQAYFPPISQPEGLPLRIQDVKGKEWMFQFRFWPNNNSRMYVLEGVTPCIQSMQLQAGDTVTFSRMDPEGKLIMGFRKATNSTAVQETLPSNMPNGSHSSETSYSGVYVNLPILSGYSGLLQLQKGCSETHLNALSKKWNSAGGDMSWHNIDMPESRKRDELPLPPVMVPEKKRTRNIGSKSKRLLIDSQDALELKLTWEEAQDMLRPPPTVKPSIVMIEDHVFEEYEEPPVFGKRSIFVVRSTGVNEQWTQCDSCSKWRKLPVDVLTPPKWTCVENLWDQSRCSCAAPNELNPRELDNLLRLNKDWQQARDWPWNMNLQDWMLWQMQQYWVMMQVTLAGHQLLAPQNILGIDLGALALSVSSHQKRQSEREAEIAQRNQLSWRTKDESEVDSTLRHLTPVDRLENEVRVQNELDSRSQNHAVAEAAKGQLDLNCQPDREDVQAWPNNLSMTSLLEEANLPLETYLKRNGLSSLISEQQTNSASNVQAQTTNDSEGKHNEDCGTALVIHERESSPEENSGQDREQNNSLS

SEQ ID NO: 161251 - protein, 342 aa, Glycine max
  Coding DNA Sequence Number=SeqID_69566
MAPKKLLSERARKDAAGEGSSVAPQADMEFDGHWFQSEEHQRCFEAIKSWRQWTQLAGPMDKYDSEIVMEFYANAWPTEEGVGYKRSCVRGQWVPFDEDAINKFLGHPLVLEEGPAAVCFGAGLRMKCDRKTDLDDTASQQHPPSDHNSDFPLPKCQLVYAILTQVSIHVAHLISNATYQFVGITPPRHLVDPEKFNRALGFSTLITGLCQFYEAQQQRQDHQQKPSADALPPPLQQPPFLKSISAHMQRMELYMKHVTDQQAANHKGQVQLNESFYQYTLHQQSQDPSPYSWPTPKQFEATVAWPGDRPSFQEGARPIGTPRDEDGAQEDDGMADVMNFFL

SEQ ID NO: 161252 - protein, 226 aa, Glycine max
  Coding DNA Sequence Number=SeqID_69567
  Homolog annotation: Hit_ID=Q6WAY6; Match level="QueryCoverage=46%, HitCoverage=18%, E-value=1e-11, Identity=34%"; Hit description =Putative uncharacterized protein
MSIPYKVIACVPKKERKIGRNSWQEGEAGVLCSCEGFPNIPLIGAKGCINYNSILAIRQLGYPMRGAPSEEIIMPFVAWGFNEGNAEMLQRIRKVWNTMERKDKELWGSNNGVIGGYHKWLKTRTQGITWLSKLKSPSREEAEVPEESDEVPALKAELERTRVVKEKLKTTVTRVRKDCDELKDVNVTTAPEKKNMTETSFEGLYRAVTMSSSFEGPKGTSQRWKV

SEQ ID NO: 161253 - protein, 39 aa, Glycine max
  Coding DNA Sequence Number=SeqID_69568
MRPRRYQIATVINFYIVLHSSSGVLFVALYIFISFFYHL

SEQ ID NO: 161254 - protein, 105 aa, Glycine max
  Coding DNA Sequence Number=SeqID_69569
MVIFWNFLDLNSPRPTSGLPGPWESFNLKQPARLGELPLQQMAFSYKYSCRGRVSGVGKLRKEGKNAERRKKRIRKKQSKRCQIELWIVSYIISLASLVPYATVG

SEQ ID NO: 161255 - protein, 250 aa, Glycine max
  Coding DNA Sequence Number=SeqID_69570
MEHELNNIYIRNAQMRVNLPRFDKGVGSTSNHNQNYAQAVRQGDGTKKHKWKAKGVNQVGKHEELWLDEVYLVGGIGNLKLNYIGDLTVLIFDIKDVEGWKNSSDGELSKRSVYGWDFSSLIDECYDNCGEDGVKLQGDGGGKGDKKAKRVDSGVSTKGTEAKIVWGWVVNLKASIPCIVEENTKMIKREKGDEDTQKVTTHETKIKEKKSNVPKDQREGHLCGRNSILAQARSPHKVVKVGTTPDKIGG

SEQ ID NO: 161256 - protein, 70 aa, Glycine max
  Coding DNA Sequence Number=SeqID_69571
  Subcellular localization annotation: CTP_CleavageSite=29; ConfidenceScore=5.31e-01
MKVKIAVFSIAVVVGSGIQVEKNARGRSRAEQHNSTTTTPPTMVKKQLTSPAPTVHSRSRNRAEEEVWSR

SEQ ID NO: 161257 - protein, 94 aa, Glycine max
  Coding DNA Sequence Number=SeqID_69572
MFPIIGGTPMLFPHVKYQPFEEEILEYYEMHYVVKTNLKFQLVSTFLWMQDIPMVQGFYHHIEGLDIISMSGLETPLKVTRRYLIFIMQVPEMQ

SEQ ID NO: 161258 - protein, 109 aa, Glycine max
  Coding DNA Sequence Number=SeqID_69573
  Homolog annotation: Hit_ID=Q2QSQ2; Match level="QueryCoverage=74%, HitCoverage=5%, E-value=3e-08, Identity=39%"; Hit description =Retrotransposon protein, putative, Ty1-copia subclass
MKEDLTKLRDMNKDDVNSQANVVKSVEDEDDVFLAINDELGNDGKMKVEGIGSVKMKLYDGVLQTFSNVRFAPSIIVNMISMGEMTSQWYKYVGSKWGCKVYKGRYLVL

SEQ ID NO: 161259 - protein, 481 aa, Glycine max
  Coding DNA Sequence Number=SeqID_69574
  Gene Ontology: Mol. function=nucleic acid binding; Cellular component= intracellular; Biological process=regulation of transcription
  Homolog annotation: Hit_ID=A7PKI8; Match level="QueryCoverage=98%, HitCoverage=98%, E-value=1e-149, Identity=58%"; Hit description =Chromosome chr15 scaffold_19, whole genome shotgun sequence
  Pfam annotation: Domain name=zf-C2H2; Domain location=13-35; Score =8.5; E_value=1.3; Accession=PF00096.17; Description=Zinc finger, C2H2 type
  Pfam annotation: Domain name=zf-C2H2; Domain location=226-248; Score =19.3; E_value=0.015; Accession=PF00096.17; Description=Zinc finger, C2H2 type
  Pfam annotation: Domain name=zf-C2H2; Domain location=308-330; Score =11.6; E_value=0.64; Accession=PF00096.17; Description=Zinc finger, C2H2 type
  Pfam module annotation: Pfam domain module=zf-C2H2::zf-C2H2::zf-C2H2; Domain location=13-35::226-248::308-330
MALILDQQSNFKHFCKICKKGFGCGRALGGHMRAHGIGDESGHMDDDDQASDWEDRLGGNVPPSNKRMYALRTNPNRLKSCRVCENCGKEFLSWKSFLEHGKCTSEDAESLVSCPGSDADDGGIGSGRRGCGWSKRKRSLRTKVGSFNYNCPSSEEEDLANCLMMLSNAIVDPLIAEPEESCASASKEEEQRRNPMNFIAPLSYKINNNNQHLVDNKAKGVAKGLFECKACKKVFNSHQALGGHRASHKKVKGCFAAKLDNLDDNIMEDDVITHEEFFPTKSNSTLQFDHGSSNPSLASSSKRKPKVHECSICHRSFSSGQALGGHKRCHWITSNAPDTSTLTRFQPFQEHLDQIPKFDTSSEPLDLKLDLNLPAPSNDLARRNVSSEFYLRPWVASKDAKDDNKNSQCQSLHNPNNNLDIDNDEDKNNNNSMQNMDNEGDSKIKLAKLSELKDMNTGGSSLPWLQVGIGSTATDVETDNC

SEQ ID NO: 161260 - protein, 141 aa, Glycine max
  Coding DNA Sequence Number=SeqID_69575
  Subcellular localization annotation: CTP_CleavageSite=36; ConfidenceScore=5.00e-01
MMITKDDDKGDDKKLKDQSKNNSSDQNKIKNNSRVQDKIKKNSRLKRRVKSQESRFKVQDLKNQDQDSRLKIQESREGLIKIRYILCGTSRGYIYLGLTENKRGYISCGSVLVEGTSTRFKENKGGYIPCGSLLVKGFLQG

SEQ ID NO: 161261 - protein, 142 aa, Glycine max
  Coding DNA Sequence Number=SeqID_69576
MYGVKGVTNTPLSEEEVSQALEEFKKEEESIFPQAHESLVNILSKKQKAKEIMVCPRCSVVFDRSTTKAFEASKIRKGFEKVQESKEFEVSSLALRREGTAEGSRKGYYEYQKIQWRRHPMMRRDVILAMQHKNATKPSVFD

SEQ ID NO: 161262 - protein, 360 aa, Glycine max
  Coding DNA Sequence Number=SeqID_69577
  Pfam annotation: Domain name=MAP7; Domain location=2-167; Score= -79.0; E_value=0.05; Accession=PF05672.2; Description=MAP7 (E-MAP -115) family
MSHHSSSVNGKGTSHKDPLSRILDELSSLKLWKEKQERKEKGKKRVEEISQDERKKIREEERRKIMKEMKREKHASYSSHNSCKSLSEELRDYYEGRHRSHLRPHSHRREKERKPQEANIKLSYFHGKDNVEANLDWEIRVEQQLKKKSTSKSYGSHSYPKKDQGQGILGVTPSKPKDDKGKTIEKQSPKASMQEKTSSINESEKAKGEESSEEIYPQEEGQPLVVKEKCKEALASIATPLGLEFIPQVKKLLDEGLVCKSLNPCAFLVPKIGIIRHQVPKIGGMMNVLSGATLFCKITRTPNIFLVCVHRDPLGRNNQYENTEKSVEGRSPKYEEPRDLRSNPFQGGGNDAILPRKGIG

SEQ ID NO: 161263 - protein, 67 aa, Glycine max
  Coding DNA Sequence Number=SeqID_69578
MDDGSQGFFYEPSILYGVEPNDIGMGNDNDENVGVDDTDMHLQPSYLDFSSYFMTNEVFKKSDDLLE

SEQ ID NO: 161264 - protein, 123 aa, Glycine max
  Coding DNA Sequence Number=SeqID_69579
  Gene Ontology: Mol. function=hydrolase activity
  Homolog annotation: Hit_ID=A9PCE4; Match level="QueryCoverage=39%, HitCoverage=12%, E-value=2e-12, Identity=68%"; Hit description =Putative uncharacterized protein
MTVSPPFPTISNPSTKVLEKTRVYHYKRLILEAGYSKEQHSLFRTVTLGFKLTKQSMWRSTPNWLAVSTSRYPTGHFLANQGGIGLQFAQLGRDASAIVNIRSVDEAVVIGAALSLSSSAFVL

SEQ ID NO: 161265 - protein, 156 aa, Glycine max
  Coding DNA Sequence Number=SeqID_69580
  Subcellular localization annotation: CTP_CleavageSite=50; ConfidenceScore=5.33e-01
MAFLGETSNQTIANSRLAFNFPNGSITHNQTGVYFQSLTPTPMQVPNGCSFETLKSRMHNTLQLTNDQLVDEIYYQKPFIDACQQYFFQSLQLTNDDDVYTMLMCNEQYSCIGPIELLCTINRTSNGMLNLLQSTITSCSCCNFVLPMGSGTYHVK

SEQ ID NO: 161266 - protein, 58 aa, Glycine max
  Coding DNA Sequence Number=SeqID_69581
MSTMKGHKKGREIRGKGVCKDKLRCVEEVLDESERKKMRGYEAQSTEEKQRLLKLRIN

SEQ ID NO: 161267 - protein, 481 aa, Glycine max
  Coding DNA Sequence Number=SeqID_69582
  Gene Ontology: Biological process=intracellular signaling cascade
  Homolog annotation: Hit_ID=A7QFE7; Match level="QueryCoverage=99%, HitCoverage=99%, E-value=1e-159, Identity=59%"; Hit description =Chromosome chr8 scaffold_88, whole genome shotgun sequence
  Pfam annotation: Domain name=DUF231; Domain location=312-481; Score =212.3; E_value=1.1e-60; Accession=PF03005.6; Description=Arabidopsis proteins of unknown function
MQSWKWNRKKPPVFPLLVLILLFFIAFSTLHSEHIIQRIHENPDHVHNHQEVSSATFVKPNLSGHLKQAAEVLDRFSRCNSTVEYNGRKVAWLGDSQHSGHWSARPESCDVFSGKWVFDNVSHPLYNESDCPYMSDQLACHKHGRSDLGYQYWRWQPHNCNLKRCSSLLLTLLTEVEGKDMNYTQQIFINGRPRRWFFRDYKRLFIGTKNIFNPPTKVECERNVGEVERQKANVLIPADKRSMSPNAHLTIFRAEEYNATVEFLWAPLLVESNSDDPVNHRLDERIIRPDTVLRHASLWENADILVFNTYLWWRQGPVKLLWTAEENGACEELDGHGAMELAMGAWADWVSSKVDPLMKRVFFVTMSPTHLWSREWKPGSKGNCYGEKDPIDLEGYWGSGSDLPTMSTVEKILRHLNSKVSVINITQLSEYRKDGHPSIFRKFWEPLRPEQLSNPPSYSDCIHWCLPGVPDVWNELLFHFL

SEQ ID NO: 161268 - protein, 407 aa, Glycine max
  Coding DNA Sequence Number=SeqID_69583
  Gene Ontology: Mol. function=metal ion transmembrane transporter activity; Cellular component=membrane; Biological process=metal ion transport
  Homolog annotation: Hit_ID=A7PKP4; Match level="QueryCoverage=44%, HitCoverage=50%, E-value=2e-29, Identity=40%"; Hit description =Chromosome chr7 scaffold_20, whole genome shotgun sequence
  Pfam annotation: Domain name=CorA; Domain location=5-303; Score=39.6; E_value=1.2e-08; Accession=PF01544.9; Description=CorA-like Mg2+ transporter protein
MISFTVSFLLKTQVCNRKQSWRDLGRAIVINLEHIKAIITAQEFLLLNSHDPSVTPSLHELQARIIRHHNQDDVDPNPNPNDAIKILSFEFVSLEACLEAACSVLENEAKTLEQEAHPALDKLTSKISTLNLERICQTKSRLDTIIGRVQKVKEELEHLLDDDEDMAEMYLSEKLAEQQVLEGDVDDDDCGSNDFQDYFDDVKESRVKQVPKNQASRIKSQRIKIQEQLSFKIQEQSRSRFKTQDSRFKRRYILYGTSRGYISCGSVQVEGTFTWFFKENKGGYIPCGSLACKGFYKVERNLKNRRPLDPTTTTTIPFLPTTMIFFNLMFMITLTGTSSFPFNSSTHFSLTSKCNSSFNFFRNAPELSFDNVLGRDNHGTRDNATYSAITKQLDVEELEMLLEAYFV

SEQ ID NO: 161269 - protein, 40 aa, Glycine max
  Coding DNA Sequence Number=SeqID_69584
MGCCLSGGGGGGGVEEDGRVSPVMARVSPAAARSFPVAKV

SEQ ID NO: 161270 - protein, 114 aa, Glycine max
  Coding DNA Sequence Number=SeqID_69585
  Subcellular localization annotation: CTP_CleavageSite=26; ConfidenceScore=5.27e-01
MCVSIRKTVREKATPLMMTKLSPSTRLQMTMSMPKPQRKGREMSTSMMWKLWQMEWKRSVAHMGMRKKAGVWGFLKKLKGFDLIASNRCGSKGRGRRIGRVIGGQRTNFQGNEK

SEQ ID NO: 161271 - protein, 192 aa, Glycine max
  Coding DNA Sequence Number=SeqID_69586
MNTHGNLAYTKLTYVPRGESFEHPRVFQHPSSNSVCWVFFEPDFQEQCRGFCGFERGQCGCRGSGFRREEKEKSDFRQEDDKEKKEGKVFERAGLVILEDKVVKVHLYRNGFNPNYWIWSDHGEDMPHVDLNDNNSYMDASSSATDVAQGEQFMLMQEMVYDAMRKPFEAPKRIWKNLQMKILKDFTIYWWT

SEQ ID NO: 161272 - protein, 256 aa, Glycine max
  Coding DNA Sequence Number=SeqID_69587
MERFIHLRLRQRLSLCPLGNNLVTFGLHGEEFQKIVKNFFSSVFRFHPSKVATKAVTLFIRQQSGHPWPTWGAIPKDCEELYFQHFKAKLSQVRSNVASSVGESQHIPVDPAEEQRLMSWCRLQLGDQSVRDKFMALETLLVLMNLKMKTSCNIRKDLPVALKMPERLTDQGRSFVNQRNKCVNFSQLSFSSYLLKCETLFININNPTSNIMTSNSRTSSSNKTMTKQTTSNNIMSSRDTLAMTILIIELATQNYY

SEQ ID NO: 161273 - protein, 295 aa, Glycine max
  Coding DNA Sequence Number=SeqID_69588
  Homolog annotation: Hit_ID=A5BSR3; Match level="QueryCoverage=66%, HitCoverage=53%, E-value=6e-11, Identity=28%"; Hit description =Putative uncharacterized protein
  Subcellular localization annotation: CTP_CleavageSite=32; ConfidenceScore=5.54e-01
MATPPSSPPPSTGAASQSSSTLKRTRKATCLRSLATRPVGAERPLVHVDPAIGKVDNPYRKKLRTYLGIVAHDKVDVTYENWKQVPVTQKDLIWEDIQPTRKVSMTLYTKSTTLARRSGPNFVRPAKTLRGRCAKKGTTIEKQNTSLQVLSRGGYEYLENKLMEDKKKKKVEEATKYRSTNTMIDPSSPIRRHVKWKMACTKKTGQMTPEAAKEIDDKIASQGSFVAHGCYDVLTAAIGRLEHPGRVHVARAGVTIKQYFEPAPRTSYTSSSMAPEDLKQLTQKIRTARESITEK

SEQ ID NO: 161274 - protein, 105 aa, Glycine max
  Coding DNA Sequence Number=SeqID_69589
MRVHLLGLLTENKKGYISCGSVLVEGTSTRLFKENKGGYIPCGSLLRKKKSHSDSDSERRHGVGVRKKIRDVVERNRVATKMMMQRQHGGDTELRQRRRYARDVR

SEQ ID NO: 161275 - protein, 160 aa, Glycine max
  Coding DNA Sequence Number=SeqID_69590
MERGEVEAKREGGGRKGRDKVTTKHPSSSLIFLLTIGQKTYGISKEYDKISKVFIPKKTEKKGERFGFARIERVADSRVFALKLDEIFIDKSQAGPKKEETRKDAHNEASYASVVKLRSSLAIVEWGSSMAWCVFCPSTRYLVYVRPDGSVSERNKLRRW

SEQ ID NO: 161276 - protein, 979 aa, Glycine max
  Coding DNA Sequence Number=SeqID_69591
  Gene Ontology: Mol. function=nucleotide binding; Cellular component =intrinsic to membrane; Biological process=defense response
  Homolog annotation: Hit_ID=Q2HVE0; Match level="QueryCoverage=89%, HitCoverage=94%, E-value=1e-147, Identity=37%"; Hit description =Leucine-rich repeat; Leucine-rich
  Pfam annotation: Domain name=LRR_1; Domain location=459-480; Score =2.6; E_value=1e+02; Accession=PF00560.24; Description=Leucine Rich Repeat
  Pfam annotation: Domain name=LRR_1; Domain location=482-503; Score =10.0; E_value=4.4; Accession=PF00560.24; Description=Leucine Rich Repeat
  Pfam annotation: Domain name=LRR_1; Domain location=505-527; Score =7.8; E_value=11; Accession=PF00560.24; Description=Leucine Rich Repeat
  Pfam annotation: Domain name=LRR_1; Domain location=529-549; Score =2.1; E_value=1.2e+02; Accession=PF00560.24; Description=Leucine Rich Repeat
  Pfam annotation: Domain name=LRR_1; Domain location=551-570; Score =5.1; E_value=35; Accession=PF00560.24; Description=Leucine Rich Repeat
  Pfam annotation: Domain name=LRR_1; Domain location=572-593; Score =5.6; E_value=29; Accession=PF00560.24; Description=Leucine Rich Repeat
  Pfam annotation: Domain name=LRR_1; Domain location=595-616; Score =16.7; E_value=0.088; Accession=PF00560.24; Description=Leucine Rich Repeat
  Pfam annotation: Domain name=LRR_1; Domain location=641-668; Score =4.6; E_value=43; Accession=PF00560.24; Description=Leucine Rich Repeat
  Pfam annotation: Domain name=LRR_3; Domain location=459-478; Score =17.7; E_value=0.044; Accession=PF07725.3; Description=Leucine Rich Repeat
  Pfam annotation: Domain name=NACHT; Domain location=63-210; Score= -14.5; E_value=0.00081; Accession=PF05729.3; Description=NACHT domain
  Pfam annotation: Domain name=NB-ARC; Domain location=23-316; Score =111.5; E_value=2.5e-30; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_3::NACHT::NB-ARC; Domain location= 459-480::482-503::505-527::529-549::551-570::572-593::595-616::641 -668::459-478::63-210::23-316
MTMKKTKKVHRTEVELLGEIINIVNLVLTSLDKFDPESSRLIGIDKQIQHLESLLHQESKYVRVIGIWGMGGIGKTTIAEEIFSKLRSEYDGYYFLANVKEESSRQGTIYLKRKLFSAILGEDVEMDHMPRLSNYIKRKIGRMKVLIVLDDVNDSNLPEKLFENHDWFGRGSRIIITTRDKQVLIANKVDDIYQVGALNNSEALELFSLYAFNQNHFDMEYYKLSEMVVNYAKGIPLVLKVLGRLLCGKDKEVWESQLHKLENMPNTDIYHAMRLSFDDLDRKEQKILLDLACFFIGLNLKLDSIKVLLKDNERDDSVVAGLERLKDKALVTISEDNVISMHDIIQEMAWEIVRQESIEDPGNRSRLIDPNDVYEVLKYNKGTEAIRSIRANLPAIQNLQLSPHVFNKMSKLQFVYFRKNFDVFPLLPRGLQSFPAELRYLSWSHYPLISLPENFSAENLVIFDLSGSLVLKLWDGVQNLMNLKVLTVAGCLNLKELPDLSKATNLEFLEISSCSQLLSMNPSILSLKKLERLSAHHCSLNTLISDNHLTSLKYLNLRGCKALSQFSVTSENMIELDLSFTSVSAFPSTFGRQSNLKILSLVFNNIESLPSSFRNLTRLRYLSVESSRKLHTLSLTELPASLEVLDATDCKSLKTVYFPSIAEQFKENRREILFWNCLELDEHSLKAIGFNARINVMKSAYHNLSATGEKNVDFYLRYSRSYQVKYVYPGSSIPEWLEYKTTKDYLIIDLSSTPHSTLLGFVFSFVIAESKDHNRAVFLDYPFYITVSEGEGESEKGGIDIFVSHTVRVESGVCVMYDQECSHYLHSRAKNQTRLKIKVTTKEVAPSDSKRGLELKGFGVTPITYSVYQNFIQEINSSADHSFNQQVNTSADHSFIQQTNSPANHSFIQQTNSSANHSFIQQINTSADHSFIQQVNFSADHIFIQQMEVPSSMLFTQILAIIIILLIPFWFLVVKRRRL

SEQ ID NO: 161277 - protein, 86 aa, Glycine max
  Coding DNA Sequence Number=SeqID_69592
MVYYSHRAKNVAGQRLDDGFLGSCGRVLEDYFNAPPMLFNVFFSLSDVVEVVGGNDVEIEYFYIVAKERNDVESAGYYIGAGEKRC

SEQ ID NO: 161278 - protein, 141 aa, Glycine max
  Coding DNA Sequence Number=SeqID_69593
MVRGVNLKLLKTICMLIMLELDDLSLDNLMQSYPARALGRRLQVDWARDPREGPRLSSNFFRNLLKEASQGGELSYERAFSPRFLSKAHLGGEAPSSMAYSLVDGAAFYLFSFVFRCISMAEFKDYASSGLENTCKLGVVG

SEQ ID NO: 161279 - protein, 148 aa, Glycine max
  Coding DNA Sequence Number=SeqID_69594
  Homolog annotation: Hit_ID=Q00M75; Match level="QueryCoverage=20%, HitCoverage=5%, E-value=2e-09, Identity=96%"; Hit description=PPR -repeat containing protein
QLSSKDSFLSKAEAKTILEINAISEDVVCVTVGTISKIVMDNHSWCYPACAQCHRKTDIQTGPFTCGCGKDNDQPVLRASPGAVVKLCLGDLLVMGSNPETASLHMQGYRLKVMVTQNNESGKFLLWDHECAELIGQTTDGVNRVKIE

SEQ ID NO: 161280 - protein, 269 aa, Glycine max
  Coding DNA Sequence Number=SeqID_69595
  Subcellular localization annotation: CTP_CleavageSite=71; ConfidenceScore=5.55e-01
MELSAQPSATPKTFSISWPQRSTELVPVSHKGRSPHGTPPDLSLRSPSIAIRTTFISETLFWRGTWSSLILSMMNSLRSWSEDVERLPGDADHHFGGGVADQFFPVSSHLPQPSNHYEEAVYAGWPVYNIECRRGSMKDFVEGLDHSRSNMECLMDMDLGSMIFSQITQIAQSNSSSTIINLTYIKKNYWNPTDPSIVFSGPQKATTRATPDALPVVPPSVSIPPSLFSTPPDQLIPMMQSSPGPISSHVEPSSALPPSASHVARGFLG

SEQ ID NO: 161281 - protein, 108 aa, Glycine max
  Coding DNA Sequence Number=SeqID_69596
MKSSIIVNQNNNNTLKLLCEQQDDHISQDSSLPHNKSYVQKPLDRILPFYELMLNPTQFQAKEEKVQVADDSLSEPDPLSEWLLLSKAYNLLSGLGNPRRGSFRDVLA

SEQ ID NO: 161282 - protein, 137 aa, Glycine max
  Coding DNA Sequence Number=SeqID_69597
  Gene Ontology: Mol. function=helicase activity; Biological process =viral genome replication
  Homolog annotation: Hit_ID=Q9LW42; Match level="QueryCoverage=100%, HitCoverage=8%, E-value=2e-30, Identity=51%"; Hit description =Helicase-like protein
MLDENNAHAKSLRMARDRLTGTEVHTVRLKLIAGREKDGRTYNVPSVPEIVALIAGDIDANSNRDIIVETQNDQLQRIHELHCSYLALQYPLLFPYGEDEYRPGILHRDTLSGKKRKKNRLTMREWFAYRLQCRPNE

SEQ ID NO: 161283 - protein, 221 aa, Glycine max
  Coding DNA Sequence Number=SeqID_69598
MELIENMAASDHAILRDQAYTPTTKSLLELTSQDTLLAWHKLLPKQLETLTEMLSKLPQQLQAVQLAHSSVMHIGGCNICGRAHELAMCMVQDDVSKEVNYMTNPHHQGFHQGGPPRYNQGGYFSQGQEDTLNQFMQLSLSNHKSTKSAIKNLEAQVGQLATQLAETSTNSFGANTEKNPKEECKYLLDESTHCFKSTNKIKKITDKDLVKLLTESHFYLQ

SEQ ID NO: 161284 - protein, 226 aa, Glycine max
  Coding DNA Sequence Number=SeqID_69599
  Gene Ontology: Cellular component=ribosome
  Homolog annotation: Hit_ID=A2Q6B4; Match level="QueryCoverage=68%, HitCoverage=59%, E-value=2e-11, Identity=28%"; Hit description =Ribosomal protein L33; Nucleic acid-binding, OB-fold
MARIADKIKTIDGSKETLKLVVRIIELWFVGTSGRSKQAEVVFVDSDPLVRYFSYSQGDQIHVVCKQDQLKTWKMDLKEGCTYMMHNFRVNKNDGQFRVCDHPYKLTFIGVTVVRQCELDGLPFKNYRFADFSNVIAGLLQSDLLVDIIGVVDEVVFRHISPISKRVVFKLMNLRLSELGIEIRSVLTRRSQCSSQALGSAQLSSRETFISKSEAKTISEINNLCE

SEQ ID NO: 161285 - protein, 167 aa, Glycine max
  Coding DNA Sequence Number=SeqID_69600
  Subcellular localization annotation: CTP_CleavageSite=30; ConfidenceScore=5.18e-01
MTSHSSSATSKGPSNCLAAIRFSAAFHVSKASQVWQPILFSDGLKEFRRTHGIDDSVIMRFFVADKNTSFEVDVIGPIHWQGRPRSVLATRRHIFTADVTEHMMQQSFPLITMHDGVPSVAQPWFQYLSENSLIAGDEVIFFFRFDEHVWEVLFRKEVVWDDEDLSN

SEQ ID NO: 161286 - protein, 190 aa, Glycine max
  Coding DNA Sequence Number=SeqID_69601
  Gene Ontology: Mol. function=small protein activating enzyme activity; Cellular component=dendrite; Biological process=protein modification process
  Homolog annotation: Hit_ID=A7NYA8; Match level="QueryCoverage=64%, HitCoverage=12%, E-value=6e-38, Identity=63%"; Hit description =Chromosome chr6 scaffold_3, whole genome shotgun sequence
MLRELGLGFFLVVVSLLLWRFFGFDFDPLHDRDANSWLFFLIAFVLVLTIALRAAHYCTICSNSGDASEGASNMALGKSNPPDIDEDLHSRQLAVYGREIMQRLFVYFLSAVKNLILTGVKFVTLHDEGTVELWDISGSFVFSENDVGKIRAATSVSKLQELNNAVVVQSLTTQLTKEHLSNFQVPTSSV

SEQ ID NO: 161287 - protein, 191 aa, Glycine max
  Coding DNA Sequence Number=SeqID_69602
  Gene Ontology: Biological process=response to biotic stimulus
  Homolog annotation: Hit_ID=A9PD67; Match level="QueryCoverage=90%, HitCoverage=87%, E-value=2e-58, Identity=65%"; Hit description =Putative uncharacterized protein
  Pfam annotation: Domain name=Dirigent; Domain location=18-190; Score =190.6; E_value=3.9e-54; Accession=PF03018.5; Description=Dirigent -like protein
MVTKFLIFFFLSIIALTSVTAEDGTGFVGSPNRKFLGLKTKEKLSHFRFYWHDILTGSNPSAIQIIPSVPKYNTTTSFGLVRILDNPLTLGPELSSKQVGRAEGLYASASRSELSLLMVMNFALTEGKYNGSTITIMGRNRALSKVSREMPVIGGSGIFRFARGYALVKTHSSDPKTMQATVEYNVYVLHY

SEQ ID NO: 161288 - protein, 243 aa, Glycine max
  Coding DNA Sequence Number=SeqID_69603
  Homolog annotation: Hit_ID=Q7Y1W1; Match level="QueryCoverage=98%, HitCoverage=43%, E-value=2e-71, Identity=54%"; Hit description =Putative uncharacterized protein At5g01590
  Subcellular localization annotation: CTP_CleavageSite=56; ConfidenceScore=5.64e-01
MASINFNPFGGNWFSKPPNPLPLPSLPNTLTDAPSLPPNFAAISLPNPFRRRPKPKSAEPTEPGPYEQLARQVLWECETLPDHRHTPEVDKILADNDAAFGGDDDSVFVRREDATDEEVRENAELVERLRSSPVVQFMARAEEILDKMNEMELKENERPYHKEDWEVWKNVPNVIGLDGRPMPRKAQKTREEADDKFWDFARQFFFGLWNFRQRPYPPGKPIDAAQSIGYKNLERRYYDCELQ

SEQ ID NO: 161289 - protein, 197 aa, Glycine max
  Coding DNA Sequence Number=SeqID_69604
  Gene Ontology: Mol. function=acyltransferase activity; Biological process=metabolic process
  Homolog annotation: Hit_ID=A7NTH0; Match level="QueryCoverage=42%, HitCoverage=20%, E-value=7e-13, Identity=54%"; Hit description =Chromosome chr18 scaffold_1, whole genome shotgun sequence
MESELKDLNSKPPTYNGNANSICDDRPLLKSEPPAFANSIVEMEKKLTTYVRRDVYDTMGHSEFPGKEKLLLDFALGTLLPIRGLHSLLYSDWRGGIGRLRSYEWVEENHHCFVWAIDLLQKNQDNAKASLEVLAADMQFLMQVLMMPKIIYLIMVVIIKTGENLNHASFDDAKKNLLDNGCHHQKGRKCECMNTSF

SEQ ID NO: 161290 - protein, 92 aa, Glycine max
  Coding DNA Sequence Number=SeqID_69605
MAATMADPEFVNLIHGKKLKKKLLQMLEIIARVITDTNVKLWFNALKDIVSEIDDLTMFPPKLLLKSRLKIMLNGVFLKNHFNLGLAEVKFF

SEQ ID NO: 161291 - protein, 68 aa, Glycine max
  Coding DNA Sequence Number=SeqID_69606
MIYILPLFDDDNHYSRLDLFDIIKIFMITKWKLEVGSWKGKLLEVEIGSGSYWKLKLEVEVAGSYVDY

SEQ ID NO: 161292 - protein, 159 aa, Glycine max
  Coding DNA Sequence Number=SeqID_69607
MLQPYGISISLKEHSNPVTPKAYTPKSPSEPLPPDSAISHWDIVATYPSAGGRCVTRRMRVPRKEYAWSRHQRLFEENIGKTGKDAIYELLSERLGSCIYARGRCFPLLLRTLPLERKSDLRSSFLCVNQVVLFYLKGDHFKALDLKNDPFYLIKREMT

SEQ ID NO: 161293 - protein, 143 aa, Glycine max
  Coding DNA Sequence Number=SeqID_69608
MPRGPRLRKPWWIRAKEKQQDHVIMEENFIKDGLQPETLVHSSMLNQLDYDIPREVNPNISMDSIARFQENSEKAEEKLKGDLDEAEAEILKTHEVYFFKAIQQAKCFFKEVDLSLFDIDKDIKHKEELVPKAEVEVGIEKPT

SEQ ID NO: 161294 - protein, 83 aa, Glycine max
  Coding DNA Sequence Number=SeqID_69609
MSRDFTYCETKDAKYPKVADQRLHIINSIGACRPWILFINGVLCFLKFDSSGMEKENDDWRCHFKEKMSLEEAHHHRKPWIRA

SEQ ID NO: 161295 - protein, 97 aa, Glycine max
  Coding DNA Sequence Number=SeqID_69610
  Homolog annotation: Hit_ID=A7PYA8; Match level="QueryCoverage=47%, HitCoverage=5%, E-value=1e-10, Identity=73%"; Hit description =Chromosome chr15 scaffold_37, whole genome shotgun sequence
MPLKTLMRGLSASIQSCAEANSTINVYVAKRIHSIEMVSLSYSCHEEKVELEQQETRRLRKELESEKAAREESWAKVSVLELQINATMRDLDLRGGG

SEQ ID NO: 161296 - protein, 452 aa, Glycine max
  Coding DNA Sequence Number=SeqID_69611
MDCDTKRLCRRWPPWRQRSNRQLSTKVSGVLANLLCTRLDGDELFICYKDLQAEKMDLGGNVESLAAEKDRLAKVVADLEARLKESMSRLEESELWATKERETSRELEEYFSPNGCEELCLSYPWLNVLPNQCGDRLLDLLSFSSDGYEDGVAVRLVELEPLTVVIIVAACGPWVCRALDQERVCPGFCQTYGAVSRLTKDGPWILWTYMSLTMGGMYWRQNGFLLHMRLLRSSRIDKGIVQPRFGHCVLAYMPLTMGGRTGGLIMIRSCIMPLAAVIMLEEGLTKGRPRVLRASEVGCDPEGTFLVGAKLFHLAICESIRSFIGCYLECTVGPEDDSVSCLCLAVVVGDNGVCEVVPAYEGFLGDYFHLVGLVPVCPFHTWLKAKGSSDYEASSHLFVARERPPIWRPGHPIWFFLFSDHNFLNIYGGSLEHLLDDGLKVPDLLGTGQLEE

SEQ ID NO: 161297 - protein, 239 aa, Glycine max
  Coding DNA Sequence Number=SeqID_69612
MLPPICFQVIEWHQPDRVLRQFGMQQPISGCPSQFQGIGRRREAVEAEPYFYPGMEERGHGIYYTPPTFSQYPTQMYQYPFEGHQSDTSASSSTLGGVAETYPIFSWPAMTPSQQHDAPIPTPNVPLEHKLNTFKRTSSNTSELSEISEVTCLTYINQLNEQLPRSDCIGHRCLLCPSAPHLLHFCWCSDGSSQSISFLILVDFGRHFAQILVGLGISVHASSEGGIAASFPRGHHYAE

SEQ ID NO: 161298 - protein, 246 aa, Glycine max
  Coding DNA Sequence Number=SeqID_69613
MGVSRRRNWRDQCTSACLACETGGTLQLSILLAIYNGGTPMSPNLLPEEEFVISGSAQELLPEERHPECFRKKLLPEDFHFLPEEGSSGISIGGPVKYLKIWWSRVLYLKRKIRNEHFRKLLRPIPEEVLPENTSGMVLSNFRKHFFRKLLRPIPEEGLPEINGGMTLRCHKKFIWIMIMIIKKNVGVNEPHVDCSNAFNTSQVFATRDDVLQWARTVAHENGFVAMIMRSDTETGSREEFICLNW

SEQ ID NO: 161299 - protein, 173 aa, Glycine max
  Coding DNA Sequence Number=SeqID_69614
  Subcellular localization annotation: CTP_CleavageSite=76; ConfidenceScore=5.62e-01
MGDMLGAPRFFAGAPSNLLKCQFCPSFKNIKSFFPLSEAFCLLFREKASFLSSLFRESKLPWWSSSPRDFSAFIFSARLLSSICIREDAEKNGGSLVTVSLPEDPLGVLPEEDLPELPEEDLPELPEEDLPEDFRKKGSSGSNETTSGRTGLPESSRNTSSASGNIPEEGSFG

SEQ ID NO: 161300 - protein, 157 aa, Glycine max
  Coding DNA Sequence Number=SeqID_69615
  Subcellular localization annotation: CTP_CleavageSite=87; ConfidenceScore=5.66e-01
MTQIPTEPYKGSSRSSLTRSLTESTRLTHLPAPSPNHSSPRTTSSSPSPICTLTTTIGSTRSRKAHVSHKISRRIAIFSSERNASCRCWLKAAREEFTFNTRERTLGLVSVVDASSQEPREDERDNGKRKASEARREELKSHTFFLKKITLIQLQFL

SEQ ID NO: 161301 - protein, 290 aa, Glycine max
  Coding DNA Sequence Number=SeqID_69616
  Gene Ontology: Mol. function=catalytic activity; Cellular component =protein serine/threonine phosphatase complex; Biological process =protein amino acid dephosphorylation
  Homolog annotation: Hit_ID=A5BF43; Match level="QueryCoverage=98%, HitCoverage=65%, E-value=3e-88, Identity=56%"; Hit description =Putative uncharacterized protein
  Pfam annotation: Domain name=PP2C; Domain location=22-275; Score =106.5; E_value=8.1e-29; Accession=PF00481.12; Description=Protein phosphatase 2C
MLSMIHYQDFTGKKDMIFCGVFDGHGPLGHKLSQCIRDNLPAKLSASIKQSQEKAMKHYDANATNGGSHSDDYVEDNQNMSFPSWEGTFMRCFSEIDEKFAKNIDTDGFRGGSTAVTVIKQGDQLIIGNVGDSRAVLCRRAPDNRLIPVQLTVDLTPDIPREALRIINCGGRIFATEEDPSVNRVWMPKGDCPGLAMARAFGNFCLKDYGVTSIPDVSYRKLTKQDEFVVLASDGIWDMLSNSEVINIVASAPKRSMAAKLLVNHAVRAWRYKHGFKVDDCSAICLFLKD

SEQ ID NO: 161302 - protein, 276 aa, Glycine max
  Coding DNA Sequence Number=SeqID_69617
  Homolog annotation: Hit_ID=A7QFG7; Match level="QueryCoverage=99%, HitCoverage=54%, E-value=1e-121, Identity=77%"; Hit description =Chromosome chr8 scaffold_88, whole genome shotgun sequence
FDSSMPHIREIVVKKVRHAIDSESNSNGKCSVPEYKKKQVRNAEALIEEEPLKPWITLKRNVKNIKYLSSMVDISFKDRYVYIDVGARSYGSSIGSWFRKQYPKQNKTFHVYAIEADKTFHQEYGTKKGVTLLPYAAWVRNESLVFEINRDPGEKKVQGKGRGMGRIQPLKSSGGFDGGELEKISGFDFAEWLKNTVSENDFVVMKMDVEGTEFDLIPRLFETGAICLVDEIFLECHYNRWQRCCPGQRSPKYEKTYDQCLQLFTSLRQSGVLVHQ

SEQ ID NO: 161303 - protein, 67 aa, Glycine max
  Coding DNA Sequence Number=SeqID_69618
MAKWKKRKLEFWVKIAVRARFYGVVVSTLNFESSDLGLTLAGLIIDEINPDFYIILSHSQKLVLLNL

SEQ ID NO: 161304 - protein, 107 aa, Glycine max
  Coding DNA Sequence Number=SeqID_69619
GEVDGVLIAVLPGTAPGGEDGGGIFGADVLGGGEAAEEEGAEHKGVGGRGEGVELGGDVGVGGDEEGVGIGIWGCGRGRVGGGGGGGEEEREGGGGGVAGERGVVRG

SEQ ID NO: 161305 - protein, 23 aa, Glycine max
  Coding DNA Sequence Number=SeqID_69620
MVNLMMNTWTKKAGYPVIQFMLN

SEQ ID NO: 161306 - protein, 36 aa, Glycine max
  Coding DNA Sequence Number=SeqID_69621
MALGGEEARTAVQKQPNGTGKREVYIGRNTPKTLTF

SEQ ID NO: 161307 - protein, 1464 aa, Glycine max
  Coding DNA Sequence Number=SeqID_69622
  Gene Ontology: Mol. function=binding; Cellular component=nucleus; Biological process=metabolic process
  Homolog annotation: Hit_ID=A7PF23; Match level="QueryCoverage=87%, HitCoverage=98%, E-value=0.0, Identity=45%"; Hit description =Chromosome chr11 scaffold_13, whole genome shotgun sequence
  Pfam annotation: Domain name=PPR; Domain location=1010-1043; Score =23.2; E_value=0.00094; Accession=PF01535.11; Description=PPR repeat
  Pfam annotation: Domain name=PPR; Domain location=1112-1146; Score =47.4; E_value=4.9e-11; Accession=PF01535.11; Description=PPR repeat
  Pfam annotation: Domain name=PPR; Domain location=1147-1181; Score =20.0; E_value=0.0091; Accession=PF01535.11; Description=PPR repeat
  Pfam annotation: Domain name=PPR; Domain location=1183-1216; Score =11.4; E_value=0.34; Accession=PF01535.11; Description=PPR repeat
  Pfam annotation: Domain name=PPR; Domain location=1249-1283; Score =12.2; E_value=0.28; Accession=PF01535.11; Description=PPR repeat
  Pfam annotation: Domain name=PPR; Domain location=135-169; Score =14.4; E_value=0.15; Accession=PF01535.11; Description=PPR repeat
  Pfam annotation: Domain name=PPR; Domain location=238-272; Score=7.4; E_value=1; Accession=PF01535.11; Description=PPR repeat
  Pfam annotation: Domain name=PPR; Domain location=321-355; Score =18.9; E_value=0.019; Accession=PF01535.11; Description=PPR repeat
  Pfam annotation: Domain name=PPR; Domain location=356-390; Score =18.0; E_value=0.036; Accession=PF01535.11; Description=PPR repeat
  Pfam annotation: Domain name=PPR; Domain location=392-425; Score =11.4; E_value=0.34; Accession=PF01535.11; Description=PPR repeat
  Pfam annotation: Domain name=PPR; Domain location=458-492; Score =12.2; E_value=0.28; Accession=PF01535.11; Description=PPR repeat
  Pfam annotation: Domain name=PPR; Domain location=682-716; Score=8.7; E_value=0.72; Accession=PF01535.11; Description=PPR repeat
  Pfam annotation: Domain name=PPR; Domain location=780-814; Score =19.2; E_value=0.015; Accession=PF01535.11; Description=PPR repeat
  Pfam annotation: Domain name=PPR; Domain location=883-917; Score=8.5; E_value=0.76; Accession=PF01535.11; Description=PPR repeat
  Pfam annotation: Domain name=Pro_isomerase; Domain location=1325 -1457; Score=144.4; E_value=3.2e-40; Accession=PF00160.12; Description=Cyclophilin type peptidyl-prolyl cis-tr
  Pfam annotation: Domain name=TPR_4; Domain location=1182-1207; Score =12.8; E_value=1.2; Accession=PF07721.5; Description=Tetratricopeptide repeat
  Pfam annotation: Domain name=TPR_4; Domain location=134-159; Score =2.2; E_value=21; Accession=PF07721.5; Description=Tetratricopeptide repeat
  Pfam annotation: Domain name=TPR_4; Domain location=391-416; Score =12.8; E_value=1.2; Accession=PF07721.5; Description=Tetratricopeptide repeat
  Pfam annotation: Domain name=TPR_4; Domain location=779-804; Score =1.9; E_value=23; Accession=PF07721.5; Description=Tetratricopeptide repeat
  Pfam module annotation: Pfam domain module=PPR::PPR::PPR::PPR::PPR::PP R::PPR::PPR::PPR::PPR::PPR::PPR::PPR::PPR::Pro_isomerase::TPR_4::TPR _4::TPR_4::TPR_4; Domain location=1010-1043::1112-1146::1147 -1181::1183-1216::...
  Pfam module annotation: Domain location=1249-1283::135-169::238 -272::321-355::356-390::392-425::458-492::682-716::780-814::883 -917::1325-1457::1182-1207::134-159::391-416::779-804
  Subcellular localization annotation: CTP_CleavageSite=12; ConfidenceScore=5.45e-01
MLPQLTIPCSTVCTAAFPFKLSPHSRTISSCILLKMLMRLPLPCPSRHVRESQNSGVKSTDLRHPDIVSWNTVLSGFEESVDALNFARSMHFRGIAFDLVTYTSALAFCWGDHGFLFGWQLHSLVVKCGFGCEVFIGNALVTMYSRRGMLDEVRRVFAEMPERDLVSWNAMILGYAQEGKCYGLEAVLLFVNMVRHGMLIDHVSLTGAVSACGHMNNLELGRQIHGLTQKVGYGTHVSVCNVLMSTYSKCEVPKDAKAVFECISNRNVVSWTTMISIQEEDAVSLFNAMRINGALLDMCGKRGDIIESQRVFNETPERTQFARTAIISPYARHGVFESVMSLYTEMEREGINPASITFLSVLAACCRKGMIDVGHRVFDSMVKKHSIEPTSEHYSIMVDMLGRVGRLDEAEELMHQIPGGPGLSVLQSLLGSCRLHGNMEMAEKVVGRLIEMDPASSGPYVLMANLYAEKGKWEKVAEVRRGMRGRGVKKEVGFSWVDVSNVDSLYLHGFSSGDKSHPESENICKIAEFLGLQMKILKENRETEGEWYHEPNSFGHSGDHYDSLFSSIVMLCPLKTRHRVPLQLSFRLCSKFFHALKHDHHQFDFIPHPNAASVNHSMLNCLHSRLPFQALTAFKNHFQLHSLENVDEVTVALSLKACQGESKLGCQIHGFAVCSGFVSFVTVSNSLMKMYCKSGNFGKALIVFENLSHPDIVSWNTVLSGFEESVDALNFARSMHYCGIAFDPVTYTSALAFCWGDHGFLFGWQLHSLVVKCGLGCEVFIGNALVTMYSRWGMLDEARRVFDEMPERDLVSWNAMISGYAQEGKCYGLEAVLLFVNMVRHGMLIDHVSLTGAVSACGHMKNLELGRQIHGLTQKVGYGTHVSVCNVLMSTYSKCEVPKDAKAVFESISNRNVVSWTTMISIDEEDAVSLFNAMRVNGVYPNDVTFIGLIHAVTIRNLVTEGLTIHGLCIKSCFLSEQTVSNSFITMYAKFECIQESTKIFEELNCRETVSWNALISGYAQNGSYKEALLTYLSAVKEIKPNQYTFGSVLNAIAAAEDISLNHGKSCHSHLLKLGLGTDPIVSGALLDMYGKRGDIIESQRVFNETLERTQFAWTAIISAYARHGDFESVMSLYTEMEREGINPDSITFLSVLAACCRKGMVDAGHRVFDSMVKKHSIEPTSEHYSIMVDMLGRVGRLDEAEELMHQIPGGPGLSVLQSLLGSCRLHGNMEMAEKVVGRLIEMDPASSGPYVLMANLYAEKGKWEKVAEVRRGMRGRGVKKEVGFSWVDVSNVDSLYLHGFSSGDKSHPESENICKIAEFLGLQMKILKENREREGECGYYDGTIFHRNIKGFMIQGGDPTGTGKGGTSIWGKKFNDEIRESLKHNARGILAMANSGPNTNGSQFFLTFAKQPHLNGLYTVFGKVIHGFEVLDLMEKTQTGAGDRPLAEIRLNRVTIHANPLAG

SEQ ID NO: 161308 - protein, 653 aa, Glycine max
  Coding DNA Sequence Number=SeqID_69623
  Gene Ontology: Mol. function=protein binding; Cellular component =cytoplasm; Biological process=vesicle docking during exocytosis
  Homolog annotation: Hit_ID=A7PY89; Match level="QueryCoverage=100%, HitCoverage=77%, E-value=0.0, Identity=64%"; Hit description =Chromosome chr15 scaffold_37, whole genome shotgun sequence
  Pfam annotation: Domain name=Sec1; Domain location=21-637; Score= -19.2; E_value=3.2e-09; Accession=PF00995.14; Description=Sec1 family
MDFSYEMYMVQGFITDQETAMEELYGNIENTRRFNTCLNNMAIRIATVFASLKMEDFNGLLLTHCNESVACMLWLFAWLSNLSSNKSRLLLTCNVRRVRKGFSSYMEHIVKVRQRGRVVPKGSFPQPQINIRESYSFSHKESLRELPCVWYRAAKDSDESTATAVRELVPTKLANAVWDMVSKYKSTIPGFPQNETCDMLIVDRSVDQLSPFDDCVESAPQIAPVIHEWTYDAMCHDLLTMDGDKYMHEVPSKVGGQPEIKEVILQDHDSVWLELRHTHIADASERLHEKFTNFVSKNKAAQIQQSGRDGSELSTRDLQKMVQALPQYTEQVEKISLHVEIAGKINKIIRETDLRELGQLEQDLVFGDAGAKEVINFLRTKQNTTPEYKLRLLMIYASVYPEKFEGDKASKLMQLAKLSPDDMKVISNMQQLAGSSNKKSSAAGGFSLKFSNQKTKQAARKDRTEEEETWQLFRFYPMLEELIENLSKGELAKNEYSCINEPNPSNARGSVRISKQTQTPPTTAPHSMRSRRTANWGRARTSDDGYSRNKLCFKMITVSVSSFNPDFILLPNFNSDSTLKNVTTDFKRMGKRIFVFIIGGATRSELRVCHKLTPKLKREVILGTTSMDDPPQYLTKLKLLFDNNVSQLNGLGI

SEQ ID NO: 161309 - protein, 140 aa, Glycine max
  Coding DNA Sequence Number=SeqID_69624
  Homolog annotation: Hit_ID=Q8LGE7; Match level="QueryCoverage=50%, HitCoverage=64%, E-value=1e-23, Identity=75%"; Hit description =NADH:ubiquinone oxidoreductase-like protein
  Pfam annotation: Domain name=CHCH; Domain location=22-62; Score=13.7; E_value=0.063; Accession=PF06747.4; Description=CHCH domain
MASAVDASGNPIPTSAVLMASSKHIGIRCHSENLEFLKCKKKDQNPENCLDKGRDVTRCVLGLITPKGMHNILTKKVLLKLKGKFYHSLTTKGEGRLGNTVGKSIKNALEVVVALSTDKIHKSQWNTIVSFDSCKQSTST

SEQ ID NO: 161310 - protein, 144 aa, Glycine max
  Coding DNA Sequence Number=SeqID_69625
  Gene Ontology: Mol. function=histone serine kinase activity (H3-S10 specific); Cellular component=chromosome, pericentric region; Biological process=protein amino acid phosphorylation
  Homolog annotation: Hit_ID=O64629; Match level="QueryCoverage=79%, HitCoverage=39%, E-value=5e-47, Identity=74%"; Hit description =Serine/threonine-protein kinase Aurora-3
  Pfam annotation: Domain name=Pkinase; Domain location=14-138; Score= -94.0; E_value=0.0056; Accession=PF00069.16; Description=Protein kinase domain
  Pfam annotation: Domain name=Pkinase_Tyr; Domain location=14-144; Score=-135.0; E_value=0.00038; Accession=PF07714.8; Description =Protein tyrosine kinase
  Pfam module annotation: Pfam domain module=Pkinase::Pkinase_Tyr; Domain location=14-138::14-144
MDGNPKREWSLNDFEIGKPLGKGKFGRVYVAREVKSKFVVALKVIFKEQLEKYRIHHQLRREMEIQFSLQHQNVLRLYGWFHDSERVYLILEYAHNGELYKELSKKGHFNEKQAATCQGFGGLCNRSATALVAFVPYFLQYQGL

SEQ ID NO: 161311 - protein, 97 aa, Glycine max
  Coding DNA Sequence Number=SeqID_69626
MEHIVQMKGRLKLNVTTTNNGDMRTIRNSDVLIFSVPEALKDRKLELLPAMVWEQELDVLLKGSIKAHRHSNDNGERWLTMQDGIERRPVVYAMTGH

SEQ ID NO: 161312 - protein, 827 aa, Glycine max
  Coding DNA Sequence Number=SeqID_69627
  Homolog annotation: Hit_ID=A7PY22; Match level="QueryCoverage=96%, HitCoverage=27%, E-value=0.0, Identity=56%"; Hit description =Chromosome chr15 scaffold_37, whole genome shotgun sequence
MAAAGVAAEGLSPNAAKAEAENATHLSVALVENAIVILMLAEEHLRSQSKQSSSLRPTDGSPSPLSLFYPVHYNLKPLTNTSAESAELRGDRTSSSSNSGGVSLDVLSSMADENGQISTSVIERLAAAAAADPYESVSCAFISYGSCAKDLAIGWKYRSRLWYGVGLPSNTASLGGGGSGWDFWKSLLEKDANGYWIELPLVKKSMEMLQALLLDESGHGGGLGIGGGSGTGMGAMTALYQLLDSDQPFLCMLRMVLLSMREDDDGEDHMLTKTASSIGAVPEGRKLQSALLWSVLAPILNMPVSNSKKQRVLVACCVLYSEVYHAVSIDRKILRKKYLEAILPPFIAVLRRWRPLLARIYELATADGLNPLMVDDDALASYAESIEAALDMISPTWAAAFASPPAAMALSMIAAGTSGAENHAPSSNAQIRRETSLLERKHARLHSFSSFQKPLAVPNKTSQIPKSKAAAKDAALAAARDLQRFSRIGSGRGLSAVAMATSEQRRSASDMERVKRWNITEAMGVAWMECLQPIDTKSVYEKDFNALSYKFIAVLVASFALARNMQRSEIDRHARANIICQHHISTGIHAWRKLIRQLIEMRSLFGPFADYLYCPLRVFWKLDFTESSSRMRRCMRRNYQGSDHLGFAANYEDYSGENNDHTTPVLSAEAITIEDVNEDEEQAETENLDARIDDIEDKVENQPNFSKAAEKVAQESLESSAIQHESDEGVVQSSSAFAPGYVPSELDERIVIELPSTMVQSLRVVQGTFQQKEIHHVVFGIMACCGSSEEDDANKDNGVTTFRYEVLPGMKKPMEEGAVLAVDRHQI

SEQ ID NO: 161313 - protein, 299 aa, Glycine max
  Coding DNA Sequence Number=SeqID_69628
  Homolog annotation: Hit_ID=A7QKM1; Match level="QueryCoverage=95%, HitCoverage=92%, E-value=6e-95, Identity=61%"; Hit description =Chromosome chr2 scaffold_113, whole genome shotgun sequence
  Pfam annotation: Domain name=DUF716; Domain location=113-262; Score =173.4; E_value=6e-49; Accession=PF04819.3; Description=Family of unknown function (DUF716)
MLEGHQVLGFGFFVIGLWHLFNHIKLHALCSMSYTSTLWFPTTKSRYLELKFIITSSTIFIALELFISPARHQPFNPDGSIPSDHLHNFEHSSMAMSFLVYATFALVLDKICSKAQYELTHFLGAIAFAQQFLLIHLHSRDHMGLEGQYHYFLQLLILVSLSTTLMGIGYPNSFLVSFVRSFSIMFQGLWLMVMGFLLWTPGFQAKGCVTHLREYMVTCNDDDALHRAKSLVNILFSWLLILVTIFVMSFYLVLVTRYGIEKVEYASLVKEQHHLENGLTIDVESQNHKHANNVADLST

SEQ ID NO: 161314 - protein, 272 aa, Glycine max
  Coding DNA Sequence Number=SeqID_69629
  Gene Ontology: Mol. function=GTP binding; Cellular component=nucleolus
  Homolog annotation: Hit_ID=A7QKF6; Match level="QueryCoverage=84%, HitCoverage=88%, E-value=1e-69, Identity=59%"; Hit description =Chromosome chr2 scaffold_112, whole genome shotgun sequence
  Pfam annotation: Domain name=DUF947; Domain location=72-261; Score =174.4; E_value=3e-49; Accession=PF06102.3; Description=Domain of unknown function (DUF947)
MKKQRTRIPDSMETQYEESEKDESSSSYSSSEDEEEEIEKELADVTFEELQKARSNGAHAFFQKPKEDIKLKRANKNRPMEASSKKPVTGFREVIQAPKKVVRDPRFESLCGKLDPDGNCQIMLKDSCSDLYHSAYQEVSRFRKRYNFLYENDLPAERQALKKELKKYKDPKRVNEIEERISWIDKQVKSDSAKHIDAEISAKHKKKEREAAKQGKRPFYLKKSEIRKQRLIEKYNHLKSSGKLEAFVEKRRRRNAAKDHRYMPYRRSGDVE

SEQ ID NO: 161315 - protein, 64 aa, Glycine max
  Coding DNA Sequence Number=SeqID_69630
MALVSQAKPPYPCICKEAVSGFEPMTNKSPRHNFTAAPGFALNFTCCYYGIQIAERFSITAVVA

SEQ ID NO: 161316 - protein, 53 aa, Glycine max
  Coding DNA Sequence Number=SeqID_69631
MEGIMKQVQLTCDDGVSRRLRELRWSLAAAHGGVAGKTFSGCSQTTLLIVTTR

SEQ ID NO: 161317 - protein, 72 aa, Glycine max
  Coding DNA Sequence Number=SeqID_69632
MEEDEGQCLLQPLNPISLYFSHSKAWLDSGCGGGGLLDFLAHEGLLSEHVSLSESFPSAKRAGCLAKRMRLT

SEQ ID NO: 161318 - protein, 281 aa, Glycine max
  Coding DNA Sequence Number=SeqID_69633
MFDRVGDKLLWNGGEDIKPKYLGDDMVLLVGLTNDRAVQLGILPHAWDLEYIKQIVLAAGEVVIVDDDVDEFQRMDMARECWMNQEFLRGKDARQQTDRQNSRHGTLGNNLRLLTQSQNLVASEGRSGPTGAGKRKIEEVTRGQSEADGAEAGVNQSFTQQRMFGEKYTKGVIVTTTSKEKQDKNREKQKQVDATDEVHNNNESGQEMDLLMSHDFEIELQESHACPHDKEGDKPLMGLTKNTNTGINEGAEGNMAGKTNEPTSAMKVYSKTRGGSLDTGH

SEQ ID NO: 161319 - protein, 127 aa, Glycine max
  Coding DNA Sequence Number=SeqID_69634
MVLLLRLLCLEVLPRSKTVLAVGPGKLPCCLIYVRTKIFCGFSEWEIAPALTAFKKHVLICLQNCKGMLATCQGQFYHFQRILGAPAIMLGVPSNITNELKAAKSEIQKWHSSFQNEPFISAETTPR

SEQ ID NO: 161320 - protein, 55 aa, Glycine max
  Coding DNA Sequence Number=SeqID_69635
ASTKRNTHRLSARKTLEEDEPYRRLPGYGKLNPLLDLPCRYLISGNWSDSKVLDS

SEQ ID NO: 161321 - protein, 111 aa, Glycine max
  Coding DNA Sequence Number=SeqID_69636
MAVISPTKISQPLFPRGYNPNVTCAYHGGVPGNSIEHCMTLKHKVQSLIDAGWLRFEEENRSTCTVLFTFPCYKVMTKDNNRYLRALHWGNERHHARVSSEPKGRSEVLTW

SEQ ID NO: 161322 - protein, 108 aa, Glycine max
  Coding DNA Sequence Number=SeqID_69637
VVPGDMSRGSGDLGDVRRAPGSQQIKGTKTTKQGGLCGGWPTVNLEARGASGNRLPGDVIDYQASKGNWNTVEASGNRLPACVIDYTEEWVTGNRLPVAMRQIVLRHS

SEQ ID NO: 161323 - protein, 624 aa, Glycine max
  Coding DNA Sequence Number=SeqID_69638
  Homolog annotation: Hit_ID=A6EIG7; Match level="QueryCoverage=95%, HitCoverage=77%, E-value=2e-52, Identity=26%"; Hit description =Putative uncharacterized protein
MVKVAEYIPDALMKKVSSKAIKTYGWIPESELLLWNSSLKDEKTGYPVRVAVVPSNSDVIRSAERYYKNDSIMVFNSPSLIENANVKIPNGQIVYVYKQAENNKRFLVGKKPNIDIDSISTGLYGWVSSNVISAWGERSAVKMKNTTGVTETALGLHEGAPGGSDAASRTAILLTDVNKRTPLENIYPVKLALKEAPTPDSKTKYFTNILDYSKNYVLNVLGEPIYFDRYREITERNKNINIVFALDISAPNALYAPIVKNNSCGDNVAVSSLNADYSKIISFIEDKINEMNCPTNSGYQPVSEGLTAAGNLLSAVPDETNLVITVGTSANQSGNMYGVINSLTQAQARLIMFQTSSRSSDTYNDFVLLGQNVVSNTAKNIAELKKQKIINQNDVLTKNNFNLVEGDEGFFSLDYPKQSMSQGFVIFPKKGDVTTPGYLKKSVDSLISQVTMDNMSIDNSLNAYFHSSVGAGRTDVDLKYKYLYPGLTNRVPAGIAAQLINYGSPFLVKGYVPKDLKDYKPGLEKGILISETEYDNLKAFYREVYEKTGPARADFNQSKAIKEYVRLVKKYNPTTTFIDKGDLYEQPMSYAVGLTTGFDLSEEELMSKYKLKGWRKSKIVLNET

SEQ ID NO: 161324 - protein, 46 aa, Glycine max
  Coding DNA Sequence Number=SeqID_69639
MSGGKCESRLYNDRCRLKAQVEKDEGPSGQGQSPQVEKDECSSGDG

SEQ ID NO: 161325 - protein, 235 aa, Glycine max
  Coding DNA Sequence Number=SeqID_69640
  Gene Ontology: Mol. function=hydrolase activity, acting on carbon -nitrogen (but not peptide) bonds
  Homolog annotation: Hit_ID=UPI00006DBC1C; Match level="QueryCoverage =82%, HitCoverage=43%, E-value=2e-83, Identity=77%"; Hit description =COG0402: Cytosine deaminase and related metal-dependent hydrolases
MTVRRTLFKGGTILTLDASVPDLVCGDVLIEDDRIAAVGENLSADDAQVIDACGHIVMPGLVDAHHHMWLGAMRRLMPNVDDLFAYIDVVAETLGAHYRPLDMYLSTRLTALACLDAGITTVIDACHSSRSPAHTDAALDALQESGIRALHMVGAAMDKQASSDHLPGDLARLASRWNHAGSRVQVGLFGQLNLACCRRSLPNPACWVRTTFSITVRAYRRTSGSSWRTRASTLP

SEQ ID NO: 161326 - protein, 344 aa, Glycine max
  Coding DNA Sequence Number=SeqID_69641
  Gene Ontology: Mol. function=exopolyphosphatase activity; Cellular component=plasma membrane; Biological process=cell redox homeostasis
  Homolog annotation: Hit_ID=Q71RW6; Match level="QueryCoverage=92%, HitCoverage=62%, E-value=1e-160, Identity=89%"; Hit description =Exopolyphosphatase
  Pfam annotation: Domain name=Ppx-GppA; Domain location=1-248; Score =325.9; E_value=7.1e-95; Accession=PF02541.7; Description=PpxGppA phosphatase family
MERGLSCLALFAERLQGFSAANVTIVGTHTLRIASNAEEFLQRAAEVIPYPIEVISGNEEARLIFMGVEHTQPEKGRKLVIDIGGGSTELVIGEDFEPQLVESRRMGCVSFANLYFPKGEISQENFRRARLAAAQKLETLAWQYRLQGWQYALGASGSIKAACEVLMAMGEKEKRVTPENLDMLVSEVLKHKSFAALSLPGLSDERKAVFVPGLAILCGVFDALAIRELRLSDGALREGVLYEMEGRFRHQDIRSRTAQSLANHYAIDSDQARRVLETTEQLYSQWLEQNPKLANPQLTALMKWAALLHEVGLTINHSETVPADDLPAAARHPAEQSAPGHHAP

SEQ ID NO: 161327 - protein, 206 aa, Glycine max
  Coding DNA Sequence Number=SeqID_69642
  Gene Ontology: Mol. function=polyphosphate kinase activity; Cellular component=polyphosphate kinase complex; Biological process =polyphosphate biosynthetic process
  Homolog annotation: Hit_ID=Q71RW7; Match level="QueryCoverage=83%, HitCoverage=24%, E-value=4e-83, Identity=88%"; Hit description =Polyphosphate kinase
  Pfam annotation: Domain name=PP_kinase; Domain location=19-206; Score= -421.6; E_value=0.00035; Accession=PF02503.8; Description =Polyphosphate kinase
MVEDTERNRNFAFIPPDIPSSNSITESEWEAADKSNPLIERMRFLGIYSNNLEEFYKVRFADLKRRILIGEEQGTPTTLRHLLKKIQLRVQKSDQEFDALYNDLLLEMARNQIFLINERQLSPNQQEWLRYYFKHQLRQHVTPILINHDTDLIEFLKDDYTYLAVEIIRGEEIRYALLEIPSDKVPRFVNLPAESPRRRKAHDSAG

SEQ ID NO: 161328 - protein, 160 aa, Glycine max
  Coding DNA Sequence Number=SeqID_69643
  Homolog annotation: Hit_ID=Q1J7G7; Match level="QueryCoverage=20%, HitCoverage=60%, E-value=9e-07, Identity=66%"; Hit description =Transposase
  Subcellular localization annotation: CTP_CleavageSite=46; ConfidenceScore=5.28e-01
MVKVGTSYVPINVSFSPKVGPGLPAVPPVQLLTGWCVTAKAPPDISAGKCSGRVPFAIQAAQLLGRAIGAGLFAITPAGERGMCCKAIKLEGTSTWVVATENKRGYISCGSVQVEGTSTWLFKENKGGYIHLWIFACKGFYKVEKKSQGSQVAWGLDVGT

SEQ ID NO: 161329 - protein, 99 aa, Glycine max
  Coding DNA Sequence Number=SeqID_69644
  Subcellular localization annotation: CTP_CleavageSite=40; ConfidenceScore=5.23e-01
MASSSAKTMDRLKLLTFPFWRCLDSLTTLFPPPGTPTRFIASHSSKALFSKEKLNMQQGQACIPLVRFPDPNYGIKNCKFYNKLPSPIVSSPSVPLWVT

SEQ ID NO: 161330 - protein, 55 aa, Glycine max
  Coding DNA Sequence Number=SeqID_69645
  Gene Ontology: Mol. function=4 iron, 4 sulfur cluster binding; Cellular component=cytoplasm; Biological process=metabolic process
  Homolog annotation: Hit_ID=Q6YNR9; Match level="QueryCoverage=90%, HitCoverage=5%, E-value=6e-10, Identity=68%"; Hit description =Putative aconitase
MTGTDSNTTIIDGLGVAGWGVGGIEAEATMLGQPMSMVLQGVVGFKLLGKDVWVL

SEQ ID NO: 161331 - protein, 91 aa, Glycine max
  Coding DNA Sequence Number=SeqID_69646
MKVILSKPTRKGRKWYLNQTYQGNPCGVYPDLSSFTGSGVYPDLSSFIESGVYPDLSSLFGSGITKTSVACIKRSASPQVHITKALSKLER

SEQ ID NO: 161332 - protein, 135 aa, Glycine max
  Coding DNA Sequence Number=SeqID_69647
  Homolog annotation: Hit_ID=Q2HSQ4; Match level="QueryCoverage=28%, HitCoverage=40%, E-value=4e-07, Identity=68%"; Hit description=RNA -directed DNA polymerase ; Zinc finger, CCHC-type; Peptidase aspartic, catalytic, putative
MEFKGYASVWWNQVRRIKLRSLKRPPWQELHHYASLEDLIHQAIKVEQQVKRKQTYKKESGSSFKSHEKVLPLSQLMLAISYVEGLGSMIRMLSIMVSQTNFHLYKGKKVTLTPMSPSEVCEDQIKNETEERTRD

SEQ ID NO: 161333 - protein, 107 aa, Glycine max
  Coding DNA Sequence Number=SeqID_69648
  Subcellular localization annotation: CTP_CleavageSite=90; ConfidenceScore=5.07e-01
MPKFAAQLFKCSFDFQAQFDKIEAFQGLLTLSIWSFVVFYRPYTRQIGQRASTAKRSFSTLSMTRESGRAQGSRSRAKCEISLLSETFVPCQAQWTTSAKPKSTYSR

SEQ ID NO: 161334 - protein, 54 aa, Glycine max
  Coding DNA Sequence Number=SeqID_69649
MVRTEYRTLGELVLFGGLVRARSLSALMDRLAHISEFWLSACLSRLVDEVKRCT

SEQ ID NO: 161335 - protein, 132 aa, Glycine max
  Coding DNA Sequence Number=SeqID_69650
MDQRGHGMYYMPPTFSQYPSQMYQYPFEGHDTNMSASEHSYGGVAETHPHFSWPTMTHSQQHDAPMTTPNAPLAPQWNALICVTSFLLRLSNKGGDSGQEEILIVKLEGGIDHVAQAHAITDTIMTDFDVSI

SEQ ID NO: 161336 - protein, 56 aa, Glycine max
  Coding DNA Sequence Number=SeqID_69651
MVKEECKETLVSIATPLGLEVIPQVKEFLDEGLVRKSLNHCALLVPKIGIIRHQNP

SEQ ID NO: 161337 - protein, 48 aa, Glycine max
  Coding DNA Sequence Number=SeqID_69652
RDKVKKQKPIKVLRDGRKERLGSRPIGGHPLPSLGQTESAAAKHPNIL

SEQ ID NO: 161338 - protein, 173 aa, Glycine max
  Coding DNA Sequence Number=SeqID_69653
MKAPDEAMDLIESMAASDIAILRDRTHIPTKKSLLELTSQDALLAQNKFLSKKLETLTTTLRCTICGGAHESGCCIPNEEQMTHEVNYMGNQPRGNFNTSGFPGFQNNQQYQQQRQWQNHPGNQFNRDQCGSSTRPQQQMPNHYDRTTKLEETLAQFMQVSMSNQKSTESAIK

SEQ ID NO: 161339 - protein, 66 aa, Glycine max
  Coding DNA Sequence Number=SeqID_69654
MSTASCMVDMGKKILHMGIEDQKISFDFFQEDKDPPSQNVCLKVHVMEEKRPEKKVLEVGTLLDPG

SEQ ID NO: 161340 - protein, 137 aa, Glycine max
  Coding DNA Sequence Number=SeqID_69655
  Subcellular localization annotation: CTP_CleavageSite=74; ConfidenceScore=5.35e-01
MYPTLFSLNNLVDVPSTKTDPQEIYPLLFSVTTTQVDVPSTCTTKDVPSNVLRQSSQAVSPSKLCEGGNKRILRREESKEFSDCVVLNSLTREKGDTKEFRRLVLRSFGKGRRETQKEFRRLVLGEIFLAREKRMKR

SEQ ID NO: 161341 - protein, 216 aa, Glycine max
  Coding DNA Sequence Number=SeqID_69656
MDNEEGVQEQMKAELSALKDQMASITEAMLKLQKTIEDNATAVASNTTREAEPVLQPAINLGRDRNMMVFGRRYSPQAYPYGLPPDFTPPTAPDDLSQAPTFEGQLPPHADYPLQEDDEGDAHLGPLLPLKDPAPHELPQPNIVRHVPSPPAPVNEDDVSKRSSSHVLPKDGDIFYGRKVVDAFLSRQLSRSSSGMVYQSGSFLDPVMERLGNCLH

SEQ ID NO: 161342 - protein, 100 aa, Glycine max
  Coding DNA Sequence Number=SeqID_69657
MTRGNPGDLQPFDLEIDRTFHILVRHSVHPGHSMHFEHFEHPDHFEHYVAGDSEYSDFEHLAINFHTENMAQPPPREKTLKEMAAPDFTYESLCIQYPDE

SEQ ID NO: 161343 - protein, 120 aa, Glycine max
  Coding DNA Sequence Number=SeqID_69658
  Subcellular localization annotation: CTP_CleavageSite=20; ConfidenceScore=5.04e-01
MGGTKRLLVIIPKVVISLLMVSRVGTTSKNMLSKRKTLDEGSLSSSKSETQHDHRFTSTPYVPMDPVPSGVVNCRNLPFGGRATRGSWVCLPRKENARSCHQRLFEENVGKIEKGMVYEL

SEQ ID NO: 161344 - protein, 113 aa, Glycine max
  Coding DNA Sequence Number=SeqID_69659
  Gene Ontology: Mol. function=glycolipid transporter activity; Cellular component=cytoplasm; Biological process=glycolipid transport
  Homolog annotation: Hit_ID=A2X7D0; Match level="QueryCoverage=100%, HitCoverage=100%, E-value=7e-36, Identity=53%"; Hit description =Putative uncharacterized protein
  Pfam annotation: Domain name=GLTP; Domain location=10-109; Score= -12.7; E_value=2.8e-06; Accession=PF08718.2; Description=Glycolipid transfer protein (GLTP)
MEGTVFTPALEGIKLVKSEQGEILTQPFLDACKHILPVIDKFGAAMALVKSDIGGNISVAMKLAPDRKKFMEVIQGTGDISADIQKFCTDFSPIFEENHKFLARCGLDDMKAS

SEQ ID NO: 161345 - protein, 313 aa, Glycine max
  Coding DNA Sequence Number=SeqID_69660
  Gene Ontology: Cellular component=integral to membrane; Biological process=cellular response to phosphate starvation
  Homolog annotation: Hit_ID=A7NXF1; Match level="QueryCoverage=94%, HitCoverage=36%, E-value=3e-80, Identity=54%"; Hit description =Chromosome chr5 scaffold_2, whole genome shotgun sequence
  Pfam annotation: Domain name=SPX; Domain location=2-312; Score=32.7; E_value=1.7e-08; Accession=PF03105.10; Description=SPX domain
MVKFSKELEAQLIPEWKEAFVNYWQLKKQIKRIKLSRLPKQSHHHAKPDFGLSIFDSLSFFVKNIAQNFSTSDHHDLNIIQVRKKTTKGDEEEIYETELAQLFSEEDEIRVFFMRLDEELNKVNQFYRRQESEFIERGETLNKQLQILLDLKRIISDRRRKNSPSKPYSTGISPQYSPTRDSDYSGNFGDSDETNSEISHTDEVITTLERNGISFVNSATRTKTKKGKPKTAMRIDVPATNPTRAITAITSMLWEDLVNNPTGDFLHKRKLQCAEKIIRSAFVELYKGLGLLKTYSMNLQYLSVKTSKANLKL

SEQ ID NO: 161346 - protein, 80 aa, Glycine max
  Coding DNA Sequence Number=SeqID_69661
MSHHEDETPKNKSHKQEEHKMVKNTSSPYELNSNDNMRIGRGKRGIVRANVVYDGGTSADTRISEGDSSGPYFEDADWSK

SEQ ID NO: 161347 - protein, 103 aa, Glycine max
  Coding DNA Sequence Number=SeqID_69662
MNGNTRTYTDMETSCRNRTRSVAKLNGQQLWHTCKRLANGIKLHSPHDILQIQPTTRILKSVSELIAAIKNVAEVQESSFVVVALCQCLCGQCGCKECGNCGK

SEQ ID NO: 161348 - protein, 439 aa, Glycine max
  Coding DNA Sequence Number=SeqID_69663
  Gene Ontology: Mol. function=protein serine/threonine kinase activity; Cellular component=phragmoplast; Biological process =protein amino acid phosphorylation
  Homolog annotation: Hit_ID=Q53VE2; Match level="QueryCoverage=80%, HitCoverage=84%, E-value=1e-143, Identity=78%"; Hit description =Ser/Thr protein kinase
  Pfam annotation: Domain name=Pkinase; Domain location=115-305; Score =66.5; E_value=8.8e-17; Accession=PF00069.16; Description=Protein kinase domain
  Pfam annotation: Domain name=Pkinase_C; Domain location=323-352; Score=10.8; E_value=0.088; Accession=PF00433.15; Description=Protein kinase C terminal domain
  Pfam annotation: Domain name=Pkinase_Tyr; Domain location=115-313; Score=-81.3; E_value=2e-07; Accession=PF07714.8; Description=Protein tyrosine kinase
  Pfam module annotation: Pfam domain module=Pkinase::Pkinase _C::Pkinase_Tyr; Domain location=115-305::323-352::115-313
MDRCWFNKFKPKDKTPSSKNKETGIAKGSKPPTNDEAPSNVTKQKVAAAKQYIENHYKKQMQDLQERKERRNMLEKKLADAEVSEEEQNNLLKYFEKKEREYMRLKRHKMGADDFEPLTMIGKGAFGEVRVCREKATGHVYAMKKLKKSEMLRRGQVEHVKAERNLLAEVDSNCIVKLYYSFQDEEYLYLIMEYLPGGDMMTLLMRKDILTENEARDIKPDNLLLDRNGHMKLSDFGLCKPLDCSNLQEKDFSIGSNRSGALQSDGRPVAPKRSQQEQLQHWQKNRRMLRLGTKGADEIKAHPWFKGIEWDKLYQIKAAFIPEVNDELDTQNFEKFEEADNQTQPSSKSGPWRKQCGVTLGHYKEAVASWFSCAAVTTAIPEWQNGRNHGGVASLVLLAFGQGIGPPSAIKGFYFLACPFSLDGLSGSSAPAIAALVGY

SEQ ID NO: 161349 - protein, 479 aa, Glycine max
  Coding DNA Sequence Number=SeqID_69664
  Gene Ontology: Mol. function=protein serine/threonine kinase activity; Cellular component=cytoplasm; Biological process=protein amino acid phosphorylation
  Homolog annotation: Hit_ID=A7NXD5; Match level="QueryCoverage=100%, HitCoverage=100%, E-value=0.0, Identity=75%"; Hit description =Chromosome chr5 scaffold_2, whole genome shotgun sequence
  Pfam annotation: Domain name=Pkinase; Domain location=9-305; Score =113.1; E_value=8.3e-31; Accession=PF00069.16; Description=Protein kinase domain
  Pfam annotation: Domain name=Pkinase_Tyr; Domain location=9-300; Score=-140.5; E_value=0.00083; Accession=PF07714.8; Description =Protein tyrosine kinase
  Pfam module annotation: Pfam domain module=Pkinase::Pkinase_Tyr; Domain location=9-305::9-300
MDHVIGGKFKLGRKIGSGSFGELYLGVNVQSGEEVAVKLILCLLLLPCVTEKKGLFRITVELEMLLESVKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYLLMYFLRGSLPWQGLRAGTKKQKYDKISEKKMLTPIEVLCKSYPLEFTSYFHYCRTLRFEDKPDYSYLKRLFRDLFIREGYQFDYVFDWTMLKYPQIGSSSRARPSGKPVINPGQSGERIERPSGAVEAFARRNGSGLVLQSEHSRHRSSDDVPSSKDVQADSERPRSSSRNGSSSKKPVLSSSRPSSSGEPSESRTSRLVLSSGRLSTTQRLQPGFESKTSLSRASATRGGRDDTLRSFELLSLGSGKRK

SEQ ID NO: 161350 - protein, 217 aa, Glycine max
  Coding DNA Sequence Number=SeqID_69665
  Gene Ontology: Cellular component=nucleus; Biological process=cell division
  Homolog annotation: Hit_ID=A7NUY9; Match level="QueryCoverage=62%, HitCoverage=29%, E-value=2e-23, Identity=54%"; Hit description =Chromosome chr18 scaffold_1, whole genome shotgun sequence
  Subcellular localization annotation: CTP_CleavageSite=55; ConfidenceScore=5.23e-01
MVTQETRISVNNMVRVFRAPPEQPMAMPQPRANLIPYATQSMVATSQPFQGPGPSQSMLSASNNVAERAQLFAPPIHHREMEVTQMKQEHDKRQASLIAEHNEQLKHTQLQAEKELREKTMFMRNDHEAQIKALRCELEDECRKLEEELHLQKSKEDRQRALLQLQLKVMSDKPKEDQEVNSKQSIKGGGHPHPSNIGDLFSEGSLNPYAEDPYAFD

SEQ ID NO: 161351 - protein, 49 aa, Glycine max
  Coding DNA Sequence Number=SeqID_69666
MEKVKNLFSPHHLIYSLCPIPRNNNKHRGCPSILEGHNCNNSPYNRVDD

SEQ ID NO: 161352 - protein, 180 aa, Glycine max
  Coding DNA Sequence Number=SeqID_69667
  Homolog annotation: Hit_ID=A7NX15; Match level="QueryCoverage=83%, HitCoverage=30%, E-value=1e-38, Identity=57%"; Hit description =Chromosome chr5 scaffold_2, whole genome shotgun sequence
MQLQDGSVGKVINNLSQVLARVVGDQSIFPHLHKKDHSAHVIEKFSHYVGRQMGFLESEVPAELCRLADEYLIKPKECVESILEYLAHQKDPTTLCQKLIDEFDRCILSYFAFNWNQASYMISQVLSVESPQKIRLKKILLEATREQRFERVTKNLKVARVFSTLVEEMKAIKVDSQKTT

SEQ ID NO: 161353 - protein, 349 aa, Glycine max
  Coding DNA Sequence Number=SeqID_69668
  Gene Ontology: Mol. function=DNA-directed RNA polymerase activity; Cellular component=nucleus; Biological process=transcription
  Homolog annotation: Hit_ID=A9PGH2; Match level="QueryCoverage=46%, HitCoverage=93%, E-value=5e-70, Identity=79%"; Hit description =Putative uncharacterized protein
  Pfam annotation: Domain name=RNA_pol_Rpb7_N; Domain location=8-81; Score=40.9; E_value=4.6e-09; Accession=PF03876.8; Description=RNA polymerase Rpb7, N-terminal domain
MFLKVQLHWNVIIAAENLQPEGLMLHRAIIVRLLSDFAVKKATKDLGYFLAVTTLEKIGEGKVRQHTGDVLFPVVFNVITFKFFKGEILEGVVHKVLKHGVFMRCGPIENVYLSNLKMPDYRYVPGENACFMNDKMSKIGKDVTVRFSVIGTKWMEAEREFQALSVDVSSDVVVFDPFDAVPVAGNEMDLIPNPNANPKQPAFCLKWPWNDANHNSNSNPSPCNFEGPWLFKSLQNVGLIAFNFASSFSSRKKKTSPAAASSSEAEQRAFASALASGKEATLVEFYSPKCRLCNSLLKFVSEVETRNSNWLNIVMADAENPNWLPEFFLGLSKNPRDILSTSDVVTVTD

SEQ ID NO: 161354 - protein, 356 aa, Glycine max
  Coding DNA Sequence Number=SeqID_69669
  Gene Ontology: Mol. function=ATP binding; Cellular component=integral to membrane; Biological process=dicarboxylic acid transport
  Homolog annotation: Hit_ID=A7Q9L4; Match level="QueryCoverage=89%, HitCoverage=96%, E-value=1e-125, Identity=73%"; Hit description =Chromosome chr5 scaffold_67, whole genome shotgun sequence
  Pfam annotation: Domain name=DUF140; Domain location=98-345; Score =285.5; E_value=1.1e-82; Accession=PF02405.7; Description=Domain of unknown function DUF140
  Subcellular localization annotation: CTP_CleavageSite=31; ConfidenceScore=5.48e-01
MQTTSYSHPLFCFSCRNISTNGKSKGSVKFRAPYPSQLGRKCGFNGRPRVYISPSPIKPNRLYVLHNTGDNHPSAFSVDDEMNTNHAPNGMSPTFLSNWSPPRYLWRGLSVLILAGQVVVKTLKGKIHWRNTLQQLERVGPKSVGVCLLTSAFVGMAFTIQFVREFTRLGLNRSVGGVLALAFSRELSPVVTAIVVAGRIGSAFAAELGTMQVSEQTDTLRVLGSDPVDYLVTPRVLATCIALPLLTLLCFTLGMASSALLADGVYGLSINIIMDSAQRALRSWDIISAMIKSQVFGAIISIVSCAWGVTTLGGAKGVGESTTSAVVISLVGIFIADFALSYVFFQGAGDQLKNCV

SEQ ID NO: 161355 - protein, 1021 aa, Glycine max
  Coding DNA Sequence Number=SeqID_69670
  Gene Ontology: Mol. function=chitin binding; Cellular component =extracellular region; Biological process=chitin metabolic process
  Homolog annotation: Hit_ID=A5B1U9; Match level="QueryCoverage=86%, HitCoverage=67%, E-value=0.0, Identity=45%"; Hit description =Putative uncharacterized protein
MCLEILVYKFPDVPPMDRQPSVDNQDNIQGQFPHHMFPPWPVHSPPGSVPVLPPYPVQGIPYYPAYPGSSPFMQPNYSPMEDPRLIAGQNNGRRRHSMDSRHSNTESETQDEVDMEREGSHTGDQQKKDRQSGRQKSGVVVIRNINYITMAENSGSGSYSDSASETGEDNKESVKTSKRREPGKESLKKLDSSDKEETKHGKDADGGHWQAFQNCLLRDVDEDRHVIDQDQYDQEKVNDVRRKKHIAVNDPLVFNDREMHEVQGSSAIDMHNISKGLAHMPKTSSDDLLLSASAGQSGDGWSGDDVQSLEVTGKKGGYRRASRDEFIISKQEHQFGNAYPSSDIETSLGCSNSKLERKLFHDMNDDSYILEHRSMGVNDAGNVERNAINMDSEIPMVQQSSDEINHINYEPDELSMLPERGAERGSMSYDPALDYEMQAQAGGTLQNKNKEVVTDTKPGSKRLDKEAKSKLTSNNSDKRKTGGPIRRGKTSKLNPLDEARARAESLRNYKADLQKMKKENEEEEMKRLEALKMKRQKRIAAKSSAITAQSPSQLTKKQLPTKLSPSSHKGSKFCDSEPGESSPLQRFPVRTASVGSNDSLKASKTSRLISRSHLDNNKLSRSVSSLPESKLEKDDNTTDTKASMARIRRLSEPKISTTHQTSSVKPHGTGTISKTKAADGPESKKISAIVNHDKSKTAALPELKIRTSKATEVPQNRTTVKEKAHKLNDNKSSMNSQGTMLKKNEIGTSFNDDGDNNPVVEKTVVMLEREKPYVPPIHSSEENFDIPKKQYDNDEVMEKTETASNYVAIRAPVSPLSMDIIDKETSERQSHLQPISTEVKIDNIEKETSKSSSLCIAAETYHAPYARVSSMEDPSTRNSEYGKAAPPSLETAAIGVETVKVHVSNNENSTLEKIPEAIEKPLVKESSSKGFRRLLKFGKRSHSLASERNMESDNVSIDNEADEVGTNGSSNEALTFSEGQTCDSRAEVQPIMLNLAILNEFGDNPAQASTMLKSKIKHTKF

SEQ ID NO: 161356 - protein, 121 aa, Glycine max
  Coding DNA Sequence Number=SeqID_69671
MARVTLGRRDHNWKCVRKGSRMRRHAPWIAAVWLVKGAVRENSDGDVSDRFEESSAGNGLKEVEPDASGSPKKMKIIARDNGSIEVPLLGSRYPVSEYSTGLSLYRLIALVTNKWRIFDFL

SEQ ID NO: 161357 - protein, 170 aa, Glycine max
  Coding DNA Sequence Number=SeqID_69672
  Gene Ontology: Mol. function=serine-type endopeptidase inhibitor activity; Cellular component=periplasmic space
  Homolog annotation: Hit_ID=A8GCA1; Match level="QueryCoverage=100%, HitCoverage=100%, E-value=4e-85, Identity=90%"; Hit description =Ecotin precursor
  Pfam annotation: Domain name=Ecotin; Domain location=8-168; Score =290.5; E_value=3.2e-84; Accession=PF03974.4; Description=Ecotin
MNKASVVFSGLLMAVSAGAMAATSGDDVDISKQPLEKVAPYPKAEKGMNRQVIYLPKQEHEENYKVELLIGKTLEVDCNRHMIGGTLETKTLSGWGYDYLVLEKLSEPASTMMGCPDNTKTKQFIAANLGDAAMQRYNSRLPIVVYVPKDAEVKYRIWKAEDTVSQAEQK

SEQ ID NO: 161358 - protein, 196 aa, Glycine max
  Coding DNA Sequence Number=SeqID_69673
  Gene Ontology: Mol. function=4 iron, 4 sulfur cluster binding; Biological process=gluconeogenesis
  Homolog annotation: Hit_ID=A8GC93; Match level="QueryCoverage=100%, HitCoverage=43%, E-value=1e-104, Identity=95%"; Hit description=L -serine dehydratase 1
  Pfam annotation: Domain name=SDH_alpha; Domain location=1-191; Score =387.6; E_value=1.9e-113; Accession=PF03313.6; Description=Serine dehydratase alpha chain
MVDWINMFALAVNEENAAGGRVVTAPTNGACGIIPAVLAYYDKFIRPVNANSYTRYFLASGVIGALYKMNASISGAEVGCQGEVGVACSMAAAGLTELLGGSPAQVCIAAEIAMEHHLGLTCDPLAGQVQVPCIERNAISAVKAVNAARMAMRRTSEPRVCLDKVIETMYETGKDMNAKYRETSQGGLAIKVVACN

SEQ ID NO: 161359 - protein, 99 aa, Glycine max
  Coding DNA Sequence Number=SeqID_69674
MSSSQSISINTQVLCNIYTKTQSYMQCGTMLVKNHVGCLRVHDKTNHTLGDQSGLRYFVRMLQPYGINIGLKENSNWVTRKTYTPKSLSEPLPPDSGPT

SEQ ID NO: 161360 - protein, 45 aa, Glycine max
  Coding DNA Sequence Number=SeqID_69675
MPPAEVSSIKKGPITRTMSKRLQEDWARAAEEGPRVLMNLRGSIL

SEQ ID NO: 161361 - protein, 415 aa, Glycine max
  Coding DNA Sequence Number=SeqID_69676
  Gene Ontology: Mol. function=helicase activity; Biological process =viral genome replication
  Homolog annotation: Hit_ID=A2Q378; Match level="QueryCoverage=99%, HitCoverage=25%, E-value=1e-103, Identity=45%"; Hit description =Putative uncharacterized protein
MVHGPCGILRPASPRMKEGKCSRFYPKKFQLTTLIDGDGYPVDRRRNTGQTITKNEIIIDNRCIVPYNPKLLKKYQAHINIEWCNQNTSIKYLFKYINKGYDKVTAVMVHDDTRTVPHANTLNDEIKEYLDCIYISPCESTWRIFGFPIHGRKPSIERLQFHLPRQHSVLYQDHDDIDDLLSNPSISKSKFIAWMNANQAFVEGQSLTYSEFVTKFMYNQKQRCWQLRKKGYTIGRLQWVPQTTGEIFYLRMMLTVSRGPISFEDIRTVAGVEYPTYRETCFAIGFLQDDREFIASINEAKDWGSTPYLKNLFVLLLLIGTMNKPEQVWGKTWHCLSDDILYSHRRSTSTPGLHIDDCNLMNLVLLEFERLLQANQRSLKDYPCMPYPENANLLTHADNGLILSELNFNNEELRS

SEQ ID NO: 161362 - protein, 190 aa, Glycine max
  Coding DNA Sequence Number=SeqID_69677
MAPKKLSAKRSRRDTADEGTSAAPEFDSHHFRSTEHQQCFEVIKGWSFHRERRVQLRHDEYTDFQEEIARRHWTSLVTPMAKFDPYIVLEFYANAWPTEEGVQDMRSWVRGQWIPFDADALGQFLGDPLVLEEGQECEFSQRRNMADGFDEEAIAQLLCIPGQDFARTAAGRAGAGSCAPSMTTLKPKCG

SEQ ID NO: 161363 - protein, 80 aa, Glycine max
  Coding DNA Sequence Number=SeqID_69678
MRDWGNFLHRILEEDSKDYALITLFFLISLRELVLLSGRPIFVLSTTIRTECNSLCTNSRSAQFPLGLELRLARSSHLAR

SEQ ID NO: 161364 - protein, 97 aa, Glycine max
  Coding DNA Sequence Number=SeqID_69679
  Homolog annotation: Hit_ID=Q949K8; Match level="QueryCoverage=75%, HitCoverage=33%, E-value=2e-08, Identity=36%"; Hit description=Gag polyprotein
MAGRGRDQNRDVQDRITTVLETLVQGRDVEPTEYRGLMAFPETEKIFEAIGCLEEHKVPYATFMLQGEAENWWKFVRPTFAAPRGVIPWNAFKDKFL

SEQ ID NO: 161365 - protein, 97 aa, Glycine max
  Coding DNA Sequence Number=SeqID_69680
MKLKSGEPLKHIPWKKRPKESYPTDRIIPQNTNDGKIRTKFYVPEPVFQKTEDLADDYSSLNRDWEDYNAQLMEDLLHKKRYRYHHLVYGSLTRSEA

SEQ ID NO: 161366 - protein, 79 aa, Glycine max
  Coding DNA Sequence Number=SeqID_69681
MAIIVNAEACGYVSMNYYQYIDVVYTNEHILKAYSAQWWPLGNETAIPPSDEAWTLIPDPTTIRAKGRPKSTRIRNEMD

SEQ ID NO: 161367 - protein, 94 aa, Glycine max
  Coding DNA Sequence Number=SeqID_69682
MYKQNQKDFLRFVVRLGYKNLLVVYTPNKDVNNSAPILIEIRQPQTNHAHVSQPIGETHEMPLHNLADFEPCLGYATEGQAVGGIPLQNTFEGP

SEQ ID NO: 161368 - protein, 96 aa, Glycine max
  Coding DNA Sequence Number=SeqID_69683
MMISKNTSRFKRKFDFKNQESRFMVQASKNQDQDSRIKRRINQDKGYIYLGLTENKRGYISCGSILVEGTSTRLFKENKGGYIPCGSLLVKGFLQG

SEQ ID NO: 161369 - protein, 98 aa, Glycine max
  Coding DNA Sequence Number=SeqID_69684
LKVVSEESFEAPEEDEEVQVLKNELGKARLAKEKFKLAATDIRKESVGLREENATTARALEQETKRARKEEYGRNKFHGALWGSNSELKLRREERDQS

SEQ ID NO: 161370 - protein, 151 aa, Glycine max
  Coding DNA Sequence Number=SeqID_69685
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=100%, HitCoverage=40%, E-value=2e-76, Identity=85%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTGTGQLNGIPVAIGIMDFQFMGGSMGSAVGARMQEGSLSLIQMAKISSALYDYQKNKKLFYVSILTSPTTGGVTASFGMLGDIIIAEPNAYIAFA

SEQ ID NO: 161371 - protein, 212 aa, Glycine max
  Coding DNA Sequence Number=SeqID_69686
MELIENMGASDHAILRDRTHVLTKRSLLELSSQDAILAQNKLLAKQLESLTETLSKLPTQLQVAQPFHSAVMQVGGCSICGGPHESGCCIPLDDVAKEGQGWRSHPRNQFNKDQGGQSTKPQNQGPNMYERTTKQEETLAQFMQVSMSNHKSTESAIKNLEIQVGQLAKQIAENSSGGFGANTEKIPKKNELVADGEKEKEEDQMKEKKNKG

SEQ ID NO: 161372 - protein, 62 aa, Glycine max
  Coding DNA Sequence Number=SeqID_69687
MPMCMDSSSHRPYKDLGNRNLNQKVILRTRCKNSKRDSYLGAYLNGAHWQMVIILPQKNVVI

SEQ ID NO: 161373 - protein, 104 aa, Glycine max
  Coding DNA Sequence Number=SeqID_69688
MASMMEAMLGMRQLIEKNLATATTVSLAAEADPTLQATAHHPPPNAVGRGRSTLGHNSNPHFGYNRVAYPYGLPPNYTPPVMQDDAGHISSPILEGEPPRQPDE

SEQ ID NO: 161374 - protein, 110 aa, Glycine max
  Coding DNA Sequence Number=SeqID_69689
MESGDMRGYRMVIRTFRQPGANEPVDAQRLSSSSAPFVILTHGVRWHVGVPYGFYSSRRETCKLDDTQDFSLLGGGQSSSMAWGSVVVVPLYRFQDTEVLLTHLIPFLSF

SEQ ID NO: 161375 - protein, 138 aa, Glycine max
  Coding DNA Sequence Number=SeqID_69690
MVAGNATIEKPREQWDEEERKKGMDEYFRVSNYKNAKEMWDTLQVTYEGTTDEHEMELMRLNQHKENDKKKKGITLKASSSIQEGSDKEDLNDIEEDDDFSFFVKRFNKFLRNKGKQRKIKLQIKEKKRRFIFCSKVL

SEQ ID NO: 161376 - protein, 95 aa, Glycine max
  Coding DNA Sequence Number=SeqID_69691
MKAQVEKDEGPEAETLSRLLIVAETYQGNPCGVYPDLSSFTGSGVYPDLSSFTGSGVYPDLSSFTGSGVIQTFVACIKRSAPTQVHIIWYQSFDS

SEQ ID NO: 161377 - protein, 217 aa, Glycine max
  Coding DNA Sequence Number=SeqID_69692
MATMMEAMMSMKKIMEVNAVTIAATSTVAKVNPTSPFDINQMNHPTSAMAFPPYGLPPNYTPPNVAYTPSENVNNSTPILIESGQPQTDHAHVSQPMGETHEMPHHNLVDFEPCLEYATEGQAIGGIPLQNPLEGPQYHPQLHLLHYTTSKNPHAMAEMGKLDHLEERLRAIEGGEDYAFANLGELFLVPNIITPPKFKVLDFDKYKGTTCPKNHLK

SEQ ID NO: 161378 - protein, 114 aa, Glycine max
  Coding DNA Sequence Number=SeqID_69693
MDICEDTDILVILGRPFMLTASCIVDMDKPAPEQNVCLQVMEGGQEVLKLRKHLLKNSPFAKCKPRAKRIFVHALNRDSQALSAQPLHLRLIWSAKLAKAELSQLQFDLNSTKL

SEQ ID NO: 161379 - protein, 124 aa, Glycine max
  Coding DNA Sequence Number=SeqID_69694
  Subcellular localization annotation: CTP_CleavageSite=68; ConfidenceScore=5.74e-01
MTLSSWQNKLNRLVATPLSSHPPPPSPPPPTEAASQLSSTLKQTRKATRLRSLATRPARAYRPMVHVDPSTGKADNPHKKKLRTYLGIVACDKVDVTYENWKQVHAAQKDLIWEDIQAEFDIPD

SEQ ID NO: 161380 - protein, 243 aa, Glycine max
  Coding DNA Sequence Number=SeqID_69695
  Gene Ontology: Mol. function=motor activity; Cellular component=cell projection
  Homolog annotation: Hit_ID=UPI00016621D1; Match level="QueryCoverage =64%, HitCoverage=40%, E-value=4e-17, Identity=37%"; Hit description =UPI00016621D1 related cluster
MHVLAFRGLHTLTFRGLHVLTFRGLDPLIFRGLHVLAFRGLHVFTFRGLHVLTFRGLHPLIFRGLHILTFSGLHALAFRGLHVLAIKGLHVLTFRGLHVLTFRGLHVLTFRGLHPVIFRGLHVLAFRGLHAFTFSGLHVLTFRGLHPLIFRGLHILTFRGRHTPPSKGCTSSPSEDYVSSPSEGCTPSPLEDCMFSPSEGCTPSPSEDYLSSPSEDCTSSPSKDYTSSPSEDFTPSPSKGDTS

SEQ ID NO: 161381 - protein, 195 aa, Glycine max
  Coding DNA Sequence Number=SeqID_69696
  Subcellular localization annotation: CTP_CleavageSite=25; ConfidenceScore=5.27e-01
GSHPQDTQWTRKSPTGPWGFRLWLRASVSPTGCPSPQQGIAPTRHPVDPEKSNRVLGFPALITGLFQFYGVPVAPSKVIRPPTNRAFIKKARHHSSLGMTGSGNICTAATFRAPQLIYEGWSVVYNPWPTNVKEALLGGNLELATKKLPAKRSRIPVWPHKPTQALTNTDSKTWNINSVSRPSKDGHSLDRDKGS

SEQ ID NO: 161382 - protein, 111 aa, Glycine max
  Coding DNA Sequence Number=SeqID_69697
MSILTLGSKRKKIPNQKKGNSQSKSGRKQKEMKFPIKEWEKAKRKERKFPIKEWEKAKRKERKFPIKEWEKEKREEGGKKAPDRGSKEKQKKYAERSLDRTISEQYRIVTK

SEQ ID NO: 161383 - protein, 113 aa, Glycine max
  Coding DNA Sequence Number=SeqID_69698
MRDLRMKLSIIVVLLSCMQRRSTASGLIPIDLDINATCRRRNSERIKFFLQNLEATTTPEEEPQSSEASSSFPIVGHFHIEPVEDPIMAEEPRRVTLEDYSSSIVPQFFTSIV

SEQ ID NO: 161384 - protein, 92 aa, Glycine max
  Coding DNA Sequence Number=SeqID_69699
MAKVDKSCRNAVLQLLLTGETNNEEKKLDLGVLGSDMDKDDILWANLVGDDNNEGEKEETNMETKSKCFRCSSFRIDVLDQNEVVTTMMEYP

SEQ ID NO: 161385 - protein, 524 aa, Glycine max
  Coding DNA Sequence Number=SeqID_69700
  Gene Ontology: Mol. function=histone deacetylase activity; Cellular component=nucleus; Biological process=regulation of transcription, DNA-dependent
  Homolog annotation: Hit_ID=A9PFZ1; Match level="QueryCoverage=98%, HitCoverage=98%, E-value=0.0, Identity=79%"; Hit description =Putative uncharacterized protein
  Pfam annotation: Domain name=Hist_deacetyl; Domain location=18-329; Score=629.8; E_value=2.5e-186; Accession=PF00850.10; Description =Histone deacetylase family
MDTGGNSLPSAPDGVKRKVCYFYDPEVGNYYYGQGHPMKPHRIRMTHALLAHYGLLQHMQVHKPFPARDRDLCRFHADDYVAFLRSITPETQQDHLRQLKRFNVGEDCPVFDGLYSFCQTYAGGSVGGAVKLNHDQCDIAVNWAGGLHHAKKCEASGFCYVNDIVLAILELLKQHERVLYVDIDIHHGDGVEEAFYTTDRVMTVSFHKFGDYFPGTGDVRDIGYGKGKYYSLNVPLDDGIDDESYHFLFKPIIGKVMEVFRPGAVVLQCGADSLSGDRLGCFNLSIRGHAECVKYMRSFNVPLLLLGGGGYTIRNVARCWCYETGVALGIEVDDKMPQHEYYEYFGPDYTLHVAPSNMENKNSRHLLEEIRSKLLENLSKLQHAPSVQFQERPPDSDLGEDCEFDRNIVVLLIHYDPNVWARVGSYPADEDHDDGDEPWDPDSDMDVDVERELVSSKVKKEIAEPQPNDLEDQRSGEHLRDSDTAVAETCMKALDISSQKADEDNVKVEQNTVNDLAKETDLKG

SEQ ID NO: 161386 - protein, 189 aa, Glycine max
  Coding DNA Sequence Number=SeqID_69701
  Gene Ontology: Mol. function=metal ion binding; Biological process =metal ion transport
  Homolog annotation: Hit_ID=A9PI31; Match level="QueryCoverage=81%, HitCoverage=100%, E-value=2e-71, Identity=82%"; Hit description =Putative uncharacterized protein
  Pfam annotation: Domain name=HMA; Domain location=65-126; Score=54.3; E_value=4.2e-13; Accession=PF00403.17; Description=Heavy-metal -associated domain
MINLGIWEELMDRCAVVPPPCPDSKSSDYDWNWVVMGALDHISELFDCSSGSSKHKKRKQLQTVEVKVKMDCEGCERKVRKAVEGMKGVNQVDVERKANKVTVVGYVEASKVVARIAHRTGKKAELWPYVPYDVVAHPYAPGVYDKKAPSGYVRNTDDPHYSHLARASSTEVRYTTAFSDENPSACVVM

SEQ ID NO: 161387 - protein, 401 aa, Glycine max
  Coding DNA Sequence Number=SeqID_69702
  Gene Ontology: Mol. function=metal ion binding; Cellular component =nucleus; Biological process=DNA replication
  Homolog annotation: Hit_ID=A7P8B3; Match level="QueryCoverage=68%, HitCoverage=94%, E-value=1e-101, Identity=67%"; Hit description =Chromosome chr3 scaffold_8, whole genome shotgun sequence
  Pfam annotation: Domain name=zf-primase; Domain location=210-240; Score=8.9; E_value=0.0035; Accession=PF09329.2; Description=Primase zinc finger
MTSHEEDLDLLLSLDERVAETPPSSPTISDDDDDELELPNQRERDKPDMSVFKSALQDCLPYDPPKPTNKPVINVDSHLEKFSGLRIRNQLLTPAELKEHFSDIRFVRLSVIKNSLVGDTVSGSWATVGVLTEKGTQKTSSTGKSYCIWKIGCLDETTVSLFLFGDAYQMNMQEQAGTVFALFNSTVRKDNAGNGFSLSIYSTRQIMKMGTSVDYGVCKGKRTDGMACTLKASEKYSSMRTELKGGNLRTAFRPMGYLKSEGIYLVDPLADKTNLKKSQPVKLLSVDGIRKALSINNNFYTSNAGKVTTASHSQGIRFLSEVAAKSDPKMKNKGSKFPNVQNKWTEKRKSSFPNVGSSPVIGNRQSGEKRIKPDGQVLADKTLKRIEKMIEIDLVSSDEDF

SEQ ID NO: 161388 - protein, 55 aa, Glycine max
  Coding DNA Sequence Number=SeqID_69703
  Gene Ontology: Mol. function=actin binding; Cellular component =intracellular
  Homolog annotation: Hit_ID=A9PD44; Match level="QueryCoverage=89%, HitCoverage=34%, E-value=3e-16, Identity=83%"; Hit description =Putative uncharacterized protein
MKVLFRSPTASRIRAKILYATSKDGLRRALDGISYELQATDPTEMGFDVIRDIAK

SEQ ID NO: 161389 - protein, 384 aa, Glycine max
  Coding DNA Sequence Number=SeqID_69704
  Homolog annotation: Hit_ID=Q2HVW1; Match level="QueryCoverage=26%, HitCoverage=43%, E-value=1e-07, Identity=31%"; Hit description =Putative uncharacterized protein
MELNEYERESGEAEWDTERACRERNRVWVGKGPRHNYDRKRYSQGAGLTGELNGSVRQREEEITNWRDATDIQSFYFTRFPEEMGEKDMWLKFKKWRDLREVFIARHRNRNGRRYDFVCFKGVEDVKLLERQLDNMVIGGLKLHANLLKHGRERTTDKKANSEVQSKVGMNRSRACVDGQEHNRNDAVLNIGDVRMFNQHTHQWTKPRSYANVLATGIRNVGKREIQGQKYQTLTTSHSSLQLNIPMEQVKRFSNTWVGRLRKLSAFDKLEDEFMWEAGPEVKPKYLGDDMVLLVGLNDTRAEELCNAEEDKGISLFHSLEKWNPGLRTGYRLVWILCWGVPLHAWDINNISKIAAVVGEVDDDAEELRKLDRARVLIKTPRRS

SEQ ID NO: 161390 - protein, 338 aa, Glycine max
  Coding DNA Sequence Number=SeqID_69705
  Homolog annotation: Hit_ID=A9PBG4; Match level="QueryCoverage=89%, HitCoverage=100%, E-value=3e-73, Identity=52%"; Hit description =Putative uncharacterized protein
MENWGDVQPNVPISKGDWEDMSSWKENRRQLEMIQQGIDSKFCEYSLGNCKMDLPNRDKQLTVAVKTALRDLQNDNKIMVPTSVGSSSFLKDKDPGTDSNRVSGTKRPLSDYPLNHQLQQSPSNNAANGHLVYVRRKSEAELSKGIAYENPSINAYCSHSRQLCCEEETAQPKSQIKEPPQLKEPKASCFPAFAPFPMASSMNSSGKPSVPISLGKSAKKLAPVESNYVTASSGPTTIGNPKGLKNLHWDERYQQLQMFLRKLDQSDREEYIQMLHSLSSVELSKHAVELEKRSIQLSLEEAKELQRVAVLNVLGKSVKNFKAPADYDECSDKLKTLS

SEQ ID NO: 161391 - protein, 64 aa, Glycine max
  Coding DNA Sequence Number=SeqID_69706
  Gene Ontology: Mol. function=hydrolase activity, acting on glycosyl bonds; Cellular component=vacuole; Biological process=polysaccharide catabolic process
  Homolog annotation: Hit_ID=A9PJS5; Match level="QueryCoverage=57%, HitCoverage=11%, E-value=7e-09, Identity=67%"; Hit description =Putative uncharacterized protein
MVKVKLGKENENEDEAGEKNVEDKKEYCGEGCQSRCGGPAGGDLSSIIPRSSFDQMLKHRNDLE

SEQ ID NO: 161392 - protein, 296 aa, Glycine max
  Coding DNA Sequence Number=SeqID_69707
  Gene Ontology: Mol. function=transporter activity; Cellular component= integral to membrane; Biological process=transport
  Homolog annotation: Hit_ID=Q5DVT5; Match level="QueryCoverage=92%, HitCoverage=100%, E-value=1e-146, Identity=90%"; Hit description =Plasma membrane intrinsic protein 2;5
  Pfam annotation: Domain name=MIP; Domain location=25-254; Score =459.9; E_value=3.4e-135; Accession=PF00230.11; Description=Major intrinsic protein
MSKEVSQQRKDYVDPPPAPLIDLAEIKLWSFYRALIAEFIATLLFLYVTVATVIGHKKQTGPCDGVGLLGIAWAFGGMIFVLVYCTAGISGGHINPAVTFGLFLARKVSLIRALFYMVAQCLGAICGVGLVKAFMKHSYNSLGGGANSVSAGYNKGSALGAEIIGTFVLVYTVFSATDPKRSARDSHIPVLAPLPIGFAVFMVHLATIPITGTGINPARSFGAAVIYNNGKVWDDHWIFWVGPFVGALAAAAYHQYILRAAAIKALGSFRSNPTNYGTDTQQKVIKQKAENLEEKK

SEQ ID NO: 161393 - protein, 439 aa, Glycine max
  Coding DNA Sequence Number=SeqID_69708
  Gene Ontology: Mol. function=phosphotransferase activity, alcohol group as acceptor; Cellular component=nucleus; Biological process =regulation of transcription, DNA-dependent
  Homolog annotation: Hit_ID=A5AT73; Match level="QueryCoverage=41%, HitCoverage=98%, E-value=2e-77, Identity=79%"; Hit description =Putative uncharacterized protein
  Pfam annotation: Domain name=Anti-silence; Domain location=258-403; Score=354.7; E_value=1.6e-103; Accession=PF04729.4; Description=Anti- silencing protein, ASF1-like
MLHPRPRKKSINTVNANNSARSTLESNKLVLNGFDVEEKNDGCYRAKPTKKRKSFNKRECSDPERIKIKMLDDFQKRNLDSRASTLDVYYGAQHNAQLNSVSVMHDGYYSSQPAITGLGQLHSVPSSGSHHEMQHSMQGPLQGQLTFRTPTVQGFFDLQDSLEAMVKCGKWRTFASGLWSLRNEEEVLTTTAYSCFWIVVGKVPDYDYDGLVSPNVSVLGVRPRRVVNVSVFSLQNPLPPTHRASSSSSVLCFVNSEMSAVNITNVTVLDNPASFLTPFQFEISYECLTALKDDLEWKLIYVGSAEDETYDQLLESVLVGPVNADPPDPSKIREEDIIGVTVLLLTCSYLGQEFIRVGYYVNNDYDDEQLREEPPPKVLIDRVQRNILSDKPRVTKFPINFHPENNENEEQLPPSEHPSETGEDPLAVVDRDPPDEKDS

SEQ ID NO: 161394 - protein, 80 aa, Glycine max
  Coding DNA Sequence Number=SeqID_69709
MPKSSPNMHVKQEVSTRVKPRLLCKQSMGQNTLNKIDDDGSNSHQGKGPITRTMSKRLQEDWARAAEEGPRVLMNLRVDF

SEQ ID NO: 161395 - protein, 110 aa, Glycine max
  Coding DNA Sequence Number=SeqID_69710
ENRGGACHPARPGELSSARRARLLPPKATAFWRNILEGPTFRMLWKLTDCVTILPFDFRHVTEFQGLHKMLHFDFRHVSELHELPNDGCQVPRSGQTKVACHQTMVTGRN

SEQ ID NO: 161396 - protein, 70 aa, Glycine max
  Coding DNA Sequence Number=SeqID_69711
  Subcellular localization annotation: CTP_CleavageSite=60; ConfidenceScore=5.22e-01
MWERLKSSVVFPVRQGCDSPWVRSGKVWANCSSPWGRLTRASSRSWSAFSFVDMNPHGTRADLGSSRIRP

SEQ ID NO: 161397 - protein, 139 aa, Glycine max
  Coding DNA Sequence Number=SeqID_69712
IAIKCSFTIPHLVTLFLQHFNIPLDSEPYVPTKRSFLISAAVIASFGYRKERDVSWVKKGDQPNVDEGHLPVGEDSSLLQSILDRFDGLQTYVGERFDALEQQVDMRFDEMDSRITKVEGDVTFIRTCFDLPPPPPPSS

SEQ ID NO: 161398 - protein, 120 aa, Glycine max
  Coding DNA Sequence Number=SeqID_69713
  Subcellular localization annotation: CTP_CleavageSite=38; ConfidenceScore=5.25e-01
MPSTSQGPKKGRMSSSKGPRTKLGYYPPDLPPSIGVPRGSQGAVLKKVLHRIAVQSSNFLVPGIKFPPQRHYFMTREKKVGCRFNLTLAEGAEVILKDNLPPNKVFLRWKPIPKKSPSKS

SEQ ID NO: 161399 - protein, 27 aa, Glycine max
  Coding DNA Sequence Number=SeqID_69714
MEDRVTTDQSSSLPGTGPAENVAARFK

SEQ ID NO: 161400 - protein, 96 aa, Glycine max
  Coding DNA Sequence Number=SeqID_69715
MWVQAIGLFAQVTCAPEFGLPRPFNQRLLVLHVGGGAGGPLGTSTLTFRGLHILTFKGLRVLAFRGLHVLPFRGLHAIAFKRLHALAFRGLCILIF

SEQ ID NO: 161401 - protein, 84 aa, Glycine max
  Coding DNA Sequence Number=SeqID_69716
MSGLSQRGRWKAALMRRYSSSKSQIWKESEGKRWEIWKRRKMTNHSSSRFSLKQRGRKGSKELKQRRFSLKQRGRKGSKEFYRE

SEQ ID NO: 161402 - protein, 67 aa, Glycine max
  Coding DNA Sequence Number=SeqID_69717
MESYQCFETLDSNQMLPHQRILDENSVEDDKEGRIGVGDAPVAPGRGVRVAATEVDEPLRFLDDSAI

SEQ ID NO: 161403 - protein, 140 aa, Glycine max
  Coding DNA Sequence Number=SeqID_69718
  Gene Ontology: Mol. function=acetyl-CoA C-acyltransferase activity; Cellular component=cytoplasm; Biological process=fatty acid metabolic process
  Homolog annotation: Hit_ID=A8G8D0; Match level="QueryCoverage=100%, HitCoverage=36%, E-value=5e-63, Identity=88%"; Hit description=3 -ketoacyl-CoA thiolase
  Pfam annotation: Domain name=Thiolase_C; Domain location=14-139; Score=281.5; E_value=1.7e-81; Accession=PF02803.9; Description =Thiolase, C-terminal domain
MLLMSESRAKALGLKARARIRSMAVVGCDPSIMGYGPVPASKLALKRAGLSVQDIDLFELNEAFAAQSLPCIKDLGLMDSIDDKINLNGGAIALGHPLGCSGSRISTTLLNNMERRDAQFGLATMCIGLGQGIATVFERV

SEQ ID NO: 161404 - protein, 374 aa, Glycine max
  Coding DNA Sequence Number=SeqID_69719
  Gene Ontology: Mol. function=porphobilinogen synthase activity; Cellular component=chloroplast; Biological process=tetrapyrrole biosynthetic process
  Homolog annotation: Hit_ID=Q6DAQ0; Match level="QueryCoverage=27%, HitCoverage=29%, E-value=2e-49, Identity=97%"; Hit description=Delta- aminolevulinic acid dehydratase
  Pfam annotation: Domain name=ALAD; Domain location=1-101; Score= -79.7; E_value=6e-13; Accession=PF00490.12; Description=Delta -aminolevulinic acid dehydratase
MDPANSDEALQEIAQDLQEGADMVMVKPGMPYLDVVRRVKDTFGVPTFAYQVSGEYAMHMAAIQNGWLQEQPAVMESLMCFKRAGADGVLTYFAKRVAQRLRAPFALHLLELSVVDALADLFVDQVQQQHGAGLAVRLGVDRLQPFEHAVDDQDGIPRLRGFRIDIGFAGVRAQLIDHLARDDARQRAEAHEVADAAGGADGGGVNALRVELHKQIVGKQGFADRDTLAAHDLFQRDDRAEAVYLLPFQMFLRPQQLTAASGYIVMQVSACNITYLYEYAAISEGSHTYRYGAVWQGVAPPAVTLFIVFDRGKINGAVSVEQRQAVWRSRAAGVCQKPTAGDDCASRHQIRRFYPLCADPLRLRPACAGAGANA

SEQ ID NO: 161405 - protein, 202 aa, Glycine max
  Coding DNA Sequence Number=SeqID_69720
  Homolog annotation: Hit_ID=A8ACY0; Match level="QueryCoverage=88%, HitCoverage=61%, E-value=2e-43, Identity=51%"; Hit description =Putative uncharacterized protein
MTTRGGHRRSAEEYHRNRFAANGKTGRVGDPLGERRLQQAAGGVHHDLHRFAFGVFHGLGVRDLLLGAVDDHPSHHAGTQALAGAHGQQRGGFHFIVHHAHRLPFFHRAFEAADHTAGVSVVTLLARIEGIGGGGHADVRGGAAGLGRFHQRGGAGEVRNRRELHRREVQAGAVEAYRRRGDQHVTDVDVCLNGAGGADAQE

SEQ ID NO: 161406 - protein, 76 aa, Glycine max
  Coding DNA Sequence Number=SeqID_69721
MALRKLASKRSRKDKAVEGTSSAPKYDSHRFRSAEHQQRFEAIKGWSFLRERRVRLRDDEYTAFQEEIVRRRWASL

SEQ ID NO: 161407 - protein, 79 aa, Glycine max
  Coding DNA Sequence Number=SeqID_69722
PNAVLVVLANAITGDSHYLLNLRLGPSATRVSTMGKLCQFLRDKQGVEGPAKPADRLDPDVNPIYVMTLTIPLVFLKPL

SEQ ID NO: 161408 - protein, 57 aa, Glycine max
  Coding DNA Sequence Number=SeqID_69723
MWCEQEVYMDYENEQECGVNEPYVDCSDAFNTSQASWETSAWRGRLDGEVDLWDSQS

SEQ ID NO: 161409 - protein, 271 aa, Glycine max
  Coding DNA Sequence Number=SeqID_69724
  Gene Ontology: Mol. function=motor activity; Cellular component=cell projection
  Homolog annotation: Hit_ID=UPI00016621D1; Match level="QueryCoverage =92%, HitCoverage=43%, E-value=2e-15, Identity=30%"; Hit description =UPI00016621D1 related cluster
MTPLPSLQKGLQHLMSYLLEFGMTVPFNESISFFLIRGLHVLTFRGLHTLTIRGLHVLTLRGLHVLAIRGLQALTIRGLQVLAIKGLHVLAIRGLHALTFRGLHALAFRELHVVTIRGLHALTFRGLHVLTFRGLHVLTIRGLHVLTIRGLHVLAIRGLHALTFRRLHTLTIKGMHVLTFRGLHVHNLRGYRGLHALTFGGRHVLAIRVLHVLALKGLHIFPFRGLHALAFRGLHTLAFRGLHTLTFRGLRVLTFSGLHICSFRELKVLNP

SEQ ID NO: 161410 - protein, 113 aa, Glycine max
  Coding DNA Sequence Number=SeqID_69725
MQNSKRDVYQGAYLNGPGNYLKGIINSALKGLDDTSQSKSKAAARWIVLKCNRQKGSTECGYYVIHWMSTIILGTFKNNWEMYFNDARPWEPERLKALCIQWTKFYLKVKNET

SEQ ID NO: 161411 - protein, 500 aa, Glycine max
  Coding DNA Sequence Number=SeqID_69726
  Gene Ontology: Mol. function=transporter activity; Cellular component= membrane; Biological process=transport
  Homolog annotation: Hit_ID=A7MFA5; Match level="QueryCoverage=95%, HitCoverage=70%, E-value=0.0, Identity=93%"; Hit description =Putative uncharacterized protein
  Pfam annotation: Domain name=BCCT; Domain location=16-484; Score =923.1; E_value=1.2e-274; Accession=PF02028.8; Description=BCCT family transporter
MINPPASEKDRINPVVFYTSAGLILTFSLVTILYSDLAAGWIQSAVNWVSSTFGWYYMLAATLYIVFVIYMACSRYGAIKLGPEQSKPEFSLLSWSAMLFAAGIGIDLMFFSVAEPVTQYMQPPEGAGQTLEAARQAMVWTLFHYGLTGWSMYALMGIALGYFSYRYNLPLTIRSALYPIFGKRINGPIGHTVDIAAVIGTIFGIATTLGIGVVQLNYGLKVLFDVPEGLTAQMALIVLSVVIATISVTSGVDKGIRILSELNVALALGLILFVLFMGKTDFLLNALVLNVGDYINRFMGMTLNTFAFDRPTQWMNSWTLFFWAWWVAWSPFVGLFLARISRGRTIREFVLGTLIIPFTFTLLWLSVFGNAALYEIIHGDAGFAQEVMAHAERGFYSLLAQYPAFKFSASVATITGMLFYVTSADSGSLVLGNFTSKLKDINSDAPNWLRIFWSVAIGVLTMGMLMTNGISALQNTTWKIIAAPAPAVIPRPIFRRAMIV

SEQ ID NO: 161412 - protein, 96 aa, Glycine max
  Coding DNA Sequence Number=SeqID_69727
  Subcellular localization annotation: CTP_CleavageSite=37; ConfidenceScore=5.25e-01
MRLRMPPDSWVTHFVSKQPFRGNTGSHKNRRKSLNVYQSHTGQGLTFSPWVKVYDKLGFWLKACRTAGHDICQGLASGSGIKGMFYIISMIHMQQW

SEQ ID NO: 161413 - protein, 106 aa, Glycine max
  Coding DNA Sequence Number=SeqID_69728
MAGTFFLLKQQNSLEIMSGTPQTTRSRDHEDKEWPRLYILLQLSSGPCRRPYPLDEQCEEVRLKPKRNVCFAKVPGLLASEISNLISQDISVLPDNIGWEIRRNPH

SEQ ID NO: 161414 - protein, 127 aa, Glycine max
  Coding DNA Sequence Number=SeqID_69729
MLWKLGRIDGDPALRGTRIRATWEYVSSVGGGQQGMVEWYLEICRGGQETLGTSGGVLLPKTKLDQSRPNPGIVSHQQIKGTKTTKQGGLCGGWPAMNLIDIWDMGSGNRLPRVGNRLQGLKMKTGG

SEQ ID NO: 161415 - protein, 108 aa, Glycine max
  Coding DNA Sequence Number=SeqID_69730
IFNLASSSSSNHYDVASAPLEDDLLWMQKNHISQHIWNGANDRMLKIQRATPLYNHREAPPDEIIPLLQVSSLYPIMKLAQLKATKKGLKDLLVLVDKSSSRVPMRYL

SEQ ID NO: 161416 - protein, 164 aa, Glycine max
  Coding DNA Sequence Number=SeqID_69731
  Homolog annotation: Hit_ID=A5AII0; Match level="QueryCoverage=56%, HitCoverage=55%, E-value=5e-09, Identity=38%"; Hit description =Putative uncharacterized protein
YILCGTSRGYIYLGLTENKRGYISCGSVLVEGTSTRFKENKGGSKKKSSKVRNFLLKLKLSIVNHLLGLGKTFEDDELNIKILNFLSSTWEPKIKVIKESKDLASMSMEALFEKLLAYEHEFIQQSGAEKTKKRNEKELHSKLNLQRKITKKVPVMMKIQRISA

SEQ ID NO: 161417 - protein, 36 aa, Glycine max
  Coding DNA Sequence Number=SeqID_69732
MTYEYDFVAWKTPFNGNGSEKAFHKEIQEGRRGRRD

SEQ ID NO: 161418 - protein, 208 aa, Glycine max
  Coding DNA Sequence Number=SeqID_69733
  Gene Ontology: Mol. function=intramolecular transferase activity, phosphotransferases; Cellular component=cytoplasm; Biological process=carbohydrate metabolic process
  Homolog annotation: Hit_ID=Q9SM60; Match level="QueryCoverage=94%, HitCoverage=33%, E-value=2e-99, Identity=89%"; Hit description =Phosphoglucomutase, cytoplasmic
  Pfam annotation: Domain name=PGM_PMM_II; Domain location=1-71; Score=- 11.3; E_value=0.0045; Accession=PF02879.7; Description=Phosphoglucomut asephosphomannomutase, alphabetaalpha domain II
  Pfam annotation: Domain name=PGM_PMM_III; Domain location=73-196; Score=115.2; E_value=2e-31; Accession=PF02880.7; Description =Phosphoglucomutasephosphomannomutase, alphabetaalpha domain III
  Pfam module annotation: Pfam domain module=PGM_PMM_II::PGM_PMM_III; Domain location=1-71::73-196
MSVVICLDLWMTCWIQEDFGGGHPDPNLTYAKELVARMGLGKSEPQDEPPEFGAASDGDADRNMVLGKRFFVTPLDSVAIIAANPVEAIPYFSAGLKGVARSMPTSAALDVVAKHLNLKFFEVPTGWKFFGNLMDARLCSVCGEESFGTGSGRIREKDGIWEVLAWLSILAYKNKDKLEDKLVTVEDIVRQHWATYGRHYYNQYDYEV

SEQ ID NO: 161419 - protein, 138 aa, Glycine max
  Coding DNA Sequence Number=SeqID_69734
MFSKKEGMMRIMKLAKYRLKAQVEKDEAPEWRRMKAQVEKDEGPEAETLSRLLIVAEGPNLSSFTGSGVYPDLSSFTGSGVYPDLSSLTGSGVYPDLSSFTGSGVIQIFVACIKRSAPTQVHISRPASVFKKKLRNVG

SEQ ID NO: 161420 - protein, 130 aa, Glycine max
  Coding DNA Sequence Number=SeqID_69735
MLVATSRIFLPWKTHKEGWCLQESIQRLPIKLDQLPSYSNLARKFFFWVVQIQIELVDRGHVNVTIFILGQGPVPVPPDQLPSKVIILSHKKIHVPLRKDVPGVNVLCVTSLCDLRNESCRIVWFLRSGG

SEQ ID NO: 161421 - protein, 158 aa, Glycine max
  Coding DNA Sequence Number=SeqID_69736
MELIENMAASDHAILRDRTHIPTKRSLLELSSLDAFLAQNKLLSKQLETLIETLSKLPTQLNVGGCTICGGAHESGPIDDTTHEVDTQVSNMSRITTSNKDNEELTQGTNSTKTRIDSRCFDDNKDDDKKFMRMISRLSQEQFKNQEKVSSRRFKIQE

SEQ ID NO: 161422 - protein, 106 aa, Glycine max
  Coding DNA Sequence Number=SeqID_69737
MLSRYPLHGINANFTLISATGVSLSLTHALSEYHPLSEASACLASKRNLEGNLPCKHALSVLSARPASHLSLQALSAPGSLSHCSLTRAKRAFEDRKPFLKPEVEN

SEQ ID NO: 161423 - protein, 310 aa, Glycine max
  Coding DNA Sequence Number=SeqID_69738
  Subcellular localization annotation: CTP_CleavageSite=26; ConfidenceScore=5.40e-01
MMPPSFPFTATRHESLPSVDFHHFVVAQSVNQSIASSFRRSFRKSFRKTEDLENVNNVAYEPHEEPYAQITEDVGGDSQGFSGVFHTFEAIDVEQVVDLSIELLELSRQYVKDEIDQCRRTYVRLVWLQDIYRSKCDARQCTVVAQAYLLHLVAVALVHMYDNLNVVSKHTTKHLVGYITLLRIYEHFPTIANIISNEDCHERKPHACHWKSRKALPMTSYRKRLNRLTSDAVSWIPDGDHRAFKEFELSIHPLPTALSLSIEEIDNRWLQFSQYLASVGEFCSFPSQCATSYMEWFYRISQPFMSLPQL

SEQ ID NO: 161424 - protein, 182 aa, Glycine max
  Coding DNA Sequence Number=SeqID_69739
  Subcellular localization annotation: CTP_CleavageSite=11; ConfidenceScore=5.39e-01
MPKSSPNMHVKQEAKSPTLFSLEDPAQFSLRLLPPRDSLTSSTPSSSSVSILVRPPDVAPTPSLPSTKARPSSSHVNAHGPSPVPASTPSPSSVDARGPSPVPTSTPSPSPPVSNLPIDEDVVNLVMEDPPLNNRPMVMLINGTFHPSKVVAKAVTLSIRKQFGQPWPTWGAIPKEHQELFF

SEQ ID NO: 161425 - protein, 249 aa, Glycine max
  Coding DNA Sequence Number=SeqID_69740
  Gene Ontology: Mol. function=nucleotide binding; Cellular component =mitochondrion; Biological process=cell division
  Homolog annotation: Hit_ID=A2Q1P0; Match level="QueryCoverage=92%, HitCoverage=55%, E-value=1e-100, Identity=81%"; Hit description =Dynamin central region; Dynamin
  Pfam annotation: Domain name=Dynamin_M; Domain location=117-249; Score=-110.5; E_value=0.00016; Accession=PF01031.11; Description =Dynamin central region
  Pfam annotation: Domain name=Dynamin_N; Domain location=3-108; Score =59.1; E_value=1.5e-14; Accession=PF00350.14; Description=Dynamin family
  Pfam module annotation: Pfam domain module=Dynamin_M::Dynamin_N; Domain location=117-249::3-108
MDGAKTDREVGGNKGVSNKQIRLKIFSPNVLDITLVDLPGITKVPVGDQPSDIEARIRTMIMSYIKTPTCLILVVTPANSDLANSDALQMAGITDPDGNRTIGVITKLDIMDRATDARNLLLGKVIPLRLGYVGVVNRSQEDIQMNRSIKDAVVAEENFFHNRPIRKFLCIVNSIQWFSNSCSVPQLAKKLNLILTQHIKAVLPGLRAHISTSLVAVVKEHASYGEITESKACVNTRMHLGCPYDLLDT

SEQ ID NO: 161426 - protein, 114 aa, Glycine max
  Coding DNA Sequence Number=SeqID_69741
MEKRLKPPLVLSSCDSVFSLHEYYLANPNGGKRKKLQCERYFSQLKHDIKIPNGENARNWAENVVLKFHDDQTVNESEIIIFLRQVRWPAGKRENFGGREKKRNCEVEETEESV

SEQ ID NO: 161427 - protein, 73 aa, Glycine max
  Coding DNA Sequence Number=SeqID_69742
MSRQQQDVEAKLHDDDKKLKDQSRKIQEFKIRIKKNSRLKKKVERQESRFKVQDLKNQDQDSRFKNDEKTQSR

SEQ ID NO: 161428 - protein, 144 aa, Glycine max
  Coding DNA Sequence Number=SeqID_69743
MQKYYHLVKQLLEHFVHKELAHVDRGQKDQANALARLVSTKRPSQHQTFIQETSPPPPSMLSRSSQAVEARKARHQASHYVIINNEMLRKFISRPLLKWIDENHMEYVLNKIDYAEYVKTYKECQEFDNVHHASSKALHSITSP

SEQ ID NO: 161429 - protein, 84 aa, Glycine max
  Coding DNA Sequence Number=SeqID_69744
MALGIMAACPGEFLLQPKVTLLTQASWRATGFRKRLEMTFLPLPLGIFCILDRNIEWSSVHAITSVQHRKSTSKDQQTIVPGQN

SEQ ID NO: 161430 - protein, 88 aa, Glycine max
  Coding DNA Sequence Number=SeqID_69745
MADVTCGPCNNAWPYPLLLQATPSLHMPRCTRHLQYLKVVGCRATRPTWALQKIPPEGCCFWRKQPCLPGRAELAWASWVASFSPNFL

SEQ ID NO: 161431 - protein, 171 aa, Glycine max
  Coding DNA Sequence Number=SeqID_69746
MTNVLTRVFLIFEKNRRVAPMKVQPIAIDIDSKKVKDTGGNSSGGGGSERVSAKVALEKLGLLGENGAEFHGGAATGAMLVMEEDEDEETLLVRVVARGDEDGGGCHVHTDLWWKDEEDEWVEAVGPGVDWGLDCEGGGGGEGGSGGDAVGGDDHREEQRWHGREEGEEDC

SEQ ID NO: 161432 - protein, 148 aa, Glycine max
  Coding DNA Sequence Number=SeqID_69747
MEPFNNKFDGMTTTVDIPMFIPMSFNPHQGMILNEIQAMVAPYMFGANKDNSIDGEEQIVRTAYSISANRQTRRTLKPNGLLDQEVNLVVRKMTSFERYMYGHGATWQFFWNKCFGIHPNRFINLSKPKFSTYTLEVLHDVGQQAFGS

SEQ ID NO: 161433 - protein, 147 aa, Glycine max
  Coding DNA Sequence Number=SeqID_69748
  Subcellular localization annotation: CTP_CleavageSite=24; ConfidenceScore=5.16e-01
MQKMPKRRGKRVFSLSFLDPSSPRLASGLPRPSNDFKLKEPAHLGEPITLGVSLSSLGRAAMVPSTLFSINRREGELRKGFQGLEGEGIERREKEEEEEERKGNNAEALPNRDCDQSLHRSLFGVLRAIVGVPLVIMCTFIFSIYHR

SEQ ID NO: 161434 - protein, 144 aa, Glycine max
  Coding DNA Sequence Number=SeqID_69749
MVMQSYPLRALDKRLQEDWARDARKGPRVMAIKAGHVELHVRAANRRGRWVKRRGNLTLGEAIDGLLQSVGGDLPSMVLRHIGGRNQLVGYCICTSRIFLEVIGPLCDSLWPINVVASFCNLAMHEVKTLALSDIKGHVAFFNI

SEQ ID NO: 161435 - protein, 242 aa, Glycine max
  Coding DNA Sequence Number=SeqID_69750
  Subcellular localization annotation: CTP_CleavageSite=41; ConfidenceScore=5.06e-01
MSRRSGDLGDVRWGAIAQNQAWLIPTQPRHSQSVRTCDVPKQASSWQSTNKRTKSTKQGSLCGGWPAMYLGWYLEISLWGDKTLVIDYQLGVIDYTVLPATAQLIHDRVVMECLEGVWETLEGNERCRFRGTIRLTATSLVHPEEPARTLQQPVEWILPTPTPYRLVEPVQVIEVSSSEEDLEEDPEELPPEPAMDTLDLPEDDEDPLPDVDSLEDIMSASEADSTEESGPGGTTNSDDSSS

SEQ ID NO: 161436 - protein, 636 aa, Glycine max
  Coding DNA Sequence Number=SeqID_69751
  Homolog annotation: Hit_ID=A5AFE7; Match level="QueryCoverage=20%, HitCoverage=13%, E-value=4e-10, Identity=36%"; Hit description =Putative uncharacterized protein
MQVNYVVIIAICCNQKLLEDEVEMPDFNGGEVVANSTDEENNSADGDNTVLSTRQLQKYGPRSVRNEQVRNRKRISEALLHSKESASASHATCSKANTSGIWKAKPRFSLASVLRKSGDIGHSISNIESLPEIVKAVDPRASANLDGNHLEDDDRIEINSDIAPAETEAFPHGFNLAPMADLFYNLQDKADQGKPVLEMEEAQIWAKKVELPAFMGGQTQLVGMPGLKNSLSQNNPDSDWESFSTALIKRFGDRHGRTNISKRKHMLRKILNEEVDSHASQQDKNSMEGSGLEFSELNASSWARKVELPSFDRSIEGGTDLKEETKNDEAKLAREKKIEKVMEEEVDPSIKREMHKENGVTNVGREDDFLDNPITDLIKKEVETGDATKPHCFQDSDFHKKIVMVKQKSFMKVVGTTMVLESWNVNLLGERLALKFVVSMADSLAMELRQKECTEPVKLIKIIWSPPLSLPPPKLNLHAGIPTLRARLIFRRGVLLGYKENEELVNIETVINSEDSPEPVDSGSSSDKEVSGQHKKITIPGKKMQTVAERFEEALGTSSVMTEERFEEALGTSSVITEGTHVGALNSLRPGIFGKLQQMMLKEKETDMDFWKKLQAEARPDSKTFAFTFSAVSILI

SEQ ID NO: 161437 - protein, 554 aa, Glycine max
  Coding DNA Sequence Number=SeqID_69752
  Gene Ontology: Mol. function=receptor activity; Cellular component =integral to membrane
  Homolog annotation: Hit_ID=A7Q2W4; Match level="QueryCoverage=93%, HitCoverage=87%, E-value=0.0, Identity=61%"; Hit description =Chromosome chr12 scaffold_47, whole genome shotgun sequence
MAPAGALIGPIAFSIIVIGNSAVFIGLWSAHFVWTYYCVARTNRFGLVFKLVVLMCLPIPLLLWPIVGIVGSLLGGIGYGFFAPLLATFQAVGKGENVNQKFHHCFIDGCRSTIERSYTVVQDVTDFCFHSYFSYMDELRENLPHHEKPLDIQLSLLPCCLLVIMVGVPLDMALITCIAIWKSPYMLFIGWKRLLEDLIGRKGPFLETECVPFAGLAIILWPLAVVVAVLAATIFSLFLALYSGVVVHQEDSVKMGFAYIVSVVSLFDEYVNDLLYLREGSCFPRPIYRRNKSHAIERKNLGGGDNDLRNWRDGSQNSKHAIQQSRSLKWRIQQYRPVQVWDWLFKSCEVNGRILLRDGLVSVGEVEECILKGNCKKLSIKLPAWSLLQCLLTSAKSNSDGLVISDDVVLTRMNGPKDGVFEWFIGPLLIIKEQLKNLELEETEETCLKELVMKCKNELPEEWDSTGFPSDDTVRRAQLQAIIRRLQGIVASMSRMPTFRRRFRNLIKVLYIEALQAGASASHIGGTLIPKHREKGSIQSKDNVDELDEPSNEC

SEQ ID NO: 161438 - protein, 202 aa, Glycine max
  Coding DNA Sequence Number=SeqID_69753
  Subcellular localization annotation: CTP_CleavageSite=41; ConfidenceScore=5.23e-01
MGPKYILRLMRTLGPSFASLAQSTWSLLSNVSDYHALGSSTAFMIFYFSNNSSMVTTSRDDERELPWDHLKNELLEGYGDIGKGDIYECLAALHQHSGTDEGRVCSMQMLGMLLCSRLLNLTRVVERELSEKDDAPSLPQNGGFRTRFGSGFLACSNDHGSFSPTHVGCLPGLVWGFVCSNWEVRDGNTTSLGPPKPNISDL

SEQ ID NO: 161439 - protein, 321 aa, Glycine max
  Coding DNA Sequence Number=SeqID_69754
MASRGSSAVYDTLSRWQGRRCEAVTLRVSAAAGRVSDAKVDVSLSELNVLSECHSLSEASTHLADRRNLEENLSRRHALSASSACSASRLSPSRLSASMALSGNSLTRVKRENDAKHDVEAKSSVGDSCYEVATDSSSSTENKKLEGKLDALITIQIFILLCSNLESMSNLKPMLQTFTIDLLNSKTNNNRIIMTFQAIDTIQNVAGPSKPYVPPPIQQQQQQSQQGQQASEAPPQPSLEEFDENHETGQIQAKGPSYGYLDDATSGRRHKDYLDKYDNWFNKEPREKLSPNFIKCQKFLMRILRGGSFDTGYEGLDDATS

SEQ ID NO: 161440 - protein, 42 aa, Glycine max
  Coding DNA Sequence Number=SeqID_69755
MAVMQSYPTKALDRRLQEDWVRDAREGPRVLMNLRVDFGPMD

SEQ ID NO: 161441 - protein, 62 aa, Glycine max
  Coding DNA Sequence Number=SeqID_69756
MNKKGESTHLEWWSQGKEKADEGLREEEKIEKEKEKIKEERVTWRKLGKGKRNGEGRQAIIK

SEQ ID NO: 161442 - protein, 1033 aa, Glycine max
  Coding DNA Sequence Number=SeqID_69757
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=98%, HitCoverage=92%, E-value=1e-170, Identity=37%"; Hit description =Functional candidate resistance protein KR1
  Pfam annotation: Domain name=LRR_1; Domain location=557-582; Score =8.0; E_value=10; Accession=PF00560.24; Description=Leucine Rich Repeat
  Pfam annotation: Domain name=LRR_1; Domain location=620-641; Score =6.2; E_value=22; Accession=PF00560.24; Description=Leucine Rich Repeat
  Pfam annotation: Domain name=LRR_1; Domain location=643-665; Score =13.3; E_value=0.94; Accession=PF00560.24; Description=Leucine Rich Repeat
  Pfam annotation: Domain name=LRR_1; Domain location=667-691; Score =5.7; E_value=27; Accession=PF00560.24; Description=Leucine Rich Repeat
  Pfam annotation: Domain name=LRR_1; Domain location=714-735; Score =0.8; E_value=2.2e+02; Accession=PF00560.24; Description=Leucine Rich Repeat
  Pfam annotation: Domain name=LRR_1; Domain location=737-759; Score =9.8; E_value=4.7; Accession=PF00560.24; Description=Leucine Rich Repeat
  Pfam annotation: Domain name=LRR_1; Domain location=789-811; Score =2.3; E_value=1.1e+02; Accession=PF00560.24; Description=Leucine Rich Repeat
  Pfam annotation: Domain name=LRR_1; Domain location=814-835; Score =10.6; E_value=3.4; Accession=PF00560.24; Description=Leucine Rich Repeat
  Pfam annotation: Domain name=LRR_1; Domain location=837-859; Score =8.9; E_value=6.7; Accession=PF00560.24; Description=Leucine Rich Repeat
  Pfam annotation: Domain name=NACHT; Domain location=213-366; Score= -3.5; E_value=0.00011; Accession=PF05729.3; Description=NACHT domain
  Pfam annotation: Domain name=NB-ARC; Domain location=174-468; Score =175.3; E_value=1.6e-49; Accession=PF00931.13; Description=NB-ARC domain
  Pfam annotation: Domain name=TIR; Domain location=16-149; Score =168.3; E_value=2e-47; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::NACHT::NB-ARC::TIR; Domain location=557-582::620-641::643-665::667-691::714-735::737-759::789 -811::814-835::...
  Pfam module annotation: Domain location=837-859::213-366::174-468::16- 149
MENHGAVSETKCTFDVFLSFRGEDTRHTFTCKLYDALWLKGIDTFMDNKELKNGDKIGPTLHKAIEEARISVVVLSENYADSSWCLDELVKIHECMESKNQLVWPIFYKVNPSDVRHQKGSYGVAMTKHETSPGIDLEKVHKWRSTLNEIANLKGKYLEEGRDESKFIDDLATDIFKIVSSKDLSREMFIVGREYRVKELKLLLDLESRDITCLLGIHGTGGIGKTTLAKALYDSIYKQFDGTSFLNVGETSNPKTDLKHLQEKLLSEILEDDKIHWRNIEEGTAKIERRLGFKRVLIVLDNVDDIKQLNNLAGKCAWFGPGSRIIITTRDKHLLDLGEVEKRYEVKMLDEKESLELFCHYAFRKSCPESNYKDLSNRAMSCCKGLPLALEVLGSHLFKKNVDVWKDALDRYEKSPHGNVQKVLRISYDSLFRHEKSIFLDVACFFKGQRLDYVKTVLDASDFSSGDGITTLVNKSLLTVDYDCLWMHDLIQDMGREIVKEKAYNKIGERSRLWHHEDVLQVLEDDNGSSEIEGIMLDPPHRKEINCIDTVFEKMKNLRILIVRNTSFSHEPRYLPKNLRLLDWKNYPSKSLPSEFNPTKISAFNGSPQLLLEKPFQFDHLTYMNISGCDKVSEFPDVSRAMNLRKLILDGCENLVSIHKSVGHLANLVSLSASNCTQLHSFVPTIYLPSLESLSFVLCTTLAHFPDIEGKMDKPLEIVMSYTAIQKLPDSIKELNGLTYLEMTGCEELRYLPSSLFKLPNLVTLKLAECAFLPRSLRMFIGSPSTCAKLETLHFDNTGLTDYDLKTIVAIFPNLKDLNVSRNRFSDLTLSIGKFTNLTSLDVSYCTDLKGMPSILPSSVQKVDARECRSLNQFSSNALWIQVKKEKNELEVMMPKREIPKWFHYVNKGRFPDFKARGKFPAVAIAFVFGEVNAIDKANRSINVGIHLLIEDERRKFRNVPVPENHVFLCDLRGLFSLEEWEDVGVGVGNDWKTIQVYCDTKLPLCSWGVYVYKSESNMKYIQFPSNDPCSSF

SEQ ID NO: 161443 - protein, 29 aa, Glycine max
  Coding DNA Sequence Number=SeqID_69758
EKEGEACHPACPGELGCFLQKAPPSGELP

SEQ ID NO: 161444 - protein, 62 aa, Glycine max
  Coding DNA Sequence Number=SeqID_69759
MERFDFGNLPVEDRRTTKNERRTMKNGKKREVVAAQLAQASWVASTRRRRLLLEPPGRPKWA

SEQ ID NO: 161445 - protein, 67 aa, Glycine max
  Coding DNA Sequence Number=SeqID_69760
MTILIANTLTTFHRDERLGNTYAMHGKCNYEIEMPKETSFPSSPCIRNGFMIPTWLAHEKNARIMHK

SEQ ID NO: 161446 - protein, 411 aa, Glycine max
  Coding DNA Sequence Number=SeqID_69761
  Homolog annotation: Hit_ID=Q6WAY6; Match level="QueryCoverage=44%, HitCoverage=31%, E-value=3e-08, Identity=27%"; Hit description =Putative uncharacterized protein
VGEWRLIYGHAGSPTRLITVKPHLEFSSFGDAFSPVVPTATMLLPKRLAPPIEEFEGILGCPIGGRKPYLFSGYYPSMVKVAGVVNISERELDQVKKIRNGVAGILRKCLDEKAKTLASQGEWVSFMDVLTLLVYGTILFLNVDRLVDLAAIETFLAYHHNKESPVIAVLADVCDAFDLRCKNCHHMCLGKDKANWEELLVGMTGPLVGSHDGKKGEGKSIMLMISYERCAIGGNHRAFHHTRGLNGEEAEVPEESEEVKALKAEFEKTKVAKEKLKVAATRVRKKSDKLRDINMTATEALERETKKAKKEEWSRNKFRGALLGRSNELKLRKAERDKSRMESGSLKEQLRKTEENMLIIIDQYKEKVNLAASHGQMLRDKQAKVSALRVKREAREEVMELLHKEGMKWMD

SEQ ID NO: 161447 - protein, 24 aa, Glycine max
  Coding DNA Sequence Number=SeqID_69762
MGRSRVALRSADDDPNHRCFSASR

SEQ ID NO: 161448 - protein, 41 aa, Glycine max
  Coding DNA Sequence Number=SeqID_69763
MSMLFLKPSDYAPVVFVIESKKGGGRGGSGKGHGGGRFANF

SEQ ID NO: 161449 - protein, 104 aa, Glycine max
  Coding DNA Sequence Number=SeqID_69764
  Subcellular localization annotation: CTP_CleavageSite=37; ConfidenceScore=5.03e-01
MMHDDTYIIADPPMLPVHTTAMPQPPTPTTVDSNMPRHAMAACQKIAKSLEHMINMRMVTVGTDAYTLTKHCLRLARGVTEQGNVYVCLRRRRDTQDRDGGGQR

SEQ ID NO: 161450 - protein, 184 aa, Glycine max
  Coding DNA Sequence Number=SeqID_69765
  Subcellular localization annotation: CTP_CleavageSite=59; ConfidenceScore=5.29e-01
KNCWNLDELLVTFPGTRKARARGFEGPSSSAPPASTAPTPLPPSVSATLGTSAQISDIVVSMLQSLHHELYLVMQSIHALAQHRPIMRMEEFSTQVAWPGVQPSSFGGGKASTAQEPKPKLEAAAQKANLEDIPEATPVAQEDIVEATPETTSYASPVTTPMLELSKEEDDATDMDYAVDLATE

SEQ ID NO: 161451 - protein, 140 aa, Glycine max
  Coding DNA Sequence Number=SeqID_69766
  Gene Ontology: Mol. function=metal ion binding; Cellular component =nucleus; Biological process=regulation of transcription, DNA -dependent
  Homolog annotation: Hit_ID=A7Q311; Match level="QueryCoverage=47%, HitCoverage=11%, E-value=9e-22, Identity=71%"; Hit description =Chromosome chr12 scaffold_47, whole genome shotgun sequence
MLKVAFCLVESRADWSIGEKKPKLSGEDRPSMTDLSGYSFKREEFDVEYDNDAEQVLADMEFKDTDTKAEYAMKLHGTSTWVVVTENKRGYISCGSVQVEGTSTWLFKENKGWYIPCGSLLVKDFTRLKRNLKDRRSLGD

SEQ ID NO: 161452 - protein, 82 aa, Glycine max
  Coding DNA Sequence Number=SeqID_69767
  Subcellular localization annotation: CTP_CleavageSite=59; ConfidenceScore=5.16e-01
MCNIWFSIVGDSARFPPLEDAPMNLASPSRRRLLAKPICRLSESSAKRTTLAVERTTPAAEHEEEPGRRMSWTHMLSEGSFR

SEQ ID NO: 161453 - protein, 132 aa, Glycine max
  Coding DNA Sequence Number=SeqID_69768
MVLKDELKACPRSKRSLSQQLSETEGNMLAIIDKYKEELNLEMAHEHRLVDEYAKVSVEKEARGRVIDSLHHEAIMWMDRFTLTLNGSQELPRLLAKAKAMADIYSSPEEIHRLLSYCQHMINLMAHIIRSH

SEQ ID NO: 161454 - protein, 84 aa, Glycine max
  Coding DNA Sequence Number=SeqID_69769
MSCTPLLYDYLRILPCCVHPPCRNVPFCGRAKASLTGALSKGGKMRGVATNEGISTSHVDKSGALAPTYPPSKRKSDLRSSFYV

SEQ ID NO: 161455 - protein, 211 aa, Glycine max
  Coding DNA Sequence Number=SeqID_69770
  Homolog annotation: Hit_ID=A5AHQ6; Match level="QueryCoverage=84%, HitCoverage=19%, E-value=1e-07, Identity=23%"; Hit description =Putative uncharacterized protein
MVCSDQAEMTDRLLAESLTFDNRIMHYIIVRILLPRSSNLAQASEEDLILMWAFLTGRQIDWAYLVRYRMHKALRANAPLPYPQLIALFLRHFQIPLDDEPFVQVKRSFAIGAGAVTSFGYRKDRNGQWLKKDALPPQDERTPSPPPQREDSALLNEVLTELRGLCSYVGERFDSLDTRFAGMDIRLTQVEEDVSFIRTCFDPPPPPPSSS

SEQ ID NO: 161456 - protein, 84 aa, Glycine max
  Coding DNA Sequence Number=SeqID_69771
  Subcellular localization annotation: CTP_CleavageSite=38; ConfidenceScore=5.06e-01
VCDIYPRIELANGQTKYAKYSDSKSIQMPKLCRITMMRVMSKMTTTAMKSISLKPLGRDGTVRPHLLEEIPIVVPSFHLDMGEV

SEQ ID NO: 161457 - protein, 175 aa, Glycine max
  Coding DNA Sequence Number=SeqID_69772
  Homolog annotation: Hit_ID=A5B4G8; Match level="QueryCoverage=65%, HitCoverage=14%, E-value=7e-12, Identity=35%"; Hit description =Putative uncharacterized protein
MTRGNPSDLQPLDPEIDRTFHRLVRHSVHPTFPEHFVPFEHPEHSVTGESVHSVIGDFEHPDFEHYNFEHSENMAQPPPRERTLREMAAPNFTYESLCIQYPDEDVLYVLKTGPIHLLPKFHGLAGEDPHKHLKEFHIVCSTMKPPDVQEDHIFLKAFPHSLEGVAKDWLYYLAP

SEQ ID NO: 161458 - protein, 148 aa, Glycine max
  Coding DNA Sequence Number=SeqID_69773
  Gene Ontology: Mol. function=oxidoreductase activity; Cellular component=cytoplasm; Biological process=metabolic process
  Homolog annotation: Hit_ID=A6TDU5; Match level="QueryCoverage=62%, HitCoverage=36%, E-value=8e-45, Identity=100%"; Hit description =Putative short-chain dehydrogenase
MAYVASKGAVIAMTRSMARELGEKRIRINAIAPGLTRVEATEYVPAERHQLYENGRALSGAQQPEDVTGSVVWLLSDLSRFITGQLIPVNGGSEVPGTGSGARFTTAAGVWRTASRSDLCRAASAGGYAESDRLSRGADAGIYGLSRA

SEQ ID NO: 161459 - protein, 94 aa, Glycine max
  Coding DNA Sequence Number=SeqID_69774
MQALAGFHVEYRLMQRAFHLAIFDKALAQERIGMRANVFQRVIFAINQINTDFLTVDIAAIWEIFLYLLRVTYAYPAHRNPPGFCFIYETLFLI

SEQ ID NO: 161460 - protein, 91 aa, Glycine max
  Coding DNA Sequence Number=SeqID_69775
MENCTKQSLRMAPNSGGGHMNENAIHGAPKKGCRPKVHRVFPKENMLFAKKNEIIALTILLRMASNSKVEECLNENTIHGAPNKIENGELH

SEQ ID NO: 161461 - protein, 128 aa, Glycine max
  Coding DNA Sequence Number=SeqID_69776
DVAGGSMFHSANSLTSCGNNLSNNEAQPPRNVSNLHGDEDDDDDYLVSNSYVEESLDEDDSVDGISDTDDEVTDMIQPVRIVHPVEAPNKSPISAIALGTFHCVPNGALGVGIGASCCCEGVIVGHEK

SEQ ID NO: 161462 - protein, 29 aa, Glycine max
  Coding DNA Sequence Number=SeqID_69777
MGSGVVYVRGRALPLLLPILKCDEELRPT

SEQ ID NO: 161463 - protein, 157 aa, Glycine max
  Coding DNA Sequence Number=SeqID_69778
MSARKDDRSRSKKEESPEDADRLFPNRHRPNIIGGLNRKNNNGHWSLIAPIDIYRLTLWNFISKRWPIIFFTVGLVFSCKLNRSCVSVDTGMYSFTRLQKHWATSTKKHYSPILIKKDGSRCRPEKMTDPGLKKKNHRMTPIEHFLIDIVEILSGNE

SEQ ID NO: 161464 - protein, 51 aa, Glycine max
  Coding DNA Sequence Number=SeqID_69779
MAHQKPPNLAFCTPGQNEIKNKIQGMKGMGNIKLAYVFLNERQGMKGMVQI

SEQ ID NO: 161465 - protein, 112 aa, Glycine max
  Coding DNA Sequence Number=SeqID_69780
MSVHVAQLIVDAIYLFAEKYCTPRQAQGDAPQAADAPPPPHQADPAGSFGMERYLQNLVRQQAANHRAHVQTHDCLYQLSLSLQGQGFAPFPCPTPNQFRAEVAWPRDWPEN

SEQ ID NO: 161466 - protein, 87 aa, Glycine max
  Coding DNA Sequence Number=SeqID_69781
LVARITDNIVSETEHEALYQDDELVGLQEVLKVDPDVINESLADVDGGGEEIDADLLKQLDLVEPDEDECILSENDIESDFDDIDTS

SEQ ID NO: 161467 - protein, 148 aa, Glycine max
  Coding DNA Sequence Number=SeqID_69782
MSGFTRNSPQISASPHQLDLAPYASEPYNAQWNAPGLLRDKHTLRSSRILGEMEVDEPWLGLWLPLNYQVDMGSSLAYDNGIWGGLRHWKCGRQTLWNGSHSMGFSLILTLFICPSFLIRLSRMIKFASFRTHIDPFTGEDQIRKALR

SEQ ID NO: 161468 - protein, 183 aa, Glycine max
  Coding DNA Sequence Number=SeqID_69783
  Homolog annotation: Hit_ID=A5BQX5; Match level="QueryCoverage=62%, HitCoverage=34%, E-value=8e-12, Identity=35%"; Hit description =Putative uncharacterized protein
MTRGNPSDLQPFDPEIDRTFHRLVRHHFIPFDHSEHSITGESVHSVIGDLEHPDLEHYNFEHSDSEHSDFAHSENMAQPPPRERTLREMAAPDFTYESLCIQYPDEDVPYVLKTGLIHLLPKFHGLAGEDPHKHLKEFHIVCSTMKPPDVQEDHIFLKAFPHSLEGVAKDWLYYLLQVHHELG

SEQ ID NO: 161469 - protein, 236 aa, Glycine max
  Coding DNA Sequence Number=SeqID_69784
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=42; ConfidenceScore=5.12e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIKIDRRLKFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 161470 - protein, 81 aa, Glycine max
  Coding DNA Sequence Number=SeqID_69785
MVAIIPAKIPQPPFTQGYNSNGTCAYHGGVSGHSIEHCMTLKHKTVIDTSEPYIGTMRGTMLEPQANLGADQKFSPGRLKT

SEQ ID NO: 161471 - protein, 84 aa, Glycine max
  Coding DNA Sequence Number=SeqID_69786
MGDLNYFLGLQIKPRIFIINGFLCFLEDEWQWNGERERERRRHFKEKMSLEEAHHHRRPWIRAWRKKEMNEGRGREEHEILCSK

SEQ ID NO: 161472 - protein, 101 aa, Glycine max
  Coding DNA Sequence Number=SeqID_69787
  Subcellular localization annotation: CTP_CleavageSite=40; ConfidenceScore=5.37e-01
MNQPCKHARNALSARLASRLSPSRLSARLALSQNSLTCAKCKNGAKRDVEVESLLKLDLHRMKDRPREMHREPSSSIERCIVSLELDIAGLGYRMSGNGVR

SEQ ID NO: 161473 - protein, 164 aa, Glycine max
  Coding DNA Sequence Number=SeqID_69788
MDWLRRGLSRGSRNSKTPNIQTQSNSEVQQHLEESIYGITEELINHIKTFTLDTFKNFPLQVNSNHRLLGIGSIGFSLFVGKPNNDTMKLKAVMGKTLNPLQPKFEMNFLSGKRNMQSSYSQESRELYLRLYTKYCKADGTTAKVLFHWVMSLESLSEIGRLKS

SEQ ID NO: 161474 - protein, 79 aa, Glycine max
  Coding DNA Sequence Number=SeqID_69789
MLPFDSRHVMELHGLPNDACQVPRSGQAKGSKDKTLISFEQNIIRLVDIPASGTFAIAPDRLCPAEKNPARRWALNVFG

SEQ ID NO: 161475 - protein, 131 aa, Glycine max
  Coding DNA Sequence Number=SeqID_69790
  Gene Ontology: Mol. function=peroxidase activity; Cellular component =cytoplasm; Biological process=response to oxidative stress
  Homolog annotation: Hit_ID=Q76LA8; Match level="QueryCoverage=48%, HitCoverage=24%, E-value=3e-18, Identity=73%"; Hit description =Cytosolic ascorbate peroxidase 1
MHIQGTLLEPLTRAQTLVDPSDIAIRLLEPLKVEFPILSYADFYPLAGVVAVEVTGGPEVPFHPEREVLRVLCSKISLLYCFLLLQEIVPLEEVFQTLRCDSNGLTIASAERNTNSNPQNTTIANLTTLTV

SEQ ID NO: 161476 - protein, 146 aa, Glycine max
  Coding DNA Sequence Number=SeqID_69791
MERATHLNGSRIAFGWKRWRRGYRESSEVPRAIPPQKQVLHKGLELTTSIGERSVVACLALYVLKKIRLARQNERCRRSTHQEVVCSNALSTMFALLLDTVKMETLFQHLSNQGSRCSPSIKGMNLKEEQEEGKVTYGKTFEQVTN

SEQ ID NO: 161477 - protein, 140 aa, Glycine max
  Coding DNA Sequence Number=SeqID_69792
  Homolog annotation: Hit_ID=A5AKH3; Match level="QueryCoverage=29%, HitCoverage=7%, E-value=2e-08, Identity=58%"; Hit description =Putative uncharacterized protein
MGSKIYPKVHEKPKAFFISYSPILLEPLAHGSGMLELMWYLDNSCSRHMTRDKYKFISFIANKGGYVTYGDNNKGNFFGIAEWRRRRERIRHFKEKMSLEEAHHHRRPWIRAWRKKEMNEGRGREDHKILCSKRALKSEV

SEQ ID NO: 161478 - protein, 254 aa, Glycine max
  Coding DNA Sequence Number=SeqID_69793
MIYAVKNVRIPKFVDLEWFSQLGFNFPNLLKAQGLSKFVQVKGTFYLELVQVFYTCARVDMEEMVIDAAVWKVVAELDMGGVRKFDESVDGYNKMQTYRSMLLDPARNLRNCLGIGGLTAKDRKLMYLITYIFTPRSSNHGQVIDDDLQIVYGFKSSIQMNWVLLIEDIMLKSHRLVDYEFPYVVLASRFIDYFNTDVSNEIVDSTKASNDIIERHLKKLEMRFVEHKWIMAGEPPPVANMDQMEDEAQQEFAY

SEQ ID NO: 161479 - protein, 85 aa, Glycine max
  Coding DNA Sequence Number=SeqID_69794
  Subcellular localization annotation: CTP_CleavageSite=23; ConfidenceScore=5.12e-01
MVDAQTSSTTVSLRGCFLAAPPQAASATSSTKKKKRHKEDVQAMKKKAQEDEEAGRRRRELIRKKKKQKRKRGEGEREGIMAFSQ

SEQ ID NO: 161480 - protein, 68 aa, Glycine max
  Coding DNA Sequence Number=SeqID_69795
MACRKLGQVWLRKKKVSILALYALEEFGHCANKETAPNGTEDSWILLLEEHSQLSLIWLHNPQGIVAY

SEQ ID NO: 161481 - protein, 273 aa, Glycine max
  Coding DNA Sequence Number=SeqID_69796
  Homolog annotation: Hit_ID=A5AWV0; Match level="QueryCoverage=80%, HitCoverage=14%, E-value=3e-08, Identity=26%"; Hit description =Putative uncharacterized protein
  Pfam annotation: Domain name=Transposase_23; Domain location=144-214; Score=-9.3; E_value=0.012; Accession=PF03017.5; Description=TNP1ENSPM transposase
MARMKKTDQMTSEATKKITNKIDSLEEQASQGSFVAHGCQDVLTAAIGRPEHSGHVRAARAGVTIKRYFGPAPRTSRTSSSMAPEVLEHLTQQIRDQLEESITEKSQMQSQGLAQPPELEVGPSAARVNTKETCVDPSGNDPDTGDSDKCGLYIEENPPRLVALGRVYEGSTTIHNIPLLHDQVKVGVEEVRDANAPILVPIEEVKLVGQALNTFLAWSTHLVKHLSEQVMWDATVFGVFNEDFPLYIQLHMTETSIRAGNSDVYGFLEPQSI

SEQ ID NO: 161482 - protein, 78 aa, Glycine max
  Coding DNA Sequence Number=SeqID_69797
  Subcellular localization annotation: CTP_CleavageSite=39; ConfidenceScore=5.10e-01
MKNGGKPSQNRPRKRLGSVTEAPRLGFSSRKQFFSLILSESQISGGGKREVVAAQASWVASTRRHRLLLEHPGRPKCA

SEQ ID NO: 161483 - protein, 73 aa, Glycine max
  Coding DNA Sequence Number=SeqID_69798
MALGTPNLQNRLDLTKSTTTLVMQSYPPRALDRRLQEDWAKDAREGPRVLMSLRVGYPRNIGFFSPCILGHLD

SEQ ID NO: 161484 - protein, 375 aa, Glycine max
  Coding DNA Sequence Number=SeqID_69799
MKGRVNLGLEGESMLEIPFRTYEKGWAVLERKTNDQSEQRAISRVQQNFGLVQKNACVWLAVERVVQNEFWMFASRSQRVFCLCPVLLGLLVCDDLDVELPGCWRSLGGLMETRGWWVYVRFVDVENLLCTIARPPPSTTCDGVVPGDMSRGSGDLGDVRRAPDSQQIKGTKTTKQGGLCGGWPAVNLEAKMVSGNRLPRLQKGNWKTMEASGNRLPDCVIDYTEEWVTGNRLPAQLIHDRVEMECLEGAWETLEGNTRCRFRGTIRFTATSLVHPDEPVRTLQRTMEWILPTPTPYRLVEPVQVIEVTSSEEDPEEDPEELPPEPVVEALDFLEGDEDPLPEVDSPEEVMSASEADSTEDSGPGEMAISGGSSS

SEQ ID NO: 161485 - protein, 289 aa, Glycine max
  Coding DNA Sequence Number=SeqID_69800
  Gene Ontology: Mol. function=protein serine/threonine kinase activity; Cellular component=extracellular region; Biological process=response to abscisic acid stimulus
  Homolog annotation: Hit_ID=A7R3H4; Match level="QueryCoverage=82%, HitCoverage=91%, E-value=4e-92, Identity=66%"; Hit description =Chromosome undetermined scaffold_522, whole genome shotgun sequence
  Pfam annotation: Domain name=DUF26; Domain location=184-238; Score =81.2; E_value=3.3e-21; Accession=PF01657.8; Description=Domain of unknown function DUF26
  Pfam annotation: Domain name=DUF26; Domain location=72-126; Score =109.1; E_value=1.3e-29; Accession=PF01657.8; Description=Domain of unknown function DUF26
  Pfam module annotation: Pfam domain module=DUF26::DUF26; Domain location=184-238::72-126
MYFSYKIIFLFFLCTWGAKAEDPLGRFCNENTIIGSGGKLSANIDKILTEIALKTPSTGFVATTYGKDQDKVYALAQCRGDVSTQDCSNCIQDATKQIRQRCPNQVDGRIWYDYCFLRYSNKSFFGEVDTSFGIFYFNVENVTDPEDFNKELGALMDHIRAQAVVPREEGLGKGKSVLSPFVTLYALVQCTRDLSEISCAQCLSIAVNNFPNFCSNRKGCRVLYSSCYVRYELYPFFFPLDSNKTGPSNTAKTCASFPFSLSNFTANNVMWEVKIVIQLSWQIELLAEI

SEQ ID NO: 161486 - protein, 236 aa, Glycine max
  Coding DNA Sequence Number=SeqID_69801
  Homolog annotation: Hit_ID=Q6WAY6; Match level="QueryCoverage=40%, HitCoverage=16%, E-value=7e-11, Identity=42%"; Hit description =Putative uncharacterized protein
MDGLVDLAAIDAFLAYHHVSHLFFHESRPVFPLQGHCLCAKKRKANCEQLLASVVRACINWFPQWKEGRYGVLSSCEGFSNVPLMGTRGCINYNPILAIRQLVYPMRGASSEESIMPFITQGFSDPNARILRGIRKAWSAVQKKDKELRESRNGIIDGYHKWLKARTLELDWLPKLKVSSEVEAETPEDSEEVQALKVELERAQAVKEKFKTTAIKVRKECNELRDINVATAEALE

SEQ ID NO: 161487 - protein, 66 aa, Glycine max
  Coding DNA Sequence Number=SeqID_69802
MAVVTTSNNMLSKKKTLDEGSLLSSKSETQHDHRFTSSPYVPMDPGVGLLFNSPCVKKGVGAMCIK

SEQ ID NO: 161488 - protein, 176 aa, Glycine max
  Coding DNA Sequence Number=SeqID_69803
  Homolog annotation: Hit_ID=Q2HTA0; Match level="QueryCoverage=24%, HitCoverage=6%, E-value=9e-10, Identity=72%"; Hit description=IMP dehydrogenase/GMP reductase, related
  Pfam annotation: Domain name=DUF1723; Domain location=17-66; Score =43.7; E_value=6.7e-10; Accession=PF08330.1; Description=Protein of unknown function (DUF1723)
MVARTGLSPLIVCLIDTDDQGLISSFVERWHRETSSFHLLVGEVLITLDDVVSLLHLPIVGAFHDIQPLYSDEAMLLLVELLMVSPEVAMAETGQYGGPYCWIYEHFPSFAECNADLDYDEVSPRACRWIVTKKTVNKVSTTTNRQHLDRLRIPDVCWMPYAEHRPVQDFHPISCF

SEQ ID NO: 161489 - protein, 146 aa, Glycine max
  Coding DNA Sequence Number=SeqID_69804
PKNDEERTTNDEERLKIFAKSPTETLRKRYGSASAWIFFTETIFLTNFKGGACYPARPGELGCFLQKQQPSGGTSWKRSNKGCMPSNNSPRMKLGYDKVYCPKKVFQSSDFNLLAAIYLKVAYSQFGWFCSWGLDGSRMWGSMKTC

SEQ ID NO: 161490 - protein, 116 aa, Glycine max
  Coding DNA Sequence Number=SeqID_69805
MVEREMITMIVDTLPVFYYETLVGYMPSSFANLVFAGERIEVGLKRGKFDYVAPAGTSNRRFRATVAKKKEGDVAKGVITLSELNALSAHQRLSPAPARLASKKESGKTSATQACA

SEQ ID NO: 161491 - protein, 115 aa, Glycine max
  Coding DNA Sequence Number=SeqID_69806
  Subcellular localization annotation: CTP_CleavageSite=55; ConfidenceScore=5.31e-01
MSSKAPQDGFLVKLSSFSVSPQPKILKKLNNPSEIEILALNRHSSPVFSLSLRVKGSALSEFTLAQRLCTAHPSYRFFCALSRWLAQRVAWPSKFINSALHQSCPFCLKLKRNDH

SEQ ID NO: 161492 - protein, 34 aa, Glycine max
  Coding DNA Sequence Number=SeqID_69807
MAIYRKRPFGVGEACPGQETHKVTPQETLRACEN

SEQ ID NO: 161493 - protein, 79 aa, Glycine max
  Coding DNA Sequence Number=SeqID_69808
MATKMKRRPFEALDSIAPITSMPHIENDHGANNTFNHSPWQSSNTHLSKSFGPWHAHWHGCQRILHAPLMVFLSRNVMK

SEQ ID NO: 161494 - protein, 75 aa, Glycine max
  Coding DNA Sequence Number=SeqID_69809
MAPKKLPAKRARKTTTGEGSSTAPPLDIEFDGHQAKIARRHWTQLAEPMAKYDPKVVMEFYANVWPTKEGVMDKL

SEQ ID NO: 161495 - protein, 75 aa, Glycine max
  Coding DNA Sequence Number=SeqID_69810
  Homolog annotation: Hit_ID=A2Q246; Match level="QueryCoverage=100%, HitCoverage=42%, E-value=4e-29, Identity=67%"; Hit description=CENP -B protein
MDIDNLMNYPDTVSLEPVTRKEALMASNTLHNFMIQYKNTTPELLDAIRKVRDELQIDLNFKEKQTTIESYFNRV

SEQ ID NO: 161496 - protein, 158 aa, Glycine max
  Coding DNA Sequence Number=SeqID_69811
  Subcellular localization annotation: CTP_CleavageSite=20; ConfidenceScore=5.21e-01
MAGTFFLLKQQISLEIMSVASVALSSLNTNKQCLFKPQGSSQSASPLLQNTNIQFHHQYGQQCRKLLLTPSKMCLSSPLASSIHGTQEVKEKQTFKPSTIPSSETRIESTPFHCTCRMPYSATLKTKEWPLERVVVRENVLSFCPCLKSHPLQTPSPS

SEQ ID NO: 161497 - protein, 67 aa, Glycine max
  Coding DNA Sequence Number=SeqID_69812
MHLSHKHFFMHSSIFPVTDVGVLICTGAWAQKEVLSGQDQEPRSRQSEKVRAVDGSTPAMSLSQDLW

SEQ ID NO: 161498 - protein, 262 aa, Glycine max
  Coding DNA Sequence Number=SeqID_69813
MSWKHYGSTSAKIFFTETIFLTNFERILNTRKAESFLLCPLSPIYRRKEGGGCRLARPGEQGCFHQKSPPSIGTLRKAQNFTDYVKTPIFFPKCCETLRIMQRCLFSFRNVVKLYGLRNDGCFEGSEGSKQKAKLHDESRVIQRCFDDNKDDNKGDDKKLKGQSKNEFKIFKIESRTLQDSRGKLISRIKNQDSRDQDFKNQDSRDQDSRLKIQESREGLIKISMKRFSQKLSSTWIFLKTCLPKSFYSLVIDYQIVVIDYQ

SEQ ID NO: 161499 - protein, 116 aa, Glycine max
  Coding DNA Sequence Number=SeqID_69814
MKVRGRVCEGIGPTSGKGSKRERVIDSLHRETMIWMDRFAFTLNGSQELPRLLAKAKGNGGRVLGSRGVNTITKHTFRHPYRTHSKTRVMGDIEEVQEQIKADIEALKDQVASVSA

SEQ ID NO: 161500 - protein, 88 aa, Glycine max
  Coding DNA Sequence Number=SeqID_69815
MVRTRGLGRALGQAIGKVLGRRDASDDDAPQRRRPIASAPAVELNEEQSKAHVEEVVTDVEGFPGGPHDTSVLKDFENHIAFRVSNGE

SEQ ID NO: 161501 - protein, 138 aa, Glycine max
  Coding DNA Sequence Number=SeqID_69816
  Homolog annotation: Hit_ID=Q2HTA0; Match level="QueryCoverage=71%, HitCoverage=15%, E-value=2e-10, Identity=36%"; Hit description=IMP dehydrogenase/GMP reductase, related
  Pfam annotation: Domain name=DUF1723; Domain location=1-44; Score =40.2; E_value=7.6e-09; Accession=PF08330.1; Description=Protein of unknown function (DUF1723)
MSAFVERWHKEISSFHLPVGEVTITLDDVALLLHLPVVFHSFELLHVDDAVEMLVELLEVTAAKARAEMIQCHGSYVQISWLRDVYVMKIEACHWIVAAWGYAWGNVALMHMIMIRGDRVHVDGPLARHCPLPRIAGV

SEQ ID NO: 161502 - protein, 502 aa, Glycine max
  Coding DNA Sequence Number=SeqID_69817
  Gene Ontology: Mol. function=sulfuric ester hydrolase activity; Cellular component=integral to membrane; Biological process =metabolic process
  Homolog annotation: Hit_ID=A8G801; Match level="QueryCoverage=100%, HitCoverage=89%, E-value=0.0, Identity=75%"; Hit description =Sulfatase
  Pfam annotation: Domain name=DUF1705; Domain location=3-150; Score= -22.4; E_value=2.2e-05; Accession=PF08019.3; Description=Domain of unknown function (DUF1705)
  Pfam annotation: Domain name=Sulfatase; Domain location=184-488; Score=233.0; E_value=6.9e-67; Accession=PF00884.14; Description =Sulfatase
  Pfam module annotation: Pfam domain module=DUF1705::Sulfatase; Domain location=3-150::184-488
MRLLSLGGKWFYRVIASLLVVISVAAAYYMAFFNVVIGYGIVASVMTTDVDLSKEVIGLHFVLWMVLVSALPLLLIWRNNLSLTLIEQLKTPGQRLKPTVILLLSVALVWLPIRYFDKLQKANEELTNIDLPSYGGVVAHSYLPSNWIAALGLFAWTKVDEKLDSQELLDPAKKFTYVAPPGIDDTYVVFVIGETTRWDHMGMLGYNRDTTPKLSKEKNLVAFRGESCDTATKLSLRCMFVREGGTMDNPGRTLKEQNIFAVMKELGFTSELFAMQSEVWFYDNADVNNFSFREQIGSEKRNQGKAVDDMLLVPELQASLQRFPKGKHLVVLHTKGSHYLYSQRYPREYARYQPECIGVDDKCSKAQLINAYDNSILYVDTMLDSVLDQLRDKKAIVFYAADHGESISENMHLHGTPREMAPPEQFRVPMIVWASDKYLQDPTNRSNFERLQAQQRVGKTHRHVELFDTILGCLGYTSPDGGIKAANNWCQAPATASSAKAL

SEQ ID NO: 161503 - protein, 94 aa, Glycine max
  Coding DNA Sequence Number=SeqID_69818
MLKSITCGSNDFQNYFDDAKGSRVKQVPKNQESKSFKNQVSKNQDSRIIKFQDSIKFQESRFKNNQDQDSRLKIQESREDSIKISTKKVFQNIE

SEQ ID NO: 161504 - protein, 202 aa, Glycine max
  Coding DNA Sequence Number=SeqID_69819
  Subcellular localization annotation: CTP_CleavageSite=32; ConfidenceScore=5.14e-01
MVKPSKKRKGSLSRSQRHSEAQDTPIPSSISSSSLFSSKEQRTKYINLFSSCSIIDPKFIDMDFFSDESFECIQAFQNSNLIPFMSLKLPVYSELVKAFYSNLEIQESTLISEVFGIKMFIYQSLFYDLTQLSSEGVPIEGALDDDWKFDFSVHDVRQLICTNQVDMIRRLLAISLALESRILHYLIFRIPLPTSSKPCIGF

SEQ ID NO: 161505 - protein, 75 aa, Glycine max
  Coding DNA Sequence Number=SeqID_69820
  Subcellular localization annotation: CTP_CleavageSite=34; ConfidenceScore=5.07e-01
MNITIYKLNTLRTGASSKGGKCAESPPTFICGKRQKNRRKLVMKNISDSGDVFTFEEEVDKSGALAPTYPSSKRK

SEQ ID NO: 161506 - protein, 194 aa, Glycine max
  Coding DNA Sequence Number=SeqID_69821
  Homolog annotation: Hit_ID=Q2HTA0; Match level="QueryCoverage=62%, HitCoverage=18%, E-value=8e-09, Identity=33%"; Hit description=IMP dehydrogenase/GMP reductase, related
MPYADHQGVRGFDLISYFQGQLRWGPIVVFVRPERVVRQFRYIQTIPPPPVSASLSYEEIDDRWMNFSDHVAPAGEIRVVLGQVSADYMDWFFQISHPFVTPTQAGDQPRHPPAPHDEEYVEPHIPEVPVASNLPRDSVMLVKVVKQSQKGWSVCSTLGWSLKAQSYTRSCKIASGSLGVTPQMEVLGCDVDVA

SEQ ID NO: 161507 - protein, 39 aa, Glycine max
  Coding DNA Sequence Number=SeqID_69822
MQNSHEDVYLRAYLNGALKGFNDSQGSKSKVATRGILVK

SEQ ID NO: 161508 - protein, 205 aa, Glycine max
  Coding DNA Sequence Number=SeqID_69823
MPIDRDYFSLPFINQRQASPLTRRDKYGHLHPFIEDSMSIDRDYFSLPFVNQGQASPLTRREQYGHLHPFVKDSMSIDRDYFSLYFINQRQASPLTRRDQYGHLHPFIEDSMSIDRDYFSLPFVNQRQASPLTRRDKYGHLHPSIKDSMSIDRDCFSLPFVNQRQASPLIRRDQYGHLHLFLEDSILSTETTLVSMSSTSGRRAL

SEQ ID NO: 161509 - protein, 126 aa, Glycine max
  Coding DNA Sequence Number=SeqID_69824
MDVEERVENLCVITHGNVTDAPRLGFSSRKQFSSANLREYEVPRRLKPLPPFIPPPIYSKIGEELCHPARQARQGCFLQKQPPSGGRNWKAQLLKKLRKLTDCAKTPPFDLRHITESHRSRKSGSF

SEQ ID NO: 161510 - protein, 34 aa, Glycine max
  Coding DNA Sequence Number=SeqID_69825
MWDRHRLKGTLKLGVFTPKVYTPKSPLGSLPPDS

SEQ ID NO: 161511 - protein, 73 aa, Glycine max
  Coding DNA Sequence Number=SeqID_69826
MGETYEIPYHNLGDFKPCIGYATEGQAVGGIPMQNTLEGPQFHPQPQPLHSTASKIPPAMAADKISRGKAQSH

SEQ ID NO: 161512 - protein, 34 aa, Glycine max
  Coding DNA Sequence Number=SeqID_69827
MGSGVVYVWGSSPRRAGYFTPKSSGGRRARGWPG

SEQ ID NO: 161513 - protein, 199 aa, Glycine max
  Coding DNA Sequence Number=SeqID_69828
  Gene Ontology: Mol. function=helicase activity; Biological process =viral genome replication
  Homolog annotation: Hit_ID=Q2R017; Match level="QueryCoverage=89%, HitCoverage=11%, E-value=2e-41, Identity=42%"; Hit description =Helicase, putative
MLAFTSAGIKLDKSINRSRGPPTIRIQGQPCHRIGNLLPMSGKEPKFAPLYIFDTDNEVKNRINAISEMLDKHNAHAKSFRMARHRLANSDFDHVRLRLISTREKDGQTYNVPTVSEVVALIVGDFNPNSRKDIILEIQNGQLQRIHELHSSYLGLQFPLLFPYGEDGYRPGILHRATPNSKKKREREKSSHYERVVCL

SEQ ID NO: 161514 - protein, 206 aa, Glycine max
  Coding DNA Sequence Number=SeqID_69829
  Homolog annotation: Hit_ID=A6BLN7; Match level="QueryCoverage=58%, HitCoverage=23%, E-value=3e-08, Identity=29%"; Hit description =Putative transposase
MKLFLKFKNSERGPVSFTAGDQGSSQVSGSSQLSSKDAFLSKAEAKTIFDINNISKEIVCVTVDTINRIVMDNHSQCYPAYSYCYRKTDIETIAFTCACSKHNDQVVLRYRVEVMVTYKEQSTKFFMWDRECIELIGQSANEFNKLKIEEGDIDLNVSPLALDKLLGYVLAFKIKVQPKFNNNVVLRYSNDLDLINVVVDILPDAE

SEQ ID NO: 161515 - protein, 223 aa, Glycine max
  Coding DNA Sequence Number=SeqID_69830
MSGLDFAQTATGSNVLPSDHNSDLPLPKCQLVYVILTRMSVHVAQVIADAIYLFAGMPPTRHPLDPDKSNRALGFSALITGLCQSFGVPVTPSKVIRPPITQAFIEMYCTPRQAQGDAHQAADAPPPPHQADPAGSLGMERYLQHLIRQQAANHRGPSQQGQGFAPFACPTPEQFGAEVAWPGDWPEAQAGEEPVGSPGEAEEARMDEEMMDLLGFLGGSRAT

SEQ ID NO: 161516 - protein, 59 aa, Glycine max
  Coding DNA Sequence Number=SeqID_69831
MRGVATNVYLWKTSEKPKETGHNENSKFGSCIYVDKSGALAPTYPPSKRKSDLRSSFLR

SEQ ID NO: 161517 - protein, 76 aa, Glycine max
  Coding DNA Sequence Number=SeqID_69832
MSHGRLYQQRIKNAFDKKGQNHLRPWSEVKTKLTAEINQGTYGRMQMEDRVTTDRSSSLPGAGQAENIAARQPSIL

SEQ ID NO: 161518 - protein, 148 aa, Glycine max
  Coding DNA Sequence Number=SeqID_69833
MMTLALFWERVVFCNQLLCSCDEAGRYTQPLHLRLIWSAKLAKDELSQLQFDPNLAKFRKLRLCILSLKKFAHFASVLSFCIINFEETTIHHPNAMNSLSEHAALSEFIYTHCIEAFSEELAKRDYRAKRVHPLRMNIYPLVELPVAK

SEQ ID NO: 161519 - protein, 132 aa, Glycine max
  Coding DNA Sequence Number=SeqID_69834
MAASDHTILHDRVHIPTKKSLLELSSQDALLAQNKLLSKKLEYLTETLSCTLCGGAHRSGLCIPTEETSHEVNYMGNHPRQNFSAGGFSGLQHGQPYQQHNQWRTHAGNQPLVQVKEFDEKVLKERTKIDPI

SEQ ID NO: 161520 - protein, 62 aa, Glycine max
  Coding DNA Sequence Number=SeqID_69835
MLLGAPSMSQHKNRTEPILDPAAKFTHLWQRSSQTCSGCCYAQPAKLPVHPVIVRNFHFALS

SEQ ID NO: 161521 - protein, 115 aa, Glycine max
  Coding DNA Sequence Number=SeqID_69836
MASLLTISHVARKTPVVMASSYHLQIASPSSESEHRYTMNSVITVLYFNGRVYEDNDGVIFEGSKKEIQIKRGISFNALKKKIGDKENILPCKFATTKTLKRCWKVLNNNKKCQF

SEQ ID NO: 161522 - protein, 109 aa, Glycine max
  Coding DNA Sequence Number=SeqID_69837
MKMKANKTRNELKVSDSNTYQLKTKEPTKNGQRTVKKNEKSARICSRKCLGSVTEAPRLGFSSQKHVFSSKTAEMHSIGVRDQFTQPPSPIYSQNGEVLAAQRLPEEDF

SEQ ID NO: 161523 - protein, 60 aa, Glycine max
  Coding DNA Sequence Number=SeqID_69838
MPPLWFQFFAFFCTRQGPFSKKFQDVTSAIVTYESDDMQRYTSDYLHKQFLLTLTREVRW

SEQ ID NO: 161524 - protein, 48 aa, Glycine max
  Coding DNA Sequence Number=SeqID_69839
MFGGGARRFDSGGWVADVWADDCGGQDGAIGLDYGLVFGGVGGGRLRH

SEQ ID NO: 161525 - protein, 67 aa, Glycine max
  Coding DNA Sequence Number=SeqID_69840
MVLHLWICEGNQPMKVDSDVRQGGRWRERGKDGIRAISDPGTTLPLTLACGDKHPPFVVHASSPRSV

SEQ ID NO: 161526 - protein, 125 aa, Glycine max
  Coding DNA Sequence Number=SeqID_69841
MNNYQIAPQDPYYPPPGYAPPYPPPQGYPPPGYPSAPPQPPPGYVPYPPPQYEGYQGYFNHGYPLPPPPNYHCHHAQHHHNDNPGFTSFLQGCLAIQNHDQPVIKAQLFLLIGNKINIYITRLFK

SEQ ID NO: 161527 - protein, 165 aa, Glycine max
  Coding DNA Sequence Number=SeqID_69842
MLGELLLLIKAIARKFDVIKEINGPKYKESQNDYLRSQGTYVASISSSMYGPKVMINEVMSDIENFRKRYKLEIKVFYGKHHAKVMFWDSNCTRLIRLLTVDLKKLMIEVGEDDLRLYPKHLDNMIGCTSTFRVKYSIKFNNFPISRMVDDLELINLIKEQLDSD

SEQ ID NO: 161528 - protein, 94 aa, Glycine max
  Coding DNA Sequence Number=SeqID_69843
  Homolog annotation: Hit_ID=A5BKR0; Match level="QueryCoverage=75%, HitCoverage=5%, E-value=3e-12, Identity=56%"; Hit description =Putative uncharacterized protein
CSSPHTYYCSRNNSIENNVSIIVDDIVQEQDNNEVLPQIPIQQPQKVSLRRSIREKRSSIPDDYIIFFQEHEDDIGLTEDDLINFCQAMHSSNS

SEQ ID NO: 161529 - protein, 91 aa, Glycine max
  Coding DNA Sequence Number=SeqID_69844
MGKITVKLDQRTCDCGKPQKLYMSLLHMNGNGMEKEERERRRHFKEKISLEKVHYHRRPWIRAWRKKEMNEGREREEHEILCSKRALKSEV

SEQ ID NO: 161530 - protein, 127 aa, Glycine max
  Coding DNA Sequence Number=SeqID_69845
MMDIIGVDFLGFAPNIITYVKCLVRRLKTGINREPKCTAQKGIDCSHWARSLLGIKWVSPKKCHVLERRVGMNFTCRRRSIHGSMCGGMPDRVMVAYKGDSDRRAHVGKRETMLPLNSGKERRHYSP

SEQ ID NO: 161531 - protein, 279 aa, Glycine max
  Coding DNA Sequence Number=SeqID_69846
  Gene Ontology: Mol. function=acyltransferase activity; Cellular component=plastoglobule; Biological process=metabolic process
  Homolog annotation: Hit_ID=A7PA01; Match level="QueryCoverage=27%, HitCoverage=10%, E-value=1e-25, Identity=71%"; Hit description =Chromosome chr14 scaffold_9, whole genome shotgun sequence
MPFGLCNTSTIFQATMSDAGGEVANQPVHVPLILPKVHGRFYYYFGKPLEMEGRKQELRDRKKAHEIYLQVKSEVKRCIAYLKVKRESDPYRGVCAISGASLCGWVTFKSESKRGKGEKLGKRKERWARREHVLSHLYHFQQFLPLLSLATLRIQRLGELCQHRLELPNSHDEIEAARLEVAAEVGDRVDKEGGAIGANLVEAENGEDGEGVIVGNSEALIVEEAEVVMKPDKGGTTALEGGLAEMVDLKEVLEGGGVMVERERCVKDEAWVGTLSLLG

SEQ ID NO: 161532 - protein, 40 aa, Glycine max
  Coding DNA Sequence Number=SeqID_69847
MGEFGDPFGQSFRRAQRVGSGRRQGMRGWVGEHKEEDRKG

SEQ ID NO: 161533 - protein, 348 aa, Glycine max
  Coding DNA Sequence Number=SeqID_69848
MASRKRKLSTSRPHVPYDMTRFVSEELERRWWHKALTRHPNGRIGVALVKEFYANLFDLEDKSPRQVRVWGKLIKFDVEMLNTFLEAPVVLEPGERYSTYSKFCHAHPDPQELASKLCILGRGFILNTEGAPWKLLRKDLTTLAQTWSGEVSVWVGDEDGHGLRLHHLKPDLTDGLVQLLSAWLPCFDHCLKNCWNPNDPTITFPRTRKTRARGPSDISTSAPASTSAPAPPLAPIPAPLALTAPSSPFAQSSDVLVPMQQSLHHGLCLHGGFHGPGGLARSPAFSCEGEAPTAQELQPEPEATAEETLEVTPTATPLEATGRETALLTLITSQIWQQRRAPRTPGPH

SEQ ID NO: 161534 - protein, 177 aa, Glycine max
  Coding DNA Sequence Number=SeqID_69849
  Gene Ontology: Mol. function=ammonium transmembrane transporter activity; Cellular component=membrane; Biological process=transport
  Homolog annotation: Hit_ID=A7Q611; Match level="QueryCoverage=87%, HitCoverage=39%, E-value=9e-26, Identity=47%"; Hit description =Chromosome chr14 scaffold_54, whole genome shotgun sequence
  Subcellular localization annotation: CTP_CleavageSite=24; ConfidenceScore=5.18e-01
MNGDSNATWEKAKSLAGMTTPTPRGTARRKAPPPLAPFVQGWAAILMGVISRSIPWYTMMILHDKLPFLKQIDDPMAVFHTHAVPALSTSLLCMAKSLFYMVPDWEKYIRLAYGLQNDATHAGVVQGWAAILMGVISGSIPWYTMMILHDKLPFLKQIDDPMAVFHTYAVTGALAGA

SEQ ID NO: 161535 - protein, 196 aa, Glycine max
  Coding DNA Sequence Number=SeqID_69850
MSVLELYIEKDVAGGSMFHSTNSLTSCGNNLSNNEAQPAINVSNLNGDEDDDDDDYLVSNSYVEDSLDEDDSVDSISDTDDEVTEMIQPVRIVHSIEGVEGNQNPFWNDVLHYNNINWSHPDEEDICGLEMPSTFNVGQELYVGMEFDSKDVVKNAVKQYVMKVHQSFKVVETKSNKHDQRRSVNKSVFDSREDKQ

SEQ ID NO: 161536 - protein, 128 aa, Glycine max
  Coding DNA Sequence Number=SeqID_69851
  Gene Ontology: Mol. function=ammonium transmembrane transporter activity; Cellular component=integral to membrane; Biological process=transport
  Homolog annotation: Hit_ID=A7Q611; Match level="QueryCoverage=92%, HitCoverage=43%, E-value=6e-40, Identity=45%"; Hit description =Chromosome chr14 scaffold_54, whole genome shotgun sequence
MAFYAFAGVLVCWVEWGFRMSFGKKMLNFGAWMLFVPLWLTFSYTVTAFSIWLAKPGVIDFSGGYVIHLSAGVAGAGLLWMGWSGFNGGGPFVASTVASLAVLNTHVCAAASIIVWVLLCLGPYRDDN

SEQ ID NO: 161537 - protein, 505 aa, Glycine max
  Coding DNA Sequence Number=SeqID_69852
  Gene Ontology: Mol. function=binding; Cellular component =mitochondrial inner membrane; Biological process=metabolic process
  Homolog annotation: Hit_ID=Q2HUK9; Match level="QueryCoverage=70%, HitCoverage=90%, E-value=9e-82, Identity=34%"; Hit description =Tetratricopeptide-like helical
  Pfam annotation: Domain name=PPR; Domain location=176-209; Score =18.7; E_value=0.022; Accession=PF01535.11; Description=PPR repeat
  Pfam annotation: Domain name=PPR; Domain location=285-319; Score =24.1; E_value=0.00051; Accession=PF01535.11; Description=PPR repeat
  Pfam annotation: Domain name=PPR; Domain location=369-403; Score =44.8; E_value=3e-10; Accession=PF01535.11; Description=PPR repeat
  Pfam module annotation: Pfam domain module=PPR::PPR::PPR; Domain location=176-209::285-319::369-403
MGHEDEEDDDDNINDDDDDDNSGDHVLQQQYTITRGHPRTREGELFKELVDEVDEAVLSTTKPRTRLISLCLSAMVSSMRLATFCTSSTGKRDASEVTDPFFGNDTYLGPSHATAVPLTLSAFKNYGSEEKEAETVNHLTQCRKNTKTSLKDHLCTSFNYNDSRHLFDEIPDRSVVSWTSIIAGCVQNDRARDAVRVFKELLVEESGSVESEDGVFVDSVLLGCVVSAFSKLGWRGVTEGVHGLVIKRGFERCVGVGNTLMDAYAKFGEMGVAKVFDGMNESDHYFWNSVIAEYAQNGLSAEAFSVFGDMVKSGNFRYNAVIMDWSFRSFAAGEVHTSSGTSIVDIYCKCERVEMARKAFDCMKVKNVKSWTAMVAGYGMHGRAKEAMEIFYKMIRSGVKPNYITFVSVLAACSHAVERMRILMKSRGLLKAPGFSIVELKAARTWVYAKCNMVLHDVDEEEKGMVLRVHSEKLAVAFGIMNSVPGGFIISRKGRVHVGTIGDSN

SEQ ID NO: 161538 - protein, 120 aa, Glycine max
  Coding DNA Sequence Number=SeqID_69853
MVTTLTSTVDGDDAPSTVDSGVALHENLLNAPRNLFMTSSSSRQQWFVAEEEEQPFPTMVTNGDAGEKNKISHPTNTIMPSVDASNGKKSNITATETNGHNQAVSRSLCNLNPMALTSSI

SEQ ID NO: 161539 - protein, 534 aa, Glycine max
  Coding DNA Sequence Number=SeqID_69854
  Homolog annotation: Hit_ID=A7UQU7; Match level="QueryCoverage=51%, HitCoverage=52%, E-value=4e-29, Identity=31%"; Hit description=IMP dehydrogenase/GMP reductase, putative
  Pfam annotation: Domain name=DUF1723; Domain location=197-246; Score =35.6; E_value=1.8e-07; Accession=PF08330.1; Description=Protein of unknown function (DUF1723)
MEVMRVSMEVLTLFQAALHTHSSMQSRQLIMVRARGLGCALGHVTCRGVGRGNRDDYDDALQRRRPTASARRQRVLMTAAHDEPVVPAPDVEADVFSDDLMAPADVEDTGADIPLDTGAQAAENEHEGFPGGPNDLFVLTQYADHVACSVWTREERPELKLSSHGRKVHTLGRSVPAIEGLVAGTGLSPLIACSVDTGDRTILSSFVERWHREMSSFHLPVREVTIMLDDVSSLLHLPVVGDLHAFQPLHVDDAIQMLVDLLMVSAEAVRAETRQCRGPYVRLQWVYDIYERRCQAGHWTTAARAYLLHLLGCTLYAWGVAALVHMYDQMNDASISSSRQLDSYITLLQCWIYEHFPSVAESTADQDYYEDSPRACRWIATKKTMKSICTPAYRERLDQLWILDVGYTQTIPAPPVDSWVSYDDIHDRWIHYSDHMVPAGEVCTVSGQCVSDYMDWFFRISHPFMTSDQASDPLPDGHAPQPRVIPQAPQTDIPHVPEPGAPSTSARPVVEEPKHAVVGAPSELRGGQARLIDT

SEQ ID NO: 161540 - protein, 466 aa, Glycine max
  Coding DNA Sequence Number=SeqID_69855
  Gene Ontology: Mol. function=DNA binding; Cellular component=nucleus; Biological process=regulation of transcription, DNA-dependent
  Homolog annotation: Hit_ID=Q2HUJ5; Match level="QueryCoverage=69%, HitCoverage=97%, E-value=1e-107, Identity=65%"; Hit description =Transcriptional factor B3
  Pfam annotation: Domain name=B3; Domain location=141-246; Score=93.0; E_value=9.4e-25; Accession=PF02362.12; Description=B3 DNA binding domain
MDQRQREKLLHKTEACAFVAGVVPELSLVTVPGNNTNNVNNNNNVVSHSQSNGSGRIQENNHHLGLVAAVTSAFGTVQRKKRMARQRRSTKPTSLMNHLNNHKHNKPRSLPSPSASSSYVPLSSATLQPAREIDQRRLRFLFQKELKNSDVSSLRRMILPKKAAEAFLPALESKEGIVISMDDIDGLHVWSFKYRFWPNNNSRMYVLENTGDFVNTHGLRFGDSIMVYQDSENNNYVIQAKKASDQDEFMEETSDTINDIFLNDYEVNKPGCFNVTNPAVNDTGMSFIYETTFSNDSPLDFLGGSMTNFSRIGPVETFGSVENFGSNCLESTAKATTASRLAAPREDITNCIAHFSIEHERGEEDRENLERLRELEPHERHESGNRMVEELKENELTTSDSSQGGNIAATGAGLVALPEPPRLFDFSGGGDQEVGEYGDGDDGHREAVEHGNGSQRNGSATSKKQG

SEQ ID NO: 161541 - protein, 87 aa, Glycine max
  Coding DNA Sequence Number=SeqID_69856
MVILNLHPERSEPSVHGLDCITCAMVSESDSDSPSPRSAKLMASLAKQMDKLQINIERRMGKRFDEIQKSTQELSGKMEDIERRRHH

SEQ ID NO: 161542 - protein, 78 aa, Glycine max
  Coding DNA Sequence Number=SeqID_69857
MGAKFDEGTDWENNKKPYFPLTGGSVLDNGGRMNSARQSIHGASNKMVEDAQMTINSWGSGLDGGGCMNDNQFMGLRT

SEQ ID NO: 161543 - protein, 108 aa, Glycine max
  Coding DNA Sequence Number=SeqID_69858
MERSMIDAANGGALGDMTPVEARNLIEKMASNSQQFIARNDAIVLRGVHDVATDSSSFAENKKLKGKLDALVNLVTQLAMNKKSAPIARVCGLCSSADHHTDLCPSLQ

SEQ ID NO: 161544 - protein, 53 aa, Glycine max
  Coding DNA Sequence Number=SeqID_69859
MYVRLIRITDKWFLRDGYISFLYADSVGSVSEAFGNLLMEQDAVLQCRKCVAL

SEQ ID NO: 161545 - protein, 62 aa, Glycine max
  Coding DNA Sequence Number=SeqID_69860
MTRTKKIGQMTSKAIKEIAEKIDSLEEQASQGSFVPMDVRMSSLLPLGDQNTLVVYVLLEPM

SEQ ID NO: 161546 - protein, 146 aa, Glycine max
  Coding DNA Sequence Number=SeqID_69861
MAPRKLSSKRSRKDAAAAGTSATPKRVQLRDDEYTDFQEEIARRRWTPLVTPMANFDPDVVLEFYVNAWPTEEGVRDLRSWVGGQWIPFDADALSQFLGYPLVLEEGQECEYGQRRNWADRFDEEAIAQLLCIPGQDFARTTTGRR

SEQ ID NO: 161547 - protein, 122 aa, Glycine max
  Coding DNA Sequence Number=SeqID_69862
MVSQDFGSRFVEWLDMIHVRVWFGSRIKRDAPHYFHDTNAKMMIWKLYAKLVMHAPMRTLKRQIFMVMTMFLNEELYTVPEFQINIIDNNDISTNATIQTKMYALYKRQSKQQKQTLVCGIL

SEQ ID NO: 161548 - protein, 68 aa, Glycine max
  Coding DNA Sequence Number=SeqID_69863
MTISDSFAVGSCARFNRWEFRNNVRGGRQKESHEDSPSGGFNPFSVSLTFGNSIGAVGGKTGGILGNR

SEQ ID NO: 161549 - protein, 165 aa, Glycine max
  Coding DNA Sequence Number=SeqID_69864
MMEGDLIKELGQFHDVGLSIAAWMPRAHASYSAMLLVQSDPSLAVKGVDGDPVLRGTRIRATWGYVSSVEELICTIARSSPSTTYDGVVPGDMSRGSGDLGDVRRAPGSQPIKEQRPQSKEACVVAGQLWILNDISNMASGNRLPREVEMASGNWLPRGVIDYQA

SEQ ID NO: 161550 - protein, 50 aa, Glycine max
  Coding DNA Sequence Number=SeqID_69865
MAILVDGEFDANRLFDEAVFWTWTWLRHFEKHFSTHLNQWASNISQGFIM

SEQ ID NO: 161551 - protein, 60 aa, Glycine max
  Coding DNA Sequence Number=SeqID_69866
MRTSPSHAEDADISEKGADDDVSLHATGLLGHGNKRWDGRQKQGFCSYVSSISDEELRPT

SEQ ID NO: 161552 - protein, 99 aa, Glycine max
  Coding DNA Sequence Number=SeqID_69867
MVMEASWLGFFGRGKDTRCLGEGYSCFLGDDSYPGVATCTQHYCWGTQQTVKWRNCPSAIILPEEVRTDNFRKNVIRNVSGRSFFRKNSIVFRKKLLPE

SEQ ID NO: 161553 - protein, 93 aa, Glycine max
  Coding DNA Sequence Number=SeqID_69868
MSHHSSSVNGEDEREQIREEERTKILKELKKEKHASYSSHDSCKSLSEELSDYYRGRHRSHPRPHSHKSEKERKPQEANINLPYFHGKDNVKA

SEQ ID NO: 161554 - protein, 81 aa, Glycine max
  Coding DNA Sequence Number=SeqID_69869
MNLLPSVVHASSTIESGAPRIDCLVLFAYPPPSNLIRRPMNRLPSIVHASSTIKSGAPRIDCLVLFVYPPPSDSEPHELIA

SEQ ID NO: 161555 - protein, 150 aa, Glycine max
  Coding DNA Sequence Number=SeqID_69870
MFLCSMLKAQVLNIDVSSEDVSSTSRNLTIVEAKLHDESILIQRCFDDNKDDDQKLKGQSKNEFKMFKIESRILQDSRGKLKNTLRFKRKVDFKNQESRFKDQASKNQDQDSRLKIQESREDLIKITVIDYNVLVIDYQCLRTSKFKFKC

SEQ ID NO: 161556 - protein, 27 aa, Glycine max
  Coding DNA Sequence Number=SeqID_69871
NKTCMHSLDFRTVIIKKGEIVEAISSK

SEQ ID NO: 161557 - protein, 55 aa, Glycine max
  Coding DNA Sequence Number=SeqID_69872
  Subcellular localization annotation: CTP_CleavageSite=49; ConfidenceScore=5.03e-01
MVSGASVKFWETLENPSRGASVTLPRRFRKQIREGFPSFFTVLHPFFVRSSFFNG

SEQ ID NO: 161558 - protein, 61 aa, Glycine max
  Coding DNA Sequence Number=SeqID_69873
MAYGASVMLTCLRKLPEEAICSLGRARASFGEQGGNLHRILAINRGMRLFQRISDISGYAF

SEQ ID NO: 161559 - protein, 243 aa, Glycine max
  Coding DNA Sequence Number=SeqID_69874
  Homolog annotation: Hit_ID=Q6WAY6; Match level="QueryCoverage=90%, HitCoverage=40%, E-value=4e-28, Identity=34%"; Hit description =Putative uncharacterized protein
MVEEFEEIIGCPLGGRRPYLFSGFYPSLARISKIVQISAQELDHRKQLENGVVGIPRKCLEAKARILAGRGEWAPFIDILALLIFGGVLFPNVDGLVNLAAIDAFLAYHDHKESPVVAMLADLYDTFDRRCDKSGTRIVCCTPALYVWLVSHLFGQEQTKKERLSIGSLDGKKEESGVLILCGGFSNVPLMGTRGCISYNPVLAIRQLGYPMRRAPLEVELAPVISRGFNKTNGETLQKVRKA

SEQ ID NO: 161560 - protein, 49 aa, Glycine max
  Coding DNA Sequence Number=SeqID_69875
SIVSDSSFLGDPTVPFSEGKDGNSHPRSRTAGRDVCRGVDLANSSGIRG

SEQ ID NO: 161561 - protein, 411 aa, Glycine max
  Coding DNA Sequence Number=SeqID_69876
  Gene Ontology: Mol. function=transferase activity; Biological process= transport
  Homolog annotation: Hit_ID=A1FZ06; Match level="QueryCoverage=90%, HitCoverage=52%, E-value=0.0, Identity=88%"; Hit description=General secretory system II, protein E-like precursor
MELRFYNYLLPRKDMIQLPVTSLDREWYELVAGVYMDEFAEWHAKDLVVRESVSGMVPSAGVGTCFSRRALLALSAQTDNQPFNTDSLTEDYDVGARLAAMGMQSIFARFPVQFRVRRPSWFGWGPVRERTQQMALCVREYFPDNFRASYRQKARWVLGIGLQSWESLGWRGSLATKYLLARDRKGIITSFVSIIAYIIFLQLLLFWLLKMTGLWTMQFPSVFQAGTWQMNVALLTTAALATRVVQRFYFVNRLYGWEHALMSIPRMVVGNMINFMATARAWKVFLAYLLFGKRMVWDKTMHDFPDAAQLVQTRKQLGELLTTWQAVEPERLQQALDQQQAGRQQPLGRILLTQGWLDDETLAEAIAFQGDLPRACRCLRAMAHAAAAAAPGRHPATGRGPVRCPRTPWHC

SEQ ID NO: 161562 - protein, 82 aa, Glycine max
  Coding DNA Sequence Number=SeqID_69877
AKLMIGLRCSKTRLSEATSMVMHKAVIKVGNPSLEELDWAIEVIYPEMRALTFISSSVTRPKISLARSTIRSDVWEVGARLE

SEQ ID NO: 161563 - protein, 66 aa, Glycine max
  Coding DNA Sequence Number=SeqID_69878
MARENSPFAKRKPRAKRIFGHALSRESKALSIQPLHLRLIWSAKLAKAELSHFQFDLNSAKRQPNR

SEQ ID NO: 161564 - protein, 65 aa, Glycine max
  Coding DNA Sequence Number=SeqID_69879
MDRPKKCANFNGLNFSDRNEQVQLHLSVLDHDLAMLEEKYVTIIDANSNEEKPTIKIGKDRIDSA

SEQ ID NO: 161565 - protein, 121 aa, Glycine max
  Coding DNA Sequence Number=SeqID_69880
  Homolog annotation: Hit_ID=A2Q1D6; Match level="QueryCoverage=67%, HitCoverage=13%, E-value=1e-10, Identity=45%"; Hit description =Ovarian tumour, otubain, related
MDEDQWTYDYTMSQEVHMDYDNEEECGVNEPHVDCSNVFNTCQVFGTRDDVLQWARTVAHENGFVAVIMRSDTDTGSRGRSSFVLIGCERSGLYKSRNKEFVRRDTGSRKCGCPFRLHRKP

SEQ ID NO: 161566 - protein, 122 aa, Glycine max
  Coding DNA Sequence Number=SeqID_69881
MKGRRKRKRKKKAVGRGRMMCTMVWKRKKKDAHNDNNKKRKKKDDMTAMQTLCGVGSITTEKNVNAKKDKMLVNETTAISDIFGNLKNETSHVIIIMNGVTVLTNTKGLTMEQTLLPASLSP

SEQ ID NO: 161567 - protein, 161 aa, Glycine max
  Coding DNA Sequence Number=SeqID_69882
MFSKKEGMMRIMKLAKYRLKAQVEKDEGPSGEGQSPRVEKDEGPNFWHLIKFGESFSLGSIFNQSQTYQGNPCGVYPDLFSFTGSGVYPDLSFFTGSDVIQIFIACIKRSVPSQDHIKYLDKKKLMAGDEVVFYFWFYDHAWELLIRLEIEWEEEDIHLED

SEQ ID NO: 161568 - protein, 160 aa, Glycine max
  Coding DNA Sequence Number=SeqID_69883
LSTSAPLPALADLSAQSSQTSDAKLKSLFEGQILIMQSLQELPQQRPIMSVEQFIGKAPQQHELELENDHSFEAIIPGAVDFSKIKLETRSNEVTHPGPVLVPADVPFPGMDPSSPQHATYSSTPILEIPEGQTTPVLALDTSPPATPVLHLTDKEDVQS

SEQ ID NO: 161569 - protein, 1120 aa, Glycine max
  Coding DNA Sequence Number=SeqID_69884
  Gene Ontology: Mol. function=metal ion binding; Cellular component =cytoplasm
  Homolog annotation: Hit_ID=A7P3B2; Match level="QueryCoverage=97%, HitCoverage=93%, E-value=0.0, Identity=56%"; Hit description =Chromosome chr1 scaffold_5, whole genome shotgun sequence
  Pfam annotation: Domain name=Hemerythrin; Domain location=20-81; Score=25.8; E_value=0.00016; Accession=PF01814.14; Description =Hemerythrin
  Pfam annotation: Domain name=Hemerythrin; Domain location=209-271; Score=27.2; E_value=6.2e-05; Accession=PF01814.14; Description =Hemerythrin
  Pfam annotation: Domain name=Hemerythrin; Domain location=274-340; Score=11.7; E_value=1.5; Accession=PF01814.14; Description =Hemerythrin
  Pfam annotation: Domain name=Hemerythrin; Domain location=552-613; Score=23.5; E_value=0.00078; Accession=PF01814.14; Description =Hemerythrin
  Pfam annotation: Domain name=Hemerythrin; Domain location=623-715; Score=20.5; E_value=0.0063; Accession=PF01814.14; Description =Hemerythrin
  Pfam annotation: Domain name=zf-C3HC4; Domain location=1024-1065; Score=17.1; E_value=0.001; Accession=PF00097.16; Description=Zinc finger, C3HC4 type (RING finger)
  Pfam annotation: Domain name=zf-CHY; Domain location=895-972; Score =143.0; E_value=8.1e-40; Accession=PF05495.3; Description=CHY zinc finger
  Pfam annotation: Domain name=zf-MIZ; Domain location=1020-1068; Score= -2.9; E_value=0.003; Accession=PF02891.11; Description=MIZ zinc finger
  Pfam module annotation: Pfam domain module=Hemerythrin::Hemerythrin::H emerythrin::Hemerythrin::Hemerythrin::zf-C3HC4::zf-CHY::zf-MIZ; Domain location=20-81::209-271::274-340::552-613::623-715::1024 -1065::895-972::1020-1068
MSNWGLQVIFPALDKRVKNVAHTYFLEHEGEGLLFDQLFKLPNSNLLNEESYGRELASCIGALRTSICQHMFKEKEQVFPLVIEKFSSEEQGSLVWQFLCSIPVKMMAEFLPWLASYISSDEYQGCFNQNEVFNFNLLDVKVIFGWMEGLKIKHRKCTHDTKVQWKDVGMSNLLSHNEKVYSICGSSKTVKRKRVGLNEDPTNSNISCPLDELLLWHKAIKQELSDLAETARKIQLSEEFSNLSSFSGRLQFITEVCISHSIAEDRVIFPAIKAELHFLQDHTDEELQFDKLRCLIDSIQSAGADSSSAEFYFKLSSHTEQITDTILKHFEDEEAQVLPLARKLFSPQRQRELLYESLCSMPLKLIECVLPWLVGSLNQTEVRSFLQNMYMAAPATDHALVTLFSGWACNGYSRNSCFYSSTTGLCPDRRLMEIPFCMCEPSFGLNEKSSAIQQEDENGCIGPVKHGKPESKQDNDVANLMVTGKTLSSSLNQSCCVPELRVNASNLGLGSLALTKSLRELSDYPSAPSLNSSLFMWETNLVSADNQCIARPIDNIFKFHKAIRKDLEYLDVESVKLNDCDEIFIQQFTGRFCLLWGLYRAHSNAEDDIVFPALESKDNLHNVSHSYTLDHQQEEKLFLDISSGLTQLTQLHELLYKKNWSDHITNCFSNYAGCYDIDTVQNYNELSTKIQGMCKSIRVTLDQHILREELELWPLFDRHFSLEEQDKIVGHIIGTTGAEVLQSMLPWVTSALAQDEQNKMIDTLKQATKNTMFCEWLNEWWKGPASSLNITTPGDYSLGTDAYEDSEHSFLAFRPGWKDIFRMNQNELESEIRKVSQDSTLDPRRKAYLIQNLMTSRWIASQQKSSQSLGVESSKGDILETSLSFHDPEKKIFGCEHYKRNCKLRAACCGKLFTCQFCHDKVSDHLMDRKATTEMMCMQCQKIQPAGPVCATPSCGSLLMAKYYCSICKLFDDERTVYHCPFCNLCRLGKGLGVDFFHCMQCNCCMSKKLVDHICREKGLETNCPICCDFLFTSSESVRALPCGHFMHSACFQAYTCSHYICPICSKSMGDMSVYFGMLDALLASEELPEEYRNQCQVKNIYSSTTSTALEAESKLLKPF

SEQ ID NO: 161570 - protein, 423 aa, Glycine max
  Coding DNA Sequence Number=SeqID_69885
MMDNEPLQQLQARIVEIERCHKEEHRKMKTDHDELKAHIRRPQEDEHCAHMINKYTQADDSSTSFHRPNHGGRPTSRLETAQPDGKLARFKGWTMVNFLGLNKVDLGIKGMNEMVKTASFAFLALALVIGPPSPSSGSLPLLLVMSSSTDLDEHLDAFLTKANLYTNGDMILYQFFPMSLKRAALTWYGGILPRAKVDVSLSELNALSECHPLSETSTRLADMRNLEGNLSYRHALIASSACSASRLSPSRLSASLVLSENSLTHAKRDIERSEESHEKALNSRKSLKSEIHKGKEQSKRASFDLLGRFELPCYGRLNPQLGILADIERCIVSLELDRAGLGYRMSGHGVRLLVAWTSNGNELRATFRWKKCRDSETKFNKLDKSTRKEKVAQGPTYISQISDTNWKNVNPFKEDQGMIAIHP

SEQ ID NO: 161571 - protein, 86 aa, Glycine max
  Coding DNA Sequence Number=SeqID_69886
MYRLKVQSIKHTFSSNWVQGINSFIHKTYQGNPCGVYSDLSSFTGSGIYPDLSSFTGSGVIQKTLQPISNVPSRKVHIIWYQSFGS

SEQ ID NO: 161572 - protein, 51 aa, Glycine max
  Coding DNA Sequence Number=SeqID_69887
MVENLREITHGNEKEGDVCHQARPGELGCFLQKQPPSGGTSWKAQVGLVAI

SEQ ID NO: 161573 - protein, 369 aa, Glycine max
  Coding DNA Sequence Number=SeqID_69888
MASSKRKETASVPQARYDRSKFSSQKAWDRYSSNALGWKILPERNVQLYFTEFDEFRRELERRNWHKELTNFADGSIDVAIVKEFYANLYDPEDKSPKQEGESLLAYSRFALLRPVSQELAARLGLPGKGFELNADGLPLKILRKNLTGLAQTWSVLSFSNLAPTSHTSDITLDRAKLGFPALITALCKARGVTFDSLTLESLSPTINLAYVKKNCWNLDDPSVTFPGTRKSRDKGSEVPSSFVPPSSAPSSSAPFASVSALPPTAPSPVLPEPASRSDPNHAKLAELNPSEARAQPSPLGGGEASASQEPQQDQQEDIPEAAEPTTPPEPLTFETDPRVVQVQEDVTASKPSPQPEPKPGPSTPVQDI

SEQ ID NO: 161574 - protein, 89 aa, Glycine max
  Coding DNA Sequence Number=SeqID_69889
MAYTHILVKVRISKDVEFTSDSPQISASPHQLDSAPYASGSYNAQGNAPGLLHDKHMLHSSRILEKMEVEEPWLGLWLPLHYRVDMGVS

SEQ ID NO: 161575 - protein, 494 aa, Glycine max
  Coding DNA Sequence Number=SeqID_69890
  Gene Ontology: Mol. function=protein binding
  Homolog annotation: Hit_ID=A7PGW5; Match level="QueryCoverage=99%, HitCoverage=99%, E-value=1e-107, Identity=44%"; Hit description =Chromosome chr17 scaffold_16, whole genome shotgun sequence
  Pfam annotation: Domain name=DUF266; Domain location=140-484; Score =568.7; E_value=6.1e-168; Accession=PF03267.5; Description =Arabidopsis protein of unknown function, DUF266
  Subcellular localization annotation: CTP_CleavageSite=81; ConfidenceScore=5.10e-01
MKSSNNQHPLNSVSKHFNLQLVRFLPYLLFLAFGVTIGIIISFYLKSFSLQHTQFLHSSSSQINAPPPNTMPPPIEKPEVSDSNLNQEGPEEFTPPSNVVHNTQESIQPSIVVHDTKKFIQPSNHVVHNMKEFIHPSNVVHDMSDEELLWRASMTPKIREYPFDRVAKVAFMFLVRGPVPLAIFWERFFKGHEGYYSIYVHSNPSYNGSDPESSVFHGRRIPSKSGLTAVVTVRTRDGNRSRALRWLSQSWHTVLLSDFDIGSTKLVTIDGGAVAAGEESMIVEWGKFNMIEAERRLLANALLDFSNQRFILISESCIPLFNFSTIYSYLMNSTQSYVMAYDEDSLVGRGRYNPRMSPMVTLKQWRKGSQWFEMDRELALEVVSDKTYFPIFQEHCTRPCYADEHYLPTFVNIMFPEKNSNRSLTWVDWSKGGLHPTKYVRPEVTVAFLENLRNQKCEYNGQAYTNACFLFARKFLPTSLTRLMRFSPSVMHIQ

SEQ ID NO: 161576 - protein, 33 aa, Glycine max
  Coding DNA Sequence Number=SeqID_69891
MAVLFREWNPWGVPDDYRCELIENDFPSMFLSL

SEQ ID NO: 161577 - protein, 282 aa, Glycine max
  Coding DNA Sequence Number=SeqID_69892
  Homolog annotation: Hit_ID=A5ANW6; Match level="QueryCoverage=41%, HitCoverage=37%, E-value=8e-13, Identity=35%"; Hit description =Putative uncharacterized protein
  Pfam annotation: Domain name=zf-CCHC; Domain location=44-61; Score =13.4; E_value=0.014; Accession=PF00098.14; Description=Zinc knuckle
SNSEKDAENFNLMVRKFGKFLKKSKDRKFSKSSKKVDNFNNNNYTCFECGKQGHIKSEYPIYLRKHGGEKKGKKDRKQKKAYITWEDSASTTSNSLSDEEIANVCLMAKSMDDLSTSEEIEVFLKARDSLWYLDNGCSRHMTGDKSKLSDFVSKDGGYITSSLLQIGLRFHDCNHIVEFVFVVFVFVVFVSATYRLSSSLSQTGLHFRDCNHIVEFVFVEFVTATYRLRLKKTRKGKSPGKGGTQFWKSIVLGFKTPREAIEGMSLLYVIDKNPLFNGLSLL

SEQ ID NO: 161578 - protein, 108 aa, Glycine max
  Coding DNA Sequence Number=SeqID_69893
MTCGYTQVVIRTKRFLLILTREVRWHAEIPKWFYLLLSRDGESEDMLGYLMVLLLSSRDIQVRRRARFFSTRQGRSSSMACGNVMVIPCYLIEAVPESNKHENAVTRK

SEQ ID NO: 161579 - protein, 201 aa, Glycine max
  Coding DNA Sequence Number=SeqID_69894
MTITPPRAKGIVIGSSKKRSSMKVEKSGKKKQRTEYQTPSLFQDMKFKDKFDVGWFNKQVVNGRYIDLLDIKECEHLLADIMRVPKDSSRLYEDWLEGKGLRKTKVQKKFLENKRDDFKSKSLKSFGRIIHWMCMHYVLPKVGTFQELMTLVCKHFEVSLEGELLDDDVLSWGAKNVYAPKLSRQLGMEKLVLLEIGGATT

SEQ ID NO: 161580 - protein, 541 aa, Glycine max
  Coding DNA Sequence Number=SeqID_69895
  Homolog annotation: Hit_ID=A5AD69; Match level="QueryCoverage=24%, HitCoverage=12%, E-value=3e-14, Identity=34%"; Hit description =Putative uncharacterized protein
MQNLAAAKRKENIATTVMVKKQNCEKQRVVLVAPWWKGVAGFEWRRHGGHHSHGAQPSPLNQNAALLQLKAQPLHPAATPRTQNSASSDDPTATTSTGTKGGDVHRHERRRQAPARTAATTRTKVVNIAAFAKCQLHNRFASLLDPAIAPVSGPTSLTSFYNIDQDAGNVSEAYLDWEQDQSIISGEMLTRVIGCKFTWHLCDKIHSDFHSLTCAKACQIRNELRSLSLKNHPIFENFLQIQTLVNSHTSIGDSISPGEHLEMILNGLPEEYESTVWLVCNKFEPFTVDEVETLLLEQKLPSRDIIRDLWFQSILLKPSSTDMNYNDYHITPVVAVAGVLTVVVVAVAGTLVAVTLMCSAKFYENYVSIAPQGLNMQPQWYPLFWTIPPVPYIRSSQQQMPPPSQFGFPQLYSHSYPQPYTQPNYTYNRPARPISRAPPQAFHMSAPASSSTPSTSRYPDLGDWVCLEERDSPLEVTWPESQPRAATNPREFRSVRSMRRPPEVHWTSTSCFTFSWARFSPCYPVLTTCSFQPLCFLLLLR

SEQ ID NO: 161581 - protein, 119 aa, Glycine max
  Coding DNA Sequence Number=SeqID_69896
MLHVQFNVSTTQPTCVSLLCFKILILVTYDCDVAQDNSSVNFKLTREMIKPDCGGVSEVCGCAVVLIAARVLRPSAMQRTFSARRELQKRWEPCPPPQVATVDEAPTVQTVDASLLPSE

SEQ ID NO: 161582 - protein, 47 aa, Glycine max
  Coding DNA Sequence Number=SeqID_69897
MVKLNKQGIDEGAVGGFSKKPLEKASRRSHEEASRGSLLMKLLEKAT

SEQ ID NO: 161583 - protein, 182 aa, Glycine max
  Coding DNA Sequence Number=SeqID_69898
  Homolog annotation: Hit_ID=Q9ZVK3; Match level="QueryCoverage=46%, HitCoverage=11%, E-value=5e-08, Identity=34%"; Hit description =Putative retroelement pol polyprotein
MGPVAYKLALPENSRIHLVFHCSILKPFIGSPTSEQAMHLPPLAMDNQPIPAPLAILAHKTGLHPDEASWEEWSTIKSLHHLEDKLPGLHDGISHCGMVDLNLDDFGFFLDTDVDGLVESLGEGFGFPHLEGEDFASGDHGERGFELEGLGHAHGNGGLAGAGLADQEDCVAGNFSVFDHLS

SEQ ID NO: 161584 - protein, 92 aa, Glycine max
  Coding DNA Sequence Number=SeqID_69899
MMTKVMTKKLKGQSKNEFKIESRTLQDSRGKLKNTSRFKRKRVHLLGLLTENKRGYISCGSVLVEGTSTRFKENKGGYIPCGSLLVKGFLQG

SEQ ID NO: 161585 - protein, 146 aa, Glycine max
  Coding DNA Sequence Number=SeqID_69900
MSAIGLYIEKDVVGGSMFHSANFVTCGNNLSNNDSELPRNVSALDDDDDYLVSNSYVENSLDEDDSVDGISDTDDEVIHMIQPLLGVEGIQNPFWNDALYYKNINWSHPDEEDICGLEMPSSFNVGRELYVGMDFDSKDAEKNALK

SEQ ID NO: 161586 - protein, 53 aa, Glycine max
  Coding DNA Sequence Number=SeqID_69901
MGDSWWLGDKGNGRGSWWLRAKEEEGCSGNMKGEEERRKREGEEKRKEKCEEA

SEQ ID NO: 161587 - protein, 371 aa, Glycine max
  Coding DNA Sequence Number=SeqID_69902
  Gene Ontology: Mol. function=RNA-directed DNA polymerase activity; Biological process=RNA-dependent DNA replication
  Homolog annotation: Hit_ID=A5B6M9; Match level="QueryCoverage=45%, HitCoverage=44%, E-value=3e-22, Identity=38%"; Hit description =Putative uncharacterized protein
MAGAGDGGGEYHQLDGSQCLLLDNVGRHYGGKRGGNDGPRKNRMEGKNKIEGVKLNVPHFKGKSDLDTYLDWEMMIEHVFSYNDYIEEQKVKLVVAEFSDYALRNLAIKTPEVVLGKFDYGGVLQRDGNALVRANIEEETEDTMTRFLSGLNPNIRDVVELQEYMELDDLLHKAVQSPHGKLAAPSAGTKHNSASSSNTDGEITSESEISEEEEVEEELEEEVMQGDMLMNPEHKGEESLGGSEVVEEFYKDSGNLKWVEVCLTIGRYNDRVLCDMVPMEGDARLTASSKRNILGLSVRKNPEEDEVYSTNKATYLSLKSDFVKRVWTGIQSFACLGFLERERSKFQEFREILLCEDLQRPELEAGAGLRA

SEQ ID NO: 161588 - protein, 67 aa, Glycine max
  Coding DNA Sequence Number=SeqID_69903
SPLDLESCSIQSKLDHNSCQEHVPEKPHIANNLNQQVLLDMLEELVRNLSDLVARLESKLLEPPKEK

SEQ ID NO: 161589 - protein, 332 aa, Glycine max
  Coding DNA Sequence Number=SeqID_69904
  Gene Ontology: Mol. function=phosphoprotein phosphatase activity
  Homolog annotation: Hit_ID=A7UQU7; Match level="QueryCoverage=46%, HitCoverage=27%, E-value=3e-13, Identity=32%"; Hit description=IMP dehydrogenase/GMP reductase, putative
  Pfam annotation: Domain name=DUF1723; Domain location=168-212; Score =41.9; E_value=2.3e-09; Accession=PF08330.1; Description=Protein of unknown function (DUF1723)
MEIMVRTRGLGHALAMVIGRGRQDEHDVPQRRRPTASARRRRVHITVDEGAPQVTEDVPHMANDVAQMSEDVPQMTADVDATVAEDLGRDGAEGSHADEGFPSGPRDPSVLTSFVEYVAHAIWTGQCPELKLVSHERKVALIGRPVPAIEGLVVATGLSPLIECSVVTSDPGLISAFMERWHRETSTFHLPVGELTITLDDLLEVSDEEARVETIRACEAYGPLSWVREIYEMRCQCVTDDAYEEMSPRTSRWLMMKAHMKGITGAMYRACCDALTVTDVCWFPYSDHRGLRWGPTVVTVRSERVIRQFGYIQSIPPPPISASLSYDDIDDR

SEQ ID NO: 161590 - protein, 46 aa, Glycine max
  Coding DNA Sequence Number=SeqID_69905
MEGSSYLRVNDNEKNLIEMVVIRGNGVVTVEVLQIQVFKCKLTIVK

SEQ ID NO: 161591 - protein, 66 aa, Glycine max
  Coding DNA Sequence Number=SeqID_69906
MVQNDHNLSLRAIGHDCVWMAKGHRLTIICLYVPSNTTVSGWQKGQYDRDCGAADKSEALAPTYPQ

SEQ ID NO: 161592 - protein, 195 aa, Glycine max
  Coding DNA Sequence Number=SeqID_69907
  Gene Ontology: Mol. function=thymidylate synthase activity; Cellular component=cytoplasm; Biological process=nucleotide biosynthetic process
  Homolog annotation: Hit_ID=Q1CAR9; Match level="QueryCoverage=99%, HitCoverage=73%, E-value=1e-107, Identity=93%"; Hit description =Thymidylate synthase
  Pfam annotation: Domain name=Thymidylat_synt; Domain location=2-195; Score=285.1; E_value=1.4e-82; Accession=PF00303.10; Description =Thymidylate synthase
MKQYLDLMNKVLAEGTPKADRTGTGTLSIFGHQMRFNLQEGFPLVTTKKCHLRSIIHELLWFLNGDTNIAYLRDNKVTIWDEWADENGDLGPVYGKQWRAWGAADGRQIDQLSNVLQQLKQDPDSRRIIVSAWNVGELDQMALAPCHAFFQFYVADGKLSCQLYQRSCDVFLGLPFNIASYALLVHMMAQQCDLE

SEQ ID NO: 161593 - protein, 45 aa, Glycine max
  Coding DNA Sequence Number=SeqID_69908
MDSREASTRTCYGHDQVEDSVSRYGKMGRPKLVSPPSINMVGRGG

SEQ ID NO: 161594 - protein, 313 aa, Glycine max
  Coding DNA Sequence Number=SeqID_69909
  Homolog annotation: Hit_ID=A5B5V0; Match level="QueryCoverage=83%, HitCoverage=57%, E-value=9e-14, Identity=24%"; Hit description =Putative uncharacterized protein
MAEPSKKRKGTLSRSQRHSGSLEMPIPSSIPSGSLFSSEEQRIQYTNLFSSHSIIDPKFIDMDFFSNESFECFQAFENSNLIPFMSLKLPIYSELVKAFYSNLEIHEGTLISEVYGIKMVIDQSLFYDLTQFPSEGVPFKGALIDDWKFNFSVHDARRLVCTNQADMTGRLLVGSLAFESRILHYLIVRILLPRSSNLAQVSEEDLIVMWAFHKGLQIDWAHLVRYHMYKALRLNAPLPYPHLVTLFLQHFNIPLDFEPYVPIKRSFLIGASVIASFGYQKEHDGSWVKKGARNIGEEGHDGEDSSLLSKIMD

SEQ ID NO: 161595 - protein, 59 aa, Glycine max
  Coding DNA Sequence Number=SeqID_69910
FLHIHSLLTVATYPSAGGRRVTRGMRVPRKEYARSRHQRLFEENVGKTGKDAIYELFSE

SEQ ID NO: 161596 - protein, 436 aa, Glycine max
  Coding DNA Sequence Number=SeqID_69911
  Gene Ontology: Mol. function=catalytic activity
  Homolog annotation: Hit_ID=A8GIQ6; Match level="QueryCoverage=46%, HitCoverage=99%, E-value=1e-101, Identity=92%"; Hit description =Metal dependent phosphohydrolase
  Pfam annotation: Domain name=HD; Domain location=44-149; Score=25.3; E_value=4.6e-05; Accession=PF01966.13; Description=HD domain
MSSAVPALDFGSMTQVIQFLMEIDKLKGVQRRTKVLGTQRQENSAEHSWHFAIAAMSLAPYAGDDVDIQRVIQMALLHDIVEIDAGDVLVYDLAARAAIHDQEVAAARRLFGMLPEAQREYFTALWQEYEDGESADARFALLLDRTMPMLMNLHNEGQSWVENGISLEQVLARNASIADVHPELWHHMEQHLRDAQRKGWLNLFISPDGGSILAFRRHRSGQFKQTQPRHGICVSYLLNPSEKIQFIYHNLHGADASEEILAYLLSQLEKSGDLGSLAAYMNNELLHYSGQEVILKEQQAALIETVNQTLFPSFNGSVSDGAEWVQGFYYAVKSTMTSDGINYWGNVINKHPEQLNLIAQKFVDAPDNNQLQKYTAGLTINTENRGDVIVRMINDIRNDDTSEHADAKAIFLAHTHVYAAGELPAPEYQEAITAYT

SEQ ID NO: 161597 - protein, 82 aa, Glycine max
  Coding DNA Sequence Number=SeqID_69912
MWKFGPRPTPCHPDLFRPRYQDWVPTIKDPIETQPRTFFEPWPVKEGSSFFPPKQRTVKSPQGRANGMLKLDFPKKGMGKEK

SEQ ID NO: 161598 - protein, 49 aa, Glycine max
  Coding DNA Sequence Number=SeqID_69913
RGWKFSSWVKVYGELGFWLKACRTAGHDICQGVGLANSSGIKECPTLFP

SEQ ID NO: 161599 - protein, 105 aa, Glycine max
  Coding DNA Sequence Number=SeqID_69914
  Homolog annotation: Hit_ID=A6ELD8; Match level="QueryCoverage=68%, HitCoverage=15%, E-value=1e-14, Identity=55%"; Hit description =Putative uncharacterized protein
MEFNGNHLIELGFRPAKWFKEAIEYINENNLDEAQIKTYLEQYKQPDQIPLHETPKDFIINIRAEHESENDNVEKDQKVIYRWVVWLLLKMQSIPGFIAQISAVP

SEQ ID NO: 161600 - protein, 171 aa, Glycine max
  Coding DNA Sequence Number=SeqID_69915
  Homolog annotation: Hit_ID=A3HVZ8; Match level="QueryCoverage=83%, HitCoverage=76%, E-value=5e-21, Identity=38%"; Hit description =Putative uncharacterized protein
  Subcellular localization annotation: CTP_CleavageSite=44; ConfidenceScore=5.10e-01
MFKQAVLLAGILTAGVASAQSVQMNNMLKVGANVGLAVPSDNLSAAVGVDVAYQNLITPGVGLGIATGYSHYFGKENNGYKNNDVGVIPVAALLRIYPKQTGDDKVASNTSVDRPSGGFYIKPEIGYHNQDWNFFVQYQKVFTGSKGDLVNQDYNVGNIGVGFSYNIPLGK

SEQ ID NO: 161601 - protein, 148 aa, Glycine max
  Coding DNA Sequence Number=SeqID_69916
MPISPCRCTGWDRAHKTPVGPKKSNRALGFPALESHLQRHPVDPEKSNRAMEFPALGSRLQNTQWTRRSPTGSWNCQALITGLCQFYGVHVTSSKGIRPPTNRAFIKKNCIPRQAQGETPQQPGDGQQRATDAPPSPLEFTSAHPQKG

SEQ ID NO: 161602 - protein, 125 aa, Glycine max
  Coding DNA Sequence Number=SeqID_69917
MSLPSTVHLFSTVESGASRMSLPSAVRQFSILHFHSEPHECHCLALFIHPPPKEFGAMLQDCLSVDPLVQSSILHFFAEPHECHCLALFMCPPRSSLEPRECDCLALFANSPFSTSIRSPMNVIA

SEQ ID NO: 161603 - protein, 147 aa, Glycine max
  Coding DNA Sequence Number=SeqID_69918
  Gene Ontology: Mol. function=aspartic-type endopeptidase activity; Biological process=DNA integration
  Homolog annotation: Hit_ID=A5BSF6; Match level="QueryCoverage=91%, HitCoverage=47%, E-value=7e-20, Identity=38%"; Hit description =Putative uncharacterized protein
MKDDEKRKVQDDQKAKNILPSSLSSDEFFHTTRCKRAKEIWKMNEVTHDRRTDNRETILDLQTRFTHIVNHLIGLGKMFEDDELNIKILNCPTRTWEPKITTIKESKDLASMSPEALLGKLVAYEHELIQQSHAEEIEKKRKGIALK

SEQ ID NO: 161604 - protein, 547 aa, Glycine max
  Coding DNA Sequence Number=SeqID_69919
  Gene Ontology: Mol. function=4 iron, 4 sulfur cluster binding; Cellular component=peroxisome; Biological process=gluconeogenesis
  Homolog annotation: Hit_ID=A7MKE7; Match level="QueryCoverage=65%, HitCoverage=81%, E-value=1e-157, Identity=73%"; Hit description =Putative uncharacterized protein
  Pfam annotation: Domain name=NUDIX; Domain location=28-155; Score =76.5; E_value=8.5e-20; Accession=PF00293.19; Description=NUDIX domain
  Pfam annotation: Domain name=SDH_alpha; Domain location=345-547; Score=375.5; E_value=8.8e-110; Accession=PF03313.6; Description =Serine dehydratase alpha chain
  Pfam annotation: Domain name=SDH_beta; Domain location=190-332; Score= 257.5; E_value=2.9e-74; Accession=PF03315.6; Description=Serine dehydratase beta chain
  Pfam module annotation: Pfam domain module=NUDIX::SDH_alpha::SDH _beta; Domain location=28-155::345-547::190-332
MELTLAQFLSRFVLQPPLATAHSVISGRRAAVLVPVIDGDQPELLLTRRSALLRKHAGQVAFPGGMMDATDDSLIATALREAQEEVGIAPQQVRVVGVLPPVTSSTGFAVTPVVGIIPPHLPLQLNPDEVESAFSMPLAEALRLGRYSGLTLRRGHRQHQLLAAARWRLLLAALTACAVEKKICEERHRSHTVGPMKAGKQFVDLLIEQGKLQDVTRVAVDVYGSLSLTGKGHHTDIAIIMGLAGFEPASVDIDSIPAFIKDVETRERLLLAQGAREVDFPRDGGMVFRSENLSLHENGMTLYAFAGDRLLERKTYYSIGGGFIVDEAHFGQSVLDEVAVPYPFHSAKELLSHCRDTGMSLSGLACIDRGLNTEGVLPGPLRVPRRAASLRRLLVSSTKHSNDPMNVIDWVNMFALAVNEENAAGGRVVTAPTNGACGIVPAVLAYYDHFIETVTPDIFIRYFLASGAIGVLYKMNASISGAEVGCQGEVGVACSMAAAGLAELLGASPEQVCVAAEIGMEHNLGLTCDPVAGQVQVPCIERNAIAS

SEQ ID NO: 161605 - protein, 116 aa, Glycine max
  Coding DNA Sequence Number=SeqID_69920
  Subcellular localization annotation: CTP_CleavageSite=30; ConfidenceScore=5.36e-01
MYPLLFSVTTTQVDVPSTCTTKDVPSNVLRQSSQAVSPLKLCEWGNKRILKREESKEFSDCVVLNSLTWEKGDTKEFRRLVLRSFGKGRRETQKEFRWLVLGEFFLAKGEGNEKDE

SEQ ID NO: 161606 - protein, 149 aa, Glycine max
  Coding DNA Sequence Number=SeqID_69921
GAERPVVHVDPATGKADGPHRKKLRTYLGIVVRDKVDMTYENWKEVPTAQKDLIWEDIQDGVDDTVCEKYDISKEKWTQFCQTRRDPSWEKLLAKKTKKKLEEATQSGSVDGMTDPPSPVRRHVKWKMAHMKKTEEMKTKAAKETVEKI

SEQ ID NO: 161607 - protein, 186 aa, Glycine max
  Coding DNA Sequence Number=SeqID_69922
  Gene Ontology: Mol. function=helicase activity; Biological process =viral genome replication
  Homolog annotation: Hit_ID=Q9C8V4; Match level="QueryCoverage=100%, HitCoverage=29%, E-value=3e-33, Identity=42%"; Hit description =Putative uncharacterized protein T22A15.15
RLIWVPPSTRELFYMRMMLSSVKGSQSYKDIRTIDNVVYHTFREACFAKGFLVSDQEFVGALGEANTWGTPHFLRKLFVKLLFMNTMDRPEYVWEQTWQWMADDIVFNHRRQGGVYFLYGYGGTGKTFMWKTLSSAIRFNGGIVLTVASSGIASLLLPGALDKSLKDIMHNDRPFGGKVIVFGGDF

SEQ ID NO: 161608 - protein, 45 aa, Glycine max
  Coding DNA Sequence Number=SeqID_69923
NRLRQWSNVGIGLKAKTNQEARVTIDRSSSHAQHWTNRKRSWGTA

SEQ ID NO: 161609 - protein, 91 aa, Glycine max
  Coding DNA Sequence Number=SeqID_69924
SNKLSDKRAETNYGHSAPFVIREQQVELDRVRGHAETNYGHSAPCVNQEERIRQYQDDVGCRKSKASTVSQSVKFRNIPEVKRKHCCTIRE

SEQ ID NO: 161610 - protein, 48 aa, Glycine max
  Coding DNA Sequence Number=SeqID_69925
MDVKTTFLNGDLEEEVYIKNLKASPLAVASIWYVIFYLQPMIGVCYMR

SEQ ID NO: 161611 - protein, 104 aa, Glycine max
  Coding DNA Sequence Number=SeqID_69926
CPMCTVKKVIWTFQLPVTKDETNMHRMRDDMMHMRKSATGGCTQHGIIPFEKHIAAVGTTSNNMLSKRKTLDEGFQKKAMPSGGSNPARLGELGGNHLPLFSYK

SEQ ID NO: 161612 - protein, 186 aa, Glycine max
  Coding DNA Sequence Number=SeqID_69927
  Subcellular localization annotation: CTP_CleavageSite=29; ConfidenceScore=5.06e-01
MASFSQLQSQMQSQAPPEPLVGPGPSIPRVSTKGSCVDPSGNDSETGDSDRYGLYIEADPARLVAVGRVYEGSTLVHNTPLLPSQVKLSVDEVKDADAPVHVPTAEVAVSPPKPPPKPDPEVDDPLYLMTLTIPELFLRPYQVRWDATVFGVVNPYFPLYIKHEDLSKIAHGGQCLSISMLQLWIL

SEQ ID NO: 161613 - protein, 350 aa, Glycine max
  Coding DNA Sequence Number=SeqID_69928
  Gene Ontology: Mol. function=hydrolase activity; Biological process =lipid metabolic process
  Homolog annotation: Hit_ID=A7P389; Match level="QueryCoverage=99%, HitCoverage=96%, E-value=1e-130, Identity=61%"; Hit description =Chromosome chr1 scaffold_5, whole genome shotgun sequence
  Pfam annotation: Domain name=AXE1; Domain location=64-339; Score= -200.8; E_value=0.0028; Accession=PF05448.3; Description=Acetyl xylan esterase (AXE1)
  Pfam annotation: Domain name=Abhydrolase_1; Domain location=163-337; Score=-9.9; E_value=0.033; Accession=PF00561.11; Description =alphabeta hydrolase fold
  Pfam annotation: Domain name=Abhydrolase_2; Domain location=126-343; Score=-72.6; E_value=0.022; Accession=PF02230.7; Description =PhospholipaseCarboxylesterase
  Pfam annotation: Domain name=Abhydrolase_3; Domain location=137-325; Score=-90.5; E_value=0.082; Accession=PF07859.4; Description =alphabeta hydrolase fold
  Pfam annotation: Domain name=Peptidase_S9; Domain location=149-350; Score=-56.4; E_value=0.0025; Accession=PF00326.12; Description =Prolyl oligopeptidase family
  Pfam module annotation: Pfam domain module=AXE1::Abhydrolase _1::Abhydrolase_2::Abhydrolase_3::Peptidase_S9; Domain location=64 -339::163-337::126-343::137-325::149-350
MEPSVTLRFRSHTLSLFPHAPISSIDHPHNHLLIPISPKFSSNTTLSVAATAKKKPSIEGVSEELNAMASQNLDFAPSRRRVRAAFTEVHQQLDHFLFKTAPPGIRTEEGYERNSRGLEIFCKSWMPESGVPLKAALCFCHGYGSTCTFFFEGIAKRIAASGYGVYAMDYPGFGLSEGLHGYIPNFDDLVDDVIEHFTKIKARPEVRGLPRFILGQSMGGAIALKVHLKEQNTWDGVILVAPMCKAGYNVISYDHPTRLKTGMELLSATQEIESQLHKVSAPLLILHGAADQVTDPLVSQFLYEKASSKDKTLKIYEGSYHGILEGEPDDRIFAVHNDIISWLDFRCSLK

SEQ ID NO: 161614 - protein, 237 aa, Glycine max
  Coding DNA Sequence Number=SeqID_69929
  Gene Ontology: Mol. function=O-acyltransferase activity; Cellular component=integral to membrane; Biological process=GPI anchor biosynthetic process
  Homolog annotation: Hit_ID=A7R485; Match level="QueryCoverage=95%, HitCoverage=50%, E-value=2e-95, Identity=61%"; Hit description =Chromosome undetermined scaffold_631, whole genome shotgun sequence
  Pfam annotation: Domain name=MBOAT; Domain location=10-188; Score =75.7; E_value=1.5e-19; Accession=PF03062.10; Description=MBOAT family
  Subcellular localization annotation: CTP_CleavageSite=24; ConfidenceScore=5.26e-01
MEEFLNFGPPVRLFNSSKAQIDVPQNTNSVRNVTLNGFRWVLNFMWLKFLLIWRFFRFWSLINGIETPENMPKCINNCHNLEGFWKNWHASFNKWLVRYIYIPLGGSKKKLLNVWVVFTFVAIWHDLEWKLLSWAWLTCLFFIPELVLKSAAKAFQAQSSFGECIFRELSAVAGAVTITCLMVANLVGFVVGPTGINWLLSSFLNNNGLPVLGGMLMTFYVGTKIMFHIDEAKQRSP

SEQ ID NO: 161615 - protein, 326 aa, Glycine max
  Coding DNA Sequence Number=SeqID_69930
  Gene Ontology: Mol. function=glutamine-tRNA ligase activity; Cellular component=cytoplasm; Biological process=tRNA aminoacylation for protein translation
  Homolog annotation: Hit_ID=P52780; Match level="QueryCoverage=94%, HitCoverage=38%, E-value=1e-139, Identity=81%"; Hit description =Glutaminyl-tRNA synthetase
  Pfam annotation: Domain name=tRNA_synt_1c_R1; Domain location=8-170; Score=331.5; E_value=1.5e-96; Accession=PF04558.6; Description =Glutaminyl-tRNA synthetase, non-specific RNA binding region part 1
  Pfam annotation: Domain name=tRNA_synt_1c_R2; Domain location=171 -263; Score=137.6; E_value=3.6e-38; Accession=PF04557.6; Description =Glutaminyl-tRNA synthetase, non-specific RNA binding region part 2
  Pfam module annotation: Pfam domain module=tRNA_synt_1c_R1::tRNA_synt_ 1c_R2; Domain location=8-170::171-263
MPAKDDGSDKEKCLDLFLKIGLDERTAKNTVANNKVTANLTSVIDEAGATDGCSRTVGNFLYTVATKYPANALPHRPTLLQYIVSLKVKTTAQLDAALSFLATTGSENLDLDRFEEACGVGVEVSEEDIKQAVSEVVEENKATILELRYRTNVGELLGHVRKRLPWGDAKVAKQLVDAKLYELLGDRTAADDEKPSRKKKEKPAKVEDKAAPVSTPEKSPEEDVNPFLIFPNPEENFKVHTEVPFSDGSILRCCNTRDLLDKHLKATGGKVLTRFPPEPNGYLHIGHAKAMFIDFGLAKDRDGGCYLRIFWSFVTVQCNSVLYKCA

SEQ ID NO: 161616 - protein, 468 aa, Glycine max
  Coding DNA Sequence Number=SeqID_69931
  Gene Ontology: Mol. function=cysteine-tRNA ligase activity; Cellular component=cytoplasm; Biological process=cysteinyl-tRNA aminoacylation
  Homolog annotation: Hit_ID=A7R3J0; Match level="QueryCoverage=99%, HitCoverage=86%, E-value=0.0, Identity=71%"; Hit description =Chromosome undetermined scaffold_528, whole genome shotgun sequence
  Pfam annotation: Domain name=tRNA-synt_1e; Domain location=20-335; Score=529.8; E_value=3e-156; Accession=PF01406.10; Description=tRNA synthetases class I (C)
  Pfam annotation: Domain name=tRNA-synt_1g; Domain location=43-328; Score=-258.4; E_value=0.00049; Accession=PF09334.2; Description=tRNA synthetases class I (M)
  Pfam module annotation: Pfam domain module=tRNA-synt_1e::tRNA-synt _1g; Domain location=20-335::43-328
MAEEQAEFRIYNSMSQQKEIFKTKVPGKVSMYVCGVTAYDFSHLGHARAAVSFDILFRYLKHLDYEITYVRNFTDVDDKMATWVECFQYLADHVKIIKRANETGEDPLMLSNRFCDEYNADMADLQCKTPSKEPRVSEHLNEIKDMITQIISNGYAYEVDGDVFYAVDKCPNYGMLSGQRLEHNRAGERVAVDSRKRHPADFALWKAAKPGEPSWDSPWGPGRPGWHIECSAMSACYLTHKFDIHGGGIDLIFPHHENEIAQSWAADHESHVSYWMHNGHVTNNNEKMSKSLGNFFTIRQITERYHPLALRHFLISAHYRSPLNYSISQLENSSDAIYYIFQTLQDCKDAVSPLLQGETEKNEKVPQINEAAKECIKKLNVEFQTKMSDDLQTPVILTGALQEALKFVNTSLKMLKKKMQKRAQLQLIQSLLEVEKEVGKVLDVLGLLSSKSYAEVLHQLKDKALNRA

SEQ ID NO: 161617 - protein, 205 aa, Glycine max
  Coding DNA Sequence Number=SeqID_69932
MESQFHYRQIYNESSRGHIGRESRRGGGRRMRMRRKRKKEKEKGRVLGRRKKQEQERERECGAKKGKREEGWVENFEIRGRRSRNSVKLVAYYSLKFQLDPSAVKLVGVVLAHIFDELKCAISMHWMSSRGSKHITEQEPGSKEYLRSTKLRQERGLRAIGQFELVYGRVEVEAARVLDLANVDNRSKEQLCAYEMYVAGHLALG

SEQ ID NO: 161618 - protein, 246 aa, Glycine max
  Coding DNA Sequence Number=SeqID_69933
  Subcellular localization annotation: CTP_CleavageSite=44; ConfidenceScore=5.57e-01
MWALLSGTHKTRGRGPSVASTSTPAPTSTSAPPPPALIPAPPAPSSTFAKTSDAIVPMLQSLHHGICLVMQSIHDLAQHRPIISMEDFMAQVAWPGVQSSPVGGGEAPTAQELHPELEVTPEATPEETSEATEEGDGIVDADYVADMTTTRELRFKANLFQIWGNVLGDVDYGKKSSSHRKLYKEAFQAKRRESSSAAYPLNEWHPLSEAYSLLSGLENPRRGSVRDVLAQRVVSPPNEVVVLSCA

SEQ ID NO: 161619 - protein, 43 aa, Glycine max
  Coding DNA Sequence Number=SeqID_69934
MSTSVPICTISEFWLSELGALSAKRDNNLARRANGALGEHISD

SEQ ID NO: 161620 - protein, 26 aa, Glycine max
  Coding DNA Sequence Number=SeqID_69935
MWKGGVEGGIGGACGVGEKKKEVMLS

SEQ ID NO: 161621 - protein, 198 aa, Glycine max
  Coding DNA Sequence Number=SeqID_69936
GFSGFKHGQQYNQQQGQWRNHPGNQFNRDQGGSFIISQPQGPSLYDHTMKLEETLDQFMQLVDELALKPVDDLVELEEIVEEAEGDEEGEISIKDYQERIKKEEKEEETKEKEEKVKKLKNEKQKEKVVEIEKKKGKSKANSEKKKKVTPIECMEVPYPLVPSMKDKERHLARFLDIFKKLEITLPFGEVLQKMPLLC

SEQ ID NO: 161622 - protein, 25 aa, Glycine max
  Coding DNA Sequence Number=SeqID_69937
MGFSRRSSAVLRRSSFVRHRSSVFN

SEQ ID NO: 161623 - protein, 34 aa, Glycine max
  Coding DNA Sequence Number=SeqID_69938
MEKMHGEEDEEQGIKLHVELVGLVSSSSMESFAS

SEQ ID NO: 161624 - protein, 52 aa, Glycine max
  Coding DNA Sequence Number=SeqID_69939
MTETRHATVMETQDATMVGDVTMARDETMAGDSTMCFIVDTSEGGARRYHGQ

SEQ ID NO: 161625 - protein, 210 aa, Glycine max
  Coding DNA Sequence Number=SeqID_69940
  Homolog annotation: Hit_ID=A2Q6B4; Match level="QueryCoverage=89%, HitCoverage=83%, E-value=9e-20, Identity=30%"; Hit description =Ribosomal protein L33; Nucleic acid-binding, OB-fold
MAHVADKIKLIDGSREALKLSIRITDLWFIGIPGKTEQAEMVVVDSDDQLKSRKTDLKENLTYVMHNFKVIKNDGKFRVCDHEYKLCFTGVTVVRQCDMEQLPFRKFRFVAFSSVIAGDFKIRLLVDVISVVDEVVFRHVSSKNTRVVLNLKDLSGQVLSCTLWENYCLQFLSYLNDIEDERPIVILLTHARIKEAQGQCNVRFLNFHAF

SEQ ID NO: 161626 - protein, 109 aa, Glycine max
  Coding DNA Sequence Number=SeqID_69941
  Subcellular localization annotation: CTP_CleavageSite=49; ConfidenceScore=5.49e-01
ALPESASGTTERSSGRPVLPKDVSVVPEQLLFRKSSGRPSSGSSGRTPNGSSGSRHRHQAAIFSGVFYPNVPSSTLRFHLLPKGLPEKLAEKKFVGEERTKEAFAEETQ

SEQ ID NO: 161627 - protein, 85 aa, Glycine max
  Coding DNA Sequence Number=SeqID_69942
MKVGASYRMPSIEGKIGINEMAPKKLSTTRSRRDATGEGSSAAPEFDSHRFQSAEHQQRFEAIKGWSFYRERRVQLREDEYMDFQ

SEQ ID NO: 161628 - protein, 83 aa, Glycine max
  Coding DNA Sequence Number=SeqID_69943
MDEFMPQVAWPGVQPSPLGGGEASVAQEPQPEPEVAHEATLEAAQSTWDPWPTAALETPQPAQDTPSSPYGEPAPAQDEPITS

SEQ ID NO: 161629 - protein, 109 aa, Glycine max
  Coding DNA Sequence Number=SeqID_69944
  Subcellular localization annotation: CTP_CleavageSite=71; ConfidenceScore=5.17e-01
MKGRRHKYGFNNNKREKPEKIMGSPPASPPPPPPPPPPPAPAPSNASASSSAVKWTRKASRLRSLSTRPPSAERPVVHVDPATDKADNPHRKKLRTYLGIVVRDKVYVT

SEQ ID NO: 161630 - protein, 113 aa, Glycine max
  Coding DNA Sequence Number=SeqID_69945
MVAITLAKVHQPPFLREYDSNATCACHGEAPGRSIEHGRALKHKVQATMLNEMDKVDIFVPHPLTNACLLIQLSPECGCKPLVCLLKQPALLSVDFQDRSIRDYSSRTLVGVP

SEQ ID NO: 161631 - protein, 96 aa, Glycine max
  Coding DNA Sequence Number=SeqID_69946
MSSSGDSKCMVLQPTLLWASEARLAGASSKGGKCAESPPMFICGKRRKNRTKPVMKNIPNSGVVFTFEEGISTCHVDKNGALAPTYPPSKRKSDLR

SEQ ID NO: 161632 - protein, 239 aa, Glycine max
  Coding DNA Sequence Number=SeqID_69947
  Homolog annotation: Hit_ID=Q84VH5; Match level="QueryCoverage=84%, HitCoverage=37%, E-value=8e-53, Identity=51%"; Hit description =Envelope-like protein
  Subcellular localization annotation: CTP_CleavageSite=47; ConfidenceScore=5.29e-01
MATSPKETSAPGSPSVPSSPSSTKAPSNQEQPEFNIQPIQMIPGRIVSSILKNASVPDADKDVPTSSTPNAEVLSSSSKEESTEEEDQATEETPAPRAPEPAPGDLIDLEEVESDEEPIANKLAPGIAERLQSRKGRTPITRSGRIKTMAQKKSTPITPTTSRWSKVAIPSKKRKEISSSDSDDDVELDVPDIKRAKKSGKKTCLRKRTGKRCLGLQGDHGPHQGCWTAENSHQVGRLL

SEQ ID NO: 161633 - protein, 355 aa, Glycine max
  Coding DNA Sequence Number=SeqID_69948
  Homolog annotation: Hit_ID=A0HGT5; Match level="QueryCoverage=76%, HitCoverage=53%, E-value=5e-66, Identity=50%"; Hit description =Putative uncharacterized protein precursor
RDHQARPGCARRRARSAARSAGNVGAQLQHDRRQHDGAAGGRLDVGVRQPGVHRPHRHLDREGRQQRHEDQDLRGVAQLGLLPGQDVERTARGIPQVDERHKRQQRAHQGVEEELEGRVHPVRSAPDADDDVHRDQRGFEEHVEQHAVQRAEHAHHQTRQDQEGGHVLRHAAGDDFPAGQHHDDGDERGQEHEPQRNAVHAQVVVDVEGFDPGGLLDELHGSRLGVEPGVQRDRDEEAGDRADQRQAARQAGTVVTAHRQHQQAEYDRDKDRKHEAGLQVAADRRHPAHHAGAAVDQQAVDDAAVAGLPQATTQAAQAAGDDLLVDPVDVVLVLKHLVDARQARLDRGRDLRVDQ

SEQ ID NO: 161634 - protein, 184 aa, Glycine max
  Coding DNA Sequence Number=SeqID_69949
MSSPLGGDFLFSEGEVVVGCDVIDDPPKAFYGDVLGYLFNDFELALLDNAEELAGLLELGGANTRPLRVMPLSPVILVTLGDSDLISVASSFLPPRGAYLHGTARLFLSLGSRVPVHPDALSKNLFCARRGESCPPFARLCRSTFWRSLCPSNVWALNHLASTKLWTLLFKAKHCSIDWPGIPP

SEQ ID NO: 161635 - protein, 80 aa, Glycine max
  Coding DNA Sequence Number=SeqID_69950
RKIKMFVDPQNANTTTLGEVAETLQYMVSPQGRNTWTVDDLVPYVEKITILSEEQERVTEPVSHGPASKRQFPAQEFHIL

SEQ ID NO: 161636 - protein, 79 aa, Glycine max
  Coding DNA Sequence Number=SeqID_69951
MELRQRVAVTADHVDEPVIPDPDVQDDPMEAPAAVEDIPTDAGAEAAEDQPQEFPGGPSDPFVLTAYADHVACNVWTGE

SEQ ID NO: 161637 - protein, 239 aa, Glycine max
  Coding DNA Sequence Number=SeqID_69952
  Gene Ontology: Mol. function=4 iron, 4 sulfur cluster binding; Cellular component=nitrate reductase complex; Biological process =nitrate metabolic process
  Homolog annotation: Hit_ID=A9IJ73; Match level="QueryCoverage=100%, HitCoverage=45%, E-value=1e-127, Identity=87%"; Hit description =Nitrate reductase, beta chain
  Pfam annotation: Domain name=Fer4; Domain location=10-35; Score=4.7; E_value=0.069; Accession=PF00037.18; Description=4Fe-4S binding domain
  Pfam annotation: Domain name=Fer4; Domain location=43-66; Score=7.4; E_value=0.026; Accession=PF00037.18; Description=4Fe-4S binding domain
  Pfam module annotation: Pfam domain module=Fer4::Fer4; Domain location=10-35::43-66
MYSTFENTFMMYLPRLCEHCLNPACVASCPSGSIYKREDDGIVLVDQDKCRGWRMCISGCPYKKIYYNWHSGKAEKCTFCYPRIEAGQPTVCSETCVGRIRYLGVMLYDADQIERAAAVGNEQDLYESQLDLFLDPHSPEVIAAAREQGIPESWLEAARQSPVYKMAVQWRVAFPLHPEYRTLPMVWYIPPLSPIQTAAEAGKMPQRTLGTSAMIPDVASLRIPVRYLANLLTAGKEAP

SEQ ID NO: 161638 - protein, 137 aa, Glycine max
  Coding DNA Sequence Number=SeqID_69953
EDEEVQALKLELGKARLAKEKFKSAATNIRKECTELREENVATARALEQETKRARKEERGRDKFRGALWGSNNELELRREERDQSRVHGMILKEELAACARSKRSLAQHLEAMEQSMLAIIGQYKEELNQSVTHEQS

SEQ ID NO: 161639 - protein, 100 aa, Glycine max
  Coding DNA Sequence Number=SeqID_69954
MPVSVRTYLMRIMKLAKYRLKAQVEKDEGPSGEGQSPRVEKDEGPSNPCGVYLDLSSFTGSGVYPDLSSFTGSGVYPDLSSFTGSGVIQISVACIKRSAP

SEQ ID NO: 161640 - protein, 165 aa, Glycine max
  Coding DNA Sequence Number=SeqID_69955
MLCAQYPLEDDMPFQRQPDKETFLWVLCRQSDVPKENHQAWGGMVWIPCVQPVEAKLHDESRLIQRCFDDNKGDDKKLKDVQDASRFKRKFDFKNQESRFEVQASKNQDQDSRLKIQESRKDLIKISMKRFFQKLSSTWFFLKTCLPKSFYSLVIDYQIVAIVYQ

SEQ ID NO: 161641 - protein, 90 aa, Glycine max
  Coding DNA Sequence Number=SeqID_69956
MAGSGQQTHRRHLQSPSAHLQRLERCLRPVADQQVTKSKDKAQDVKEALLGGNIELATKKLPAKRSRKGTIEEDSSVASQADTSFDKHQF

SEQ ID NO: 161642 - protein, 324 aa, Glycine max
  Coding DNA Sequence Number=SeqID_69957
  Gene Ontology: Mol. function=motor activity; Cellular component=cell projection
  Homolog annotation: Hit_ID=UPI00016621D1; Match level="QueryCoverage =89%, HitCoverage=40%, E-value=8e-23, Identity=36%"; Hit description =UPI00016621D1 related cluster
TILSQPLCNEGSYLLTFKGLHVFTFKGLHVLAFKGLHVLAFRGLRTLTFRGLHIVTFRGLHVLAFRGLHVLAFRGLHVLAFRGLHVLTFRGRHVLGLRGLHVLTFRGLHALAFRGLHVLTFGGLHVLSLRGLHVLTFRGLHDLGFKGLHVLTFIGLHALAFRGLHVLAFRGLDVLTFRGLHVLAFRGLHVLTFRGLHVVPFKGLHVLTFKDYTSTPFRGLCTLNVKGLHVLAFRGLHVLAFKGPHVLPFRGLHALPFRGLHALPFRGLHILSFRGLHILTFRGLHALTFRGPHVLAFIRIHALMRIMKLANYRLKAQVEKDEGP

SEQ ID NO: 161643 - protein, 53 aa, Glycine max
  Coding DNA Sequence Number=SeqID_69958
MDTSEPYTGAMKGTMHKPQANLGEPYTRAMRGTVHEPQAKQKKRGTNPGISMD

SEQ ID NO: 161644 - protein, 106 aa, Glycine max
  Coding DNA Sequence Number=SeqID_69959
METCPTVRDLLQQMIDQDRLKVSNKGEEEQHICMQSADKEGPKRPKPLIIHFTKDMAPQRPRHPLTVSGVWPILFPYKNSHAVPWRYAPPGGMKEEAIDVASLSTK

SEQ ID NO: 161645 - protein, 399 aa, Glycine max
  Coding DNA Sequence Number=SeqID_69960
  Gene Ontology: Mol. function=protein serine/threonine kinase activity; Cellular component=nucleus; Biological process=protein amino acid phosphorylation
  Homolog annotation: Hit_ID=A7NW94; Match level="QueryCoverage=96%, HitCoverage=30%, E-value=1e-150, Identity=71%"; Hit description =Chromosome chr5 scaffold_2, whole genome shotgun sequence
MAFLVEQGGLLGNNWYLISLSSLIVFQGRDDFQITLLRIFESLTEESPVILGNPDIFIREILPSSTVLYKGNKDGDARFLCLKILFDVMIILLSEPIEEEHRLKDLKFVSNTHFLPLYPTLIEDEDPIPIYAQKLLVMLMEFSFITIPDILHLKTISQCFEFLLGDLSNANVNNVKLCLALASAPEMESKLLSQLKVVRRIGNFLEFVYAKGMEDLLDPTLGLCKAFLARSVSCTKGFSYTTEPILLGDCPPELSGGAVDPQQCIKDIADFGSNVGVLLELSASAETSIADIASECVVLLLKAAPREATTGILTNLPKVTVILESWNRGIPHLMVQRMLHALGYACKQYLLHAMILSISKPEISRTEVIVSELKSSGGSALAKTAGLAALELQRLPRCI

SEQ ID NO: 161646 - protein, 275 aa, Glycine max
  Coding DNA Sequence Number=SeqID_69961
  Homolog annotation: Hit_ID=A7Q8Z8; Match level="QueryCoverage=95%, HitCoverage=60%, E-value=4e-42, Identity=40%"; Hit description =Chromosome chr9 scaffold_65, whole genome shotgun sequence
MSVSILDGKIQRKKVKDILAKQVMNELIQRTSSSLYNHALYNHDHTGTGSINSSNNDQSKEKGGFQKIRRTDSPILIATKMGVTEMVEKILEIDPVAILDVDADNKNVVLSAIENRQPHVYSLLNKRSMIKETAFRQVDNQGTVHCTLLPPIGVINLGVSLVLQCNCSGNTSGIRTSSMLVKNSMPPNFYERYNKNGQTAKQVFNSTHEKLAKEGGKWLTKTSESCSLVAALVATVAFTTSTAIPGGPDQNTGYPLFQGRPAFNIFAVASLACCT

SEQ ID NO: 161647 - protein, 537 aa, Glycine max
  Coding DNA Sequence Number=SeqID_69962
  Gene Ontology: Mol. function=metal ion binding; Cellular component =nucleus; Biological process=regulation of transcription, DNA -dependent
  Homolog annotation: Hit_ID=A7NWA8; Match level="QueryCoverage=90%, HitCoverage=57%, E-value=1e-116, Identity=49%"; Hit description =Chromosome chr5 scaffold_2, whole genome shotgun sequence
  Pfam annotation: Domain name=SBP; Domain location=115-193; Score =156.2; E_value=9.1e-44; Accession=PF03110.5; Description=SBP domain
  Pfam annotation: Domain name=zf-NADH-PPase; Domain location=133-165; Score=15.3; E_value=0.0041; Accession=PF09297.2; Description=NADH pyrophosphatase zinc ribbon doma
  Pfam module annotation: Pfam domain module=SBP::zf-NADH-PPase; Domain location=115-193::133-165
MEPQSLPPPPTMDDAQDPSSIWDFSYLLDFNLDDQDGIFTSSNSLPLPLNDDDDAAAPEISQNDRVRKRDPRMTCSNFLAGRVPCACPELDAKLEDEGLPVKKRARTARASASARCQVPGCEADISELKGYHRRHRVCLRCANAATVMLNDEAKRYCQQCGKFHVLSDFDEGKRSCRRKLERHNTRRRRKPPADSGGAAHSELLQPVAQNEEHNYHVEAGKDKVGFLCCKNAHWLCTNRADCSNLSTDVNDVGVSPDHEDEPVSIPSLAPDHEDEPVSIPSLAPEAQNINSDSVVSLAVSGEMRVNSGNTSNSPSYCNNKNAYSSVVGFLLSFMIGILQNFLEGYDTKQPIAFVQIFQWLANMPVELEGYIRPGCTILTVFIAMPNIMWITVRVQLDVLYIMWFLCHDSLEYVHDFVAPGKMLSGRGTALVHLNDMIFRVMKDGTSVTKVEVNMLAPRLHYVHPTYFEAGKPMEFVACGSNLLQPKFRKQNERDGSCSSSKQQTEQEKPQALQLQQTENERDERERTRWSGFEMKCE

SEQ ID NO: 161648 - protein, 272 aa, Glycine max
  Coding DNA Sequence Number=SeqID_69963
  Gene Ontology: Mol. function=sugar:hydrogen symporter activity; Cellular component=integral to membrane; Biological process =carbohydrate transport
  Homolog annotation: Hit_ID=Q8LBI9; Match level="QueryCoverage=98%, HitCoverage=52%, E-value=1e-89, Identity=65%"; Hit description=Sugar transporter ERD6-like 16
  Pfam annotation: Domain name=Sugar_tr; Domain location=46-266; Score=- 168.4; E_value=0.021; Accession=PF00083.15; Description=Sugar (and other) transporter
MAIEQHKDVESGYLQQPFIQPEEAAACEEVGSDKSVENGSIGMVFLSTLVAVCGSFTFGTCVGYSAPTQAAIRADLNLSLAEFSMFGSLVTIGAMLGAITSGRITDFIGRKGAMRISTGFCITGWLAVFFSKGSYSLDMGRFFTGYGIGVISYVVPVYIAEIAPKNLRGGLATTNQLLIVTGGSVSFLLGSVINWRELALAERYNNWLGLNFEGLVPCICLLVGLCFIPESPRWLAKVGREKEFQLALSRLRGKHADISDEAAEILVLSKLS

SEQ ID NO: 161649 - protein, 32 aa, Glycine max
  Coding DNA Sequence Number=SeqID_69964
MLGMTSFSTQFVKRQNLPPSFHHHVQVLRKGT

SEQ ID NO: 161650 - protein, 293 aa, Glycine max
  Coding DNA Sequence Number=SeqID_69965
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=A7NWB3; Match level="QueryCoverage=100%, HitCoverage=99%, E-value=1e-111, Identity=66%"; Hit description =Chromosome chr5 scaffold_2, whole genome shotgun sequence
  Pfam annotation: Domain name=2OG-FeII_Oxy; Domain location=115-240; Score=68.3; E_value=2.6e-17; Accession=PF03171.11; Description=2OG -Fe(II) oxygenase superfamily
  Pfam annotation: Domain name=ShK; Domain location=253-293; Score =18.2; E_value=0.015; Accession=PF01549.15; Description=ShK domain -like
  Pfam module annotation: Pfam domain module=2OG-FeII_Oxy::ShK; Domain location=115-240::253-293
MASALALMLQWHEAFSSYAGSASAIIDPSKVKQVSWKPRAFVYEGFLTELECDHLISIAKSELKRSAVADNLSGESKLSEVRTSSGMFIPKNKAGAKSIGAGAAIIASMGVAVENGEDIQVLRYEHGQKYDPHYDYFADKVNIARGGHRVATVLMYLTDVTKGGETVFPNAEESPRHRGSETKEDLSECAQKGIAVKPRRGDALLFFSLYPNAIPDTMSLHAGCPVIEGEKWSATKWIHVDSFDKMVADGGDCNDKQENCDRWATLGECTSNPNYMVGSPGLPGYCMKSCKAC

SEQ ID NO: 161651 - protein, 228 aa, Glycine max
  Coding DNA Sequence Number=SeqID_69966
  Gene Ontology: Mol. function=protein serine/threonine kinase activity; Cellular component=cytoplasm; Biological process=protein amino acid phosphorylation
  Homolog annotation: Hit_ID=Q8GXZ5; Match level="QueryCoverage=84%, HitCoverage=38%, E-value=3e-62, Identity=64%"; Hit description =Putative uncharacterized protein At5g18910/F17K4_160
  Pfam annotation: Domain name=Pkinase_Tyr; Domain location=124-227; Score=-152.3; E_value=0.0044; Accession=PF07714.8; Description =Protein tyrosine kinase
MNTILDLEALEIEEGSPRSQGSETPSSRASTSDSESQGSFAGTPNNNNQWRGFFKLLKKGSQMPFQTFHPLKNVPKLTRRKSKRIREDLIPSLNAASLDTEFGCFKSSWKNFTLAEIQAATDDFSHENLIGEGGYAEVYLGKLEDGNFVAIKRLTRGCQEEMTADFLSELGIIVHVDHPNIARLIGYGVEGGMFLVLQLSPHGSLSSILYGIYTNHFESFWNAMQILG

SEQ ID NO: 161652 - protein, 444 aa, Glycine max
  Coding DNA Sequence Number=SeqID_69967
  Gene Ontology: Mol. function=protein serine/threonine phosphatase activity; Cellular component=protein serine/threonine phosphatase complex; Biological process=protein amino acid dephosphorylation
  Homolog annotation: Hit_ID=A5B8E5; Match level="QueryCoverage=78%, HitCoverage=99%, E-value=1e-158, Identity=77%"; Hit description =Putative uncharacterized protein
  Pfam annotation: Domain name=PP2C; Domain location=54-333; Score =123.7; E_value=5.4e-34; Accession=PF00481.12; Description=Protein phosphatase 2C
MGCVHGKCCTRYPSPSVGGSRDFRELGPYCAQRKHILTQSSLQFVPVPSHNFTLEYSVLTQRGYYPDSPDKENQDSFGIRTQFQGNPSVHFFGVYDGHGEFGGQCSNFVKDRLVENLSSDIALLEDPVKAYTSAFLTTNDDLHKNEIDDSLSGTTAITVLVIGNTLYVANVGDSRAVLAVKDGNRVVAEDLSSDQTPFRRDEYERVKLCGARVLSVDQVEGHKDPDIQTWGDEENQGDDPPRLWVQNGKLPGAAFTRSVGDKLAETIGVIAVPEVSTVQLTPNHLFFVVASDGVFEFLSSQTVVDMAASYSDPRDACAAIAGESYKLWLEHEGRTDDITIIIVQIKGLSNPLKKLARAVPIQVSVTSGLGAGEINVSTVTRTKSKRVKGASEISATTGLDVCRSVRNGFSDLQSCPQHVVSTRSPAIVVPSPACQTPVVLVQSH

SEQ ID NO: 161653 - protein, 108 aa, Glycine max
  Coding DNA Sequence Number=SeqID_69968
MVCTHQDEGGLAYSYSEWSNWGDAEATRVGLIKRSRSYPPHPKADLKIPNICSEIPRTLNKTKHSHHSRPQPYYLLRDQGKQQCCMGEESSDNVMWEKERVANHGRGK

SEQ ID NO: 161654 - protein, 97 aa, Glycine max
  Coding DNA Sequence Number=SeqID_69969
  Homolog annotation: Hit_ID=Q9M303; Match level="QueryCoverage=60%, HitCoverage=20%, E-value=3e-12, Identity=66%"; Hit description =Putative uncharacterized protein T21J18_70
  Pfam annotation: Domain name=SAM_1; Domain location=19-77; Score =16.5; E_value=0.0035; Accession=PF00536.21; Description=SAM domain (Sterile alpha motif)
  Pfam annotation: Domain name=SAM_2; Domain location=18-82; Score =12.1; E_value=0.079; Accession=PF07647.8; Description=SAM domain (Sterile alpha motif)
  Pfam module annotation: Pfam domain module=SAM_1::SAM_2; Domain location=19-77::18-82
MGREGKCFVLFRSLGKASPEFCVKNLAQWVVLGRYAPVFKIHKVDDEVLPLLMLEDLKDVGINAVGSRRKICFVQFKSLGRASPELGFFLLLAWENS

SEQ ID NO: 161655 - protein, 413 aa, Glycine max
  Coding DNA Sequence Number=SeqID_69970
  Gene Ontology: Mol. function=triacylglycerol lipase activity; Cellular component=extracellular region; Biological process=lipid metabolic process
  Homolog annotation: Hit_ID=A9P9L1; Match level="QueryCoverage=84%, HitCoverage=97%, E-value=1e-140, Identity=69%"; Hit description =Putative uncharacterized protein
  Pfam annotation: Domain name=Lipase_3; Domain location=157-297; Score= 155.3; E_value=1.6e-43; Accession=PF01764.16; Description=Lipase (class 3)
MTKSTPATSYLHCFFFSSNYYCYDSLTSPSSLWLEKTLFAGKPTATFAVRDSASEHMGKTSWLIILVTCLCLLAFSDGRELKVRHKKPHYQYNHTLATILVEYASAVYLSDLTELFTWTCSRCNGLTKGFEMIELVVDVEHCLQAFVGVADDPCAIIIAFRGTNEHSLQNWIEDLYWKQHDINYPGMDDAMVHRGFYTAYHNTTIRPAILDAVERAKKFYGDIEIIATGHSMGGAMASFCGLDLTVNQNEKNVQVMTFGQPRVGNAAFASLYTKLVPNTIRVTNDHDIVPHLPPYYYYLPQKTYHHFPREVWLYNIGLGSLVYNVEKICDESGEDPDCSRSVTGNSIADHLVYYGVDMGSDEPSSCRIVMDSHVQNTSIRDSRGNLILSRDPATPLIKLGGEGDNQENPINVD

SEQ ID NO: 161656 - protein, 369 aa, Glycine max
  Coding DNA Sequence Number=SeqID_69971
  Gene Ontology: Mol. function=catalytic activity; Biological process =metabolic process
  Homolog annotation: Hit_ID=A7NW86; Match level="QueryCoverage=84%, HitCoverage=97%, E-value=1e-104, Identity=60%"; Hit description =Chromosome chr5 scaffold_2, whole genome shotgun sequence
  Subcellular localization annotation: CTP_CleavageSite=45; ConfidenceScore=5.23e-01
MELGIRSPVHATLFHHFSNSLLFPARLTLLNTTSSSFMATHLHVSSEEFDPSPSLAIGQHDLLIVGPGILGRLVAHNWRQEYSGCQVFGQTATTNHHRELTEIGINPSLKWTKASLKFPYVIFCAPPYQSSDYLGDLRLAASCWNGEGALLFTSSSAPYDCNDNGLCHEDSPVVPTGRSPRTDVLLKAEKIVLEFGGSVLRLSGLYISFSKFSLLGFQLFIHLGVSASNLDILNKVDKGAHAYWLEKGIVESRPDHILNLIHYEDAASLSVAILKKQFRGRIFLGCDNHPLSRQEVMDLVYKSGKFSKKFEKFTGCYHCVTHHCKSMPLYISLAGTDDPLGKRLNNSRTRQEVGWEPKYSSFAHFLETI

SEQ ID NO: 161657 - protein, 382 aa, Glycine max
  Coding DNA Sequence Number=SeqID_69972
  Gene Ontology: Mol. function=protein binding; Cellular component =cytoplasm; Biological process=abscisic acid mediated signaling
  Homolog annotation: Hit_ID=A9PEU2; Match level="QueryCoverage=91%, HitCoverage=90%, E-value=1e-160, Identity=78%"; Hit description =Putative uncharacterized protein
  Pfam annotation: Domain name=F-box; Domain location=34-89; Score =25.3; E_value=0.00023; Accession=PF00646.24; Description=F-box domain
  Pfam annotation: Domain name=Tub; Domain location=108-376; Score =429.6; E_value=4.4e-126; Accession=PF01167.9; Description=Tub family
  Pfam module annotation: Pfam domain module=F-box::Tub; Domain location=34-89::108-376
TPLHKAVTLGGIGIGDLDVPNQKHEIAVAAMRQSCWANMPQELLREVLFRIEASEDAWPPRKSVVACAGVCRSWRQITIDIVKTPELSSKITFPISVKQIVLWLKNIDAAVSRLPLREGKGEALAEDGKFLLAARKCRRPTCTDYIISLDADDMSKGSNSYVGKLRSNFLGTKFTIYDGQPPHAGAKIMKSRSTRLVNLKQVSPKVPTGNYPVAHISYELNVLGSRGPRRMHCVMDSIPAAAIEPGGVAPVQTEFSLNNIDMFPSFPFFRSKSNRVENSVSGPLVDQKDGMLVLKNKAPRWHEQLQCWCLNFHGRVTIASVKNFQLVASAENRPAGPEHDKIILQFGKVGKDLFTMDYRFPISAFQAFAICLSSFDTKIACE

SEQ ID NO: 161658 - protein, 294 aa, Glycine max
  Coding DNA Sequence Number=SeqID_69973
  Gene Ontology: Mol. function=structural molecule activity; Cellular component=endoplasmic reticulum; Biological process=lipid transport
  Homolog annotation: Hit_ID=A7NW93; Match level="QueryCoverage=86%, HitCoverage=87%, E-value=4e-41, Identity=43%"; Hit description =Chromosome chr5 scaffold_2, whole genome shotgun sequence
  Pfam annotation: Domain name=Motile_Sperm; Domain location=5-129; Score=16.5; E_value=0.0012; Accession=PF00635.17; Description=MSP (Major sperm protein) domain
  Subcellular localization annotation: CTP_CleavageSite=60; ConfidenceScore=5.26e-01
MATELLQIDPPQLTFTFELKKQSSCLVHLINNNSSHHVAFKVPSFASPTSFTLLTLLNIRSKPRRPRNTASDQLSASSSHTEHVISPAQRTAPPDLHCKDKFLVQSAVVPKGTTEDEISSDLFVKDSGRLVDEKKLRVVLINSPSSPVNGDLKQDPPSQMLPSLTAEKGMEAAQDMEEDGADKGTFPSTRSVEKVGDMKQVNDAVNLSFATKDSEELKSRLSIMDAKLREAEGTIMKLNEERRRNIREKDLLKQELVVATFHPQNSFQHKFSLVNAIELQELANYHSLSMDNRI

SEQ ID NO: 161659 - protein, 329 aa, Glycine max
  Coding DNA Sequence Number=SeqID_69974
  Homolog annotation: Hit_ID=A2Q4S5; Match level="QueryCoverage=58%, HitCoverage=45%, E-value=3e-13, Identity=41%"; Hit description=IMP dehydrogenase/GMP reductase, putative
  Pfam annotation: Domain name=DUF1723; Domain location=6-55; Score =53.6; E_value=6.9e-13; Accession=PF08330.1; Description=Protein of unknown function (DUF1723)
MCSVDTGDQGLLSSFVERWHRETSSFHLPVGEVTITLDDVSSLLHMPVVGDLHAFQPLHVDDAVQMLVDLLMALRDLSQTGRYAWGVVALIYEHFPSVTESTVDQDYDEDSPRACRWIATRKTMKSIHTLAYRERLDRLRILDVCWILYGEHRPVRDFYMISCYSGLLRWGPIVLYYRPERVMWQFGYTHTIYALPVDSWMSYDKVDALFLIGGCTIRIIWFQEVRPGIRSSARWSCSVAPSRPSGPRDRYPSCAGARSIVNIYEEPRHAVEVCHGIAERLERHLSLGLVTPGSSTHKVIEECHRMARSVTQDQLVYVRSRRRQHTDQA

SEQ ID NO: 161660 - protein, 89 aa, Glycine max
  Coding DNA Sequence Number=SeqID_69975
MTKLGLCLSSALDDKRVRITIRMTKLGLCLSSALDDKRVRITVRMTKLGLCLSSALDDKRVRITVRYLRVSWVQNDQTWSLLVIGPLSG

SEQ ID NO: 161661 - protein, 115 aa, Glycine max
  Coding DNA Sequence Number=SeqID_69976
  Pfam annotation: Domain name=G-patch; Domain location=46-90; Score =2.4; E_value=0.095; Accession=PF01585.14; Description=G-patch domain
MDSLGGSRPLNAPPKIEIHGGGVLSHCFGGGRCSESLPMQPHMSGAAMMVACVMLGHDYELGMGLGKNNDGMASLVDIKENCGKFGLSYKPTQTNVRRTVTSWKFLPGIFGNDAF

SEQ ID NO: 161662 - protein, 128 aa, Glycine max
  Coding DNA Sequence Number=SeqID_69977
  Subcellular localization annotation: CTP_CleavageSite=29; ConfidenceScore=5.12e-01
MTFRGPRKAWGKRSEVPTTSAPPETAAPSSSTAPVPLIQTLAIPSASTHIPLPAPLSPGLSDFSFTPQMLHSMLQSLHKVQSIIIQSLQGLGLPSIMSMDEFDVQVAWPGAQPSPSGEGGASTSQDQQ

SEQ ID NO: 161663 - protein, 68 aa, Glycine max
  Coding DNA Sequence Number=SeqID_69978
HSPTRALSARHALSEQSSTGTKRGVMLENAESVTRAKREPHAKHAIQQKHMLSLQHALSEQSERAKRE

SEQ ID NO: 161664 - protein, 189 aa, Glycine max
  Coding DNA Sequence Number=SeqID_69979
  Homolog annotation: Hit_ID=A5BEV8; Match level="QueryCoverage=87%, HitCoverage=20%, E-value=7e-09, Identity=28%"; Hit description =Putative uncharacterized protein
NALNEIAAEVEHLCYLGNNPFSCGCVMRSTHGLPRGWLCEAEVSIKEEVETISKRFEELDVNTKGAPKKSMKRRQISTKHDLSYWEYVDAFHSVQSSNSSVKHSASSSKPPKPTRIIPMLDQFAPFIQGFIHNVVDVKADGNCEYRSIAALLGMREDSWSLVRNKLIKELGRWLHDYTNLFVAQRDLNN

SEQ ID NO: 161665 - protein, 241 aa, Glycine max
  Coding DNA Sequence Number=SeqID_69980
TNPQEIEARLCIPRKGFVLNAKGQPWKLLINDLTTLAQTWSVFSYSNLAPTSHTSDLNMDRARLVYGLVTNMDINIGALISGQISSIAQSSSSRLGFPALITALCRARGVTSNKGARKARVRLADVPSSSTLPAPSTSATPTPAPPGSSTQDSQCFESMLQKKVSWPGTLPSFVREGGGPSAQIPQQASRSQPADPSTPVLEIPKDPATPVLGLTTTLPATPMLHLTDEEGTQDQETQQDD

SEQ ID NO: 161666 - protein, 81 aa, Glycine max
  Coding DNA Sequence Number=SeqID_69981
MVRKRIKELKKKKEKNDEVVTNEKVEEKGLSKEEKQKSKKQATNKGKVVVNHPPIEYLPYPCNDPPRHYNITTLNSKNFNF

SEQ ID NO: 161667 - protein, 58 aa, Glycine max
  Coding DNA Sequence Number=SeqID_69982
MGSRNGSGYEAEMVLSNIVEPTLLSQDGSDLDKPVSQETFLEEFKIVRMSVANRVNVN

SEQ ID NO: 161668 - protein, 84 aa, Glycine max
  Coding DNA Sequence Number=SeqID_69983
MEQYYGIWFASRRPTTGHIMQSQGVASFSCPTPDQFRAEVAWPGDWPEAQAGEAPPEAPDDGEEAHEDEEMADLLDFLGGSGAT

SEQ ID NO: 161669 - protein, 61 aa, Glycine max
  Coding DNA Sequence Number=SeqID_69984
MGRPRLRCFARMLQPCGIGTGLKELSNWVTPKAYTPKSLLGPLPPDSGPTPKIIFACRHCS

SEQ ID NO: 161670 - protein, 227 aa, Glycine max
  Coding DNA Sequence Number=SeqID_69985
MLATGNRLLPSGNRLPESKTLCSEGPSPKQVRVKGHLVKIDADSLKTFLETPVVLAEGETLPTYSRYCKLSTYYREIEAALCILGRGFILNTEGHPGKILMKDLTTLAQVSSVLSNSNLAPTSHTSDLTVDRARLIVGLSNSSRLGFPALITALCRARGVDSDSLVFERLSPIINLAYIRKNCWNPDDLTVTIRGARRARVRPTELPSTSVAPTPASTSATPSILAY

SEQ ID NO: 161671 - protein, 73 aa, Glycine max
  Coding DNA Sequence Number=SeqID_69986
MGEVLNSRKQSRSSFAKRKPCSKHIFGHALSRESQALSAQPLHLRVIWSAKLAKAELSQLQFDLNSANGRRDR

SEQ ID NO: 161672 - protein, 99 aa, Glycine max
  Coding DNA Sequence Number=SeqID_69987
MRRLTAKSLDQPRPTVHVNPSTGRGSGPHKEKFHSYLGVVARENIPIVHTTWKDVPKTLKVLVWDDTLKSDVIESMQFKAPNFIDMAWNWSRFIKRSSP

SEQ ID NO: 161673 - protein, 69 aa, Glycine max
  Coding DNA Sequence Number=SeqID_69988
MGWFLDQGAEVLDKDHEKHRETAVWDYTYPWFQLGKGRIKRIPRRGPLNSLGNGEGRHKRIQAVSPLFF

SEQ ID NO: 161674 - protein, 49 aa, Glycine max
  Coding DNA Sequence Number=SeqID_69989
MSKRLQEDWARAAEEGPRVLMNLRGAPYCRVGYPRNIGFFSPCIFGHLD

SEQ ID NO: 161675 - protein, 215 aa, Glycine max
  Coding DNA Sequence Number=SeqID_69990
  Homolog annotation: Hit_ID=A5C7R1; Match level="QueryCoverage=30%, HitCoverage=5%, E-value=3e-08, Identity=50%"; Hit description =Putative uncharacterized protein
MSTVEEAFLIATYVISRLPTCVLQGISPVEHMLSFSPLPLLSSLSCYVFGCIAFVHSHSPHRGKLDPRVVKMSKTLILRKHHNEDVEKDNNEAEEQDQFFGQKYQRGVKQNPLLSHSKFNCLNQSLGSIERQKLGSRHESRDEALERNSMWDIVDKPKDKKVVRCRGIFIVKSMEEFMSCFRMIQTSKKVIQMLLKTYTVRNDPLILCHNRLFLQ

SEQ ID NO: 161676 - protein, 70 aa, Glycine max
  Coding DNA Sequence Number=SeqID_69991
MMFEKVSYCDIGVTRYDDGDDYGDENDIKADIEDDDNDEEEEDDEVEFKGDDEFENVGVNHHNHTIVFAL

SEQ ID NO: 161677 - protein, 154 aa, Glycine max
  Coding DNA Sequence Number=SeqID_69992
  Gene Ontology: Mol. function=binding
  Homolog annotation: Hit_ID=A2Q2L0; Match level="QueryCoverage=39%, HitCoverage=41%, E-value=6e-10, Identity=60%"; Hit description =Tetratricopeptide-like helical
MIHGLFKSKRVDEAMNLLREMLHKNMVPNAVTYNSLIDDLCKSGRLTYALDLMEKEMHPRGQAAEVVIKKKEKAICSKWEKQLRRMFKVTRSGSIPLTSICLEREMGFIFTRGPKILLNWKMGRHHQQHYPWMEAESESKEGKWGLEEKEESWE

SEQ ID NO: 161678 - protein, 310 aa, Glycine max
  Coding DNA Sequence Number=SeqID_69993
  Gene Ontology: Mol. function=nucleic acid binding; Cellular component= nucleus; Biological process=mRNA processing
  Homolog annotation: Hit_ID=Q84L59; Match level="QueryCoverage=97%, HitCoverage=70%, E-value=1e-138, Identity=80%"; Hit description =Polypyrimidine track-binding protein homologue
  Pfam annotation: Domain name=RRM_1; Domain location=125-192; Score =31.1; E_value=4.1e-06; Accession=PF00076.13; Description=RNA recognition motif. (a.k.a. RRM, RB
  Pfam annotation: Domain name=RRM_1; Domain location=235-302; Score =35.2; E_value=2.4e-07; Accession=PF00076.13; Description=RNA recognition motif. (a.k.a. RRM, RB
  Pfam module annotation: Pfam domain module=RRM_1::RRM_1; Domain location=125-192::235-302
MDQNQAREDEVGFQALIQYQSRQSAVTARSTLQVVLRLHGACGITCLDELQVNYNNDRSRDFTNPNLPTEQKGRSSQPGYGDAAGMYSGARAGGFSQMANAAAIAAAFGGGLPPGITGTNERCTVLVANLNPDRIDEDKLFNLFSIYGNIVRIKLLRNKPDHALIQMGDGFQAELAVHFLKGAMLFGKRLEVNYSKHANITQGADTHEYVNSNLNRFNRNAAKNYRYCCSPTKMVHLSTLPQDITEEEVVSLLEEHGTIVNSKVFEMNGKKQALVQFETEEQATEALVCKHASPLSGSVVRISFSQLQNI

SEQ ID NO: 161679 - protein, 284 aa, Glycine max
  Coding DNA Sequence Number=SeqID_69994
  Gene Ontology: Mol. function=binding; Cellular component=cytosol; Biological process=protein folding
  Homolog annotation: Hit_ID=A9PHG9; Match level="QueryCoverage=89%, HitCoverage=51%, E-value=5e-63, Identity=45%"; Hit description =Putative uncharacterized protein
  Pfam annotation: Domain name=TPR_1; Domain location=201-234; Score =12.5; E_value=0.17; Accession=PF00515.19; Description=Tetratricopepti de repeat
  Pfam annotation: Domain name=TPR_1; Domain location=23-56; Score=8.5; E_value=0.5; Accession=PF00515.19; Description=Tetratricopeptide repeat
  Pfam annotation: Domain name=TPR_1; Domain location=235-268; Score =32.4; E_value=1.6e-06; Accession=PF00515.19; Description =Tetratricopeptide repeat
  Pfam annotation: Domain name=TPR_1; Domain location=57-90; Score =13.9; E_value=0.11; Accession=PF00515.19; Description=Tetratricopepti de repeat
  Pfam annotation: Domain name=TPR_2; Domain location=17-56; Score=6.2; E_value=5; Accession=PF07719.8; Description=Tetratricopeptide repeat
  Pfam annotation: Domain name=TPR_2; Domain location=201-234; Score =15.2; E_value=0.25; Accession=PF07719.8; Description=Tetratricopeptid e repeat
  Pfam annotation: Domain name=TPR_2; Domain location=235-268; Score =21.0; E_value=0.0044; Accession=PF07719.8; Description =Tetratricopeptide repeat
  Pfam annotation: Domain name=TPR_2; Domain location=57-90; Score =15.4; E_value=0.22; Accession=PF07719.8; Description=Tetratricopeptid e repeat
  Pfam module annotation: Pfam domain module=TPR_1::TPR_1::TPR_1::TPR _1::TPR_2::TPR_2::TPR_2::TPR_2; Domain location=201-234::23-56::235 -268::57-90::17-56::201-234::235-268::57-90
MMKTPPVQDYIGNGDLPPDRIRSALVGNDFKKLYKQGRFEEALALYDRAIAIDSKKATYHCNKSAALISLGRFLQVIVECEEAIRLEPSYGRAHTHLATIYFRLREAEKALNCNETSPCVDSVLAFQAQALQNHLSKYTEARKVKDWKVILKESQAAISLGADSAPLVSWFEDAVTTSQQASKLDPSSFEVNAVVRRARAVASARMSGNLLFKASKFTEASAVYNEGLEHDPYNSVLLCNRATCHSKLGQFKKAIEDCNVALIVQPSYSKVRLRRTDYNVKVHP

SEQ ID NO: 161680 - protein, 454 aa, Glycine max
  Coding DNA Sequence Number=SeqID_69995
  Gene Ontology: Mol. function=carbon-sulfur lyase activity; Cellular component=vacuole
  Homolog annotation: Hit_ID=A7QX58; Match level="QueryCoverage=99%, HitCoverage=99%, E-value=1e-156, Identity=57%"; Hit description =Chromosome undetermined scaffold_213, whole genome shotgun sequence
  Pfam annotation: Domain name=Alliinase_C; Domain location=89-443; Score=708.5; E_value=5e-210; Accession=PF04864.4; Description =Allinase, C-terminal domain
  Pfam annotation: Domain name=Aminotran_1_2; Domain location=92-439; Score=-94.1; E_value=0.014; Accession=PF00155.12; Description =Aminotransferase class I and II
  Pfam annotation: Domain name=EGF_alliinase; Domain location=31-87; Score=128.0; E_value=2.7e-35; Accession=PF04863.4; Description =Alliinase EGF-like domain
  Pfam module annotation: Pfam domain module=Alliinase_C::Aminotran_1 _2::EGF_alliinase; Domain location=89-443::92-439::31-87
MAKRTSPIYIGFVIVLCASSMFVICMGEWESTWSTRAAEEAEAVAAIPCSGHGRAYLDGLILKGHEPVCECNPCYGGSDCSNLLSDCAANAGSGDPYFLEPFWMQHAASSAILVSGWHRMGYSYSDESYISQLLVEYIKKLHAIVGNAATEGRYIVFGSGSTQLLNAAVHALSPSSSVSPAKVVATAPYYPVYRAQTQFFNSRDFSYEGDTSLWKNSTDSNSRFIEFVTSPNNPDGKLNKGVLKGPNVKTIYDRAYYWPHFTAIPSPADDDLMLFTISKLTGHAGSRFGWAIIKDEAVYQTMLTYLQLNTFGVSRDAQLRALKLLDVVLEGDGKELFQFAYSTLKDRWRRLKQIISESKRFSLQNLSPQYCTFFKRVKDPSPAYAWLKCERQQDKNCYEILEAAGIIGRQGSDYSADNRYLRLSLIRSEDDFEILINKLKNLVPTEKETKDFNN

SEQ ID NO: 161681 - protein, 447 aa, Glycine max
  Coding DNA Sequence Number=SeqID_69996
  Gene Ontology: Mol. function=carbon-sulfur lyase activity; Cellular component=vacuole
  Homolog annotation: Hit_ID=A7QX58; Match level="QueryCoverage=96%, HitCoverage=93%, E-value=1e-160, Identity=60%"; Hit description =Chromosome undetermined scaffold_213, whole genome shotgun sequence
  Pfam annotation: Domain name=Alliinase_C; Domain location=90-444; Score=699.4; E_value=2.7e-207; Accession=PF04864.4; Description =Allinase, C-terminal domain
  Pfam annotation: Domain name=EGF_alliinase; Domain location=32-88; Score=128.2; E_value=2.4e-35; Accession=PF04863.4; Description =Alliinase EGF-like domain
  Pfam module annotation: Pfam domain module=Alliinase_C::EGF _alliinase; Domain location=90-444::32-88
MGHFISQKSQSSTEKLLEYYYFIRKTTGEWEPTWSSRAAEEAEAVAAIPCSGHGRVYLDGLILKGHEPVCECNPCYGGSDCSKLLSDCAANAAGGDPYFMEPFWMRHAASSAILVSGWHRMGYSYSDKSYISQLLVEYIKKLHAIVGNAITKGKYIVFGSGSTQLLNAAVYALSPNSSMSPAKVVATAPYYPVYRTQTQFFNSRDFSYEGETSSWKNKTDKNSIFIEFVTSPNNPDGKLTKEVLEGPNVKSIYDRAYYWPHFTAIPSPADDDLMIFTISKLTGHAGSRFGWAIVKDEAVYEKMLTYMDMNTMGVSREAQLRALKLLDVALEGDGKEIFQFAYSTMRDRWIRLKEIISKTKRFSLQKISSQYCTFFKRGRDASPAYAWLMCERQQDKNCYEILEAAGINGREGSLYSADNRYVRLSLIRSQDDFEILINKLKILVSKE

SEQ ID NO: 161682 - protein, 124 aa, Glycine max
  Coding DNA Sequence Number=SeqID_69997
MRPQLSPSQHERLLACAAGGGAAAAASRSAGGGVGLGVVVEHIPATLMVEEGHAIVVSVDRIHDRRGRGRREWRWRMKGGSFFLWRRGSVGKRRLDRRVFRMIVLGWLRGIIFSDVIAVSNSLT

SEQ ID NO: 161683 - protein, 323 aa, Glycine max
  Coding DNA Sequence Number=SeqID_69998
  Homolog annotation: Hit_ID=A5BZX0; Match level="QueryCoverage=39%, HitCoverage=15%, E-value=6e-32, Identity=52%"; Hit description =Putative uncharacterized protein
  Subcellular localization annotation: CTP_CleavageSite=37; ConfidenceScore=5.58e-01
GTPPPPPPPPPPPTRLPPPPPPPDTFAATLERHLPPSASSSSPSRLAGLLSNRDILTSLAVDDDVSERISVGAGAMAEAIAKQCGVPNDDVILEELSHDCPQRGAFVLPTEIPDETLSPNAIPDPNQDQDSTMQAPIPTILTVIDDDPEPDSSTGAATCGGGTTTRRTTKRKKGPKRTALERRSRKKLQVIVTTLNPIPFTPAKTLDFERHQSLLRRLGLWYFVHVEFDSALRGDLLAQLITSYVPTNRCSYVNGVRINVNRADLGRTLKLPVKKTGCGGGATADSIDSAESIAFAEEVVYSWMLLHDGYIRKPNLESLHTYN

SEQ ID NO: 161684 - protein, 426 aa, Glycine max
  Coding DNA Sequence Number=SeqID_69999
  Gene Ontology: Cellular component=integral to membrane
  Homolog annotation: Hit_ID=A7Q7A4; Match level="QueryCoverage=81%, HitCoverage=84%, E-value=3e-95, Identity=57%"; Hit description =Chromosome chr18 scaffold_59, whole genome shotgun sequence
  Pfam annotation: Domain name=DUF677; Domain location=61-379; Score= -105.1; E_value=1.7e-05; Accession=PF05055.3; Description=Protein of unknown function (DUF677)
MLANNLENFLFRLKFQHQVSSKDQPSMLSKLRARKACQDWKPPRDAPKSVNFHEEYHKALRTKSYVDFFDKAQLLANQPSIYSNHNKFSEILLEPDQETIYSVIDHISKTPELKNLMLSYFDISAEASFICSHLLQSINQVQCNYQFIERALGIMDDDDSLEKFKLISFELNSFIFSKNPLSNLNINHDLFKLISDENSSVLLHRLKSMRKKLGRKVKLMTYLKKASEICVAVYDLVAITANVTAAHTLSTLIMGPTILNFPCKSLNKRELPHLRFSRRRFLSNVCDQLDIAAKGTYILNKDFDTMTRVVARLYDEIEHKRTMVQFFLDKKDDKFSLQMVKELKKSGDGFRKQVEELKEHVYLCLVTINRARCLVTEEMTKMCTEGIGSVDMLLASSEQEKVKNSTRKMVGNSNSPESKVRRYMDS

SEQ ID NO: 161685 - protein, 579 aa, Glycine max
  Coding DNA Sequence Number=SeqID_70000
  Gene Ontology: Mol. function=endonuclease activity; Cellular component=nucleus; Biological process=cytoskeleton organization and biogenesis
  Homolog annotation: Hit_ID=Q06166; Match level="QueryCoverage=100%, HitCoverage=85%, E-value=9e-25, Identity=24%"; Hit description =Mature parasite-infected erythrocyte surface antigen
MQESEDVKEEMAKRKGKEIEYFVNKGKGEEPKRMDMESKNDLTTETMQETKDVIEVMVKRKDKEIKNFADKSEGKEPKRMHTEPKKDLIKETMQENEDVKEAMFKEKSKETEYFVVNGEGGEPKRMHMEENKDLTTETMQESEYVKEAMSKRKGEEEIGYFLNEGEGENPKGTHMEAKDTTEIMQESEDIKEATIKKKGKETEYFVDQGEGREPKRIHTKEIEYDSEPIVKRKDKEIDYFVDKREGEELKMTHMEAKKDIAEETMQEEIKKNKNGTKDIDQENVLEKTDKGKFEVPTEELPKLVGRQDGSRGLKVAKMEEQKEIIKEAMAETECSMEKVKGEKSNTTGRVTEKNIASEILQKETEESNIERKSRDGPYVPNNMVKVVFEVLGTFQAKLPKQVMEAISQNKRDKNEYVIVNLRGEGSIKMHVEPNDAFDEYETEDINQKEIGTPKLNSSDQISEKDNVDVWVFDGSKKPKFPKIGQTNYVKDSAKIEEFVKKVNEDKYEKTQVEEKRGLIKAITGESTQTEREGSKIQTIEKDQHRLPEKRNKRRFEASTTAKEEFPVKTVDSLADKERD

SEQ ID NO: 161686 - protein, 348 aa, Glycine max
  Coding DNA Sequence Number=SeqID_70001
  Homolog annotation: Hit_ID=A7Q7B0; Match level="QueryCoverage=97%, HitCoverage=94%, E-value=1e-126, Identity=63%"; Hit description =Chromosome chr18 scaffold_59, whole genome shotgun sequence
  Pfam annotation: Domain name=DUF677; Domain location=31-346; Score= -179.7; E_value=0.045; Accession=PF05055.3; Description=Protein of unknown function (DUF677)
  Pfam annotation: Domain name=DUF793; Domain location=1-346; Score =679.8; E_value=2.1e-201; Accession=PF05633.2; Description=Protein of unknown function (DUF793)
  Pfam module annotation: Pfam domain module=DUF677::DUF793; Domain location=31-346::1-346
MRATAEFQGSVLNLRGVQVHSMEGSSMEQELDLFQKHVTERFLELSSVESGELLSLSWVRKLLDSFLCCQEEFRVILHNHRDQVMKHPPLDRMVGEFFERSVKALDVCNAIRDGIEQIRQWQKLLEIVLCALDHKRSIGEGQFRRAKKALVDLAIGMLDDKDSSSSGSIAHRNRNWSAARQLQALGNNLSPPKATDIVATNGLALPIFTMSYVMVFVMWALVAAIPCQDRGLGLHFSVPKQFSWAAPVVALHERIMEESKKRERKNTCGLLKEIHQIEKCARVINDLADSVQFPLSEEKGEEVRQRVQDVSKVCEALKDGLDPLERQVREVFHRIVRSRTEGLDSHGR

SEQ ID NO: 161687 - protein, 1066 aa, Glycine max
  Coding DNA Sequence Number=SeqID_70002
  Gene Ontology: Mol. function=protein binding; Cellular component =nucleus; Biological process=red or far red light signaling pathway
  Homolog annotation: Hit_ID=A5Y6J2; Match level="QueryCoverage=100%, HitCoverage=87%, E-value=0.0, Identity=72%"; Hit description=LATE BLOOMER 1
MERQYCEPEVSSGKSHATTNDSVDGESGHNSLMQQEKKPIRPLSPWITDILRAAPLGIRSDYFRWCSGVMGKYAAGELKPPTIVSARGSGKHPQLVPSTPRWAVANGAGVILSVCDDEVARYETATLTAAAVPALLLPPPTTALDEHLVAGLPALEPYARLFHRYYAIATPSATQRLLLGLLEAPPSWAPDALDAAVQLVELLRAAEDYACGIRLPRNWMHFHFLRAIGTAMSMRSGVAADAAAALLFRILSQPALLFPPLRQVDGVEVQHEPLGGYISSNRKQIEAASAEATIEATAQGIASVLCAHGPEVEWRICTIWEAAYGLIPLNSSAVDLPEIVVATPLQPPILSWNLYIPLLKVLEYLPRGSPSEACLMKIFVATVEAILQRTFPAESTSDHKIKTRYYCVGSASKNLAVAELRTMVHSLFLESCASVELASRLLFVVLTVCVSHEVQFNGSKKPRGENNYLVEEIIEDLQAVSESQKETKNRKMKKQGPVAAFDSYVLAAVCALACELQLFPMISRGDNHSVPNNVQNIAKPVKIDGSSHALQNGIDSAIRHTHRILAILEALFSLKPSSVGTSWSYSSNEIVAAAMVAAHISELFRRSKACMRALSVLMRYKWDDEIHSRASSLYTLIDIHRKAVASIVNKAEPLGATFIHTPICKDPCDRSKRKNQCENSRCLDPGQTSTSTSEDSSRSKFSKKSERTSYSNEASGCTFEKATTSLPFDASDLANFLTMDRHIGFNCSAQIFLRSRLAEKQQLCFSVVSLLWQKLIGSPETQPCAESTSAQQGWRQFFYLDLSYFLFPSPYLNLVADALCKVVSASPTKAAMAVVLQAEKELQPWIAKDDNLGQKLWRINQRIVKLITELLRNHDNLESLVIVASASDLLLRATDGMLVDGEACTLPQLKMHTHPHIYSSIPCSFFFMSLYEKLKILEQLLEATAKAVQPVIELGESGLGVADGLSNLLKCRLPATIRCLSHPSAHVRALSSSVIRDILHTSSIGSSPKPLQKNGIHDQYLNFDVIDWRADVENCLTWEAHSRLSNGLSIEYLNTAADDLGFAISI

SEQ ID NO: 161688 - protein, 360 aa, Glycine max
  Coding DNA Sequence Number=SeqID_70003
  Gene Ontology: Mol. function=protein binding; Cellular component =cellular_component; Biological process=regulation of transcription
  Homolog annotation: Hit_ID=A7Q7B7; Match level="QueryCoverage=80%, HitCoverage=96%, E-value=1e-105, Identity=61%"; Hit description =Chromosome chr18 scaffold_59, whole genome shotgun sequence
  Pfam annotation: Domain name=F-box; Domain location=49-104; Score =25.1; E_value=0.00026; Accession=PF00646.24; Description=F-box domain
  Pfam annotation: Domain name=Tub; Domain location=115-334; Score =243.5; E_value=4.7e-70; Accession=PF01167.9; Description=Tub family
  Pfam module annotation: Pfam domain module=F-box::Tub; Domain location=49-104::115-334
MSFRSIVRDVRDGFGSLSRRSFDVRLSGGGKSNSLVHEEHECLPVVQNSRWASLPPELLRDVIKRLEESETTWPARKHVVACAAVCRSWRGMCKEIVTSPEFCGKITFPVSLKQPGSRDGTIQCFIKRDKSNLTYHLFLCLSPGRSRRFYSKKVSPKVPSGSYNIAQITYELNVLGTRGPRRMNCTMHSIPMSALEPGCTVPGQPELLPRSLEDSFRSISFARSIDNSTEFSSSRFSDIFLAGKEEEQGKDRPLVLKNKSPRWHEQLQCWCLNFRGRVTVASVKNFQLIAATQPPATGAPTPSSQPAQSDHDKIILQFGKGLVTRVFIAKSALTVVVENISGSYQTNSNGGEKGIGSSDG

SEQ ID NO: 161689 - protein, 44 aa, Glycine max
  Coding DNA Sequence Number=SeqID_70004
MECEHDAKKRMIEREREKLTDYGCDTVLMLITSDTRYAPKVHTS

SEQ ID NO: 161690 - protein, 82 aa, Glycine max
  Coding DNA Sequence Number=SeqID_70005
MCSLLTDFNILKDLSIEHFEGLPLAETKVQYKVIQVALSEILTTNCVRKNWVGIVFLKCKQYKGTESLFSEPYIYRESVKVV

SEQ ID NO: 161691 - protein, 122 aa, Glycine max
  Coding DNA Sequence Number=SeqID_70006
MVRANGLVRRVRQWPNWPYHCHGSASLPRAASSAVEPTPDFDCTAAAYYTSLCVGRHTFDDCRAFRSILSVDERLRESAPLRSVYVAVVYTGGAAEVRKSQSVRREEWKIQKLFVWQLQRFG

SEQ ID NO: 161692 - protein, 61 aa, Glycine max
  Coding DNA Sequence Number=SeqID_70007
MKKKNTESRRDKDENIQSMNGPLRGSEPFILSLPPLFIAKIGEVFAIQLVGASWFLPNEAF

SEQ ID NO: 161693 - protein, 143 aa, Glycine max
  Coding DNA Sequence Number=SeqID_70008
MAAQLIHDRVEMECLEATWETLEGNMRCRFRGTIRFTATSLEHPDEPARTLQRTVEWILPTPTPYRLVEPVQVIEVTSSEEGPEEDLEELPSKPAVDALDFLEGDEDPLPEVDSPEEVTSASEADSTEDSGPGEMAISGGSSS

SEQ ID NO: 161694 - protein, 135 aa, Glycine max
  Coding DNA Sequence Number=SeqID_70009
MKIQKKGVPTDPKRIKVIPDWPTPPSIREIWGCHDLINFYKRCQGKEPKVSRTSGFEGKSFPRGERMMQSYPPRGVCVAKALASHLKELPLKASYPRHSLGGEAPSSMAYSLVDDASSHLFSFIFCCTSMVENHH

SEQ ID NO: 161695 - protein, 257 aa, Glycine max
  Coding DNA Sequence Number=SeqID_70010
  Gene Ontology: Mol. function=ATPase activity, coupled to transmembrane movement of substances; Cellular component=integral to membrane; Biological process=transport
  Homolog annotation: Hit_ID=A7P0X5; Match level="QueryCoverage=71%, HitCoverage=39%, E-value=2e-72, Identity=74%"; Hit description =Chromosome chr19 scaffold_4, whole genome shotgun sequence
  Pfam annotation: Domain name=ABC_tran; Domain location=81-239; Score=- 0.6; E_value=8.4e-07; Accession=PF00005.18; Description=ABC transporter
MGGLSILSALPNLTAITEATAAVTRLFEMIDRVPTIDSEDKKGKALSYVRGEIEFQDVYFCYPSRPDTPVLQGFNLTVPAGKSVGLVGGSGSGKSTVIQLFERFYDPVEGVILLDGHKTNRLQLKWLRSQIGLVNQEPVLFATSIKENILFGKEGASMENVISAAKAANAHDFIVKLPDGYETQPNNHNNKLHKQYNTQLRAGEHLSYDSIRDQNQLQTMNMPEQQGEKQKINLNTRNNIQHFQLPLSISLLTSQHF

SEQ ID NO: 161696 - protein, 55 aa, Glycine max
  Coding DNA Sequence Number=SeqID_70011
MRKEKIPHQAPFAIQAAQLLGRAIGFSQSRRCKTTASAKLACLQVDSRGSPQYPD

SEQ ID NO: 161697 - protein, 386 aa, Glycine max
  Coding DNA Sequence Number=SeqID_70012
  Gene Ontology: Mol. function=DNA-directed RNA polymerase activity; Cellular component=intracellular; Biological process=transcription, DNA-dependent
  Homolog annotation: Hit_ID=Q5PK93; Match level="QueryCoverage=63%, HitCoverage=18%, E-value=1e-136, Identity=97%"; Hit description=DNA -directed RNA polymerase subunit beta
  Pfam annotation: Domain name=RNA_pol_Rpb2_1; Domain location=166-356; Score=40.4; E_value=6.2e-10; Accession=PF04563.6; Description=RNA polymerase beta subunit
  Pfam annotation: Domain name=Ribosomal_L12; Domain location=37-104; Score=124.2; E_value=3.8e-34; Accession=PF00542.10; Description =Ribosomal protein L7L12 C-terminal domain
  Pfam module annotation: Pfam domain module=RNA_pol_Rpb2_1::Ribosomal _L12; Domain location=166-356::37-104
MDVVELVSAMEEKFGVSAAAAVAVAAGPAEAAEEKTEFDVILKAAGANKVAVIKAVRGATGLGLKEAKDLVESAPAALKEGVSKDDAEALKKSLEEAGAEVEGASSVSHCLAAGVLGEDAMKWFKRDSKRHCGNELRNPMVYSYTEKKRIRKDFGKRPQVLDIPYLLSIQLDSFQKFIEQDPEGQYGLEAAFRSVFPIQSYSGNSELQYVSYRLGEPVFDVKECQIRGVTFSAPLRVKLRLVIYEREAPEGTVKDIKEQEVYMGEIPLMTENGTFVINGTERVIVSQLHRSPGVFFDSDKGKTHSSGKVLYNARIIPYRGSWLDFEFDPKDNLFVRIDRRRKLPATIILRALNYTTEQILDLFFDKIVFEIRDNKLQMELVPERLR

SEQ ID NO: 161698 - protein, 148 aa, Glycine max
  Coding DNA Sequence Number=SeqID_70013
  Gene Ontology: Mol. function=N-acetyltransferase activity; Biological process=metabolic process
  Homolog annotation: Hit_ID=Q2STN3; Match level="QueryCoverage=80%, HitCoverage=85%, E-value=8e-29, Identity=47%"; Hit description =Acetyltransferase, GNAT family , putative
  Pfam annotation: Domain name=Acetyltransf_1; Domain location=53-129; Score=62.1; E_value=1.8e-15; Accession=PF00583.15; Description =Acetyltransferase (GNAT) family
MDSLITFEKLTAQHLPYLYEIRFSVEENLLHPHQIQYLQRKQALEDINQGGGWICKHGDDYAGVGFGLFIPEPLIGGLFVKPEYQSKGIGSALLARITHWMFEHGAEAIHLTTDPGSKAEGFYQHHGWAVVGQDEFGQVELVKRQEGD

SEQ ID NO: 161699 - protein, 238 aa, Glycine max
  Coding DNA Sequence Number=SeqID_70014
  Gene Ontology: Mol. function=4 iron, 4 sulfur cluster binding; Biological process=thiamin biosynthetic process
  Homolog annotation: Hit_ID=A8G8E9; Match level="QueryCoverage=26%, HitCoverage=16%, E-value=6e-26, Identity=87%"; Hit description =Thiazole biosynthesis protein ThiH
MGAVAINSVSAGSKTQPGGYADDVPPELEQFEPHDGRTPQQVAEAISNAGLQPVWKDWDENAGAAAQCRTPALAPVTSPAIVTLPTAKPGVGRGRHPLDGPALSHPGSRRSFSCATPGPRPRQRAYGVSRPVRAYGQIALSANGQSERWHNDVRHSLRSDTHRALWRQKSGNEDKKVQRRREIRVVIPGAAIGPGVGRGSFCRLLPAYGQEQAVYFVRLAPPQDANHTVCALINHTND

SEQ ID NO: 161700 - protein, 99 aa, Glycine max
  Coding DNA Sequence Number=SeqID_70015
MTGPLDESISCFLIRVDPWVLVPIDFRGLHVLALRGLDALAFRGLLVLDFRGLHVLAFRRLHALVFRGLHVLAFGGLHVLDFRGLHVLDLRGLHVLYIY

SEQ ID NO: 161701 - protein, 100 aa, Glycine max
  Coding DNA Sequence Number=SeqID_70016
  Subcellular localization annotation: CTP_CleavageSite=86; ConfidenceScore=5.04e-01
MLRNLADYIIIPFLTSGMLRNLTNCATMLPFLFPVCHGTLRIVHQYFFVFGMSRNFTNCLMMGAKHLTRTKQRSHVIKQRSPDEIRVLRKESMSFKNLWI

SEQ ID NO: 161702 - protein, 74 aa, Glycine max
  Coding DNA Sequence Number=SeqID_70017
MGFFLVGNLALSVFGLFLFCFCLARGEQVTDAQDFGKVYGKLGFWLKACSTPGHDICQGLVRFKDKRGCPTSFL

SEQ ID NO: 161703 - protein, 47 aa, Glycine max
  Coding DNA Sequence Number=SeqID_70018
MQQGHAYILIVRFPDPNNGINETLGLIRILVVDLKRANKAALTLVNF

SEQ ID NO: 161704 - protein, 74 aa, Glycine max
  Coding DNA Sequence Number=SeqID_70019
MVTSKEMKVSTENNNGLWWLMVAVGDGESAWDTKFGDDPTVNEGWAAFIPRQLHVASLRSFIKRLPQEDSSWLL

SEQ ID NO: 161705 - protein, 80 aa, Glycine max
  Coding DNA Sequence Number=SeqID_70020
LMRTLGPSLGSLAQSTWSLLSNALAGIEVDLRRGKFDYTSTMTSGNRRPEANGTKKKEGETHNVTIVPTWSSSPKTPHNP

SEQ ID NO: 161706 - protein, 87 aa, Glycine max
  Coding DNA Sequence Number=SeqID_70021
  Subcellular localization annotation: CTP_CleavageSite=55; ConfidenceScore=5.64e-01
MVSGAFVASVKFSKTLGGSNWAADSSTFLKNGFQGFRGFRKISENLGKIESKCFRNASVSDSVEILHRSSFVLRSSTAFFSSIFNVL

SEQ ID NO: 161707 - protein, 65 aa, Glycine max
  Coding DNA Sequence Number=SeqID_70022
  Gene Ontology: Mol. function=aspartic-type endopeptidase activity; Biological process=DNA integration
  Homolog annotation: Hit_ID=A5BLB1; Match level="QueryCoverage=93%, HitCoverage=12%, E-value=6e-13, Identity=55%"; Hit description =Putative uncharacterized protein
IDSIRILTLVQEALKDENWVLAMNDEIGALERNETLEIVERPKDKKAVGCRWIYIVKYQADCILD

SEQ ID NO: 161708 - protein, 125 aa, Glycine max
  Coding DNA Sequence Number=SeqID_70023
TLFLQHFNIPLDSEPYVPIKRSFLIGAAVIASFGYRKEHDGSWAKKGAQPIDDEGHLPVGEDSSLLQKFLDRFDGLQTYVGERFDALELQVDMRFDEMDSRITKVEGDVTCIRICFDLPPPPPSS

SEQ ID NO: 161709 - protein, 407 aa, Glycine max
  Coding DNA Sequence Number=SeqID_70024
  Gene Ontology: Mol. function=protein histidine kinase activity; Cellular component=integral to membrane; Biological process=two -component signal transduction system (phosphorelay)
  Homolog annotation: Hit_ID=P0AA94; Match level="QueryCoverage=94%, HitCoverage=68%, E-value=1e-173, Identity=81%"; Hit description =Inner membrane protein ypdA
  Pfam annotation: Domain name=GAF; Domain location=61-182; Score=29.2; E_value=1.5e-05; Accession=PF01590.17; Description=GAF domain
  Pfam annotation: Domain name=HATPase_c; Domain location=286-391; Score=56.8; E_value=7.6e-14; Accession=PF02518.17; Description =Histidine kinase-, DNA gyrase B-, and HSP90-like ATPase
  Pfam annotation: Domain name=His_kinase; Domain location=198-280; Score=140.6; E_value=4.4e-39; Accession=PF06580.4; Description =Histidine kinase
  Pfam module annotation: Pfam domain module=GAF::HATPase_c::His _kinase; Domain location=61-182::286-391::198-280
MSLGLTIVSEIALPMILGASSIGLIVLLVQSVEGEKEAIAARQAKLALEIANKTLPLFRQVNSDSLRKVCAIIRSDIHADAVAITNTKQILAYVGYGEQNYHNGDDGISPTTAQAIASGKIIIKNNDEAHRTKDIHSMLVIPLWEKGEVTGTLKIYYRRAHRITGSLKEMAVGLSQIISTQLEVSRAEQLREMANKAELRALQSKINPHFLFNALNAISSSIRLNPDTARQLVINLSRYLRYNLELNDDEPIDIKKELWQVKDYIAIEQARFGDKLSMIYDIDEDLHFSLPSLLIQPLVENAIVHGIQPCRGKGVVTLSVKDLGDRVRVAVRDTGAGISEEVVSRVARNEMPGNKIGLLNVHHRVKLLSGHGLTITRHLPGTEIAFTLSKSGQRLSGPLTPLAETSA

SEQ ID NO: 161710 - protein, 438 aa, Glycine max
  Coding DNA Sequence Number=SeqID_70025
  Gene Ontology: Mol. function=transporter activity; Cellular component= integral to membrane; Biological process=transport
  Homolog annotation: Hit_ID=A4SHA3; Match level="QueryCoverage=78%, HitCoverage=85%, E-value=1e-112, Identity=61%"; Hit description =Major facilitator superfamily protein
  Pfam annotation: Domain name=MFS_1; Domain location=75-423; Score =88.5; E_value=2.1e-23; Accession=PF07690.7; Description=Major Facilitator Superfamily
  Subcellular localization annotation: CTP_CleavageSite=37; ConfidenceScore=5.52e-01
MPVHVTTSALRLSKGAMPFIPVSQQFIPSPAPFTPVRATRARVRLIIAADSVFPDGREKMTTAVTPNHQRVRILTLAGTIITQFALGSVYTWSLFNGQLAQKLDAPVSQVAFSFGLLSLGLAIASSLAGKLQERFGVRNVTIGAGILMAIGFWLTAHADNLMMLYLSAGILVGLADGAGYLMTLSNCVKWFPERKGLISACSIGAYGLGSLGFKFICGALLSTQGLENTFVIWGVLAMTMIIAGALMMRDAPLQQAGSRQQQATQEFTLAQSVRLPQYWMLALMFLTACMSGLYVIGVAKDIGEGLVHLSTQTAANAVTIIAIANLSGRLILGVLSDKMARIRVISLAQLVSLSGMSILLFTHMNETTFFLSLACVAFSFGGTITVFPSLRAWLAGSFGIRRLHRDLQSDYDAAGDLAGAVAQYPSAKSSKPGRAGTA

SEQ ID NO: 161711 - protein, 73 aa, Glycine max
  Coding DNA Sequence Number=SeqID_70026
MSQNFTKCLTMGAKYLEVAKRGSHPNNGWSPDEIRGSKDKTLIWFKRNNIQPVNHPVSGTCKNLKMISTDTSS

SEQ ID NO: 161712 - protein, 226 aa, Glycine max
  Coding DNA Sequence Number=SeqID_70027
  Subcellular localization annotation: CTP_CleavageSite=68; ConfidenceScore=5.80e-01
MARKTQAHLLVSFTGSSNPRSTLGKSHFSKGSQNPRSILSDSCFSKGSSKSRSTHGESYFSKGSQNPRFSLGESCISKGSSNLRSALCESHFSKWSSKPRSILGESRIFKASTTPKVCPWNSRYTRSTIDNLFYPYYSLLYVQENKFAGTPQTQGLPLVQKPKVHPWYALLQNPRPKAHPWSAHFLGTSTTIVKCPGFVSLNKLPPDLSARPSTRWKSDPGRTRIK

SEQ ID NO: 161713 - protein, 262 aa, Glycine max
  Coding DNA Sequence Number=SeqID_70028
MKAENTYFSHEMRRVHYYSSGCLYFIPYGWVTVNWWLGRGNQHIGNDDLIVFRHKLDIMKRHEFVWEPYTANIMLVLPPICLVGSVAWVESYPRQEGLLSFNSDYMVCYRRKMKIFVDPKNANTTTLQKRIIEPVSHRSATEHQFAAQEFHILPSSVETQDMVRRREVVEAEPYLYPQMVKRGHEINISQFFMTYYDPSQQHDAPIPTPNASLGADLRHQFSAEADQVEAGRHWPRKNPDRQARRWERQCGTFSRHHGHHND

SEQ ID NO: 161714 - protein, 235 aa, Glycine max
  Coding DNA Sequence Number=SeqID_70029
  Gene Ontology: Mol. function=transferase activity; Cellular component= mitochondrion; Biological process=isoprenoid biosynthetic process
  Homolog annotation: Hit_ID=Q8GTR1; Match level="QueryCoverage=94%, HitCoverage=58%, E-value=2e-97, Identity=75%"; Hit description =Geranylgeranyl diphosphate synthase
  Pfam annotation: Domain name=polyprenyl_synt; Domain location=2-195; Score=53.3; E_value=8.7e-13; Accession=PF00348.8; Description =Polyprenyl synthetase
MSNPEKFTLQIRVKVASLLHDDVLDDADTRRGIGSLNFVMGNKLAVLAGDFLLSRACVALASLKNTEVSMEYYMQKTYYKTASLISNSCKAIAILAGQTAEVAMLAFEYGKNLGLAFQLIDDVLDFTGTSASLGKGSLSDIRHGIVTAPILFAMEEFPQLRAIVDEGFENPANVDLALEYLGKSRGIQRTRELAVEHANLAAAAIDSLPENDDEDVRKSRKALIDLTHRVITRTK

SEQ ID NO: 161715 - protein, 75 aa, Glycine max
  Coding DNA Sequence Number=SeqID_70030
MDEMETFNDMKFNLPMQELDIVPEIKIDKEALEKTGQSNKEYNHVRSSQEHVGATIVEAMPCHSAMALGKNSDMR

SEQ ID NO: 161716 - protein, 291 aa, Glycine max
  Coding DNA Sequence Number=SeqID_70031
  Subcellular localization annotation: CTP_CleavageSite=38; ConfidenceScore=5.42e-01
MTEPSKKRKRASTSTVAIRTRRHGASGAQPTSIVPSISSSTLFSSEEQCIRYTSLFSSRSIIDPKFIYLAFFDDEMFDCFQAFQNSGIIHFMSLKLPYYLDLIVRILLPRSSNLAQVSEEDLIVMWAFLTDRQIEWAHLVRYRMHKALRSNAFLPYPHLITLFLHHFDVPLGSETFFQVKRSFSIGTGVVTSFGYRKERDGSWVKKGAPAQAADDRSPSPPPQRDDSSSLMQSVLDKLDGLHTFVGERFDSLDSCIDAIDAWFAGMDTRITQLEEDVSFICQCFDLPPPLS

SEQ ID NO: 161717 - protein, 213 aa, Glycine max
  Coding DNA Sequence Number=SeqID_70032
  Gene Ontology: Mol. function=hydrolase activity, acting on glycosyl bonds; Biological process=cell wall organization and biogenesis
  Homolog annotation: Hit_ID=A7Q8H9; Match level="QueryCoverage=78%, HitCoverage=35%, E-value=4e-68, Identity=67%"; Hit description =Chromosome chr5 scaffold_64, whole genome shotgun sequence
MVAFLLLLALSNEVRVNGDGGGRQCEINPALKPRPYIVSILEFGAVGDVLNFNKGGAQLYVPPGTWLTQSFNLTSHLTLLLEKGVVILGSQDPFHWEVVDPLPSYGRGVEVPRGRYQSLINGYMLHDMVITGNDGNIDGMGLAWWELFSSHSLNYSRPHLIELVASDHVVVSNLTFLNAPAYSIHPVYCSNLYYSKLLSKPCQSEARMLRYGD

SEQ ID NO: 161718 - protein, 285 aa, Glycine max
  Coding DNA Sequence Number=SeqID_70033
MDGGVREPDTNKGPAANGGFTYNISEKELWEVFQKWERNNMQQLSTSSKPVLVRRDNHDEMEGKSVTDKDILMVDKLQESTIIQDLKEVRFQYLEEDFVMISGVNEDNVQEEMLEEGDGWANMFECIVKWKKGQNFGSRLVWVNIYGIPMKLWNEACLRSVISELGNLVSNNEATQNLDCGDRARVLLKALLITLAKLIKMVKINGHVYQVRVEEEDGAWKNGCKTQLRLKGDENGLEDGTKSLQYGRWNKDGTKLYLGQKTGPLKANDHRSGPSGGEKYNLEVA

SEQ ID NO: 161719 - protein, 45 aa, Glycine max
  Coding DNA Sequence Number=SeqID_70034
MKVMPSKPTRTGRKWLKAQVEKDEGPSGEGQSPRVEKDEGPSGEG

SEQ ID NO: 161720 - protein, 103 aa, Glycine max
  Coding DNA Sequence Number=SeqID_70035
  Gene Ontology: Mol. function=nucleic acid binding; Biological process= DNA integration
  Homolog annotation: Hit_ID=A5AEN5; Match level="QueryCoverage=83%, HitCoverage=6%, E-value=1e-14, Identity=44%"; Hit description =Putative uncharacterized protein
MATVDITGSNNNDLNKPFRFEGYHFKRWQQKMMFSLTMRKIVYVLNTDIPVVPEDAEKEVKDKMTMELTLWNENDYLCKNFILNGLADDLYDYYSPYKSAKLV

SEQ ID NO: 161721 - protein, 182 aa, Glycine max
  Coding DNA Sequence Number=SeqID_70036
  Homolog annotation: Hit_ID=A7UQU7; Match level="QueryCoverage=51%, HitCoverage=25%, E-value=6e-12, Identity=30%"; Hit description=IMP dehydrogenase/GMP reductase, putative
  Pfam annotation: Domain name=DUF1723; Domain location=99-148; Score =50.4; E_value=6.2e-12; Accession=PF08330.1; Description=Protein of unknown function (DUF1723)
MVRTRGLGCALGRVIGKALGRKDNHHLDDVPQWQRPTASTSRQREVAAVAEDVPHVDDAAEEVFQHVEEAVDDAEGFPGGPRDLSVLTAYVDHVAVIVWNGEGLISALVERWHKDTSSFHLPIGEVTITLNDVASLLHLPIIGAFHSFETLHVDEVVWVLVELLEVPRDEATAETVPCHGAY

SEQ ID NO: 161722 - protein, 35 aa, Glycine max
  Coding DNA Sequence Number=SeqID_70037
MGAKHLTRTKEWSHVIEQRSPDEIRICVYDDKLKW

SEQ ID NO: 161723 - protein, 160 aa, Glycine max
  Coding DNA Sequence Number=SeqID_70038
  Gene Ontology: Mol. function=microtubule motor activity; Cellular component=microtubule associated complex; Biological process =microtubule-based movement
  Homolog annotation: Hit_ID=A7PWI0; Match level="QueryCoverage=99%, HitCoverage=19%, E-value=9e-31, Identity=49%"; Hit description =Chromosome chr8 scaffold_34, whole genome shotgun sequence
MTVYYICKFKTRMFPSNISFLLQSGPLGGVTSKDIGVNCLALHDLFQMSNERNDIISYHIYVQMVEIYNEQVRDLLAEDKTNNKYSFDRVKHFHTTNKRLGRESFISKIWSCNGDGFNLPHARLHLLKSPTDVMTLMKLGQVNRVVCSTSMNNRSSCSHR

SEQ ID NO: 161724 - protein, 294 aa, Glycine max
  Coding DNA Sequence Number=SeqID_70039
  Homolog annotation: Hit_ID=A5C169; Match level="QueryCoverage=65%, HitCoverage=19%, E-value=8e-09, Identity=24%"; Hit description =Putative uncharacterized protein
MSLATLFGKLQEHEMELMRLHQHEENDIKRKGIAVSASSSSIQEESDKEDLTGIEEDDDFRFFMKRIILDPKYLDKDFFDGETFDCYQVFQNSGLVDFMSLKLSYYPELVRVFYSNLKIQDGTIHSEGTIVDDWKFDYSSHDTRCMVCNDQADMTGRLLAGSLTFDCRIMHYIIVRISFPRSSNLAQASEEDLILIWAFLAGRQIDWVHLVRYQMHKALQTNAPLPYPQLVTHFLHHFQISLDDEPFVQVKRSFAIGASAVATFGYHKDMDGQWLRKQDVQQSIPNECTPSPPP

SEQ ID NO: 161725 - protein, 65 aa, Glycine max
  Coding DNA Sequence Number=SeqID_70040
MRIGIVSRAELFIKFCLHEQEFVGGVESVKVKVEECVQHAIYATMLVRAGHASRDTSAFGKLAVA

SEQ ID NO: 161726 - protein, 65 aa, Glycine max
  Coding DNA Sequence Number=SeqID_70041
MVRTQGLGRALGASRGRGISEDTHEADVPLRRKPTASTRRQRVRLCEDVTERPEDVPQLHKDVPH

SEQ ID NO: 161727 - protein, 235 aa, Glycine max
  Coding DNA Sequence Number=SeqID_70042
  Gene Ontology: Mol. function=binding; Cellular component=ubiquitin ligase complex; Biological process=protein ubiquitination
  Homolog annotation: Hit_ID=Q8LGC7; Match level="QueryCoverage=61%, HitCoverage=40%, E-value=1e-41, Identity=61%"; Hit description =Putative uncharacterized protein
  Pfam annotation: Domain name=Arm; Domain location=104-144; Score =11.8; E_value=0.35; Accession=PF00514.14; Description=Armadillobeta -catenin-like repeat
  Pfam annotation: Domain name=Arm; Domain location=22-62; Score=23.4; E_value=0.00084; Accession=PF00514.14; Description=Armadillobeta -catenin-like repeat
  Pfam annotation: Domain name=Arm; Domain location=63-103; Score=9.5; E_value=0.68; Accession=PF00514.14; Description=Armadillobeta -catenin-like repeat
  Pfam module annotation: Pfam domain module=Arm::Arm::Arm; Domain location=104-144::22-62::63-103
MRAGIPREKENAACALLRLSRVEESKVVIGRSSAIPLLVSLLESGGFRTKKDASTVLYSLCMVKENKIKAVKVGIMKVLVELMADFESNMVDKSAYVVSVLVAVPEARAMLVEEGGVPVLVEIVEVGTQRQKEIAVVILLQVCEDFDGEEHRREDAADSGAGSHIEEVCNGCALVASFLLQRGFQVGNGFSGENLVHVSAVDGENAYLAPLVLDCGDAVHGGSSRGSMRNLLSRI

SEQ ID NO: 161728 - protein, 49 aa, Glycine max
  Coding DNA Sequence Number=SeqID_70043
ASRVAPGAGAPPVASSVRALPVAPGAGALPPCATCHVHSGGAGVGGALQ

SEQ ID NO: 161729 - protein, 54 aa, Glycine max
  Coding DNA Sequence Number=SeqID_70044
MGMTVMAEEVVVTITTVIPTEGVFHIGAHLSIVNTVLEIRDFYIGAYVTTDVKY

SEQ ID NO: 161730 - protein, 156 aa, Glycine max
  Coding DNA Sequence Number=SeqID_70045
  Gene Ontology: Mol. function=ATPase activity, coupled to transmembrane movement of substances; Cellular component=integral to membrane; Biological process=transport
  Homolog annotation: Hit_ID=A7Q0Z8; Match level="QueryCoverage=74%, HitCoverage=8%, E-value=7e-35, Identity=59%"; Hit description =Chromosome chr7 scaffold_42, whole genome shotgun sequence
MVLEKGYTPAQVMRPEVLPLVVSHSPPEVSFLLLVYLNKPEIPELVLGTLAAIVTGAILPLMGFLISNMINAFLEPADELRKDSKFWALMFIALGVAGTIYHPIRSYFFDVVGSKLIKRIGLMCYKKIVHMEVGWFDKVGIRSEIYKLRLFTINFP

SEQ ID NO: 161731 - protein, 241 aa, Glycine max
  Coding DNA Sequence Number=SeqID_70046
MPCHHLIDEQGNTKKVSLTKPSVFVMPRGERLVVPFDSQLRVYGEAATLLSSACGRIAMDSKNIPNNFDSWSNVPKSYKDGCFNIVKWSSFVDYHLRPEYKEVNLGRAVGRGELYIATHKKKNGSYVNEEARSIGDKMTQEMSKSDNFTKILANDSVGKVLGKDHDGRVRCLGLGGLHSVAFRSTTSFSGSWSSFSNFDSVESSRLKEEDEGSGQDGPTPRRGSSLDSNFHATSHMLLNSF

SEQ ID NO: 161732 - protein, 283 aa, Glycine max
  Coding DNA Sequence Number=SeqID_70047
  Gene Ontology: Mol. function=hydrolase activity; Cellular component =cytoplasm; Biological process=biotin biosynthetic process
  Homolog annotation: Hit_ID=A9PJB4; Match level="QueryCoverage=91%, HitCoverage=95%, E-value=1e-124, Identity=81%"; Hit description =Putative uncharacterized protein
  Pfam annotation: Domain name=Abhydrolase_1; Domain location=44-262; Score=38.5; E_value=2.4e-08; Accession=PF00561.11; Description =alphabeta hydrolase fold
  Pfam annotation: Domain name=Ndr; Domain location=1-278; Score= -102.2; E_value=0.0071; Accession=PF03096.5; Description=Ndr family
  Pfam module annotation: Pfam domain module=Abhydrolase_1::Ndr; Domain location=44-262::1-278
MGIVEEAHNVKVLGSGTRHIVLAHGFGTDQSVWKHLVPHLLDEFRVVLYDNMGAGTTNPDYFDFERYSTLEGYAYDLLAILEELRVDSCIFVGHSVSAMIGTVASISRPELFAKIIMISASPRYVNDMEYFGGFEQEDLDQLFNAMAANYKAWCSGFAPMAIGGDMESVAVQEFSRTLFNMRPDIALSVLQTIFRSDMRQILNLVTVPCHIIQSMKDLAVPVVVAEYLHQHIGGASIVEVMSTEGHLPQLSSPDIFIPKSKQMESSMIDGAVWCGVVWGVHYW

SEQ ID NO: 161733 - protein, 122 aa, Glycine max
  Coding DNA Sequence Number=SeqID_70048
  Subcellular localization annotation: CTP_CleavageSite=28; ConfidenceScore=5.76e-01
MTFSSWQNKLNRPMATPPGLPPPPLVVASQTPSTFKRTRKATRLRSLATRPPGAERPVVHVDPATGNADNPHKKKLRIYLGIVTRDKVDMTYETWKEVPTTQKDLIWEIIQAEFDIPEASLL

SEQ ID NO: 161734 - protein, 91 aa, Glycine max
  Coding DNA Sequence Number=SeqID_70049
  Homolog annotation: Hit_ID=Q2A9X8; Match level="QueryCoverage=50%, HitCoverage=10%, E-value=2e-08, Identity=58%"; Hit description =Putative uncharacterized protein
MDFLALAVDNLLLLQYTIYVCISLITTPLGIAKEEEWYMGIVKKKCTTALCILAYGLSADSVDEYVRIGETTIMECLERFVSSICTIFGNT

SEQ ID NO: 161735 - protein, 598 aa, Glycine max
  Coding DNA Sequence Number=SeqID_70050
MDYVGSVESLDATEIFLGQFLTVVHHLKETSIKVEFGKAKELDLELAKSKEVAKKLQEELDKHIGCLSNKAKENKMLNGRVSNLEKQVKDVGRKMDELSSKKKTVDENALMVELDVAKRLIVLNHREGVKKAQRQVKVLVPSINSAQHNVNGDIVDGSNSTFWELLEKAEVQIRPPESYLKKSWLRPNLLRVLGMTFPVTSSSLYASFCMDSVMRNGPSQFGESFPSELSFPASPWSLQTKLLGLKLHFLSFELYFQVILCLHPSSSRRVKLITEFEMDRYSNNSALDVSRVKMGRVKSRQICQSIGQLMYFLQALWAAHGNEVFTFVWVALDPHTGDHETKELTPFDPKDAFFWAQPHVVLLEFGEYLHQVFRMIVETEGHDFVTEVGIFSDECRLAFICSSMLLAELLSLLCHRFGFRKNGEFVAYEIRIYAWHVNDASCEEINILCQHVLDSFLKVLIKSFPYLSALVWLLSELEIMQLLSWCWPFVFLISLSFEIDPAWYSVFHMIDICCIDMLRGGMCVGLDEWSPTLLHHGCGLPPCKTDQGFGMRTFLTSQLIMTIIITIGSSCSRSNLVKSTSVNVFGGIDLLKPAAIGK

SEQ ID NO: 161736 - protein, 275 aa, Glycine max
  Coding DNA Sequence Number=SeqID_70051
  Gene Ontology: Mol. function=ribonuclease III activity; Biological process=RNA processing
  Homolog annotation: Hit_ID=Q9SZV0; Match level="QueryCoverage=84%, HitCoverage=54%, E-value=9e-60, Identity=45%"; Hit description =Putative uncharacterized protein F6G17.160
  Subcellular localization annotation: CTP_CleavageSite=80; ConfidenceScore=5.73e-01
MFVPHQWNLPSSPSRPPSLQTQSKSPPKNSIPHFRSNHRPTAGASQEQPPAPPKGAHRAQAPFTPNSTRAPRRFILTRPLDDKRVADRFLSSPQLALNTFPFLSSCLPFAPLGHVDNIWMEKHALGYPLEPSVTLRDDSKPARELDTLLYLAFQHEVCEKSRARHVRFGHSRLFFLGQYVLELAFTDYFLQRSVFWALFGAIYLCFGMPEVYRVLFEVFGMDPNAEDCQPKLCRQLEDIDHVSAEFEGKISWQDMVAYKASSTYILSSYYLFQKP

SEQ ID NO: 161737 - protein, 264 aa, Glycine max
  Coding DNA Sequence Number=SeqID_70052
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=cytoplasm; Biological process=protein metabolic process
  Homolog annotation: Hit_ID=A7PLM6; Match level="QueryCoverage=91%, HitCoverage=92%, E-value=3e-70, Identity=53%"; Hit description =Chromosome chr7 scaffold_20, whole genome shotgun sequence
  Subcellular localization annotation: CTP_CleavageSite=2; ConfidenceScore=5.08e-01
MKAKAVKGNWSLRTNKLSFPYVFLVCIFFFLAGFFGFTLFSHSQGDGDGLRPRQRLLDSTNEAEYNLMPVGELGDDSITSIPFQVLSWRPRAVYFPNFATAEQCESIIDVAKDGLKPSTLALRQGETEDNTKGIRTSSGVFVSASEDKTRTLDVIEEKIARATMIPRSHGEMASFLLYLTDVEEGGETMFPFENGLNMDGNYGYEDCIGLKVKPRQGDGLLFYSLLTNGTIDPVSLADITPWELPRDKRGEVGGYKVDKRSRIG

SEQ ID NO: 161738 - protein, 322 aa, Glycine max
  Coding DNA Sequence Number=SeqID_70053
  Gene Ontology: Mol. function=protein serine/threonine kinase activity; Cellular component=plasma membrane; Biological process =protein amino acid phosphorylation
  Homolog annotation: Hit_ID=P28523; Match level="QueryCoverage=63%, HitCoverage=56%, E-value=7e-83, Identity=75%"; Hit description =Casein kinase II subunit alpha
  Pfam annotation: Domain name=Pkinase; Domain location=34-272; Score =38.8; E_value=5.9e-11; Accession=PF00069.16; Description=Protein kinase domain
  Pfam annotation: Domain name=Pkinase_Tyr; Domain location=34-272; Score=-147.0; E_value=0.0021; Accession=PF07714.8; Description =Protein tyrosine kinase
  Pfam module annotation: Pfam domain module=Pkinase::Pkinase_Tyr; Domain location=34-272::34-272
MSKARVYTDVNVLRPKEYWDYESLTVQWGDQDDYEVVRKVGRGKYSEVFEGINVNSNERCVIKILKPVKKKKDSVVLGALQQPVSANSSLEIVIVIGSQTLILIGDLLDIVRDQHSKTPSLIFEYVNSTDFKVLYPTLTDYDIRYYIYELLKALDYCHSQGIMHRDVKPHNVMIDHELRKLRLIDWGLAEFYHPGKEYNVRVASSDSNNDGDGNQWRLWQQQNYGGNDQCEAIVGVGCSGNNSLLVVVATMMMAAVSGSCGDSGNNDLLAMFTVLTVVVVGGGTMKVAKAINYDGCGSDGGSSIKSGNGGGFGGNCSNNSGG

SEQ ID NO: 161739 - protein, 146 aa, Glycine max
  Coding DNA Sequence Number=SeqID_70054
MQIMVRTRGLGRTLGRAIGKALGRRDSSDDDAPQRRKPTASARRQRQPEHVVEDPSMAAEELNKEQPEAPVEEVVTDVEAEWRRKRERRRHFKEKMSLEEAHHHRRPWIRAWRKKEMNEGRGREEHEILCSKRALKSEVNIQMIKV

SEQ ID NO: 161740 - protein, 131 aa, Glycine max
  Coding DNA Sequence Number=SeqID_70055
  Homolog annotation: Hit_ID=A5B5E3; Match level="QueryCoverage=40%, HitCoverage=9%, E-value=2e-10, Identity=64%"; Hit description =Putative uncharacterized protein
MASHAKRVSSRVRIYTKHACLAKQVVQKCYLDNPNGKNMHIEIDNFIFNHNSSQGCINLIVYVDDTVITCSDQHGIINLKQYLSRQFQGDDLGKGLVYENSGHARVVDYSDVNWTGSPNDKRSTFGIVYAN

SEQ ID NO: 161741 - protein, 378 aa, Glycine max
  Coding DNA Sequence Number=SeqID_70056
  Homolog annotation: Hit_ID=A5AQA4; Match level="QueryCoverage=91%, HitCoverage=100%, E-value=9e-88, Identity=52%"; Hit description =Putative uncharacterized protein
MGLAGIPFVESVPCLLGSLDIPKQSEITWGSIMPAARYFSPADTIEQKLQIERRLGSVKTRKYFNLLERFLSFKISKHEFDRVCIATIGRENVPLHNHFLKSILRKACLSKTAGSRESKVESSLNVKTPNGCSNLQILCKDFPQSPRKGRTPNLRDRRSRDRPSPLGPNGKNNSIGCEDSVPKIHEQQSILNLQSAGSRLPLSVEDGEEVDQDYEILNLFKKSPIQAPLAIPTYNRRPQPKYLSQGLSSGTVSDTCQSIAQLPDTCSLTKRLEQKLEIEGLKISTDAASLLNNALDVYLKRLIKPCLDLAASKSVNKFSGPIQPGLNELPLRRCVQKPIRSASVSISDFRTAVELNPTILGEDWPLNLEKVCLCALEE

SEQ ID NO: 161742 - protein, 159 aa, Glycine max
  Coding DNA Sequence Number=SeqID_70057
NTPTENKTPKESDSERVAKDAALIEVVKKHIEIGIGLEALPLVEEEPPNKNNSQSNYNVDANEFPSEGLHHSLPLEKDLTSNPEVLETLGFFPQHLDEDALIPHDVAPYGAYTPWIFFMNDVLCFLKFMAAEWRMKKDNWRHHFKEKMSQEEAHHHRKP

SEQ ID NO: 161743 - protein, 161 aa, Glycine max
  Coding DNA Sequence Number=SeqID_70058
  Subcellular localization annotation: CTP_CleavageSite=67; ConfidenceScore=5.15e-01
MTEQAKQVFYVQYPYDERWHMATPPNSPPPPLESTTPSPSTSKKTRKATRLKSLATRPARVERPVVHVNPVTGRGDGPHRKKLRKYWWIVTHDMVDVTFDNWKQVPIAQKDLIWEDIQALAHDKEGEDDKVCEKYDISKEKWTQFCQSRRDPSWEDLQKKA

SEQ ID NO: 161744 - protein, 106 aa, Glycine max
  Coding DNA Sequence Number=SeqID_70059
MGHEDEEDDDDNNNNDDDNDGGNHGTSHRIARHLTRHRMAPRTTPRTAPHTASHDTSHRTIARPAPRMTPHDTSHGTAPHLAIFVVVKYYFLLQVVRANSIEITNC

SEQ ID NO: 161745 - protein, 41 aa, Glycine max
  Coding DNA Sequence Number=SeqID_70060
MGHEDEEKDDDNNNNDDDNDGDDDDDKVVIMFLNKTQLHII

SEQ ID NO: 161746 - protein, 164 aa, Glycine max
  Coding DNA Sequence Number=SeqID_70061
MKEIKPVSKTSKSSSSDLEIEIAELLYEKKKMEDNDNSSTLVPNNSTKELSRIQIEQHADVDYHVCPSLEAPKEDIGEDRMNSSAGFGDASADGRSVSPTKESPSCSMLDAEKPYSSSNRVMSAFPEANTQRVGKFETDLMAPPPMGLSPEVDDLSMGDFISET

SEQ ID NO: 161747 - protein, 27 aa, Glycine max
  Coding DNA Sequence Number=SeqID_70062
MTMAASARITFSEIIETTCGTLYLLYS

SEQ ID NO: 161748 - protein, 143 aa, Glycine max
  Coding DNA Sequence Number=SeqID_70063
MGRGRYGYCLPNPLPRLPNISPYPYPIPDGLQFIISSPYSSGTRWVSGIPDLVPYCGSNVFQGYFDDVKESRVKQSFKQRFKNQNKRRYISCGSVQVDGTSTWLFKENKGGYIPCGSLACKGFYKVEKKSQEPQVAGELDVGT

SEQ ID NO: 161749 - protein, 60 aa, Glycine max
  Coding DNA Sequence Number=SeqID_70064
YLRMSPDFTGQDDKNRLYGQPLGYLRMSPDFTGQDDKGAEDDGAEDDVSLCMLPDFESDG

SEQ ID NO: 161750 - protein, 63 aa, Glycine max
  Coding DNA Sequence Number=SeqID_70065
MVGYTPSSFANLVFAGERIKVGLEKGKYDRPALMNAKTRANEEDENEGETLAMTAIPIRHNPC

SEQ ID NO: 161751 - protein, 53 aa, Glycine max
  Coding DNA Sequence Number=SeqID_70066
MAEKTKKRLEETAQSGSTKGVIDPPSSIRRHMKILWKSRRHRVRLSPMDVKIS

SEQ ID NO: 161752 - protein, 368 aa, Glycine max
  Coding DNA Sequence Number=SeqID_70067
  Homolog annotation: Hit_ID=A5B5G7; Match level="QueryCoverage=51%, HitCoverage=13%, E-value=2e-07, Identity=26%"; Hit description =Putative uncharacterized protein
FTSPKAWERYTNIVVPRKLLPKRNVVIYHTEFDEFKEELERRKWDEELTSFDEGSIDVAIMKEFYANLYDPEDKSPKQVRVRGHLVKFDADTLNTFLKTPVIIEEEEELSAYSRFSLLRPDPQELVAKLCIPGRGFELNADGLPLKILRKNLTTLAQTWSVLSFSNLIPTSHTSDITMDRAKLIYGIIQKMDMNHESSRLGFPALITALCKARGVTSDSRTLESLIPAINVAYVKKNYWNLDDPTVTFRGSQKTKGKRYEAPSSSALPSSEIHPLSAPSSTAPSAPSLSTHLPALITAPAPSGSFIFTLETLFGMLQSLHRGQVAWPGVQPSPSGGGGTSAAQEPETTAEDELIPPEPFVPKPDAEID

SEQ ID NO: 161753 - protein, 242 aa, Glycine max
  Coding DNA Sequence Number=SeqID_70068
  Homolog annotation: Hit_ID=A5BMX7; Match level="QueryCoverage=30%, HitCoverage=9%, E-value=1e-10, Identity=41%"; Hit description =Putative uncharacterized protein
MATWCGRMTCGSNAFNDYFDDAKDSRMKFSGIKFQESRFKNNQDQDSRLKIQESREESIKISIKKFFKTLSSTWSFHKIFYQRVLLFGNRLPEEGTSTWVVVTENKRGYISCGSVQVEGTSTWLLEREQGRVHPLWIFACKGFYKVEKKSQGPNRSNLKSFQDYDEDQANLCLMTKSHENNKEESVRKKWYIDSGCSKHMMGDVSKFTTISPKKSGHVTYGDNNISKISKEVTSKPSLLIKV

SEQ ID NO: 161754 - protein, 78 aa, Glycine max
  Coding DNA Sequence Number=SeqID_70069
MGNKWEGNIGSKGLSKELIQGWLIWLEAYKNKMPKSSPNMHVKQEVSIRVKPRLLCKQSMGQNTPNKIDDDGSNSHQG

SEQ ID NO: 161755 - protein, 257 aa, Glycine max
  Coding DNA Sequence Number=SeqID_70070
  Subcellular localization annotation: CTP_CleavageSite=41; ConfidenceScore=5.16e-01
MDKARLVYGLVTNMDMNIGALISVNFRGARKARVRPADVPSSSTLPALSTYATPTPAPPNSSTQDSQHFESMLQSLYKGHILLMQSLQVVAPPGSILTVEQFLEKVSWPGTLPSLEREGGGPSAQVPQQVQDASFEATILEPFIFEAGETLVRQEDATPERSPQISPDPPSLVVDQSSLQQPADPPTPMHKMSANTSTPMHKMSADTSTPLLDLPKDPSTPVLGLTTIHPATLVLHLTDEEGTQDKDTQSQDLSQEF

SEQ ID NO: 161756 - protein, 334 aa, Glycine max
  Coding DNA Sequence Number=SeqID_70071
  Subcellular localization annotation: CTP_CleavageSite=46; ConfidenceScore=5.34e-01
MKDRRKTSSGDVSSTSRNLTISQNLIQSSARRLPLQAQLSPTPVTLAQPEGEDGALSGLAFAQCLYEANPSSRIVHALSHQVGRLADDALSQKISVLAIEEKEELATVVVKYAMVIADLQAKLKELEPEVVKEKEANKELEEELLAFKKEAVKQHEKGFYKADVKDNELLDEEDIVVREEDVGEEENDGEIENEIMFDHLGFDLNLVKGLVNQLGDVLPINLAMLLFCIVKLFTQDHRDLLELFTKDRRLTNDEPWSCRGSPRADLRFDEPLEIRRGSPKVDLRFDYPLEIHRGSQRADLGFDKPLEICRSSPRADLGFNEPLEVRRCSPRGGP

SEQ ID NO: 161757 - protein, 254 aa, Glycine max
  Coding DNA Sequence Number=SeqID_70072
MPMPYAGLLPSLLSNQMAMWVAFKHKVQSLIDAGWLTFQEDSPNVRTNPFASRGGSTASMIRLDGDKGDLCLMDPGASHDMETCPMGMMNKGQIEVYSAKKGKGDPFTAKKRVPFPYKSDKAVPWKYTAQGPDRRKGAFVIHVKDDIPFANVTNISSMSDMTHSGWIFMAPELPMWSKDKGKAKVDIGEKDKVGLTSNDEVPIGKIAEEGDDFSKKGISAEEELLVMILNGQCDGLLVKAGVGPPEAPGDEDGA

SEQ ID NO: 161758 - protein, 80 aa, Glycine max
  Coding DNA Sequence Number=SeqID_70073
MAEWHRGILKKRHQIEVALRVAYDDAMAELRKWHNSAFFCFLGDRCWADPTQPYPIFYCKSAAHNSKHPQNRARTEKSPA

SEQ ID NO: 161759 - protein, 125 aa, Glycine max
  Coding DNA Sequence Number=SeqID_70074
MMIMKLNVLQETFASIYFLAVYFDVKSLYKMSDDLEIGSGNYMEIMSMSASNQCSIYLRVFTHKIAYYYQQEYGSLGKGFHWKQEYNVPPTYISPLNGFIIISSIIVVRLWKLESGDGIFNRDHY

SEQ ID NO: 161760 - protein, 267 aa, Glycine max
  Coding DNA Sequence Number=SeqID_70075
  Gene Ontology: Mol. function=protein serine/threonine kinase activity; Cellular component=plasma membrane; Biological process =protein amino acid phosphorylation
  Homolog annotation: Hit_ID=A7PLP4; Match level="QueryCoverage=66%, HitCoverage=42%, E-value=1e-97, Identity=92%"; Hit description =Chromosome chr7 scaffold_20, whole genome shotgun sequence
  Pfam annotation: Domain name=Pkinase; Domain location=2-200; Score =34.0; E_value=1.1e-10; Accession=PF00069.16; Description=Protein kinase domain
MASSAQPQGTTPSSGSTSILALDYCHSQGIMHRDVKPHNVMIDHEQRKLRLIDWGLAEFYHPGKEYNVRVASRYFKGPELLVDLQDYDYSLDLWSLGCMFAGMIFRKEPFFYGHDNYDQLVKIAKVLGTDELSVYLDKYRIELDPHLAALIGRHSRKPWAKFINVENHHLAVPEAVDFVDKLLRYDHQERPTAKEAMVIVGRTWIFICLFAFLTYWFWPIHTSIQLEMQKVVELEHIELLVLVEIWCSFLTGGQQSELLFLVELAFR

SEQ ID NO: 161761 - protein, 74 aa, Glycine max
  Coding DNA Sequence Number=SeqID_70076
MVRVVICDVIAMVTMMKTRCGGSGGVAIHFQWFGEERKKKFGRKFVWLWWWQDVMAVTIKIRCGVGGVAIVFEE

SEQ ID NO: 161762 - protein, 422 aa, Glycine max
  Coding DNA Sequence Number=SeqID_70077
  Gene Ontology: Mol. function=hydrolase activity, acting on carbon -nitrogen (but not peptide) bonds, in linear amides; Cellular component=cytoplasm; Biological process=metabolic process
  Homolog annotation: Hit_ID=A7PLN9; Match level="QueryCoverage=99%, HitCoverage=99%, E-value=0.0, Identity=82%"; Hit description =Chromosome chr7 scaffold_20, whole genome shotgun sequence
  Pfam annotation: Domain name=FmdA_AmdA; Domain location=8-383; Score =767.5; E_value=8.5e-228; Accession=PF03069.6; Description =AcetamidaseFormamidase family
MAPATPRFVVPIDLKKNPWEQNAPLHNRWHPHIPHVAAVNTGEVFRVEMVDWTGGAIKDNDSALDIKFLDLSTVHYLSGPIRILDNDGVPAQPGDLLAVEICNLGPLPGDEWGFTATFDRENGGGFLTDHFPCATKAIWYFEGIYAHSPQIPGLTHPGIIGTAPSMELLNIWNERERDVEENGIKSFKLCEIRKGTSEWDKIAKEAARTIPGRENGGNCDIKNLSRGAKVYLPVFVEGANLSTGDMHFSQGDGEVSFCGAIEMSGFLELKGGMKEYLTPMGPTPLHVNPIFEIGPVEPRFSEWLVFEGISVDESGRQHYLDASVAYKRAVLNAIDYISKFGYSKEQVYLLLSCIPCEGRISGIVDAPNAVATLAIPTTIFDQDIRPKNNKVPVGPRLVRKPDVFKCTYDGNLPITRNPSATS

SEQ ID NO: 161763 - protein, 76 aa, Glycine max
  Coding DNA Sequence Number=SeqID_70078
MTMSVANSAATYLTKICWHMVKRMRKPLITKVYVRRQPDMLADSEDWFQEVQPEPKWQKVIQDLAGDPNSHPGFQF

SEQ ID NO: 161764 - protein, 310 aa, Glycine max
  Coding DNA Sequence Number=SeqID_70079
  Gene Ontology: Mol. function=transferase activity, transferring phosphorus-containing groups; Cellular component=chloroplast; Biological process=amino acid biosynthetic process
  Homolog annotation: Hit_ID=O49204; Match level="QueryCoverage=80%, HitCoverage=82%, E-value=7e-91, Identity=65%"; Hit description =Adenylyl-sulfate kinase, chloroplast precursor
  Pfam annotation: Domain name=APS_kinase; Domain location=132-287; Score=373.2; E_value=4.2e-109; Accession=PF01583.11; Description =Adenylylsulphate kinase
MTTAKALRQPCYAGIFRNIECGPSPAAESLGFPKLRGINVTGLHCGRRGLVLVLRAKSKPIRAKENASVSASLIDDWFKPITAKEDSNAEDRTSSFSGKNLTQMSNVGNSTNIMWHDCPIQKQDRQQLLQQQGCVIWLTGLSGSGKSTIACALSQSLHSKGKLSYILDGDNIRHGLNQDLSFRAEDRSENIRRIGEVAKLFADAGVICITSLISPYQKDRDACRALLSKGDFIEVFIDVPLHVCEARDPKGLYKLARAGKIKGFTGIDDPYEPPCSCEIVLQQKGSDCKSPSDMAEEVISYLEENGYLRA

SEQ ID NO: 161765 - protein, 333 aa, Glycine max
  Coding DNA Sequence Number=SeqID_70080
  Gene Ontology: Mol. function=hydrolase activity, hydrolyzing O -glycosyl compounds; Cellular component=cell surface; Biological process=carbohydrate metabolic process
  Homolog annotation: Hit_ID=Q9M2X0; Match level="QueryCoverage=82%, HitCoverage=59%, E-value=1e-136, Identity=80%"; Hit description =Putative uncharacterized protein T16K5.230
  Pfam annotation: Domain name=Glyco_hydro_43; Domain location=17-303; Score=-98.5; E_value=8.6e-05; Accession=PF04616.5; Description =Glycosyl hydrolases family 43
MECTTVCILLFHGNRTSPNGVRQNPPPHNEHSHQTKTEISVKARVTASMMVDIIGVGCYSSKDLWSWKNEGIVLAAEESNVTHDLYKTNVLERPKVIYNEKIRKYVMWMHIDDANYTKASVGTAISDTPDGPFEYLGSQRPHGYESRDMTVFKDEDGVAYLIYSSEENNVLHIGPLTEDYLNVIPVMRRLFVGQRREAPAVFKHQGTYYMITSGCTGWAPNEALVHAAESILGPWETMGNPCVGGNKMFRIATFLAQSTFVLPLPGFPGSFIFMADRWNPANLRDSRYVWLPLIVEGPADHALEYSSGLPLWSRVSIYWHRKWRLPQGWSTFK

SEQ ID NO: 161766 - protein, 438 aa, Glycine max
  Coding DNA Sequence Number=SeqID_70081
  Homolog annotation: Hit_ID=A7R7Y0; Match level="QueryCoverage=25%, HitCoverage=52%, E-value=3e-18, Identity=47%"; Hit description =Chromosome undetermined scaffold_2095, whole genome shotgun sequence
MPERESTNGYCSSGEEDGDAAWRAAIDSIAQTTTYVASTTKHNHPNHHIDDDDHKPNTQQLKHYQLKAQKLLNEILENSIEIVRKPVPVVDEDPESNECGIRLFKHAQPGIVFDHFCLLLLCYGNLALCGNFVGGGSRSLVTIVLDLNMKNLRTTLKYEKAALCMLGASAMTCGNGLSQLVGQLNQNYWSRLLHYMAADELQPPRKRPRLLPGGDIDEKSKKQFRKQIRSVAVNGIDIIAAANDAYKKSLARLEAKDAAAKAKAKREEERIENLKKIRGERWLPSMAKEMQGYIPSFMWSSIFNAKWIIDEGTYWRVDNGRDIMLNLPGCKIPPHESNFVEENMRMAHVLAMVVDGVGGFVKTLWALQERRWSYTFDAVASAAVSVTMALVLCLLAIRASYRHRRGDIRCTGNDDFLTAGREKLLHDLGLPWSQLIST

SEQ ID NO: 161767 - protein, 282 aa, Glycine max
  Coding DNA Sequence Number=SeqID_70082
  Gene Ontology: Mol. function=DNA binding; Cellular component =nucleosome; Biological process=regulation of transcription
  Homolog annotation: Hit_ID=Q0PJK3; Match level="QueryCoverage=37%, HitCoverage=35%, E-value=4e-55, Identity=100%"; Hit description=MYB transcription factor MYB85
  Pfam annotation: Domain name=Myb_DNA-binding; Domain location=5-57; Score=28.9; E_value=1.9e-05; Accession=PF00249.22; Description=Myb -like DNA-binding domain
MGAPKQKWTAEEEAALKAGVLKHGAGKWRTILTDPEFSAILHMRSNVDLKDKWRNINVTAIWGSRQKAKLALKRNLPAPKIDNNHMALSTVVRHDEVLDTKPLAVSAQIWAKKVELPAFMGTNPIGWIARAENSLSQNNPDSDWESFSPALIKRFGDRHGNHIFERLSILKQEKPTETETHIKKWETSTEFLKGRTNISERKHMLRKILNEEVDSHASQQDKNSMEGSGSEFSEAKASSWARKVELPSFDRSIEGGTNLKGSSFECDSDPLQFLKSENRSKE

SEQ ID NO: 161768 - protein, 216 aa, Glycine max
  Coding DNA Sequence Number=SeqID_70083
  Gene Ontology: Mol. function=phosphoprotein phosphatase activity; Biological process=intracellular signaling cascade
  Homolog annotation: Hit_ID=A7QV78; Match level="QueryCoverage=55%, HitCoverage=44%, E-value=7e-18, Identity=37%"; Hit description =Chromosome undetermined scaffold_186, whole genome shotgun sequence
  Subcellular localization annotation: CTP_CleavageSite=45; ConfidenceScore=5.06e-01
MAFWLAKSASTSSDLRCLSCLNPPFPVDHSREKKKNRKEKLAGVVFEQKRRRIVVVVFVFEQTSSFNMFGMGKQTENYTSDEQCRRIKCSTYAWGPAVLVHLYREMCSAIDYKVKSIGGGCDVEISILFVWEPYTTTVMAALPPICVVGSVAWFAVVPLICFHVVEWHQPDRVLRQFGLQQPILGFPSQPQNLHGLTLKGKQDENWFHLLAPIISQ

SEQ ID NO: 161769 - protein, 80 aa, Glycine max
  Coding DNA Sequence Number=SeqID_70084
MSPTNTLSKAKRIVIDYFVLKGVPVVSLFDSAPLELVGLGSSSSMDSFASWKMNGSGMEKEEREEMPLQGEDESRRSSPP

SEQ ID NO: 161770 - protein, 239 aa, Glycine max
  Coding DNA Sequence Number=SeqID_70085
  Subcellular localization annotation: CTP_CleavageSite=99; ConfidenceScore=5.02e-01
MAMETTIGSFKFMGLMPLKSLSVIVMGGRLLGGCSSSCSIGVVAHAFAGDASASLSPPFGPSFYQHLCSYNGPNGLGGGMEEGGNCMGTSTLKASSRIVAQFVVKGMRFTLGALVDCVSRVFVLLRVSHEPPTRREGIGILWGWLSPETGSCADHKYEWLQGKFYCDPTMGAKCNYRNLERSNARWTVIRIGSTISRVELASILCRRDKGGTCKKDSDTQDGLVGGDGRGGYQGTHRHG

SEQ ID NO: 161771 - protein, 118 aa, Glycine max
  Coding DNA Sequence Number=SeqID_70086
MSINLAWRGEQFGVFLDDAGVVGHVEGHKWHMQIAGGNGAFRLDAPPSSGVASFNDVLQAWTRQFDWRVESRGLLSSDYVQQRCRREGQLFCSGKRQCYWQFALQLGVASSTGDLSLK

SEQ ID NO: 161772 - protein, 274 aa, Glycine max
  Coding DNA Sequence Number=SeqID_70087
  Gene Ontology: Mol. function=transferase activity, transferring hexosyl groups; Biological process=carbohydrate biosynthetic process
  Homolog annotation: Hit_ID=A7PU43; Match level="QueryCoverage=51%, HitCoverage=39%, E-value=4e-50, Identity=69%"; Hit description =Chromosome chr7 scaffold_31, whole genome shotgun sequence
  Pfam annotation: Domain name=Glyco_transf_8; Domain location=85-270; Score=18.6; E_value=9e-08; Accession=PF01501.11; Description =Glycosyl transferase family 8
MDKRKHGSNFLQGVTQCWDEWQVAGCLDVALIQLDEIDKMAMVLDFVLLQQGWNIEKLREAIPRMHAPVFRNGEDCGSSPFATINVAMTLDTNYLRSTMATVFSMLQHSTCPENLAFHFLSAHDDAPELFSSINSTFFYLKMKIYRFDSNRVRNKISKSIRQALDQPLNYAKIYLADTIPEDVKRVIYLDSDLVVVDDIAKLYGVDMKSQGAVRVGVEGHGYVNGGGGKGVAVLIVAEGGGLPKERELQGRTAGNNNLTVLNNFNGRDLLGIKG

SEQ ID NO: 161773 - protein, 93 aa, Glycine max
  Coding DNA Sequence Number=SeqID_70088
MRKMSHSSINEDFKGLDVHQESQYAKIYRQATEDATFLKKFIEKNEDKKFIGKKINKLFIGMNLKKKNTKSTEPTSNKDKASLAPGFLESMCS

SEQ ID NO: 161774 - protein, 81 aa, Glycine max
  Coding DNA Sequence Number=SeqID_70089
MNRKQRRVSEGEEIEMGALITASVRVDLMESRLNTAIGDCSETKVAREGTKRKKKTQTWIEPLPHKEEKKQSGHEGRVKGS

SEQ ID NO: 161775 - protein, 126 aa, Glycine max
  Coding DNA Sequence Number=SeqID_70090
  Gene Ontology: Mol. function=amino acid binding; Biological process =metabolic process
  Homolog annotation: Hit_ID=A7R1I9; Match level="QueryCoverage=99%, HitCoverage=29%, E-value=4e-25, Identity=52%"; Hit description =Chromosome undetermined scaffold_358, whole genome shotgun sequence
  Pfam annotation: Domain name=ACT; Domain location=3-66; Score=30.5; E_ value=6e-06; Accession=PF01842.16; Description=ACT domain
QGLKVDIRAENTTGLLSKVTRVIRENGLSITKVQIGVEGDEMAVGSFHVANSSGQELNPNIAELVRRQIGGSVVANNNSPYRVPKSLSTSKTMHETKSSRDVRPRFSTGSMLWSQIKCLSNNFRPI

SEQ ID NO: 161776 - protein, 209 aa, Glycine max
  Coding DNA Sequence Number=SeqID_70091
  Gene Ontology: Mol. function=protein binding; Cellular component =integral to membrane; Biological process=regulation of translational fidelity
  Homolog annotation: Hit_ID=A7QE27; Match level="QueryCoverage=89%, HitCoverage=28%, E-value=1e-70, Identity=73%"; Hit description =Chromosome chr4 scaffold_83, whole genome shotgun sequence
  Pfam annotation: Domain name=DUF726; Domain location=1-202; Score= -32.1; E_value=8.1e-08; Accession=PF05277.3; Description=Protein of unknown function (DUF726)
MTFHLVLPKVRYALQWESKNLIAVSTAIQDWLTSRLAMELMKRGAMMTVLSSLLTALAWQAALLAATDFINSKWTIAINRSNKAGKLLAEVLLRGYQGNRPETLIGYSLGARVIFKCLQYLAKTENGAELVEKVVLLGAPIPIKDENGEAARKMVAGRFVNAYSRNDWMLGVAFRASRLLTKGLAGIQPVDIPGIQNAIRLIRGPHKRS

SEQ ID NO: 161777 - protein, 294 aa, Glycine max
  Coding DNA Sequence Number=SeqID_70092
  Gene Ontology: Cellular component=mitochondrion
  Homolog annotation: Hit_ID=Q9SIV6; Match level="QueryCoverage=29%, HitCoverage=37%, E-value=9e-29, Identity=76%"; Hit description =Expressed protein
  Pfam annotation: Domain name=DUF1640; Domain location=54-217; Score =29.0; E_value=1.6e-06; Accession=PF07798.2; Description=Protein of unknown function (DUF1640)
  Subcellular localization annotation: CTP_CleavageSite=76; ConfidenceScore=5.26e-01
MAAVRRRVWQLSSIPGFGASKLEVSSSFQRAILDPFPVSGTRHFSQVVKSNGKHSFQRAILDSFPVSGTRHFSQVVKSNGKHLFLVDTLALVRRLEGEGVPSKQAEAITAAITEVLNDSLENVSQSLVSNGEMQKIEMMQESNLSKFKAEVQSSQVFRSHVDVMLCVEFELVAHMDVVVVFGNDDRHDSPMKKQKGSTKRRWESAKQGQSSCAVLFTPKKGCTEKENKGEPPNKHEMTPNFWGRAWCPMVVPSMTLGGLFVGAPDGGFVGQRGHLSSDGGRWQCLESDWRWETH

SEQ ID NO: 161778 - protein, 85 aa, Glycine max
  Coding DNA Sequence Number=SeqID_70093
MPPFCTSSPQYFSVKPLPQIPIATIRVALQIHKVTFLGLEVFGRGLIMKLKMQRDILTLMKRHEVPAAIAEEYNDQFQNQFTKGG

SEQ ID NO: 161779 - protein, 164 aa, Glycine max
  Coding DNA Sequence Number=SeqID_70094
  Homolog annotation: Hit_ID=A5BKB8; Match level="QueryCoverage=39%, HitCoverage=18%, E-value=1e-24, Identity=84%"; Hit description =Putative uncharacterized protein
MTTDISALASMKNVAKCDTWCELQNPVNHRVFERKLHPNFPWKGAPERVRTPSCPDPVAPRGAVGESGCLGMQPQSGGKFRPRLNTGERPIANKYREGYINSRLLLNPWLSQGMDPIASMHVRDAVGKGGAVNCGRRKKMQNEYGRKKGKIHPLFEKGKTPYRN

SEQ ID NO: 161780 - protein, 515 aa, Glycine max
  Coding DNA Sequence Number=SeqID_70095
MALLAEVVDQSELENSLSAHLRAKPKNLLAQILGYAMNSLSKPASLSEFICFDEFLGFRMNSLSAPYSAKQVRQLSALSANSSLSWNKAKRACLAKPLVLSVVSLAKRPLALSLDTRWSRLAIVLFFYFLAKRTLCAKPLAFISIASKKRRASSSRPQEPYDTSRFVSKVAWERYETNIHNKNILPERNVELAYSHCDEFLRELEKRQWHRNLTRHMENHIDLVLVKEFYSNLYDPEDRSPRKCKVWVKTIKFDVATLNTFLETLMVLEPGERYSAYSHFCHTHPDPQEIATKLCIPGLGVLSYSNLAPTFHTSDLNMDRARLMHSLVMKMDMDLGSIISGQISQMTQSNSSRLGFPTLIIAFCIARGVVSDSLTFESLSPTINLAYIRKNCWNLEDPSIIFPGSRKVRTRAPLDAQASTPAPTPVPPPPAPISTPADPSTSSSDAIMPIMKDFLAQAAEDTLEAEDTPEAEVEAQDTPMEVAEEGVSGAAEAGIDDDYVAYVATAQGTWDPWPT

SEQ ID NO: 161781 - protein, 80 aa, Glycine max
  Coding DNA Sequence Number=SeqID_70096
MVSLSIIAILERLSGLARWSRLAQLPLKPGQRGFSVACARLARPHQPLDEGLVRLARVLLAQHIGYVSLSAGVTLSGLDD

SEQ ID NO: 161782 - protein, 681 aa, Glycine max
  Coding DNA Sequence Number=SeqID_70097
  Gene Ontology: Mol. function=transcription factor activity; Cellular component=nucleus; Biological process=regulation of transcription, DNA-dependent
  Homolog annotation: Hit_ID=A5AMI6; Match level="QueryCoverage=94%, HitCoverage=97%, E-value=1e-136, Identity=45%"; Hit description =Putative uncharacterized protein
  Pfam annotation: Domain name=AP2; Domain location=326-383; Score =49.7; E_value=9.9e-12; Accession=PF00847.11; Description=AP2 domain
  Pfam annotation: Domain name=AP2; Domain location=425-485; Score =46.3; E_value=1e-10; Accession=PF00847.11; Description=AP2 domain
  Pfam module annotation: Pfam domain module=AP2::AP2; Domain location =326-383::425-485
  Subcellular localization annotation: CTP_CleavageSite=43; ConfidenceScore=5.14e-01
MKSMENDDTVDLNNQNNNWLGFSLSPQMNNNNIGVSTHTQPSSAAAEVVPTSFYHTTPLSSYGFYYGLEAENVGLYSALPIMPLKSDGSLYGMEAVSRSQAQAMATTSTPKLENFLGGEAMGTPHHHYECSATETMPLSLDSVFYNQPSRRDQNNNQTYQNHVQHISTQQQQQQELQAYYSTLRNHDMMLEGSKQSQTSENNNNNLQVQNMGDDAVSVPVAGLKSWGVRNFQASHAHESKMIVPHHVEENGGESGSIGSMAYGDLQSLSLSMSPSSQSSCVTSSHRASSAVIDSAAMDTKKRGSEKVDQKQIVHRKSIDTFGQRTSQYRGVTRHRWTGRYEAHLWDNSCKKEGQSRKGRQGGYDMEEKAARAYDLAALKYWGPSTHINFPLENYQNELEEMKNMTRQEYVAHLRRKSSGFSRGASMYRGVTRSHRPTTTQHHQHGRWQARIGRVAGNKDLYLGTFSTQEEAAEAYDIAAIKFRGANAVTNFDITRYDVEKIMASSNLLSSELARRNQETTDNGTQYIDQNHNKPSAYEDTQEAAILMHQKSCETQNDQWKMVLYQQSSQQLEQNIPPRIESDRTNQSFSVALENMFHQEVEESSKVRTHVSNPSSLATSLSSSRECSPDRTSLPMLSGVPSTSSKLLATNPNNVNSWDPSPHLRPALTLPQMPVFAAWTDA

SEQ ID NO: 161783 - protein, 327 aa, Glycine max
  Coding DNA Sequence Number=SeqID_70098
  Subcellular localization annotation: CTP_CleavageSite=32; ConfidenceScore=5.77e-01
MNVSDPPTPLSPPIYATSIPSSFAPASPTPASAALAPTSSTTPLLLSVGVTTTGVLTSMPPPSSTLSPSAPIILPLAMPSSSSRPSISLDQVKNLADTTKVFLQRSLAILKKNVNRHKETRGGITSLEVEVAKWRATTRTVWRVEFPKVENATVALAEVVRSNHRLLSKVNNIFTKLVSTRLEGDKVSRRYKDLLKEKNDLECEAWLRDSELIVSNFQTKLKESKLKVENEKEVNKELEDELLMFKKKSMEQYEMGFFKVIRMSLRGREAHQGKTLGLMSLWRFNQGHGRVHPEFGETHQGWILGLTSLWRFNQGHIHLGFCKTHQG

SEQ ID NO: 161784 - protein, 137 aa, Glycine max
  Coding DNA Sequence Number=SeqID_70099
MAAQLIHDREVMECLEGVWETLEGNERCRFRGTIRLTATSLIHLEEPACTLQQPVEWILPTPTPYRLVEPVQVIEVSSSEEDLEEDPEELPPRPAVDALDLPEDDEDPLPDVDSPEDIMSASEGDSTEESGPRGTAN

SEQ ID NO: 161785 - protein, 86 aa, Glycine max
  Coding DNA Sequence Number=SeqID_70100
MEVPLGMNLLKGTFFVVQVEGTSTWAVVTENKRGYISCGSVQVEGTSTWLFKENKGWYIPCGSLLVKAFIRLKRNLKDRRSLGDWM

SEQ ID NO: 161786 - protein, 295 aa, Glycine max
  Coding DNA Sequence Number=SeqID_70101
MGDDMVLILGCSEDWVRCTGVPLDAWGEECFGAIAGNFGKLVKMDATFAMLVNVSYAKLLVLVASPMLVNFSAQIKIKGEVYLVRAIEENPISSEESNILSSDSENENVSLNGFSDEVGGEDGEGKGTRRESQHRGSGEEHRSTKLEFSKFNNVDIIHETNTLPNGFNMEDTPGKDGEEVACSPVEDDSLVTRLSRADVDMSKKVPQGEHKEREALKLTLKGMNCHDEDANGKCVDEKREAKRHGAIMNSASLKADPTTNKNSDCGKFLEKTEVLGLLNQRKTLYLVAKCTQQIS

SEQ ID NO: 161787 - protein, 292 aa, Glycine max
  Coding DNA Sequence Number=SeqID_70102
  Homolog annotation: Hit_ID=Q1RU69; Match level="QueryCoverage=42%, HitCoverage=59%, E-value=8e-09, Identity=31%"; Hit description =Putative uncharacterized protein
VPLGVRVQLQATAAYGGHRWSWVVENKVLGFGRRFWEKRRVKIMFFTLRIAPLGRSAQFPSIGIGLSAALGHLAQFPSVGIALSARFSLSGTSKVMVFKIPTGVTLWGSKGDNRKTCWVGAHGVKGGYEVGSEPLASKYPCLYATSTQRGHKFEWRREHFMWELELVNKLTSYVNGYNLSQFMEDSWLWRGETNGCFSVKSAYCGMFEQHKDSFECEILAVTWKLKVQSKIRFLPGMVFRNKILAGDNLIHRNIDVPDYYYSVELVLRVVLVICGASLDDYWPLLSTSPIGS

SEQ ID NO: 161788 - protein, 50 aa, Glycine max
  Coding DNA Sequence Number=SeqID_70103
MKMKRHLKKSRVFSIEDEDMVKPKQQKKLYQKKQPHPQSEISIGSVFLLK

SEQ ID NO: 161789 - protein, 84 aa, Glycine max
  Coding DNA Sequence Number=SeqID_70104
MDLSNACGSGGWLGDGMMVNLVCCGGCVGWWCLSATLVLCGWVEVGCSGHGGFEGEMTWFDWERKGKEAILGILGVHQAKTDVG

SEQ ID NO: 161790 - protein, 92 aa, Glycine max
  Coding DNA Sequence Number=SeqID_70105
MLMHHAQMTSPGICQPELHKVMEGASVFCTIKRFLRNDFYYKNYNFYYKNYNHCNDAYHLVEFRATRESPNLKINMAKTSVKSKTNDPLCEF

SEQ ID NO: 161791 - protein, 74 aa, Glycine max
  Coding DNA Sequence Number=SeqID_70106
MEKKTTRRRRQRKGDKTYLGMVAKEKKQRLVMMLECDEHDAQMQTRTFKVNIGFLEKTDVNISNVNIGFLKTRC

SEQ ID NO: 161792 - protein, 58 aa, Glycine max
  Coding DNA Sequence Number=SeqID_70107
MGAKYLEAVKQRLHAIKQWSLDEIRRALCAKRIFVHVSSESLFALSALTPTHWLKGPQ

SEQ ID NO: 161793 - protein, 206 aa, Glycine max
  Coding DNA Sequence Number=SeqID_70108
MEEGFPLCCRSLVGREVKGIGESNSKGDFLVSSPSLILDSKKTKDMSVGGSDEVEIHAQKNKRDEKVLERANGKAKRQKGDNVGMVGEKVRKGREGKFCQLLFLVTSGFLSRLKKRINITISNDVELLIVESCSANECIFMRAGKGEVDLEKTKKRKQVNIPPSLTCKRDVEVKKRLCHEVLKMTVELNSSVGLSVHPSLSTASAR

SEQ ID NO: 161794 - protein, 256 aa, Glycine max
  Coding DNA Sequence Number=SeqID_70109
MEICTKVASKNNMEGRQVGLVESLFKTQLRISERGMKTLRVRRTKDNMFLLTREEGQDFEEILGSNSECVPLQFWNNECFTKILNIIGSLVSVDKQTSSFVNLDRARILVRTMWMEFINQHRRIQINKKVCNIMVLEENGGYDEGREMCVKGGWWGKMVTSEEPFPVVDGKGLSNSMVNLVIRVCDSGQGYKGTNNEFESFSSQQGEQNEKADKSDEGGDTSKKNDNVGNSVEAQRDPLPKGGRPGKERNLKSRGS

SEQ ID NO: 161795 - protein, 108 aa, Glycine max
  Coding DNA Sequence Number=SeqID_70110
  Homolog annotation: Hit_ID=A7QPZ2; Match level="QueryCoverage=48%, HitCoverage=13%, E-value=9e-07, Identity=56%"; Hit description =Chromosome undetermined scaffold_139, whole genome shotgun sequence
MADRFARLVKLDLVQSISRSFYLGVTDSNLAVIGTAFTCFYGTNSEGVVEVGNSIWVKGGWENSDMGEKKESHEDSTSEGFNLFSVSLTFENSIGAVGGITEGISGNR

SEQ ID NO: 161796 - protein, 358 aa, Glycine max
  Coding DNA Sequence Number=SeqID_70111
MGWEFCNRTAPMAVPEASVSMNPMRLMKLLNFEGDAGIGQSTIACILSGSRATPDALRKTKEESSAQLFQGVLGGITQPEWHNLELVVSMQLIDRRHGKTIIDGNGVQGSVGEVTVAPGKWYRIDEEDGSGMGVYGVGGSFNNCTPRTILAPLMGKVYKSTEKVDLGDTRRVLVVKISARIEVQSRRGENGTIIFIICNKKMKSQLTPVTENPFLVTVVDAMMKVRPTDPPETKGTGTEEAVSDISSGYSPKMKQLNNVGGARPTIRLASRSYSVGANRNLRACNMAGQDVMNSLQVIHWYQDKAGPSMDGGGFGGSGVDGKSIKMIKDGIHLTVYCGLGLREGGMVLCKGSLALSQS

SEQ ID NO: 161797 - protein, 113 aa, Glycine max
  Coding DNA Sequence Number=SeqID_70112
  Gene Ontology: Mol. function=transferase activity
  Homolog annotation: Hit_ID=Q4A3R5; Match level="QueryCoverage=77%, HitCoverage=83%, E-value=3e-12, Identity=49%"; Hit description =Capsule O-acetyl transferase
MMTTKDDDKSDEQKAQVNQRTSISRIKIQDSSSRIKKNSRLKKKAYKQRFKISRIKIKIQESRIKTQDLKNQDQDSRIKNQDSRSQESRIKTQDLKNQDQDSRMKKRLNQDKY

SEQ ID NO: 161798 - protein, 75 aa, Glycine max
  Coding DNA Sequence Number=SeqID_70113
  Subcellular localization annotation: CTP_CleavageSite=15; ConfidenceScore=5.40e-01
MAATPRVFLSWNTHPASLASPSRRRVGCDRMDMSFSPSNKFTNSKVLICLDVFPMKFVTHEKTIKTVAIAHGVSL

SEQ ID NO: 161799 - protein, 194 aa, Glycine max
  Coding DNA Sequence Number=SeqID_70114
  Homolog annotation: Hit_ID=A5AQN5; Match level="QueryCoverage=96%, HitCoverage=55%, E-value=2e-15, Identity=29%"; Hit description =Putative uncharacterized protein
  Pfam annotation: Domain name=zf-CCHC; Domain location=165-182; Score =8.3; E_value=0.084; Accession=PF00098.14; Description=Zinc knuckle
MEIFIQSIDPGACNAIAKGLFIPTKEVNSESVPKEWDDIKDDEKRKMQDDQKAKNILTSGLSSDEFFRTARCKSAKEIWKMLEVTHEGTANGRKARKYTLKKQKTKGITLKGSSSKEDYKDSSSDDEDAENISLMMKKFGKFLKRSKDRKFSKPSKKIESNNNTFTCFECGKQGLIKFKCPIYLRKQLAKKRKE

SEQ ID NO: 161800 - protein, 656 aa, Glycine max
  Coding DNA Sequence Number=SeqID_70115
  Gene Ontology: Mol. function=microtubule motor activity; Cellular component=microtubule associated complex; Biological process =microtubule-based movement
  Homolog annotation: Hit_ID=A7PLF1; Match level="QueryCoverage=99%, HitCoverage=67%, E-value=0.0, Identity=67%"; Hit description =Chromosome chr7 scaffold_20, whole genome shotgun sequence
MVTFSPACISPADINAEETLNTLKYANRARNIQNKPVVNRDLISNEMQQLRQQLKYLQAELCSRVGAPADEVRVLKERIAWLESTNEDLYRELHKYRSRCAFVERCEIDEPNGHIILMKTDGLERHFQSLDSSDHPMVGSISGEDSKETDEAAKELEHVLLQNTMDKEMNELNKRLEQKESEMKVIAVDTETLKQHFGKKILELEEEKRKVQEERDRLLHEVENLASNSDGLAHKTQDVRGQKLKALEAQVQLQHKMKQEAEQFRQWKASREKELLQLKKEGRKNEYERHKLEALNQRQKMVLQRKTEEATMATKRLKELLEARKSSPRDNSVYSNGHLQPGLVNEKSLQRWLDQELEVMVHVHEVRAEYDKQNQVQAALEEELALLKQDRFSDGQTIPKGKSKYLRLLSMSPDAKVERIASLENMLCMSSVALKAMASQLTEAEERERTLNNRGRWNQLRSMGDAKNVLQYLFNATAEARCKLWEKNMELQDLKEQLNELVALLQQSEAQRKELVKEQKIKEQAVAITLDTPALENSRSLKHLADEMSGPLSPMSLPAPKQLKFTPGVVNWSGRESATFLDEARKMIPIGELSTKRLAAIGQAGKLWKWKRSHHQWLLQFKWKWQKPWKLSEWIKHSDETIMRSRPRAQALINVM

SEQ ID NO: 161801 - protein, 140 aa, Glycine max
  Coding DNA Sequence Number=SeqID_70116
MEKPRHHAYLNSSGSAIQETQGYHCSRLVRTICTIMVRTRGLRRVVGTGRGRDLSQDVAEDVPRRRRPTASARRQRVTQRVEDVPQLAKDVPQLAKDVPQLAKDVPHASDGSPERTAAADDAEIDRLTSDGTVDDDEGFC

SEQ ID NO: 161802 - protein, 303 aa, Glycine max
  Coding DNA Sequence Number=SeqID_70117
  Gene Ontology: Mol. function=oxidoreductase activity; Cellular component=integral to membrane; Biological process=transport
  Homolog annotation: Hit_ID=A7PLF4; Match level="QueryCoverage=96%, HitCoverage=91%, E-value=1e-114, Identity=64%"; Hit description =Chromosome chr7 scaffold_20, whole genome shotgun sequence
  Pfam annotation: Domain name=2OG-FeII_Oxy; Domain location=171-255; Score=65.4; E_value=1.9e-16; Accession=PF03171.11; Description=2OG -Fe(II) oxygenase superfamily
MAEDPGVLEVVKQLDKACTEAGFFYVKGHGFPETLLKEVRDVTRRFFELSYEEKAKIKMTPAAGFRGYQRLGENITKGVPDMHEAIDCYREVTKDMYGDLGKVMEGSNQWPQNPPTFKVLMEEYVSLCRGMPFPPPLFFFPSYLARKIMRGIALALGGSPNEFEGQRAGDPFWVMRLIGYPGLLTLLNQDDDVNALQVRNLSGEWITAPPVPGTFVCNIGDMLKIYSNGLYESTLHRVINNNSKYRVSVVYFYETNFDTAVEPLDTHKTRANGNKEFKRAVYGEHLTGKLIACMSRPTSADNI

SEQ ID NO: 161803 - protein, 370 aa, Glycine max
  Coding DNA Sequence Number=SeqID_70118
  Gene Ontology: Mol. function=tRNA dihydrouridine synthase activity; Cellular component=mitochondrion; Biological process=metabolic process
  Homolog annotation: Hit_ID=A7PLF5; Match level="QueryCoverage=97%, HitCoverage=84%, E-value=1e-159, Identity=75%"; Hit description =Chromosome chr7 scaffold_20, whole genome shotgun sequence
  Pfam annotation: Domain name=Dus; Domain location=49-355; Score =245.7; E_value=1e-70; Accession=PF01207.8; Description =Dihydrouridine synthase (Dus)
MAQTPTSLDAEHPAAADQHVGFPARSLSGESWAERAWAHWAKLGRPRFIVAPMVDNSELPFRMLCRKYGAQGAYTPMLHSRIFTETEKYRNEEFTTCKEDRPLFVQFCANDPDVLLAAARKVEPFCDYVDINLGCPQRIAKRGYYGAFLMDNLPLVKSLVEKLAVNLQVPVSCKIRLFPNLEDTLKYARMLEEAGCMLLAVHGRTRDEKDGKKFRADWNAIRAVKNAVRIPVLANGNIRHMDDVRDCLEETGVEGVLSAETLLENPALFDGFRTAEWVSESEGTNLDGKLDQADLLIEYLKLCEKYPVPWRMIRSHVHKLLGDWFSLQPHIREELNKQSKLTFEFLYDMAVTQINTAAQHLEFKVKPEPQ

SEQ ID NO: 161804 - protein, 77 aa, Glycine max
  Coding DNA Sequence Number=SeqID_70119
  Gene Ontology: Mol. function=aspartic-type endopeptidase activity; Biological process=DNA integration
  Homolog annotation: Hit_ID=Q69FA4; Match level="QueryCoverage=88%, HitCoverage=5%, E-value=1e-11, Identity=54%"; Hit description=Gag -pol polyprotein
MAEDMNVDTTTLMQTPSVLNATFSKPLPDVSKIKVFNGQNFQHRQERFNMLLDMYGVGFSLTTKKPFSVDVFSMKAN

SEQ ID NO: 161805 - protein, 482 aa, Glycine max
  Coding DNA Sequence Number=SeqID_70120
MSSFLSDFIIGLDRSDSGGSIQQPIMDREVILISGFSSKDTHRGASDSESSSSERERTSCQTSGGISCPCGRVRPSVAVGEPVSVTVILPSFASGGARRAGGDRDVRSSPCIRPSVSFGSLSSTPAIAGYEWVRDDLLKYKFCLTLATSVTALQHQMKLVNPKDSVSWSFRLAGGRGALLPILLAHSLPPTTVVQETAPAAVEAAGSAIQADFVVLSLSTVVAPLLSAYMVTTCAPTVSSPSSLAPVVLLAIVLAAMASPSSSSFPRVSLDHLYTSSDAESLWGATYKLEQKTPIGFVLAFDMNLIRLAGVQNATNSAKVFLQKSLAILEDNGLWHQEVVQKVVSWEAEVAKWMATSWTLWRVERPKVANAIIAFVEVVMAEKMDLGDKMESMAAEKDDIAKRIVELEARLRESEFRLEESELWAAKERQIGFFAKDLDLGLFDPFKDVKDGVLLNDEEIDAEEETTDEGQGAVEEGDDACV

SEQ ID NO: 161806 - protein, 119 aa, Glycine max
  Coding DNA Sequence Number=SeqID_70121
MSPFRLGNFIVRCVIEMIMPKTFNVNSLDFSAVIMKYSATPWSRCSFGSDVPLYLSMFNDFQVMGKEPESEVDCGFLPITIRGELGMDFLGTCFDMGGWLRRQRSVVELGVGDEWQALL

SEQ ID NO: 161807 - protein, 82 aa, Glycine max
  Coding DNA Sequence Number=SeqID_70122
MENLRMPINTKNGEKMKNKKVAAVGVSLSETYALSEQHPLSETSARSANEENQPCMHALNAPSACSASRLSLLAPSAPDSLN

SEQ ID NO: 161808 - protein, 140 aa, Glycine max
  Coding DNA Sequence Number=SeqID_70123
  Gene Ontology: Mol. function=galactosylgalactosylxylosylprotein 3 -beta-glucuronosyltransferase activity; Cellular component=membrane
  Homolog annotation: Hit_ID=Q4VZ79; Match level="QueryCoverage=28%, HitCoverage=8%, E-value=3e-13, Identity=80%"; Hit description =Glycosyltransferase
MKFIFRAHLNQIHPTNITRWIIDPPLDITVPSKRTPWPDAPPQLPINEKELLGTQDQTTKHSTKTRTSRSRRTRSKRKHDAKVIEIHCALWLRNCCSSLTRIWIEQMKKLMFLLDRNRNRNRIHILRVVTTVDQHMCIRV

SEQ ID NO: 161809 - protein, 97 aa, Glycine max
  Coding DNA Sequence Number=SeqID_70124
MEERMRMRKGGESGVERTVVGNNKRENERENGMENDGERIGINYGIALFASGASQHRRPNQNRQDINNQADIDTTTKEIEIGMLETLLPCLQGKENH

SEQ ID NO: 161810 - protein, 135 aa, Glycine max
  Coding DNA Sequence Number=SeqID_70125
MQFDRVRESEKNPVHSKEKPVQATTGSKTDQGSTPSFTTILFDTRKAFTGSIIEDAENIQNNCKRTKFNFITVSSLTCIYTNHEFDLHRILVLNLQNRSPDSKCREDNYKKMRRLDLFCIWRSNGVASMILACAD

SEQ ID NO: 161811 - protein, 135 aa, Glycine max
  Coding DNA Sequence Number=SeqID_70126
  Subcellular localization annotation: CTP_CleavageSite=46; ConfidenceScore=5.38e-01
SFASTLPFALSNTQAPETSARNIKQTTLWHRRPFSTFKNPFIPSVMEATLPSNWKNLIIDKYDYTIDSNEHLDVYITQPTSDLNKLCTRLAKYMQMKELAEYWNQTWVDVVSAKRDDDKPSSSKARDEGRRDWPP

SEQ ID NO: 161812 - protein, 389 aa, Glycine max
  Coding DNA Sequence Number=SeqID_70127
MVSIEGPSLKESVRGESKVRGYDDVLLANTTENVGKSVAALVVAATAECPVLKEKCSPPLITLPEYTWVDEEMCLVILRTIRFDATSPAKFVFMNREGMNIDFFYMHDYLFRDLHGTHCFSSTSSNVLDRIMTQVNADMNAFHQDWKNQLVAASGNPLPNLATSGPLDAPVDVVSSPERTLGGNKNTRGGIIMSIGAAQGSTLNTERGLRGEKAQAANAWGHEVLSRSDIVANWGEDSLNLMLEANMKLAGDKNLEDRVLTLTTNVKGLEIRAFNADALVRSQDTEVARLRAALANANKETEKANVEKERIQQKAFDDLVLIDDILKDDATPSPQRSATPVEEPSCRMSRIVNNLIKFNLSLGGCSRGNYLLIFKFNIGQGGYSGENCS

SEQ ID NO: 161813 - protein, 98 aa, Glycine max
  Coding DNA Sequence Number=SeqID_70128
MPPTLTLCHFPLRIDKGTSVTAVPPLHLRDYRASVAPPLSAHVTNSGCDNFDELVHVDNKNTAVSATLDHENYATFNWVMLLQVIQQHSLGARLSIGS

SEQ ID NO: 161814 - protein, 118 aa, Glycine max
  Coding DNA Sequence Number=SeqID_70129
MVYQKNLLMQRALTKCKFCNKPRYRAKTVGTSCIDCLHQYKLQAKCHGIMRIEDLRACYDIHLMVKHGSTLIGYMQILLLIQGMCDSVYAQMDLTHIFKHPLHLILVGQSLLPYTIFL

SEQ ID NO: 161815 - protein, 50 aa, Glycine max
  Coding DNA Sequence Number=SeqID_70130
MGWARQDRPLARYQFGEARGKHDQCLAKHMVMLQVRSAPQFAYHVDRVVL

SEQ ID NO: 161816 - protein, 242 aa, Glycine max
  Coding DNA Sequence Number=SeqID_70131
MDNILGRHILPERKVEIYHTELDEFKAELERRNFHKRLTNLVDSSIDLALVKEFYANLYCFEDPSPKQVRVRGHLVRIDAENLNIFLETLAAYSKYCRLPTNNKEIEAALCIPGRGFVLNSEGHPGKILRKDLTTLAQITSIAQSNSSRLGFPALITALCRARGVASDSLTFERLSPVINLAYIRKKCWNPDDLTVSIRGAKWARTRPAEPPSTSIAPIPARTSAAPSVPASADFQRLEAML

SEQ ID NO: 161817 - protein, 129 aa, Glycine max
  Coding DNA Sequence Number=SeqID_70132
MSSKVILMMPKNQELSAKIQESSFKFQDSRLIKIKIQDSKIQESREDLIKISIKKFFKILSSTRSFHKIITKEFYSLRVHLLGLLTENKRGYISCGSILVEGTSTRLFKENKGGYIPCGSLLVKGFLQG

SEQ ID NO: 161818 - protein, 230 aa, Glycine max
  Coding DNA Sequence Number=SeqID_70133
  Homolog annotation: Hit_ID=A5BPP4; Match level="QueryCoverage=30%, HitCoverage=11%, E-value=3e-07, Identity=42%"; Hit description =Putative uncharacterized protein
MGCEELNQAHLYILNNTQEVIPYKEAHKEFVKISHSKMTKKQVNGNTSVKVDDMGFTLIDLNRVAYSDEPFIMAEQEKQHSGCIHAARVGVPLATTLDMDHEWRREVDKKNKHREERLLENMKVVLINNSSQRASQQPRLVKENELVLGAREITKGSCVGTATNPLGEEPDTDRCGLYVDDKYLSTRLMAFGKVFVGAFVHQVCLIGDLVKASPQFLHFKADTSCEVCFT

SEQ ID NO: 161819 - protein, 188 aa, Glycine max
  Coding DNA Sequence Number=SeqID_70134
MPIYTELVKAFYSNLEIQEGTLISEVYGIKMVIDQSLFYDLTQLSSEGVPFEGTLNDDWKFDFSVLDACSIPLDSEPYVPIKRSFLIGAAVIASFGYRKEHDGSWVKKGAQPIDEEGHLPIGEDSSLLQRILDRFDGLQTFVGERFDALELQVDMRFDDMDSRITKVEGDVSHIRTCFDLTPPPRPSS

SEQ ID NO: 161820 - protein, 107 aa, Glycine max
  Coding DNA Sequence Number=SeqID_70135
  Gene Ontology: Mol. function=heat shock protein binding
  Homolog annotation: Hit_ID=A7PLM4; Match level="QueryCoverage=100%, HitCoverage=20%, E-value=1e-24, Identity=55%"; Hit description =Chromosome chr7 scaffold_20, whole genome shotgun sequence
MELLPDFFEAEERSSYETPEVLHLISGRDLFGMVCLANKVPEISITNIEKLTSFRSFHSGLCQSITDLNVHKNAKRSDDFETYQGHSFKTSSIVSDAYRHLELHISG

SEQ ID NO: 161821 - protein, 26 aa, Glycine max
  Coding DNA Sequence Number=SeqID_70136
MEKGTSLPMEKGNVRIGRGKGWLILF

SEQ ID NO: 161822 - protein, 19 aa, Glycine max
  Coding DNA Sequence Number=SeqID_70137
MVRFIQQQQQQQQQRLIPL

SEQ ID NO: 161823 - protein, 149 aa, Glycine max
  Coding DNA Sequence Number=SeqID_70138
  Gene Ontology: Mol. function=structural constituent of ribosome; Cellular component=ribonucleoprotein complex; Biological process =translation
  Homolog annotation: Hit_ID=Q9ZT03; Match level="QueryCoverage=73%, HitCoverage=72%, E-value=5e-34, Identity=68%"; Hit description=Clone MS56 unknown mRNA
  Pfam annotation: Domain name=Ribosomal_S26e; Domain location=1-134; Score=208.8; E_value=1.3e-59; Accession=PF01283.10; Description =Ribosomal protein S26e
MTFKRRNGGRNKHGRGHVKFIRCSNCGKCCPKICARHFNFQQLTFCARSVKQDKAIKRFLVRNIVEQAAVRDVQEACVYEQYTLPKLYVKMQYCVSCAIHSHVVRVRSRTDRRKRDPPQRFIRRRDDAQRPGQPGQAPRPAGTAAPVRT

SEQ ID NO: 161824 - protein, 130 aa, Glycine max
  Coding DNA Sequence Number=SeqID_70139
MAQIVKELIDCWKGKAILNQLLVIGKVGNMPGEDDVQAQVPEGGCGRGPLLAVLPSVVAPGHRSVVIGPRKWSQAMPNTTSVPPRAISCKSRVKVEEMGQTIVDKVVGTAAVNEDDDIVTRDRTHDAKGG

SEQ ID NO: 161825 - protein, 183 aa, Glycine max
  Coding DNA Sequence Number=SeqID_70140
MQVLLSSVVGWFMGSIVKVEHETRHEFDGSTLCGCDVKNALPQKITLVMEEEKTSMLFEYHVLQIRRKSMFGSEVVSNSSDENTGTTTTTTITTSSRPGSKRLQEIGLILASSRWDSEPCPSVPKEFKMFVMKIVAKVANASKKKRKLNNIHEEDTSNISKIADKVLKMLDDVVNFVGEENAV

SEQ ID NO: 161826 - protein, 112 aa, Glycine max
  Coding DNA Sequence Number=SeqID_70141
  Gene Ontology: Mol. function=aspartic-type endopeptidase activity; Biological process=DNA integration
  Homolog annotation: Hit_ID=A5BBN5; Match level="QueryCoverage=67%, HitCoverage=8%, E-value=4e-11, Identity=39%"; Hit description =Putative uncharacterized protein
MVPGNVTIEKPREQWDEEEREMVQYNLKAKNIITSALGMDEYFRVLNCKNAKEMWDTLQVTHEGTTDEHKMKLMRLNHHEENDRKKKGIAVKASSSIQEEIDKEDLNEIERT

SEQ ID NO: 161827 - protein, 154 aa, Glycine max
  Coding DNA Sequence Number=SeqID_70142
  Homolog annotation: Hit_ID=Q9FY55; Match level="QueryCoverage=29%, HitCoverage=8%, E-value=4e-12, Identity=71%"; Hit description=CLB1 -like protein
MGIKRLKVINQGPHADNNCPRTKLGPIILSSLTFSKLTLGPVAPQFTGVSIVEENSGPDGVTMDLVMQWDGIALSRGCRHIAEPRLRVAELIQRTNKWRRLWEQESRSRKMGTTKYDIEKFSGENDFRLWRIKMEAILIQHGCAEALKGEERMS

SEQ ID NO: 161828 - protein, 75 aa, Glycine max
  Coding DNA Sequence Number=SeqID_70143
  Homolog annotation: Hit_ID=A7Q6E5; Match level="QueryCoverage=100%, HitCoverage=19%, E-value=5e-23, Identity=69%"; Hit description =Chromosome chr11 scaffold_56, whole genome shotgun sequence
MSLTDGDLDLRPPSKSSFTVGEYMFADVENLEHYAKYLNQSLITFGFPASLDLFTNDPFLVARTCNCIYFLLQQR

SEQ ID NO: 161829 - protein, 304 aa, Glycine max
  Coding DNA Sequence Number=SeqID_70144
  Gene Ontology: Mol. function=RNA binding
  Homolog annotation: Hit_ID=A2Q574; Match level="QueryCoverage=64%, HitCoverage=47%, E-value=2e-22, Identity=38%"; Hit description =Cyclin-like F-box
  Pfam annotation: Domain name=F-box; Domain location=112-159; Score =31.0; E_value=4.4e-06; Accession=PF00646.24; Description=F-box domain
MVALSLVWRTFMGAELFALTEASKMALYVVLGKFGRRNDPGFHPMASSPQTSAGLGSPIFDKLEAELAKAVMSLLATNILKLAYASPEGKESEGKLVVKMKEELNLSKDDWDKISELPDNILLHMMNFMDTREAVQTCVLSKRWNNLWKRLTSLLFNSSEFESVFKFNKFLSKFLSDRDDSISLLNVDLDFRPPHEIACLSDCTLYYLGFLGRPRFELEPLNRLMEYAVSRNCQRFSINVGFDCRLDVDPVCFCPSLTILRLSFTPYGANCKLPKSLQLPVLKTLYLHHVGFTASDNGCAEPFS

SEQ ID NO: 161830 - protein, 52 aa, Glycine max
  Coding DNA Sequence Number=SeqID_70145
MVMGLDRKLTRPWGHNLNRHTCVHALLYSHGHMGEERLGARGGGEKRGASIG

SEQ ID NO: 161831 - protein, 85 aa, Glycine max
  Coding DNA Sequence Number=SeqID_70146
MIIEEFTHVAFDETIPIRPRKETFDDILDSLEGMHIHGEEHEGKGKGNDEDFQIDETKTCIDLPREWRTSRYHPLDNIIGDISKG

SEQ ID NO: 161832 - protein, 233 aa, Glycine max
  Coding DNA Sequence Number=SeqID_70147
HLDATLTSSVGPECVELISIVQRAISGVGCRKQNMSKIEAQPVPIMVVVEAVASVVVADGAKPSLDGEKNPNQVQKNLMLYGIVVEQDGVIAVRSFGAMAMKRGIGSGAMGATDVGAVVGGGGGCAEEDEAVGRGDRVAAAVLGEGHPLRIRGGIERQQGWPRPPQGDPQWRTTSEGGGRQPWKLRMSWKAVMGAPYGEWQPWKIAMGASYGEWQPWKVGGMAAMGGRSDQLL

SEQ ID NO: 161833 - protein, 410 aa, Glycine max
  Coding DNA Sequence Number=SeqID_70148
METWYFCIHVTCEVARTGDLVLEGGLTKGNFGFEELMKLRLWMLAMNLNGPSQLGPSAPARGPSFISGSPYEVTRLKSLWSNLCIISHHYSEFGNFLPDPSHVLDFVCCLEFYPHVFFIFLLLEQQSPCQWFPNFNGDHGVCTICESGFNDDFVGLGMFDRGDEFLIFSSHNFFSVIGGSLECLLDDSLEVPGIFSSCQLGEQAKGHDPVAKVGIFSDKCCYLLVWSVHPNLVVSRGLIVFYDMTDDAMDCSAIGRQGCVTLVPGPFWESLTLVRLPLAHLHNLSMVLGIFLHRLSANLAGHRARSMECNAPLGWPMWPMSCDVTNACILHIEVLNKSVEDVNEPWTKSTVLVKQASKCSSRLAVPSYHSRLSGFQPKDMSALAFSTPPQGVTPSPQCGFGVAREYQYLS

SEQ ID NO: 161834 - protein, 546 aa, Glycine max
  Coding DNA Sequence Number=SeqID_70149
  Gene Ontology: Mol. function=DNA binding; Cellular component=nucleus
  Homolog annotation: Hit_ID=A7QXJ1; Match level="QueryCoverage=83%, HitCoverage=88%, E-value=4e-25, Identity=30%"; Hit description =Chromosome undetermined scaffold_225, whole genome shotgun sequence
  Pfam annotation: Domain name=MBD; Domain location=42-111; Score=8.6; E_value=0.005; Accession=PF01429.10; Description=Methyl-CpG binding domain
MKLDTVEWKGKNGKYYFPPSSGLKFNSKEVFRYLDNVQNKIIVEKAIVEGLPPGWVKKTRITTNGDSVRRDTFYIDPVNGYTFCSIEDVDHYLETGKIGRNEFTSKDKDGSDMELKADKSPSRSVTMKPTLSVSKGQSSDLDMIANDQQIPRSASSEEYLDVPISECVVGAELTNLVISRAESSDQKQGKFGLAQSASVSGCTNKDVEEKQLQENSETKHGAAKAQAQDHQWQNKHKKEINLPHRASKRLAGIKVGPVPELKTRNRARRVAIKQSDKEETIIINVDKSPNSLSGDLAKQKLSGTDTEKTLEVQISDKDKKCFSFSPLENNATVEECARVLENGDKVDAKLDYTLDFPLGELLTDPCIAFAIQTLTGVTFEASKNSQTSSNLRNSQHSKTSAPTLASGKGDDKKSNDGLGDRVLSSLENLAIPKEHAGDDKTDSKAKNENAGPSSEKTLDMSWMDPCIEFAIKTLTDTIPSDSADQNPKNCIQLSSVCLDNIYQTDYSCRQYFGTQKPMFHKQSFVDPSLQHTRNIGIVNSAAEARL

SEQ ID NO: 161835 - protein, 253 aa, Glycine max
  Coding DNA Sequence Number=SeqID_70150
  Gene Ontology: Mol. function=transketolase activity; Cellular component=chloroplast thylakoid membrane; Biological process =metabolic process
  Homolog annotation: Hit_ID=A7PSV9; Match level="QueryCoverage=77%, HitCoverage=31%, E-value=5e-32, Identity=41%"; Hit description =Chromosome chr8 scaffold_29, whole genome shotgun sequence
  Pfam annotation: Domain name=Transketolase_N; Domain location=84-253; Score=-199.6; E_value=0.011; Accession=PF00456.12; Description =Transketolase, thiamine diphosphate b
MAMLETGSGSGSEVDKDAPVEVDTSTKDIIECNDEHVGKSVSNDLVDDSQQTSALEDSWFEASLCGHELKAGMDLVVAAEVFEAHRISAEEFRSSALSIIKNENLVLKFRERYLLWEKAAPLVLGMTVFGLDLPIEPKDTIPVGLDDAVKAKNDALGPASYGHSESDCQTSVVEPSPTSAMPISKLITISQVTTTIGFASPNKANSYNVHGSALGTKEVDATRKNLGWPYELFHVLEDVKKYGWGVRDIFVSS

SEQ ID NO: 161836 - protein, 275 aa, Glycine max
  Coding DNA Sequence Number=SeqID_70151
  Gene Ontology: Mol. function=methyltransferase activity; Cellular component=chromatin; Biological process=chromatin assembly or disassembly
  Homolog annotation: Hit_ID=A7PVZ4; Match level="QueryCoverage=74%, HitCoverage=44%, E-value=3e-23, Identity=42%"; Hit description =Chromosome chr8 scaffold_34, whole genome shotgun sequence
MSTGLCLGGNLSGMNLVTRWVVDLNKHACECLKLNHPDTEISISMGDKNLRPWLIALHVKNEEDDDTSSNEEVNSEDDNELNEDDEIFEVSEILVVCYGDPNKKKEQGLYFKGYGFALNSCEPIEFWHKEKIKEFFSRGFKSQILPLPINTVAYNEGQKVQLQKKLLFEDAISNLPMVQNNECRDEIKYDKVAQTEFQRFIRLSKHVSTLLSKSAWTHLLVMTLIARSCSFIGGGSLGRVTFQVIQEGVILEKVPSVQWESYTVIWAVLSWGRRG

SEQ ID NO: 161837 - protein, 527 aa, Glycine max
  Coding DNA Sequence Number=SeqID_70152
  Gene Ontology: Mol. function=protein disulfide oxidoreductase activity; Cellular component=mitochondrion; Biological process =intracellular signaling cascade
  Homolog annotation: Hit_ID=A7PNI1; Match level="QueryCoverage=25%, HitCoverage=18%, E-value=1e-26, Identity=47%"; Hit description =Chromosome chr1 scaffold_22, whole genome shotgun sequence
MEKNEETTMEEKLLCSDYHLMEACLWGFYGGWIFELQWGPLMVIFHHGDTTEDKGKEELHHQDDPWIRSLERMLQWRKRKRERKREGEHEIEGRKRERISSTLDTFSHAAAIDGENAYLVMLVLDCGDAVHNSGSRRSLRFRFGRFFRERSLRFVEINVDVFAEREKELRKRIGSAMVPKIFFGERLIGGLVELNAPRKDDSGELERRLAAAVGEGPSAPTYGFDEAAEVEEAAMTEEEEEIGRVVRVLRQRLPIQDQLMKMKIARNCFVGIELVELLVRHHGCAPSKVSEDPLTVKVDHLKDKTCNKDNDVIKATSFELISTLRDVLKTSSLWRDHVQTYSKSSCTCHSSSSTAGLVPYTTGPYQHVPANPSEAAGNVTSNQFGYCFSIVNKAENELEFLLIENLVVHRRIDEPNGADRGWSFSTENEEAVLFYDDENEGTTGGGEWGYLRSFTSFDSGECRSRDKTMENLATCDEDGKESWLDIITALSWEAAILLKPGTSRGGGMDPGGYVKVECIACGHRNER

SEQ ID NO: 161838 - protein, 127 aa, Glycine max
  Coding DNA Sequence Number=SeqID_70153
  Pfam annotation: Domain name=G-patch; Domain location=26-70; Score =17.2; E_value=0.0016; Accession=PF01585.14; Description=G-patch domain
MSFQALEVVSNTYVESPPVLPRSSSAALMVARVMLGNGYDPGRGLGQNGDDVANLVEFKKNCGRFGLGYKPTRANVRRSTLERRGQSMGQQQGPQVEGTSICHINESLISAGWKCEGQIAMINDEVP

SEQ ID NO: 161839 - protein, 65 aa, Glycine max
  Coding DNA Sequence Number=SeqID_70154
MVPRMSLGPLPLDDKGADDHNLSLRVNKLACLWLTKGVVWVEDDVNLRVSTGLLAAIDKGCRRRR

SEQ ID NO: 161840 - protein, 98 aa, Glycine max
  Coding DNA Sequence Number=SeqID_70155
MLCGYREANEGKLEELMLTLSLFDCISPSPAWEKQRTLEARALFSITYACARMRYGRGRCVIRTLGVERAAMRLTAEVELEDRVLLRSRAKTGLKLRG

SEQ ID NO: 161841 - protein, 323 aa, Glycine max
  Coding DNA Sequence Number=SeqID_70156
  Homolog annotation: Hit_ID=Q6XKE6; Match level="QueryCoverage=60%, HitCoverage=10%, E-value=4e-08, Identity=26%"; Hit description =Genome polyprotein [Contains: Movement protein (MP); Capsid protein (CP); Aspartic ...
  Homolog annotation: Hit description=protease (EC 3.4.23.-) (PR); Reverse transcriptase (EC 2.7.7.49) (RT)]
MDNSSFPNILEFKNKMPPDPQILRLKDWFSRYDFYVKLIKGKNNLIPDFLSKPNNKTVKVITFTHSFPLIFMAKPLFETTKTIKVFPLGLITHTLAQILEYAKFKYTSTQIFDPEIPFGGIFELFCEIGWDLCEPTIWVIWCNTIQYLILIAIKPLMTYNLLTDPYKDEYLLWTMLEWFSPLAWWRMKLKQIIDIERQRGISEDHIGELVSIVIIHHPYFMEQEQLWFRNEAQIWRTFEAYPLEESYRNQLARHLGEVNNYSYRPLDPNLPSSSQRPRDSNPTDRIILQNTNDGRIDTEIYVPEPEFQKVEDLGDDYSALEQD

SEQ ID NO: 161842 - protein, 77 aa, Glycine max
  Coding DNA Sequence Number=SeqID_70157
MVFHLRLVMSFKTKKGKHRLKGLSKGLIQEASTRIKPRLLCKQSMGQNTPNDYDDDSNSHKGKLITSKLRFQNYHDM

SEQ ID NO: 161843 - protein, 65 aa, Glycine max
  Coding DNA Sequence Number=SeqID_70158
MEAMKEQMAIMMEAMMSIKEIMEVNAVAIATTSTIAEVDLTLPYGLNQINLPTSDMVGLEGKELG

SEQ ID NO: 161844 - protein, 172 aa, Glycine max
  Coding DNA Sequence Number=SeqID_70159
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=56%, HitCoverage=10%, E-value=1e-09, Identity=35%"; Hit description =Gag/pol polyprotein, 3'-partial, putative
  Pfam annotation: Domain name=G-patch; Domain location=38-82; Score =28.6; E_value=2.3e-05; Accession=PF01585.14; Description=G-patch domain
MPYVEATEESLETAFQSFEVVSIASVDSLSGQPCLSDTAMMVARVMLGYGYEPGMGLGKNNGDRTSLVTTRGNRGKFGLGYKPTQADIRKSTSERKNRGKGSRLGQQAEGSPPCHISRSFISVGLRHEGQVATICEDDSPRRSDLVWPCPPGFRLGNWRVEERPDVYATSIM

SEQ ID NO: 161845 - protein, 23 aa, Glycine max
  Coding DNA Sequence Number=SeqID_70160
ACSKVHAPILDSNDPSQLESNLI

SEQ ID NO: 161846 - protein, 68 aa, Glycine max
  Coding DNA Sequence Number=SeqID_70161
MAFTLIQGRTKFKEFWGLYLQNPRKIRVKIFIVVKKRLLLPLPLVEVKMKQGVKSLVRKSAPMKKVTS

SEQ ID NO: 161847 - protein, 60 aa, Glycine max
  Coding DNA Sequence Number=SeqID_70162
MTTRSRFATHCCFLLSGDGLRPRVHSEIMGACHIAPVPMIFMLKHAPTKCSLKCLNGVCA

SEQ ID NO: 161848 - protein, 89 aa, Glycine max
  Coding DNA Sequence Number=SeqID_70163
MLMSNFNCWLSQPTLLRASEARLTGASSKGGKCAESPPTFICGKRRKNRRKPVMKNILDSGVVFTFEEGRQKRGPCSYVPSIEEEIRPT

SEQ ID NO: 161849 - protein, 235 aa, Glycine max
  Coding DNA Sequence Number=SeqID_70164
MRLRGRWGQEGLLRQKRIVGIAFGAAAVEGFRLRFVQRSVLTETLYQIRVGDVAAAEGHRVDEAFFDQRFGFLGGVGAGADDHPVKVGAYRVAEGVGIRFAAGPSPPVERPQRRDADADVLGTPFGDGGVDHFQRQASAILDAAAVLIAGFPRVGGRLAEIVDDARDLAGFERTRRGGRHAHPGAGFITHGGAGFGVDCRRGDRCLPARLQAGVGDAAYVPQLHGNMAVVVMHCL

SEQ ID NO: 161850 - protein, 125 aa, Glycine max
  Coding DNA Sequence Number=SeqID_70165
  Subcellular localization annotation: CTP_CleavageSite=41; ConfidenceScore=5.22e-01
MAELSKKRKGSSSTTAAAGHRRHGPSEAPTAPIHPSLSSPRSSTLFSSDDQRLWYLSQFSSRIILDPKYLDIDFFNDETFDCYQVFQNSRLIDFMSLKLSYYPELVKFFYSNLKIQDGIISSEVH

SEQ ID NO: 161851 - protein, 98 aa, Glycine max
  Coding DNA Sequence Number=SeqID_70166
MHVQHCISHWCYPLAKLLTTVDERTSSSDEMRLPEGRLPEKRNTCRSLQVVAGGGDRGWSRPTTRRIRSRPARRRVDSCPARGALVRALAPGASKRLK

SEQ ID NO: 161852 - protein, 207 aa, Glycine max
  Coding DNA Sequence Number=SeqID_70167
  Pfam annotation: Domain name=Ribosomal_L14e; Domain location=102-170; Score=-1.2; E_value=0.0057; Accession=PF01929.8; Description =Ribosomal protein L14
VQPFRFLILTCSFTIHNFKIPKTLTLIHHLHSILLKSIPTIGKIVNNNQSTPYGTTSRTLCRNLTSEMLHPSHVSSEFGLNALYDSVNGGGDVWINENCFRIRYVQIRRVAQINYGKEYGMLVVIVDVIDHNRVTPPPPPKKLIVRKRRASLNDFDRFKIMLAKIKNKAKDNDSDDNVDFVAGNVKLITTKEVWDQYLEEARRDGKI

SEQ ID NO: 161853 - protein, 116 aa, Glycine max
  Coding DNA Sequence Number=SeqID_70168
MVALKDQVASIMEAMLSMKRMMESNTAAVATTSTATEANPTHPSAINQANQPAPNMVGQGGEVLGSTSGGPPSAVEGREILDLIEERLRVVKGFGDYPFADMTKLSLVPDVAQVGA

SEQ ID NO: 161854 - protein, 81 aa, Glycine max
  Coding DNA Sequence Number=SeqID_70169
MASNSQQFSARNDVIVIRGVHEVATNSSSSAETKKLEGESSTSNSNLQKQHIPLPFPPREISNKKMEQAEKEILETFRKVE

SEQ ID NO: 161855 - protein, 67 aa, Glycine max
  Coding DNA Sequence Number=SeqID_70170
MAPKKLSAKRSRRDTAAEGTSAAPEFDSHRFRSTEHQQCFEAIKDGRSTERDASSSRTMSTQIFRRR

SEQ ID NO: 161856 - protein, 189 aa, Glycine max
  Coding DNA Sequence Number=SeqID_70171
  Subcellular localization annotation: CTP_CleavageSite=46; ConfidenceScore=5.33e-01
MRTLRPSLSTLAQSSWSLLLMALLPPRPWNKRPRGLVGKSTKLKLRREERDQSRVDSLILKDELKACSRSKRSLSQRLCETETNMLAIIIKYQEELSLATAHEHRVADEYAQVYAEKEARGRVIDSLHQEATMWMDQFSLTLNRSQELPRLLAKAKAMADTYFAPEEIHRLLNYCQHMIDLMAHIIRNC

SEQ ID NO: 161857 - protein, 226 aa, Glycine max
  Coding DNA Sequence Number=SeqID_70172
GLHVFTIRGLHVLAIRRLHAFAVRGLHILTIRGLHVLAFRGLHVLAFKGLHVLVFIELHVLAFRGTHILVIRGLHVLSFRTLHIPTFIGLHVLIFRGSTRPRLQRTTRPSQSEDYTSSPSEGCMTSPLEGNMSSPSRSYTSSLQRTTRTRLHRGLHVLAFRGLQILAFRGLHVLTFIGLHVLTFRGLHALAFRGLHFLAFRGLHVLTIRGLHVLAFRQALTACPRR

SEQ ID NO: 161858 - protein, 53 aa, Glycine max
  Coding DNA Sequence Number=SeqID_70173
MGDQATSMQEISADISNEHAGALCRSKLHDDDESRLIQVVLMITKMMTKSPRE

SEQ ID NO: 161859 - protein, 54 aa, Glycine max
  Coding DNA Sequence Number=SeqID_70174
PLIELVRYHVPSWEDVREKGVQGRSPKYEEPQDLRSNPFQGGGDDAILPPKGIG

SEQ ID NO: 161860 - protein, 111 aa, Glycine max
  Coding DNA Sequence Number=SeqID_70175
NPSDLQPFDPEIDRTFHRLVRHSVHPDHSVHFEHSEYSVASDSEYSDFEHSTTNFYTENMAQPPPRERTLREMAAPDFTYESLCIQYPDEGVPYVLKTGLIHLMPKFHGLA

SEQ ID NO: 161861 - protein, 35 aa, Glycine max
  Coding DNA Sequence Number=SeqID_70176
RDSNVNMTDLVSAEDDAFCLTDCKRMFMKVRTTTW

SEQ ID NO: 161862 - protein, 181 aa, Glycine max
  Coding DNA Sequence Number=SeqID_70177
  Gene Ontology: Mol. function=UDP-glucose 4-epimerase activity; Cellular component=soluble fraction; Biological process=carbohydrate metabolic process
  Homolog annotation: Hit_ID=O65780; Match level="QueryCoverage=43%, HitCoverage=22%, E-value=4e-34, Identity=84%"; Hit description=UDP -glucose 4-epimerase GEPI42
MATTLATPKLSEDKVRQCVDTRLGGEYPPKAVAKLGVGCTNAPPHMGSAYTTIAADAIARFQGLLQVYGGNLGWCFIEEAYYKLLLEALLSKQQGSAEYKFGNLGTGRGLEMVAAFEKASSKKIPLKMCPRRPGDATAVYASMDKAEKELGWKYAKYGIEEMCRDLWNWTSKNPWGYQGKH

SEQ ID NO: 161863 - protein, 164 aa, Glycine max
  Coding DNA Sequence Number=SeqID_70178
  Gene Ontology: Mol. function=nucleic acid binding
  Homolog annotation: Hit_ID=Q2AA09; Match level="QueryCoverage=37%, HitCoverage=22%, E-value=1e-08, Identity=47%"; Hit description =Retrotransposon gag protein
  Pfam annotation: Domain name=Retrotrans_gag; Domain location=18-94; Score=27.4; E_value=5.3e-05; Accession=PF03732.8; Description =Retrotransposon gag protein
MNLSSELIRNNLVIEDENSLHEGNSLKTWEEVVEKFLKKYFPESKIAEGKAAISSFHQLSDESLSEALERFRSLLRKTPTHGFSDASSIGACRPRIFFINGFLCFLEDEWQRNGERKRERRRHFKEKMSLEEAHHHRRPWIRAWRKKEMNEGRGREEHEILCSK

SEQ ID NO: 161864 - protein, 210 aa, Glycine max
  Coding DNA Sequence Number=SeqID_70179
  Gene Ontology: Mol. function=oxidoreductase activity; Cellular component=membrane; Biological process=electron transport
  Homolog annotation: Hit_ID=Q2MJ00; Match level="QueryCoverage=97%, HitCoverage=34%, E-value=6e-87, Identity=81%"; Hit description =Cytochrome P450 monooxygenase CYP97C10
MRFSLSKAVVPSLHKRYLSVIVDRVFCRCAERLVEKLQPDALNGTAVNMEAKFSQLTLDVIGLSVFNYNFDSLNMDSPVIEAVYTALKEAEARSTDLLPYWKACFFQSYIHDMDFLSLFVMSCAEEAVSIIRKTVEDLIEKCREIVESEGERIDVEEYVNDSDPSILRFLLASREEVSSVQLRDDLLSLLVAGHETTGSVLTWTLYLLSK

SEQ ID NO: 161865 - protein, 100 aa, Glycine max
  Coding DNA Sequence Number=SeqID_70180
MEDILKMKDLFKRWTEYFDSTRSRVNHPPPELIFLLFMACKYEKDRLKEENIEKISKRKIFSIRFKSTTTTIKKESSQAEKITMTPHTPPETQSFLMNTS

SEQ ID NO: 161866 - protein, 119 aa, Glycine max
  Coding DNA Sequence Number=SeqID_70181
  Subcellular localization annotation: CTP_CleavageSite=48; ConfidenceScore=5.78e-01
MPFFFRKSFLPPFSKSFTSHFLFFVRHCLWFVGVATLSAAVKVKFPASSFAVVGGGKQCMQMVFVCRERTDDFRIKLMDEDEWMYEIMSERADMDYENVESCGANEPHVDCSDAFKTSQ

SEQ ID NO: 161867 - protein, 200 aa, Glycine max
  Coding DNA Sequence Number=SeqID_70182
  Homolog annotation: Hit_ID=Q2HTA0; Match level="QueryCoverage=49%, HitCoverage=15%, E-value=1e-09, Identity=36%"; Hit description=IMP dehydrogenase/GMP reductase, related
VSWLPYTEHRGVRAFQEISSFQGQLRWGPMIVAVRPERVVRQFGYIQSIPPPPVSARLSQDQIDDRWMEFADHLLPAGQPCLVPGQVSADYIEWFFRISHPFMTPTQAADQQRDAPAADPEDYIQPPSPQVPVAFDPPPYVDDYEGYEAIAQRLERVLNLRIVTAGTELYDIMQDCLTIARGGLSADGTVRARQRRRTDH

SEQ ID NO: 161868 - protein, 206 aa, Glycine max
  Coding DNA Sequence Number=SeqID_70183
MGRGGNAVSAVGGGDVVSVVGGGLAEEEVGLIVLGSRGGMGGDFAEAEDGEGCIRYHGIQYPNNGIKFGSNGSLVCSSGSLNCSEFGHGGLETIHTGGGKFDRCLRSQEAKEKLANPPCAPKSNLHNQILPIDVACLPVSFSKLEFIDPIPKSSVVDSSSHGGFAKEPAMYMVTDDLVVTPISSISGVSYLYRSKVSLFDLSLALV

SEQ ID NO: 161869 - protein, 67 aa, Glycine max
  Coding DNA Sequence Number=SeqID_70184
MDGEEDREKEKTTRRRRNIPRYGGEGEEAETCDDARVRRTRCSDADRDEKTDVNISNVNIGFLKTRC

SEQ ID NO: 161870 - protein, 52 aa, Glycine max
  Coding DNA Sequence Number=SeqID_70185
MEEGCVESDTCPSQKAAQGGGKGHLACVLERIEIFGNRCMGEKSVTRSLLLP

SEQ ID NO: 161871 - protein, 179 aa, Glycine max
  Coding DNA Sequence Number=SeqID_70186
MDVNTMLMCNDQFSCVGPIELLCTVGRTPDAILNLLECHSIPTHDAVLYYNGRWNMSRQNNFVGYAFTGINPQKFDIPKGCTIEELKDLIKQVAPKGNPPHGIHESQLVRHLFYRQPAHLEYSDKVLKFEIIELKSNDDVLKVLVESNYWKQFVPIEILALFSKVVLENEDEVVTSLHV

SEQ ID NO: 161872 - protein, 191 aa, Glycine max
  Coding DNA Sequence Number=SeqID_70187
  Gene Ontology: Mol. function=phosphoprotein phosphatase activity
  Homolog annotation: Hit_ID=Q2HTA0; Match level="QueryCoverage=88%, HitCoverage=26%, E-value=8e-21, Identity=35%"; Hit description=IMP dehydrogenase/GMP reductase, related
  Pfam annotation: Domain name=DUF1723; Domain location=96-145; Score =59.5; E_value=1.2e-14; Accession=PF08330.1; Description=Protein of unknown function (DUF1723)
MTGVADAVHTEGMAIDGSLGSPAGDEGFPGGPRDPSILTGFAEDVAHSIWSGQERPDLKLVSHGRKVDKIGRPAPKIEGMIAATRLSPLIRCSVITTDPGLISAFIERWHRETSTFHLPVGELTITLDDVASLLHVPITSALHKFEPLVTSDAIGLLTELLKVSHEEATTETRQAGGPHVRLGWLQDVYES

SEQ ID NO: 161873 - protein, 270 aa, Glycine max
  Coding DNA Sequence Number=SeqID_70188
MSANSWHHLHLLVKSRAFALSVSQQYPARIVLVAREHPLLAIKHGIVAVWFLLFSDHNFLNIYGRSLERLLDDGLESDIVRAFEDNPCPTSFYVGCTIDIKDPPFDGPGYHLSCEFWLSQNLLDGIVCLDYHLMTLEVGPKSLSRDALLGDMKHAADEVDRELVLPFLLYERAGFNPSMCDHEVEELVVPTPKVHLSGLRHMLYLHSSPKTSSRHDPVPKVGIFSDKCHFVLIWRMHSDLVVFEISVVDEQLSFAIGILYHDLSDEVGMK

SEQ ID NO: 161874 - protein, 148 aa, Glycine max
  Coding DNA Sequence Number=SeqID_70189
  Gene Ontology: Mol. function=transferase activity; Biological process= carbohydrate metabolic process
  Homolog annotation: Hit_ID=A7UQU6; Match level="QueryCoverage=87%, HitCoverage=27%, E-value=2e-50, Identity=77%"; Hit description=Three- deoxy-D-manno-octulosonic-acid transferase, N-terminal
MVILDIVQKLEKEGQNVVLRSQNEKFKPGTDIYVVDTLGELRLLYTLTPIAVIGGSLLPGLSGHNISEAAAAGCAVLTGCHIGHFSHMVLEMQRSNPLSVHQVSGKLELEKALIELFTNATLLEARRRAAKEAFCCLQMNPRVLDYEK

SEQ ID NO: 161875 - protein, 241 aa, Glycine max
  Coding DNA Sequence Number=SeqID_70190
  Gene Ontology: Mol. function=endonuclease activity; Biological process=auxin mediated signaling pathway
  Homolog annotation: Hit_ID=Q2HUP4; Match level="QueryCoverage=66%, HitCoverage=60%, E-value=3e-56, Identity=64%"; Hit description =Endonuclease/exonuclease/phosphatase
MWKLEKNGESVYAGTWVHGHVDHSSMFLLSLNPDMIDLIHQAVECGVTFLDTSDIYGPHTNEVLLGKAFDGQRKTLSNLYDMDQLRNNVNARSLLGSNTLYGSSTVSKEQGPLHRRPDVVKSKQGFPHFRERVWVKKLVHDRRIRFGTWNIGTLTGKSMEIVDVMVRRKINFMCLQETKWTGEKAKELDNSGFKLWYTGKIRLRNGVGIIVDKEWKKDVVDDTFNVISGYAPQVALAEHFK

SEQ ID NO: 161876 - protein, 486 aa, Glycine max
  Coding DNA Sequence Number=SeqID_70191
  Gene Ontology: Mol. function=transferase activity, transferring glycosyl groups; Cellular component=integral to membrane; Biological process=metabolic process
  Homolog annotation: Hit_ID=Q8S995; Match level="QueryCoverage=95%, HitCoverage=99%, E-value=0.0, Identity=74%"; Hit description =Glucosyltransferase-14
  Pfam annotation: Domain name=UDPGT; Domain location=9-482; Score= -53.8; E_value=6.8e-08; Accession=PF00201.9; Description=UDP -glucoronosyl and UDP-glucosyl transferase
  Subcellular localization annotation: CTP_CleavageSite=46; ConfidenceScore=5.23e-01
MSSQTRNLNFVLFPLMSQGHMIPMMDIAKILAQNGVTVTVVTTHQNASRFTSTFSNSQIRLLEVQFPYQEAGLPEGCENLDMLPSLGTGLDFFNAANSNTLKEQVEKLFEELNPPPSCIISDMTLHYTANIARKFNIPRFSFLGQSCFSLFCLYNIGVHKVRSTITSETEYFALPGLPDKVEFTIAQTPAHNSSEEWKEFYAKTGAAEGVSFGVVMNSFEELEPEYAKGYKKARNGRVWCIGPVSLSNKDELDKAERGNKASIDEHFCLKWLDSQKPKGVIYVCLGSMCNITSLQLIELGLALEASKRPFIWVIREGNQLGELEKWIKEEGFEERTKDRSLVIHGWAPQVLILSHPSIGGFLTHCGWNSTLEAVCAGVPLITWPLFGDQFFNEKLVVQILRVGVKVGVEVPVEWGEEDENGLLVKKEDVGRAINELMDESRDSEEMRERVNGLAEMAKRAVEKGGSSHSNVTLLIQDVMQQNKRDT

SEQ ID NO: 161877 - protein, 578 aa, Glycine max
  Coding DNA Sequence Number=SeqID_70192
  Gene Ontology: Mol. function=transferase activity, transferring glycosyl groups; Cellular component=integral to membrane; Biological process=metabolic process
  Homolog annotation: Hit_ID=A7QJC6; Match level="QueryCoverage=85%, HitCoverage=97%, E-value=2e-97, Identity=41%"; Hit description =Chromosome chr8 scaffold_106, whole genome shotgun sequence
  Pfam annotation: Domain name=UDPGT; Domain location=101-573; Score= -124.8; E_value=0.00026; Accession=PF00201.9; Description=UDP -glucoronosyl and UDP-glucosyl transferase
MGILQFLRLETIVQLANVEWKLGLRLRVHLLKILNFGFYLMSFDACKLPFDVWMLDVFSFIGLGWFSRDTTQALPMETTPERNLHFVFIPLMLSGCMRPLVDMAKLMARRKVKVTIVTTARYAVQFKASIDREIQSGSSIQIQLVTFPNAEVGVPEGFENIQLPSIDLKEKLFTALSMLQPQLEELLKKLNPFPCCIIHDKHIFCVADIAVKLKVPRITYDRTNCFNLLCNHNLLTYKVYETVSSDSDEIIIPGLPHRIEMRKCRLPTVSKPYSPNSSQKMDVVRERIRGSEAEAYGIVVNSFEEFEAEYVEEYQRVTGHKVWCVGPLSLTNKDDWDKVGRVSKSPNASEIETNQYMKWLSSWPQSSVIYVGSFCPVEPKVLIEIGLGLEATKRPFIWDLKGIYRRDEMERWLSEERFEVRVKDKGILIRDNWLPQVSILSHRAVGAFFTHAGWISTLDAICAGVPLVILPVSAVEMFYNEKLLSQVAEIGVTMRTEIAIHCGGKDKYGECVREVKKDSVKEAIEKVMRKGGDHEKRREKAKKYADMAKKTIEEGGSSYHNMSMLIDDIVHAQSLNQS

SEQ ID NO: 161878 - protein, 384 aa, Glycine max
  Coding DNA Sequence Number=SeqID_70193
MRGAPSEESTTPFIARGFSDPNAMIFQSVQKAWSVVQRKDNELRGSSNGIISGYHKWLKARTQELDWLSKLKASSEEEAETLEKSDEESEELRDVNVATAEALEQETKSNNEPKLRRAERDRSRVKNMVLEDKLKACQRSKRSLSEQLSKMEENMWAIIDQYKEKLSLATTHEQRLEDEYAKVSVLFAFTLNGSQELPRLLTKAKAMADVYSAPEEAVNTITKHALRHPYRTRSKTRVMGDIEEVQEQMKADMEALKDQVASMMEAMLSMKRIMESNAATVSTAEADPTHSSATNQAHQPTPNMVGQDGEGQQPQPIGDAHEEPQEPAQVEGREKLDLLKERLRVVERFGDYPFADMTELCLVPDVVIPPKFKVPDFDKYKGTT

SEQ ID NO: 161879 - protein, 75 aa, Glycine max
  Coding DNA Sequence Number=SeqID_70194
HEKHDFHASLSQKSAKPPLETPPPPPITIVGHHESPLLAVGPPHGEERLNQSGILRIHLEDLVENKLSIVKKQAS

SEQ ID NO: 161880 - protein, 37 aa, Glycine max
  Coding DNA Sequence Number=SeqID_70195
MNSKKCPNALGVGALRYKVKDDETTVLMKLKEVPSSK

SEQ ID NO: 161881 - protein, 267 aa, Glycine max
  Coding DNA Sequence Number=SeqID_70196
MAPRKLASKRSRKDKAAEGTSSAPEYDSHRFRSAVHQQRFEVIKGWSFLRERHVQLRDDKYTNFQEEIGRRRWTSLVTPMAKFDPEIVLEFYANAWPTEEGVRDIRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNPTSPCRSVSWCMAPTRHPLDPDKSNRALGFPALITGLCQSFGVPVAPTKVIRPPITRVFIEKYCT

SEQ ID NO: 161882 - protein, 83 aa, Glycine max
  Coding DNA Sequence Number=SeqID_70197
MAAVEGDGLDDEGMSSVLALFLDAICKKRMRETLRHWTINDLLVLESIEMLRHWTINDLLGWSTKVGFLLLRILHKDEELRPT

SEQ ID NO: 161883 - protein, 91 aa, Glycine max
  Coding DNA Sequence Number=SeqID_70198
QPVEWILPTPTPYRLVEPVQVIEVSSFEADIEEDQKKLPLEPVVDALDFPEDDEDPLLDVDFPEDVMSTSEADSTEKSGPGGTANSDDSSS

SEQ ID NO: 161884 - protein, 120 aa, Glycine max
  Coding DNA Sequence Number=SeqID_70199
MALRKRAITEDIPSSSTPAPPLQELAHNRPIIPMEHFLEQVAWPEAQLPLVRPNEVAPPEPTPVQMITKDDDKGDDKKLKGQSKNEFKNTSRFKRKVDFKNQESRFKRSRFQDSRTQEKT

SEQ ID NO: 161885 - protein, 114 aa, Glycine max
  Coding DNA Sequence Number=SeqID_70200
  Subcellular localization annotation: CTP_CleavageSite=51; ConfidenceScore=5.05e-01
MVGKGVCRFHKPRALENLALPLLFVTVKSLFSFSSRLKTAGNRSLDTHIVLAQTHRTPYTAGKPTFSSLEPTEPPTLFLEVWLKENPTYTVATRVLKQSWVLKAQSFLCELQYC

SEQ ID NO: 161886 - protein, 122 aa, Glycine max
  Coding DNA Sequence Number=SeqID_70201
MEEKKPKVNRIKMKAKKIGNELKVSELETYPLKNEERMKNEPHELLNDTCFLSVKSRNFMDYATIPSSASGVLRNFTDCAIMFPFDSRHVTELHGLLNDECQVPRSGQTKVACHQTMIPGRN

SEQ ID NO: 161887 - protein, 67 aa, Glycine max
  Coding DNA Sequence Number=SeqID_70202
MAEPIRVARRNSTRKVSNAIIVQSGVILRMSVRVKKRLSFELKKVAVGLSAYPPLSAASACLVQRRI

SEQ ID NO: 161888 - protein, 102 aa, Glycine max
  Coding DNA Sequence Number=SeqID_70203
  Homolog annotation: Hit_ID=A5BQE2; Match level="QueryCoverage=90%, HitCoverage=16%, E-value=4e-20, Identity=54%"; Hit description =Putative uncharacterized protein
MESRNAKFLENDLISGSDQLRDLGFEIDYIKSQPSTLSERLIVIHAPQVQRDDEQHMIDIPKPVADNPVDQVDNQIPKNDEQPAKQHDPQENIDATLKSLLE

SEQ ID NO: 161889 - protein, 172 aa, Glycine max
  Coding DNA Sequence Number=SeqID_70204
  Homolog annotation: Hit_ID=A5C995; Match level="QueryCoverage=65%, HitCoverage=6%, E-value=1e-12, Identity=37%"; Hit description =Putative uncharacterized protein
MTRGNPSELQPFDPEIDRTFHRLVRHHFVPFEHPEHFVTGESVHSIIGDFEHPDFEHYNFEHSNFEHSENMAQPPPRERNLTEMVAPDFSYESLCIQYPDEDVPYVLKPGLIHLLPKFHGLAGEDPLKHLKEFHIVCSTMKPPDVQEDHIFLKAFPHSLEEVAKDWLYYLAP

SEQ ID NO: 161890 - protein, 161 aa, Glycine max
  Coding DNA Sequence Number=SeqID_70205
MAPRKLFAKRSRKDAAAEGTCAAPEFDRHRFRSSEHQQCFEAIKGWSFHRERRVQLRDDEYTDFQEEIAHRRWTSLVTPMAKFDPDVVLEFYANAWPTKEGVRDMRSWVRGQWNPFDADALSQFLGDPLVLEEGQKCEFSQRRNRADGFDEEAIAQLLCIP

SEQ ID NO: 161891 - protein, 103 aa, Glycine max
  Coding DNA Sequence Number=SeqID_70206
MMTRREIFAKSLTKRYENITEAPRLGFASRKQFLSAISSEYEVPRRLTPFLFTPPPIYSQIEEELATQLAQASQVASSRSNRLLGEESGRPKWVWLLFAPLFY

SEQ ID NO: 161892 - protein, 499 aa, Glycine max
  Coding DNA Sequence Number=SeqID_70207
  Homolog annotation: Hit_ID=Q3JX16; Match level="QueryCoverage=69%, HitCoverage=31%, E-value=2e-07, Identity=26%"; Hit description =Planctomycete extracellular domain protein
GDGGFEAPGHARRGLQQKSIIGRRGATDHQLDAIDHQRIGGGASAGQCNGGTRVGAGGLPLGSIELEDDVLCLELGQVAVGRAEAAGSGIARVGRNARVADVEEVAPHLAVQVDALVVGLVERFGQADGELAEFGLGRGQHGVAELQHAADLSAHSLGVERDGIALCLQRQLQALGLVRIGHRGDLGRRRAHHQRIATSGVDVHHATVLDNGGAAGVTDQLRDQLVAAIKQVRRSIGDVGADRSVDLRNLLRQAIDFRGAGDESVVDLAAEVVHLRVELHEAARQGLATIEQALPIGRAGRVRRQAADGIEEVGPGAGDIRGRVREQGIHPVGHAGELLQARQLTAAVEQARDGQLVGSAADVGDAGAAANVPKAVVLRIRRGEVDLLPAVAGGVDVGDVVAGGRQCTLEGEQGTGTGGKYAGHGARAGIGDGADGPLDGRSAGDRGDLGRIARIGGIAGALQAAGEALHVGAGLQGLLVTRAGLQQAHVVGEALGRRT

SEQ ID NO: 161893 - protein, 147 aa, Glycine max
  Coding DNA Sequence Number=SeqID_70208
MAITFAPVIKMTTIIYAVGCKTRDNPSDLQPFDPEIDITFHRLFRHSEHPDHSVHFEHFEHSEHSVYFVHSEHFVAGDSEHSDFEHSTANFHTENMAQSPPRERTLREMVAPNFTYESLCIQYPDEDVPYVLKNGLIHLLPKFHGLA

SEQ ID NO: 161894 - protein, 187 aa, Glycine max
  Coding DNA Sequence Number=SeqID_70209
MEDAPASPTSPSRRRGDEIHVVCKQDQLKSRKADLKENLTYVMHNFKVIKNDGKFRVCDHEYKLCFTGVTVVRQCDMEQLPFRKFRFVAFSSVIASHFKIGLLVDVIGVVDEVVFRYVSSKNTRVVLNLKDLRPIVILLTPARIKEAQGSYPTSVSNSFKASKLMINDLVLEIQEFRERYFSNVVLM

SEQ ID NO: 161895 - protein, 76 aa, Glycine max
  Coding DNA Sequence Number=SeqID_70210
MKTDMEAMKEQMTMMMQPMMSMRMMMEDNCHNLPFGGRATRDSRVHLPRKENARSRHQRLFEENVGKIGKGVVYEL

SEQ ID NO: 161896 - protein, 82 aa, Glycine max
  Coding DNA Sequence Number=SeqID_70211
MRIYTRFSSNFSQPVSIRLHTLCFGVIIAQWNAPGLLRDKHTLRSSRILGEMEVDEPWLGLWLPLNYQVDMGASQHRTLELG

SEQ ID NO: 161897 - protein, 256 aa, Glycine max
  Coding DNA Sequence Number=SeqID_70212
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSMGRAFDDDVEFPHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 161898 - protein, 89 aa, Glycine max
  Coding DNA Sequence Number=SeqID_70213
MQRLTSSPAPFVVLTREVRDGESGGRRRYLMVIRAFRQLRGMNSTVFTLVVRKQLSPTTREILLCWPGTIECNGEGKCHGFPTLSFSRH

SEQ ID NO: 161899 - protein, 154 aa, Glycine max
  Coding DNA Sequence Number=SeqID_70214
LYQSFGVPVTPTKVIRPPITRAFIEKYCTQRQAQGDAPQAAGAPPPPHQAGPAGSFDMEQYLRHLVRRQAANHRAHVQTHDCLYQMSLSMQSQGFASFSCPTLDQFREEVAWPGDWLEAQAGEAPPEAPGDGEEAHEDEEMADLLDFLGGSGGT

SEQ ID NO: 161900 - protein, 88 aa, Glycine max
  Coding DNA Sequence Number=SeqID_70215
MAHRNPTYKSQVFAKGKPNEILIPGDRCRTGCHDITLQNMQFMCVRMNRLNNLHDYIAVYDSGLQVLDAGGDLSSSEKSAVKELKDNF

SEQ ID NO: 161901 - protein, 31 aa, Glycine max
  Coding DNA Sequence Number=SeqID_70216
MGVMQFGPKVRFSPRSSQHGGVLYLLPYRAS

SEQ ID NO: 161902 - protein, 76 aa, Glycine max
  Coding DNA Sequence Number=SeqID_70217
MGHLSDQGVPTDPKRIKFIPDWLTPPSIREIWGCHDLTFIKGVEGRSLEYEEPQDLRSNPFQGGGEDAILPPKGIR

SEQ ID NO: 161903 - protein, 40 aa, Glycine max
  Coding DNA Sequence Number=SeqID_70218
MDKEEDAEIPLILGRPFISMAKCVVDMGNGILEMSVDDPK

SEQ ID NO: 161904 - protein, 336 aa, Glycine max
  Coding DNA Sequence Number=SeqID_70219
  Homolog annotation: Hit_ID=A7NVK8; Match level="QueryCoverage=23%, HitCoverage=11%, E-value=9e-07, Identity=36%"; Hit description =Chromosome chr18 scaffold_1, whole genome shotgun sequence
MGKDDGLGKHFDSYVKNDRLVDIIDKELIHKVDVEQLICVAKIAIDCLRESGRERPYMEEVVKRLQELHFMEKYQRERTHLSSELTKELVNATPFVSNNVSVLSVLIGRAKWRGELHGVNHLLFADDCFIFCKVDGVECELLANILENYGKYLGLLSPLGHIKKVVFSFVKDKVTTQVCHVQVFGVPKLFYGRVVDCVWGVGRILGCGAMLGLGEKHMHLFNQSLPHILEISLLGIFSSQGSRCWNKDLLKAFLERKDVEEVLKFPILPHNGKHKRKAILREVCRWPIFNMIYIPWGKEHGGYAASEGPWELEPTVVSVRINVSCERRVTYVGTNK

SEQ ID NO: 161905 - protein, 226 aa, Glycine max
  Coding DNA Sequence Number=SeqID_70220
  Homolog annotation: Hit_ID=A7UQU7; Match level="QueryCoverage=47%, HitCoverage=17%, E-value=2e-15, Identity=42%"; Hit description=IMP dehydrogenase/GMP reductase, putative
MADIFLKEKNSLEVMSDQKEMNPNRVCWIYEHFLSVADSTADQEYDEDSPRACRWIATKKIVKRIRMPAYRERLDRLQIPNVCWIPYGEHREVRDFHVRSCYSGLLRWGPVAIYYRPERVVRQFGYTQTIPAPPCSSDYMDWFFRISHPFMTPGHTLDPLPHGHAPQPQVVPQAPQTDIPRVPEPGASSTSAEEPRHAVEVCDDIAERLERHLILGVVTPGSSTMR

SEQ ID NO: 161906 - protein, 142 aa, Glycine max
  Coding DNA Sequence Number=SeqID_70221
  Homolog annotation: Hit_ID=Q2HTA0; Match level="QueryCoverage=71%, HitCoverage=15%, E-value=8e-13, Identity=38%"; Hit description=IMP dehydrogenase/GMP reductase, related
  Pfam annotation: Domain name=DUF1723; Domain location=45-94; Score =56.4; E_value=9.5e-14; Accession=PF08330.1; Description=Protein of unknown function (DUF1723)
MILTNFAFLYTSIQDAPELKLSSHGRKVHSLGTPIPAIEGLVADTNDRGLLSAFVERWHRETSNFHLQVGELTITLDDVSSLLHLPVIGDLHTFEPLHVDDAVQMLVDLLMVSPEFVRAETAQCHGPYVRLQWVRDIYERRC

SEQ ID NO: 161907 - protein, 169 aa, Glycine max
  Coding DNA Sequence Number=SeqID_70222
  Homolog annotation: Hit_ID=Q1RU92; Match level="QueryCoverage=84%, HitCoverage=26%, E-value=1e-07, Identity=30%"; Hit description=Non -LTR retrolelement reverse transcriptase-like protein, related
MPFSITISKEEYKLGSKNWKNNLHGHFILAKGDQPFHYQDLHAKLTKLWKPLGDWCMTPQDKDSMNSVSPQQMICIAFGLLELGTFSPGSSTYINGLLILIPTSRNSPILNTLLEIVGALGTPIGFTCGELTQEYWRPKTILEIAGYTEKSDVDKTHKRKLVTAPWETY

SEQ ID NO: 161908 - protein, 189 aa, Glycine max
  Coding DNA Sequence Number=SeqID_70223
  Subcellular localization annotation: CTP_CleavageSite=31; ConfidenceScore=5.41e-01
MDFCNSAFNSLTSSVSIASMKSFNDDFSPWRCSGRQRRRGERRRHSLGNKPWKKKLHHQDEPWIRAWRGCFNGGKERGGEKERGEHEIEGRKKGKKLNFELCLTRLSFIKVTTTDSYLVHGLKIYPKAHENPRTFPWISGSIDLESSIQCPCGLRCSSSNPLAMNGWIAPFEGSPRIGYPNSLIPNIGL

SEQ ID NO: 161909 - protein, 244 aa, Glycine max
  Coding DNA Sequence Number=SeqID_70224
  Homolog annotation: Hit_ID=A5AXX9; Match level="QueryCoverage=92%, HitCoverage=21%, E-value=1e-22, Identity=28%"; Hit description =Putative uncharacterized protein
MSAAANNHAQAENTDTIKLQNIQPSLCLNGKKLPQIVSLCPNLSKREGQIESSYWERCPKIHRQYLGAWDEADEVVMSWLWNSMVPKVSDACMFMKTAKDVWESCKENYSKVGDAAQIYKIKMKIATTKQGDRSVSESQDTPKTDAGNFMVSLQIRTEIGPPKVLNEENQHKFTWLSQVLPKPMLLAFYNLLHKGRVVDSGAIDHMTHSSTEFISYKPCPNNKKLANADDTFITIAGKGDILLS

SEQ ID NO: 161910 - protein, 102 aa, Glycine max
  Coding DNA Sequence Number=SeqID_70225
MARTRGLGRAIGRLVGRDRPDDQDAADVPERRRPTASAHRLRVHQMTAEGRDMAEDVADMTDDVPELAAEAPEMRAGVHGADGGEGSDVDDAAEGFPGGPRD

SEQ ID NO: 161911 - protein, 130 aa, Glycine max
  Coding DNA Sequence Number=SeqID_70226
  Homolog annotation: Hit_ID=Q1SN17; Match level="QueryCoverage=68%, HitCoverage=19%, E-value=9e-12, Identity=40%"; Hit description =Transposase, putative
MLIVQMCSILLRCLTAKRMFCDGLDPLLMKMDLWRSGEYRCRNKEFVIRDTRTRKCRCPFKLRGKPVVEGQGWVKLICGIHNHELAKSLVGHPYVWRLSKAEKTLIGDMTKSMVKPRNILLTLRSTMSIV

SEQ ID NO: 161912 - protein, 127 aa, Glycine max
  Coding DNA Sequence Number=SeqID_70227
  Homolog annotation: Hit_ID=A5AYU6; Match level="QueryCoverage=51%, HitCoverage=11%, E-value=7e-09, Identity=40%"; Hit description =Putative uncharacterized protein
MASLNSLFSENNFVYRSNLKSFQDHDEDQANLCLMTKSLENNEEEYVRKKWYIDSGCSKHMMGDVSKFTTISPKKSGHVTYEFLYFHQKCVTCRRLIRQVCEVLIFTLSLSQKIGIASHPLSATLLD

SEQ ID NO: 161913 - protein, 159 aa, Glycine max
  Coding DNA Sequence Number=SeqID_70228
  Gene Ontology: Mol. function=metal ion binding
  Homolog annotation: Hit_ID=Q9LUC1; Match level="QueryCoverage=72%, HitCoverage=43%, E-value=2e-23, Identity=44%"; Hit description =Genomic DNA, chromosome 3, P1 clone: MIE1
  Pfam annotation: Domain name=C1_3; Domain location=116-147; Score =7.9; E_value=0.062; Accession=PF07649.3; Description=C1-like domain
  Pfam annotation: Domain name=PHD; Domain location=117-154; Score =18.2; E_value=9.7e-05; Accession=PF00628.20; Description=PHD-finger
  Pfam module annotation: Pfam domain module=C1_3::PHD; Domain location= 116-147::117-154
MDSSTTFLNDLPPLKRLRLLQQQQQQKEEHQYYDSSSPLPAKKRKESRTLSPPSPTTTKTVYNYSLPAKKRVWALQPQSPPSNDVVPAFDLNVEYTPSPNNHGDLEEDHSEDEDGVLCCVCQSTDGDPADPIVFCDGCDLMVHASCYGTPCQVHPGWRL

SEQ ID NO: 161914 - protein, 46 aa, Glycine max
  Coding DNA Sequence Number=SeqID_70229
MKSGGRRRYPSGYPYKYSFAIRQTQSGDTQVVIRINTLSLSIKLRV

SEQ ID NO: 161915 - protein, 76 aa, Glycine max
  Coding DNA Sequence Number=SeqID_70230
MTTEWRWKRERRRHFKEKMSLEEAHHHRMPWIKAWRKKEMNEGRWREEHKILCSKRALKSKRTNPRSSPRFSTKCA

SEQ ID NO: 161916 - protein, 160 aa, Glycine max
  Coding DNA Sequence Number=SeqID_70231
MTLTDASKSSMAFFKLLFLIMQGITLGGNGRGIGGCRTLELLEEGPSWSGGYLFCASISFSLSDSAQLENAACQSFGTELGSTEWLLSFGETAYSVLSFASLTPLRKVEKGPQLIVVSVVVIVVAAVAVAVVALEEERMACLDQKHFGRKEQVAVVVVEG

SEQ ID NO: 161917 - protein, 70 aa, Glycine max
  Coding DNA Sequence Number=SeqID_70232
MLKSLVWYRSGKAVKKSKIRGAINGIKANISSRTVWFKDEPSEKWWACNNSIESHQNERDPELYMYETIQ

SEQ ID NO: 161918 - protein, 203 aa, Glycine max
  Coding DNA Sequence Number=SeqID_70233
  Gene Ontology: Mol. function=transcription regulator activity; Cellular component=nucleus; Biological process=regulation of transcription, DNA-dependent
  Homolog annotation: Hit_ID=A7R0D8; Match level="QueryCoverage=71%, HitCoverage=14%, E-value=9e-48, Identity=65%"; Hit description =Chromosome chr6 scaffold_305, whole genome shotgun sequence
  Pfam annotation: Domain name=Hira; Domain location=1-187; Score=32.2; E_value=2.9e-08; Accession=PF07569.2; Description=TUP1-like enhancer of split
MPIMMMGSATTFIDCDECRKLLLVTINKYLYLWDLFNKTCLLHDSLASLIASSPNSSSKDVGTIKVIYAKLSKYGSPLVIFATRHAFLFDTSLKCWLRVTNDYFPASNFASSWCMGLIQSGELAALQVDVRKYLAWKPSLTSISDNKALEGNFSDHSQSHSVASSDGCLSLLKKRHFGIRLHAIQKRTPQEHGLDGDEDVRML

SEQ ID NO: 161919 - protein, 346 aa, Glycine max
  Coding DNA Sequence Number=SeqID_70234
MVKRQNQTQTTQVDPDFKNNPSSASSEDVLGITVKLSVETIAQAISCKRRSTKFMNSWWNELKDHIGLKGLLVQCPQVPFVPLDGGHYLLSNTQVDDSILSELHQKFGLNTGQDDQLDAVWEKATKEEDRVDVDTSQAEKRTKKKMNANSSKVASAPQRPPPTLVAPKGTDGFEFRKRKVAPPSIENNVTQVKKVKPTPKVLPSLTQPRTRKKRKVTESNVDMDNEVPHQAPLSPIHLDRFEHQGPPVIDPSLNAEDIAREVVNYDKDIIGWCQKIDAQHIDPSSNDLLPLFMCPKHIQLYTPSQIAMRLPPLDLRKKKGKVPPHTKPMPHLGPKGNTALCPTPYD

SEQ ID NO: 161920 - protein, 202 aa, Glycine max
  Coding DNA Sequence Number=SeqID_70235
MARTKKTGQMTYEAVKEIANKIDVLTVAIGRLEHPGRVRAAGAGITIKQYFGPAPRTSRMSSSVALEDLEQIQSQFQSQMQSQGLALPPEPEVGHSTAHVSTKESCVDSLGNNPDMSDLETYGLYIKENPLCLVTLGKLYEESTTVHNIPLRHDQVKVGVEEVRDADASIPVPNEEVQLVRELWDQQNLQIGRIMMLMIPYI

SEQ ID NO: 161921 - protein, 80 aa, Glycine max
  Coding DNA Sequence Number=SeqID_70236
  Subcellular localization annotation: CTP_CleavageSite=44; ConfidenceScore=5.58e-01
MTLSSWQNKLNRQMTTPHRSPPPPPPPPIDAASHSPPTLKRTRKATRLRSLTTRPVGVERPLVHVDPTTGKCWINWPRNN

SEQ ID NO: 161922 - protein, 72 aa, Glycine max
  Coding DNA Sequence Number=SeqID_70237
MAQPPPCERTLREMATLDFTYESLCIQYPDEGVPYVLKTGLIHLLPKFHGLAEGVAKDWLYYLALRSIFNWG

SEQ ID NO: 161923 - protein, 291 aa, Glycine max
  Coding DNA Sequence Number=SeqID_70238
MDGWDLLWEMKGAPKKLGGALVENGMRNVQPCGGGGDDVNIRCVPGHGEHFYMHGYENRKRDLREDKELAGIGCGVDELVEQNGDNTNGCTEVDNGDTDKFVANNGDVVGQFREHDNIDGGGCLAVNFFSMGGCVDCTVAIGRVEILSGVVKRRFETVVGVGVWMEGVESQWLDGEEVGVCDGGGEKTQVGDVGGKSGIGTVRISKGVAEVAVVQKDSINVDVDVGCPWTTVVAVLTVMVVVVLATAVKRWGSVKGSIVEVETETWLLWWPEITMMVCIHGRRRLNYGSTN

SEQ ID NO: 161924 - protein, 67 aa, Glycine max
  Coding DNA Sequence Number=SeqID_70239
MAIGSGFQVFAKSETQIILDISTITIFLMQSYPARALDRKLQVDWAKDAREGPRVLMSLRVDFGPMG

SEQ ID NO: 161925 - protein, 60 aa, Glycine max
  Coding DNA Sequence Number=SeqID_70240
MQNVLDKLDGLHTFVGSVLTPWTAALMPLMHGGDCGSKASKLILMMQKTQVKNQDSSKFQ

SEQ ID NO: 161926 - protein, 97 aa, Glycine max
  Coding DNA Sequence Number=SeqID_70241
  Gene Ontology: Mol. function=transferase activity, transferring glycosyl groups; Biological process=multicellular organismal development
  Homolog annotation: Hit_ID=A2X4Z0; Match level="QueryCoverage=38%, HitCoverage=3%, E-value=2e-12, Identity=86%"; Hit description =Putative uncharacterized protein
MLRNFMDCATMLPFDFRHVAELHGLPNDGYQVPRSGQAKVASHQTDGPQTKLGDFGKMFVIPSVQPFHAIAYPLDPMLALEISCKYAAHCSVVYIII

SEQ ID NO: 161927 - protein, 94 aa, Glycine max
  Coding DNA Sequence Number=SeqID_70242
WAKRASTAKRSFSALSAIEESSISSISRLHAKHEINALSTTVVFSQAQRTTELGYHLVQNFYSRVLQHSRAHRSAYFGKRALEEARGATFAKIP

SEQ ID NO: 161928 - protein, 75 aa, Glycine max
  Coding DNA Sequence Number=SeqID_70243
MTKDAIHDHNSAAPGLHFVLPSSFCGVPHIFLDMTIYRKEPRGADKFSRANLLLNAEGTNSYRQAVVTSFTPTYI

SEQ ID NO: 161929 - protein, 101 aa, Glycine max
  Coding DNA Sequence Number=SeqID_70244
MGAKYLEVVKQGSHPNNGWSPDEIRSHPDTVEFVPPGLHKAQNDHNLSLLGFGRDRPWAASRRMTIICLCVPSDTIASGWRKGVRNDHNLSLPTSRLTVPE

SEQ ID NO: 161930 - protein, 66 aa, Glycine max
  Coding DNA Sequence Number=SeqID_70245
  Subcellular localization annotation: CTP_CleavageSite=4; ConfidenceScore=5.00e-01
ANVPVDARRATSSSARFVVLTLESGDMRGNLMVIRTFRQPGANEPIDGRRLTSSSAPFVVLIREVK

SEQ ID NO: 161931 - protein, 67 aa, Glycine max
  Coding DNA Sequence Number=SeqID_70246
STLEDPLEPHGRKDVSPLTIGRPENPRRVCAAEAGVTIKQYFGSAPRMSRSSSSLPPEELQQLTHQI

SEQ ID NO: 161932 - protein, 57 aa, Glycine max
  Coding DNA Sequence Number=SeqID_70247
MLQPYGISIGLKEYSNPMTPKAYTPKSPSGPLPPDSAYTFPPTAPVEYQTSEKRRRD

SEQ ID NO: 161933 - protein, 99 aa, Glycine max
  Coding DNA Sequence Number=SeqID_70248
MVKEFYANRYRSEDQVPKCAKVRGYMIKIDADNVNEFLQTPVLLEEGESLPTYSRFCRLRSDPREMEVILCIRGNGFVQNVEDQPWKLLRKDLTTCAQT

SEQ ID NO: 161934 - protein, 87 aa, Glycine max
  Coding DNA Sequence Number=SeqID_70249
MLRIEYKKTQDRYYFLYVTDELRTSTTEPDSFNLEYKDGSTVQIHNVWTYLEATQNALFELNLLMQHSEEVLNAVKVLRACGVKDED

SEQ ID NO: 161935 - protein, 98 aa, Glycine max
  Coding DNA Sequence Number=SeqID_70250
MVDTLPTIYYEKLIGYMPANFADLVFAGERIESGLRKGKFEYASNVAPNNNRRAPVAGTWKKEGDTHVVTTAPTWMKTPQNAQNSYQHTHPNFSIRAG

SEQ ID NO: 161936 - protein, 86 aa, Glycine max
  Coding DNA Sequence Number=SeqID_70251
MDGEELPSPVNSDGRMQVGLGSRPTDHCPFPALNKRRTSLQGSPDLNEKALGLGCILKQWGMPHCSHYLAIYVQTCAHQVLGEMPQ

SEQ ID NO: 161937 - protein, 27 aa, Glycine max
  Coding DNA Sequence Number=SeqID_70252
MKKQQWRRSHGVEAEDKGEKVRGGAIH

SEQ ID NO: 161938 - protein, 65 aa, Glycine max
  Coding DNA Sequence Number=SeqID_70253
MLLFGPKYFGIWLCDSDLDNPTGIDWVLTEKYLFADSYSNLEASILDKKEFLLLKVWGLTVWPCP

SEQ ID NO: 161939 - protein, 213 aa, Glycine max
  Coding DNA Sequence Number=SeqID_70254
MIRGDTLRLSACTLVSSRGGGPDDTRRYLTVIHTLLSSRGGGPDDKHRPKAAGPMIRGDTLRLSAPFCHPEAAGPMTSRDQVWSFCTLVSSRGGGPDDTRRYLTVIRTLLSSRGGGPDDKQRPKAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 161940 - protein, 29 aa, Glycine max
  Coding DNA Sequence Number=SeqID_70255
MQSSSRPPGCARNCPSQVISLGSKGVPYQ

SEQ ID NO: 161941 - protein, 283 aa, Glycine max
  Coding DNA Sequence Number=SeqID_70256
  Gene Ontology: Mol. function=pyridoxal phosphate binding; Cellular component=cytosol; Biological process=cell wall organization and biogenesis
  Homolog annotation: Hit_ID=A8GKA2; Match level="QueryCoverage=100%, HitCoverage=78%, E-value=1e-142, Identity=88%"; Hit description =Alanine racemase
  Pfam annotation: Domain name=Ala_racemase_C; Domain location=233-283; Score=-12.4; E_value=8.3e-06; Accession=PF00842.12; Description =Alanine racemase, C-terminal domain
  Pfam annotation: Domain name=Ala_racemase_N; Domain location=3-220; Score=327.5; E_value=2.4e-95; Accession=PF01168.11; Description =Alanine racemase, N-terminal domain
  Pfam module annotation: Pfam domain module=Ala_racemase_C::Ala _racemase_N; Domain location=233-283::3-220
MKAATAVIDRRALRHNLQQVRRQAPQSRLIAVVKANAYGHGLLETAHTLQDADCYGVARIGEALMLRSGGIVKPILLLEGFFCAEDLPVLVANNIETAVHSIEQLEALEQAELARPVPVWMKLDTGMHRLGVRPEQAEAFYQRLCACRNVAQPVNIMSHFSRADEPESDATLKQIACFEQFARGKPGQRSVAASGGTLLWPDAHNEWVRPGIILYGVSPLDNGSGAEHGLQPAMTLKSSLIAVREHKAGEAVGYGGTWVSPRDTRLGVVAMGYGDGYPRSAPT

SEQ ID NO: 161942 - protein, 342 aa, Glycine max
  Coding DNA Sequence Number=SeqID_70257
  Gene Ontology: Mol. function=hydrolase activity, acting on ester bonds; Cellular component=nucleus; Biological process=catabolic process
  Homolog annotation: Hit_ID=A1WHX9; Match level="QueryCoverage=54%, HitCoverage=74%, E-value=3e-54, Identity=54%"; Hit description =Putative uncharacterized protein
  Pfam annotation: Domain name=DUF1355; Domain location=114-340; Score =231.0; E_value=2.7e-66; Accession=PF07090.2; Description=Protein of unknown function (DUF1355)
MNPSFADKTYQRELADRGVFLEYDMIGMSYYYADESAQSPSDEENARAICALIDDGYLQQILLSQDVFLKTMLTRYGGHGYGYILKHFVPRLKRHGVSGEQLETLMITNPQRALISLLPPPGTAVRRIFSAALQDSTYAVTHMPAHAAATDFPQTLEDLQRWDVIILSDIGANTLLLHPDTWLKSRRTPNRLALIHDYVAAGGALMMVGGYYSFQGINGGARYRNTLVEKVLPVRCLAWDDRIETPEGSYAEVTTSHKVVTDLPGDWPWLLGYNEVEMQPEGTLLATVAGTGHPLLAVREYQQGRSLVWTSDMSAPLAAGRVQPLAGLSPAVDQLSRLADGA

SEQ ID NO: 161943 - protein, 113 aa, Glycine max
  Coding DNA Sequence Number=SeqID_70258
MSKSCGFGMTGPLDESISCFLIRVDPWVLVPITFRGLHVLANRGLHALTLRGLHVLALRGLHALTLVTLTVERTTRPRLERTTRPHHQRAACPHLQRTTCPRLERATRPHLGY

SEQ ID NO: 161944 - protein, 53 aa, Glycine max
  Coding DNA Sequence Number=SeqID_70259
MLHSMLQSLRRGQAIIMQSLQGLGLPSIMSMDEFDAQVYTWLRSVEAKLPRLF

SEQ ID NO: 161945 - protein, 141 aa, Glycine max
  Coding DNA Sequence Number=SeqID_70260
MLAIRQLGYPVRGAPSEEIIMPFIARGFSEGNAKMLQRVQNVWNVVERKDKEHRGSSNGVIGGYHKWLKVQTQGIAWLSKLKISSGEEAEVPEEREEVQALKAELERTRVVKEKFKMAASRIRNEYDDLRDINMATTEALE

SEQ ID NO: 161946 - protein, 256 aa, Glycine max
  Coding DNA Sequence Number=SeqID_70261
RCNFHKRLTNLVDESIDLAFVKEFYANLYNSDGLSLKQARVRGHLVKVLAEGETLPTYSRYCKLPTDYREIEAVLCIPSRGFILNAEGHLGRILRKDLTTLAQVWSVLSYSNLAPTSHTSDLTMDRAMLIFGLVSRMDMNIEALISGQMTSIAQSSTSRVGFPALITALCRARGVVSNSLTFERLSPIINLAYIRKSCWNPKDLTVSIRGARRVRVRPTELPSTFAAPTPTSTSAAPSVPTQSDSQRFEAMLQSIH

SEQ ID NO: 161947 - protein, 269 aa, Glycine max
  Coding DNA Sequence Number=SeqID_70262
  Homolog annotation: Hit_ID=UPI00016621D1; Match level="QueryCoverage =50%, HitCoverage=40%, E-value=1e-12, Identity=39%"; Hit description =UPI00016621D1 related cluster
LTYVGLHALTFRGLHVLAFRGSCSFTFRGLHVLASKGLHVLAFRGLHVLAIRGLHVLTFRGLRVLTFRGLRVLTFRGLRVLTFRGLRVLTFRGLHVLTFRGLHVLTFRGLHTLIFRGLYVFPLKGLLVLAFRGSWATPDIGGGPTVRAQPEREAITQLLCILGQDFTPAGAKRQVRVASTRHPMDPEKSNRALGFPALITGLYQSYWVPVPPGKDRARKTPSGPGEVQQGLRIFSSDYGPLSVLQSAHRPQQGPQAPINGAFIEKYCAP

SEQ ID NO: 161948 - protein, 80 aa, Glycine max
  Coding DNA Sequence Number=SeqID_70263
MSEEVDMNEENEDETGVNEEHVDCSDAFNTSEWARPVAYEIGFVVVIMRSNTNTGMRGRTSFVIIGCERSGQYRSGKKDF

SEQ ID NO: 161949 - protein, 105 aa, Glycine max
  Coding DNA Sequence Number=SeqID_70264
MAEVSTEAIASLVQYYDQPLRCFTLGDFQLTPTNFQNSQNLDTGIGPGKASRKWGGWSTNEMFGSKGESLGKSRRMGPVHGHPSTLDLWVGPLSKCGWVGGPGSD

SEQ ID NO: 161950 - protein, 35 aa, Glycine max
  Coding DNA Sequence Number=SeqID_70265
MEAPTGLSKKGPYTRDHGNLRSGGGSMVMLGLRLA

SEQ ID NO: 161951 - protein, 57 aa, Glycine max
  Coding DNA Sequence Number=SeqID_70266
MVPVATYPFAGERGKAHRSTKAGLLLLRTLYRRGNQTYVVLSKGQIKRFFLLGRWSF

SEQ ID NO: 161952 - protein, 90 aa, Glycine max
  Coding DNA Sequence Number=SeqID_70267
  Subcellular localization annotation: CTP_CleavageSite=79; ConfidenceScore=5.36e-01
MDILTLGQGLCQPSVSKTCSFINSRIHPSPFWAFGKIFTAFTLQVVRMRAHTAYLRQITKQTEKNAMAPPLPRHRASLQAMQPQPQTALG

SEQ ID NO: 161953 - protein, 98 aa, Glycine max
  Coding DNA Sequence Number=SeqID_70268
  Gene Ontology: Mol. function=molecular_function; Cellular component =cellular_component; Biological process=biological_process
  Homolog annotation: Hit_ID=A5C2Q1; Match level="QueryCoverage=68%, HitCoverage=12%, E-value=4e-26, Identity=80%"; Hit description =Putative uncharacterized protein
  Pfam annotation: Domain name=WD40; Domain location=1-36; Score=17.4; E_value=0.055; Accession=PF00400.23; Description=WD domain, G-beta repeat
METFLGHTGPISRCCFSASGNNIASASLDGTVMIWTYDTSTPVSRNATIYCSTEILSLDWECKSDRLVHPMGALRHGMWMQRELSVTSTQPKHFQGIS

SEQ ID NO: 161954 - protein, 80 aa, Glycine max
  Coding DNA Sequence Number=SeqID_70269
RKEGGGCRPARPGELGCFHQKAPPSVGTPWKAQIAQQCFFSTSGMSRNFTDYLTIGVKYLEAVKRKLYATKKWSPDEISV

SEQ ID NO: 161955 - protein, 190 aa, Glycine max
  Coding DNA Sequence Number=SeqID_70270
  Gene Ontology: Mol. function=motor activity; Cellular component=cell projection
  Homolog annotation: Hit_ID=UPI00016621D1; Match level="QueryCoverage =97%, HitCoverage=42%, E-value=8e-21, Identity=35%"; Hit description =UPI00016621D1 related cluster
WTLKGLHILAIRGLQALTFKGLHILTFRGIYVLTFKGLHFLTFRGLHVLAFKGLQVLAIRELQVLVFRGLHVLAIRGLHVLAFRGLHVLTFRGLHVLTFRGLHILTFRGLHVLAFRGLHVLAIRRLHALTSKGLHLLTFRGLHVLTFRWLHALAFRGLHALAYRGLHVLAFIGLYALTFGGLHVLAFIGL

SEQ ID NO: 161956 - protein, 146 aa, Glycine max
  Coding DNA Sequence Number=SeqID_70271
  Homolog annotation: Hit_ID=A5AJT7; Match level="QueryCoverage=84%, HitCoverage=11%, E-value=2e-12, Identity=38%"; Hit description =Putative uncharacterized protein
MFLLLESGPHTRHLLSIHGFLEKSVNISKFETSEIKFLKTDYQEYLQLKAAKESQTSSAISGHNSTACISQSDAFDHIAGNSSLFSPLSPPKIPYFITLADGSRVVATGIGHECGTGWTIGVGIESHGLYYLKPNLSWGFLNERTI

SEQ ID NO: 161957 - protein, 70 aa, Glycine max
  Coding DNA Sequence Number=SeqID_70272
MPTDPHSPVADPSSPKLEVTPPSSPIIIISEDSTESASREVVALSDTLVFHLIDEEDAQTQDTQDLSQGF

SEQ ID NO: 161958 - protein, 153 aa, Glycine max
  Coding DNA Sequence Number=SeqID_70273
MQHLHAWETALLDNLYREMCIANNIKSIGSFTLLIQLWAWEQCPTLAPVVYSSTTIKRATCLKMVGSEIAETLHFMMSPVGRRVCTFDDLLSCIEKITLLSDEEDKILEAHEDAAPSQPQFEHQQFNILQRSVETRGTAKCGDSRFSATSGNC

SEQ ID NO: 161959 - protein, 276 aa, Glycine max
  Coding DNA Sequence Number=SeqID_70274
  Gene Ontology: Mol. function=aminoacyl-tRNA ligase activity; Cellular component=cytoplasm; Biological process=tRNA aminoacylation for protein translation
  Homolog annotation: Hit_ID=A7QVL5; Match level="QueryCoverage=55%, HitCoverage=38%, E-value=1e-47, Identity=82%"; Hit description =Chromosome chr16 scaffold_189, whole genome shotgun sequence
  Pfam annotation: Domain name=tRNA-synt_1; Domain location=64-268; Score=-358.5; E_value=0.00014; Accession=PF00133.13; Description =tRNA synthetases class I (I, L, M and V)
MGLEVDLVADLGLRLLPEAADGAGFAVGGATVVEEVELFQEKGFKAAFGGVVGGGAAHDASSDDNHGYGFLKLQEHGLQHSTYGIHSMIKEGHKHLFVLDEAVLKNIDACKLSLELPPQAVSILLLGDTAIVVHPNDDRYTHFHGKYAIHPFNGRKLPIICDAILVDPKFGTCAVKITPAHDPNDFEVGKRHNLEFINVFTDDGKINSNGGSDFLGMSWFKAQEAIAYALQKKGHKKDFPNGIDECGVDALRFALVSYTAQSDKTNLDIQRVVGYR

SEQ ID NO: 161960 - protein, 103 aa, Glycine max
  Coding DNA Sequence Number=SeqID_70275
  Homolog annotation: Hit_ID=A7QJQ6; Match level="QueryCoverage=76%, HitCoverage=26%, E-value=4e-22, Identity=69%"; Hit description =Chromosome undetermined scaffold_107, whole genome shotgun sequence
MTVILTAAGVLIAALGDFFSWPLFPFFFQTMYLVLVEKSGAEDGLSSLEIMFYNSFLSLPFFMFLIIATGELPNSLSVLFAKKFKEKERGRGGAVRLNHLILW

SEQ ID NO: 161961 - protein, 448 aa, Glycine max
  Coding DNA Sequence Number=SeqID_70276
  Homolog annotation: Hit_ID=A7P523; Match level="QueryCoverage=93%, HitCoverage=93%, E-value=1e-125, Identity=57%"; Hit description =Chromosome chr4 scaffold_6, whole genome shotgun sequence
MNPSTESDNAIIIDIDSSVKTPSFVENHPNEEKHQLNVPFLLQPSYATHELRNLRTSLKWCALDHSSLVGKLISYVVFIFLTVAVPLFTSLFVHVPASASQLYPFNFKKLLQLPQSALAIIAFFTLYRFFPRYQTKVTSCMGLGSFCSYFLDVLQDDSTYVRRGYTRELQKAFRYLACMILPSFFVELVHKTIFFSSMEISVPCGTPLNWAVFVLVLVSWVYRTGLFLLACVLFRLNCELQILRFEGLHKLFERCGSDANMTFREHVRIRRQLWITSHGYRFFIISCLVTVTVSQLGSLLMVLESKSDTTFFNSDFFRLCNYVDSSLCLMGAARITHRAQGIVSIATKWHMVVTNASVESEQWKTQMPEGVPSPAASRDSDSSDICISVTPQRPSSFQTRQALVTYLQHNYGGTTLFGFVLDRGLLHTLFAFEFSMVLWILSMVAVWS

SEQ ID NO: 161962 - protein, 109 aa, Glycine max
  Coding DNA Sequence Number=SeqID_70277
  Homolog annotation: Hit_ID=A7P4Z7; Match level="QueryCoverage=99%, HitCoverage=100%, E-value=1e-34, Identity=65%"; Hit description =Chromosome chr4 scaffold_6, whole genome shotgun sequence
MSGVWVFKKDGFRLMEKRKAEGIACSSLKKKVLVHLASGEVVSSYSSLEQILSNLGWERYYGRDPQLYQFHKRSSTDLISLPKNFSKFTSVYMYDIVIKNPNVFHVRDM

SEQ ID NO: 161963 - protein, 257 aa, Glycine max
  Coding DNA Sequence Number=SeqID_70278
  Gene Ontology: Mol. function=protein dimerization activity; Cellular component=nucleus; Biological process=regulation of transcription, DNA-dependent
  Homolog annotation: Hit_ID=Q0GPH5; Match level="QueryCoverage=100%, HitCoverage=87%, E-value=8e-89, Identity=70%"; Hit description=BZIP transcription factor bZIP62
  Pfam annotation: Domain name=bZIP_1; Domain location=83-146; Score =47.9; E_value=3.4e-11; Accession=PF00170.12; Description=bZIP transcription factor
  Pfam annotation: Domain name=bZIP_2; Domain location=83-137; Score =26.9; E_value=7.3e-05; Accession=PF07716.6; Description=Basic region leucine zipper
  Pfam module annotation: Pfam domain module=bZIP_1::bZIP_2; Domain location=83-146::83-137
  Subcellular localization annotation: CTP_CleavageSite=46; ConfidenceScore=5.08e-01
MTSFSACGLIDPHCSQNLTPMHSTITATIDSQSTICATSNVGSPISANKPEGRENRTKGATSGSSEPSDEDDEAGACEQSTNPADMKRLRRKVSNRDSARRSRRRKQAQLSELELQVEKLKVENATLYKQFTDASQHFREADTNNRVLKSDVEALRAKVKLAEDMVTRSSFTTLNYQLLQTQQHQMSTPPQLNTTNLRRMAHVSPTITVHGNDASYNGVTVGEQNSSALGNLDMTFNNINNGVMNNAMSCGTIWPLD

SEQ ID NO: 161964 - protein, 152 aa, Glycine max
  Coding DNA Sequence Number=SeqID_70279
  Gene Ontology: Mol. function=methyltransferase activity; Biological process=activation of protein kinase C
  Homolog annotation: Hit_ID=A7P5J1; Match level="QueryCoverage=67%, HitCoverage=10%, E-value=4e-25, Identity=57%"; Hit description =Chromosome chr4 scaffold_6, whole genome shotgun sequence
MQKARVAPNWVTFVGVLSACAHEGLWNEGIHRNLEIAVVAMEQLLELEPEEFGNYVLLANIYAELGKWEGVSDVRKLTRSKRIKKTPGCSLIEVNNLVQEFVSAIVVFGWGNLTPAIRFLHYAAGRTCGGHAWTFSSSIGSAFRFLGYLGLV

SEQ ID NO: 161965 - protein, 190 aa, Glycine max
  Coding DNA Sequence Number=SeqID_70280
  Gene Ontology: Mol. function=protein serine/threonine kinase activity; Cellular component=nucleus; Biological process=protein amino acid phosphorylation
  Homolog annotation: Hit_ID=P51568; Match level="QueryCoverage=42%, HitCoverage=19%, E-value=8e-29, Identity=70%"; Hit description =Serine/threonine-protein kinase AFC3
MRSILHRFAEEDTSYMSQRTEDVRAHPTHFLHMFGFGTRNGLCQCPVTKNSKESTFRLRKGTTIERAIMSSILAKISLLDIKSSARWVKHIASAVGTFGRVLECWDRQTREYVAIKVVRSIRKYRDAAMLEIDVLQQLAKNNRGSSRCVQIRNWFDYRSHVCIIQVYFEKIGTELEILYYFFGGGEWGRG

SEQ ID NO: 161966 - protein, 229 aa, Glycine max
  Coding DNA Sequence Number=SeqID_70281
  Subcellular localization annotation: CTP_CleavageSite=57; ConfidenceScore=5.07e-01
MEYPFLPTFTLLNLSLVTTHAALPPVPVVGRPCFLLLQCQKPSLVSFTPIEPSIYFQCFIDKYSQKLVGLVKPGLDKKEVSGNFMENNEAVALLGQKKSQPLIEKSDGKCFGTLVRENADSKSLLGNNPTCSTSVKETSKPANALHTISNKKTVPHAKVEESRGRKDSLVKQKSFAKLSHGSTAGLEMWEITKLDDGSGNGSIEKNILMSRVDLKRGDRDDVGVLAWTK

SEQ ID NO: 161967 - protein, 80 aa, Glycine max
  Coding DNA Sequence Number=SeqID_70282
MIYSMWLRQNFQELPIDVDDVVIAQHARAHIMMLIGRCLMPETSGARDEEEDDDNNNNNNNNDNGDDDNHGDAHGGDSVH

SEQ ID NO: 161968 - protein, 124 aa, Glycine max
  Coding DNA Sequence Number=SeqID_70283
MIEIYYCDILGQSGFDWDDTKHIITIENEDACRINRLNYFVSRVPQNWDDIVNLCAKDRATSHGAIVMDVDNEAMSRETNEGEFMGLGATTSIDLEEPNSNTEGKRQGSTYFDTHSHKKIGKKK

SEQ ID NO: 161969 - protein, 325 aa, Glycine max
  Coding DNA Sequence Number=SeqID_70284
  Gene Ontology: Mol. function=metallopeptidase activity; Cellular component=signalosome; Biological process=negative regulation of photomorphogenesis
  Homolog annotation: Hit_ID=O81090; Match level="QueryCoverage=99%, HitCoverage=88%, E-value=1e-164, Identity=88%"; Hit description =Putative JUN kinase activation domain binding protein
  Pfam annotation: Domain name=Mov34; Domain location=14-128; Score =176.7; E_value=5.9e-50; Accession=PF01398.12; Description =Mov34MPNPAD-1 family
NEFQRDKPWANDPHYFKRVKISALALLKMVVHARSGGTIEVMGLMQGKTDADAIIVMDAFALPVEGTETRVNAQADAYEYMVDYSQTNKQAGRLENVVGWYHSHPGYGCWLSGIDVSTQMLNQQFQEPFLAVVIDPTRTVSAGKVEIGAFRTYPEGYKPPDEPVSEYQTIPLNKIEDFGVHCKQYYALDITYFKSSLDSHLLDLLWNKYWVNTLSSSPLLGNGDYVAGQISDLVWVSQLENSFIAAEKLEQAENQLAHSRFGPLIAPTPRKKEEESPLAKITRDSAKITVEQVHGLMSQDILFNSVHQANRTRTEASGPEPMIES

SEQ ID NO: 161970 - protein, 351 aa, Glycine max
  Coding DNA Sequence Number=SeqID_70285
  Gene Ontology: Mol. function=protein binding; Biological process=red or far red light signaling pathway
  Homolog annotation: Hit_ID=A7P4X8; Match level="QueryCoverage=91%, HitCoverage=89%, E-value=2e-88, Identity=48%"; Hit description =Chromosome chr4 scaffold_6, whole genome shotgun sequence
  Pfam annotation: Domain name=Kelch_1; Domain location=104-146; Score =11.1; E_value=0.14; Accession=PF01344.16; Description=Kelch motif
  Pfam annotation: Domain name=Kelch_1; Domain location=150-188; Score =11.6; E_value=0.12; Accession=PF01344.16; Description=Kelch motif
  Pfam annotation: Domain name=Kelch_1; Domain location=190-236; Score =4.6; E_value=0.86; Accession=PF01344.16; Description=Kelch motif
  Pfam annotation: Domain name=Kelch_2; Domain location=104-146; Score =5.1; E_value=11; Accession=PF07646.6; Description=Kelch motif
  Pfam annotation: Domain name=Kelch_2; Domain location=150-188; Score =12.8; E_value=1.2; Accession=PF07646.6; Description=Kelch motif
  Pfam annotation: Domain name=Kelch_2; Domain location=239-279; Score =4.1; E_value=15; Accession=PF07646.6; Description=Kelch motif
  Pfam module annotation: Pfam domain module=Kelch_1::Kelch_1::Kelch _1::Kelch_2::Kelch_2::Kelch_2; Domain location=104-146::150-188::190 -236::104-146::150-188::239-279
  Subcellular localization annotation: CTP_CleavageSite=39; ConfidenceScore=5.60e-01
MAGCGRRKGAGGAYSWLTLRNCRAVSSSRSVPLPSFVALCSSTWNRAITHPSFIFSKKTLSRPHLFVLAFHSQTGKIQWQALDPSSGRWFVLPQMPLQENSCPTEFACAALPHQGKLFVMAGGGGGSDTLVYRAATNQWALAAPMPGGRKRGFFAAEGVEGKIVAVGRSGTDIYDPESDTWREGKKQGGELKRYEVVAAGGKVYVSEGWWWPFMYRPRGWVYETEKDTWREMGVGMRDGWSGVSVAVGGRVFVIAEYGDAPVRVYDEEQDTWRYVKGGSFPRDVIKRPFLATGLDNRIYVASYNLNVAIGKMKSDRIQGKGDFEVSVTWEVVEAPSAFREFSPCTCQVLYA

SEQ ID NO: 161971 - protein, 124 aa, Glycine max
  Coding DNA Sequence Number=SeqID_70286
MALDRLLGYVLAFKVRIQSKYKNVVVLRYSNELDLINAMLEMLADSEACSKIDASNVDCNNATHAECQSLSVTADHDPVAGFPLTPKKRIPSDEVDDELGSSQISTAQLSSNKLTRHSDKSEFS

SEQ ID NO: 161972 - protein, 54 aa, Glycine max
  Coding DNA Sequence Number=SeqID_70287
MPSINESPDVDEVQATRNDRDEGLWENIVTVMGTPPPSPPQSDVRSEGMYSDTR

SEQ ID NO: 161973 - protein, 293 aa, Glycine max
  Coding DNA Sequence Number=SeqID_70288
  Gene Ontology: Mol. function=transketolase activity; Cellular component=cytoplasm; Biological process=metabolic process
  Homolog annotation: Hit_ID=A4TI87; Match level="QueryCoverage=97%, HitCoverage=43%, E-value=1e-149, Identity=88%"; Hit description =Transketolase
  Pfam annotation: Domain name=TPP_enzyme_C; Domain location=102-243; Score=-26.7; E_value=0.00079; Accession=PF02775.12; Description =Thiamine pyrophosphate enzyme, C-termina
  Pfam annotation: Domain name=Transketolase_N; Domain location=3-293; Score=683.5; E_value=1.6e-202; Accession=PF00456.12; Description =Transketolase, thiamine diphosphate b
  Pfam module annotation: Pfam domain module=TPP_enzyme_C::Transketolase _N; Domain location=102-243::3-293
MSSRKELANAIRALSMDAVQKANSGHPGAPMGMADIAEVLWRDYLNHNPTNPHWADRDRFVLSNGHGSMLIYSLLHLTGYDLPMRELENFRQLHSKTPGHPEYGYTPGVETTTGPLGQGIANAVGFAIAERTLAAQFNRPGHDIVDHHTYAFMGDGCMMEGISHEVCSLAGTLKLGKLTAFYDDNGISIDGHVDGWFTDDTALRFEAYGWHVVRNVDGHNPDAIKAAIEEARKVTDKPSLLMCKTVIGFGSPNKAGTHDVHGAALGAAEVAATREALGWTYAGFEIPAGHLRP

SEQ ID NO: 161974 - protein, 186 aa, Glycine max
  Coding DNA Sequence Number=SeqID_70289
  Gene Ontology: Mol. function=prenyltransferase activity; Cellular component=integral to membrane; Biological process=regulation of transcription, DNA-dependent
  Homolog annotation: Hit_ID=A7QT41; Match level="QueryCoverage=63%, HitCoverage=47%, E-value=3e-32, Identity=46%"; Hit description =Chromosome undetermined scaffold_165, whole genome shotgun sequence
MLESYSGVINLQFSVLGQLLLQCPPFRLSYQGLGEPLSFAAFGPFATCAFYLLHGSSSHFHQVEGDREVGKMSPLVRLGTKKGAEVVKGAIFMLYALLVAFGLIKALPLTCIIFMAKYFCVRLHALFGVALALGLVLARKSVDDPGRPPGIVLSAATSFWLPVPPKRVFDFLRDENSRNEVCATKS

SEQ ID NO: 161975 - protein, 114 aa, Glycine max
  Coding DNA Sequence Number=SeqID_70290
  Gene Ontology: Mol. function=helicase activity; Cellular component =chromatin; Biological process=protein amino acid phosphorylation
  Homolog annotation: Hit_ID=Q6YTQ6; Match level="QueryCoverage=99%, HitCoverage=7%, E-value=5e-36, Identity=61%"; Hit description =Helicase-like protein
MFFLYGYGGTGKTLIWKTLASSLRADNKIVIMVAFNGIASLLLPRGRTTHSKFKIPVPIFEDSTCNMHQGSQLVELLNQTSLITWDEAPMTHKFCFEALDKSLRDIIKGKSSSN

SEQ ID NO: 161976 - protein, 44 aa, Glycine max
  Coding DNA Sequence Number=SeqID_70291
MGVQIAIKPTWAFQDVPTEASAFWFSIVLHRSSFVLRRSSVFNW

SEQ ID NO: 161977 - protein, 217 aa, Glycine max
  Coding DNA Sequence Number=SeqID_70292
MIMRSQDIYSSQYEATTSPSSSESEEAKGEESIEEIYPQEEGKPLMFKEECKEVSVSSKRLAKKERHFEIKTNIKKISLLRQPPHFLLCKKTLVSIATPLGLEFIPLVKELLDEGLVRKGLNPCALLVPKIGIIRHQIPRIGGMMNVLSGATLFSEITRAPNNFMICQLAPKKLPAKRVRKEATGEGSSAVPQMDVEFDRHRFRSEEHQGCFEAIKG

SEQ ID NO: 161978 - protein, 160 aa, Glycine max
  Coding DNA Sequence Number=SeqID_70293
IPLCQSFGVPVVPSKVIRPPITHVFIEKYCTARQAQGGDPQAPDAPLPPPQADPTGSFDTERYLRHLVRQQEANHRVHVQTHYSLYQLSLSLQSQGFVSFPCPTPDQFRAEVAWPGDWPEAQAGEAPAETPAEALSKADKAREDEEMTGLLDFLGGSGAT

SEQ ID NO: 161979 - protein, 96 aa, Glycine max
  Coding DNA Sequence Number=SeqID_70294
MDAAAEGTSAAPEFDSHHFRSAEHQQRFEAIRGWSFHRERRVQLRDDEYTNFQEEIARRRLASLVTPMAKFDPDIVLEFYANSWPTKEGVRDMRSW

SEQ ID NO: 161980 - protein, 53 aa, Glycine max
  Coding DNA Sequence Number=SeqID_70295
MIEHGKNTLYSALMMQSYPARALDRRLQVDWARDAREGPKVLMSLRADFGPMG

SEQ ID NO: 161981 - protein, 67 aa, Glycine max
  Coding DNA Sequence Number=SeqID_70296
MPKDRGTCLNFRDCHHQKGGDCRQRIKLNVLMMPMDDHLPMDDHLFLKDLFKTKKLKIFKMDDQDSL

SEQ ID NO: 161982 - protein, 78 aa, Glycine max
  Coding DNA Sequence Number=SeqID_70297
MRKGPLEEGGTKAIDNTKKKGTLSKSGNRKEEKKGILKQAQPNSGAKRAQALSEQLAAGAKRGVKHEGVETVTRAKPS

SEQ ID NO: 161983 - protein, 102 aa, Glycine max
  Coding DNA Sequence Number=SeqID_70298
MGAKYLEVVKRGSHPNKQMAQNDHNLSLRVFGHDRARVARRKMTIICLCVLSDTSPLDDEMVWGVTIICFRPPLDLLSLNDKWRRITIICLSAFITQLAAPE

SEQ ID NO: 161984 - protein, 106 aa, Glycine max
  Coding DNA Sequence Number=SeqID_70299
  Homolog annotation: Hit_ID=Q1J7G7; Match level="QueryCoverage=31%, HitCoverage=60%, E-value=8e-07, Identity=66%"; Hit description =Transposase
  Subcellular localization annotation: CTP_CleavageSite=51; ConfidenceScore=5.24e-01
MPLGYINAVGTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTL

SEQ ID NO: 161985 - protein, 73 aa, Glycine max
  Coding DNA Sequence Number=SeqID_70300
  Homolog annotation: Hit_ID=A5ANI2; Match level="QueryCoverage=95%, HitCoverage=6%, E-value=1e-09, Identity=41%"; Hit description =Putative uncharacterized protein
  Subcellular localization annotation: CTP_CleavageSite=38; ConfidenceScore=5.08e-01
MAKVLIDNVSSLNVMPKSTLEKLPFNAFHLRPSSMVVRAFDGSAESYLLGRPWIHSVGVVSSTLHQKLKFVVE

SEQ ID NO: 161986 - protein, 177 aa, Glycine max
  Coding DNA Sequence Number=SeqID_70301
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=70%, HitCoverage=31%, E-value=2e-62, Identity=93%"; Hit description=NADH dehydrogenase subunit B
  Pfam annotation: Domain name=Oxidored_q1; Domain location=36-168; Score=-41.8; E_value=3.9e-05; Accession=PF00361.11; Description=NADH- Ubiquinoneplastoquinone (complex I)
MYSSIRRVHCLYRNGYNRVSVIHINSYSRRMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRCYIVGSHPSETTSIIGASVNKRITLR

SEQ ID NO: 161987 - protein, 100 aa, Glycine max
  Coding DNA Sequence Number=SeqID_70302
  Subcellular localization annotation: CTP_CleavageSite=36; ConfidenceScore=5.10e-01
MMHVATYPSAGGRRGAHGRVFHERKMRGVVTNVYSRKTSKKSERCSLRTLSVKGSGVIFTHGEGGETLRRWTINDLLGWSTKVGLLILRILNCDEEIRPT

SEQ ID NO: 161988 - protein, 57 aa, Glycine max
  Coding DNA Sequence Number=SeqID_70303
MVMMLVVEDGPGWRNERYRKRRSHRRYGGRQREEGIDGVKVKIPTFKGTRDPKVYLE

SEQ ID NO: 161989 - protein, 231 aa, Glycine max
  Coding DNA Sequence Number=SeqID_70304
  Gene Ontology: Mol. function=motor activity; Cellular component=cell projection
  Homolog annotation: Hit_ID=UPI00016621D1; Match level="QueryCoverage =88%, HitCoverage=40%, E-value=3e-21, Identity=35%"; Hit description =UPI00016621D1 related cluster
GLHVLAFRGLHVLTFKGLHVLAFIGLHALTFRGLHVLTSRGLHVLAFRGLHVLTFKGLHVLAFIGLHALTLRGLHALAFRGLHVLTFRGLHVLAFIGLYILTFRGLHILAFRGLHVLHFRGLHVLAFRGLHLFAFKGLHLLAFRGPNILIFRGLHILIFRGLYVLIFRGLHVLIFRGLYVLIFRGLHVLYFRGLHILAFRGLHVLTFRGLHTPSPLEDYASSLSEGSTSAP

SEQ ID NO: 161990 - protein, 157 aa, Glycine max
  Coding DNA Sequence Number=SeqID_70305
  Homolog annotation: Hit_ID=Q6L477; Match level="QueryCoverage=59%, HitCoverage=17%, E-value=3e-08, Identity=27%"; Hit description =Putative uncharacterized protein OSJNBa0009L15.8
  Subcellular localization annotation: CTP_CleavageSite=19; ConfidenceScore=5.30e-01
MVTPLSSSPPKPVAPCSLSASRKTRKATRLKSLATRPIGVGRLVIHVDLVIGKAYGPHRKKLRTYLGIVARNKVNVTYDNWKQVSVAQKDLIWGDIRAEFDIPKSSNLRTKKKILQIVGEHWIQFKSNLTSKWAPTPRRARMTKFVRRCSKEGACHS

SEQ ID NO: 161991 - protein, 64 aa, Glycine max
  Coding DNA Sequence Number=SeqID_70306
MSQRALRGRARARLTGALSKGGKMRGVATNVDKSGAFAPTYPPLERKSDLRSSFLSVNQVILFT

SEQ ID NO: 161992 - protein, 113 aa, Glycine max
  Coding DNA Sequence Number=SeqID_70307
  Pfam annotation: Domain name=G-patch; Domain location=1-42; Score =19.1; E_value=0.00093; Accession=PF01585.14; Description=G-patch domain
MVARVMLGNGYEPVMGLGKDNGGITSLISAKGNRGKFGLGYKPTQADIRKSVAGRRSGSQGSRLRQEDEGSPPCHISRSFISVGLGDESQVVAICEDDAPSGSDLVRPCPPDF

SEQ ID NO: 161993 - protein, 159 aa, Glycine max
  Coding DNA Sequence Number=SeqID_70308
MTIICLCMSSGPPPLDDKGKKCRTKWFPACHLARRLWMTKREKVRDQIVPRMSSGLPPLDDKGPNGSRMSSGPPPLDDKRGRMTIICLCVPSDMTVPEWQKVSGMTIICLHVSSGPPPLDDKTRRMTIICLCMPSDTTVSEWQKNDHNLSLRAIGHDCV

SEQ ID NO: 161994 - protein, 73 aa, Glycine max
  Coding DNA Sequence Number=SeqID_70309
MLVKDMMEKIHLFFQRFWTGLMVFKPLLVKGDTLELQVDMRFNEMESRITKIEEDVSYIRSSFDLPPSPPPSF

SEQ ID NO: 161995 - protein, 140 aa, Glycine max
  Coding DNA Sequence Number=SeqID_70310
MDQLKHLSIPLGMLRFSNHASYPRLGHPTRKISMQQGQTDILIARFPDPNYGVKMGFRSLPKPQAKLEDSALVEGFLSVWVFKDPNGQIMDKCLVKLQTQFREDPTVNEDWAAFLPRQLHVAFSRSFIKRLPPEASSWLL

SEQ ID NO: 161996 - protein, 216 aa, Glycine max
  Coding DNA Sequence Number=SeqID_70311
  Gene Ontology: Mol. function=receptor activity; Cellular component =cytoplasm; Biological process=protein transport
  Homolog annotation: Hit_ID=A7QQG3; Match level="QueryCoverage=68%, HitCoverage=55%, E-value=2e-63, Identity=79%"; Hit description =Chromosome undetermined scaffold_142, whole genome shotgun sequence
  Pfam annotation: Domain name=TPR_1; Domain location=133-166; Score =19.5; E_value=0.012; Accession=PF00515.19; Description =Tetratricopeptide repeat
  Pfam annotation: Domain name=TPR_2; Domain location=133-166; Score =26.5; E_value=1e-04; Accession=PF07719.8; Description=Tetratricopepti de repeat
  Pfam module annotation: Pfam domain module=TPR_1::TPR_2; Domain location=133-166::133-166
MTQSKYIRDLLQKTNMLEAKPILPPCTPTSGSPNMGLIYGKILLFRDLFLELCSMLQSLILNSVLLLTKFLNEQVAAKQQLDSSRGVYVFSDLNPYVGHPNPLKEGQDLFRKGLLSEAVLALEAEVLKNPENAEGWRLLGIAHAENDDDQQAIAAMMRAQEADPTNLEVLLALGVSHTNELEQTAALKYLYGWLRHHPKYGTLAPPEMADSLYYAD

SEQ ID NO: 161997 - protein, 97 aa, Glycine max
  Coding DNA Sequence Number=SeqID_70312
  Gene Ontology: Mol. function=receptor activity; Cellular component =peroxisomal membrane; Biological process=protein transport
  Homolog annotation: Hit_ID=O81280; Match level="QueryCoverage=81%, HitCoverage=12%, E-value=3e-33, Identity=84%"; Hit description =Peroxisomal targeting signal-1 receptor
  Pfam annotation: Domain name=TPR_1; Domain location=1-25; Score=7.7; E_value=0.63; Accession=PF00515.19; Description=Tetratricopeptide repeat
  Pfam annotation: Domain name=TPR_1; Domain location=26-59; Score =23.5; E_value=0.00076; Accession=PF00515.19; Description =Tetratricopeptide repeat
  Pfam module annotation: Pfam domain module=TPR_1::TPR_1; Domain location=1-25::26-59
MYNLSREYDKAIASFERALKLKPQDYSLWNKLGATQANSVQSADAIMAYQQALDLKPNYVRAWANMGISYANQQEAVHYSMGGSTLGYPSMQCIEAY

SEQ ID NO: 161998 - protein, 106 aa, Glycine max
  Coding DNA Sequence Number=SeqID_70313
MAFLGETSSQTIVNSRLAFIFPNGTVIHNECGVYFQSSTPVPMRVPNMWNMPRQNNFLGYTFIGKNPQKFDIPKGCTIDELKDLIKQVVSKGNPPHGIHESQLLRR

SEQ ID NO: 161999 - protein, 508 aa, Glycine max
  Coding DNA Sequence Number=SeqID_70314
  Homolog annotation: Hit_ID=A7UQU7; Match level="QueryCoverage=27%, HitCoverage=23%, E-value=3e-13, Identity=33%"; Hit description=IMP dehydrogenase/GMP reductase, putative
MVRTRGLGRALGTSRGRDMSQDAHQPEVSRHRRPTASVHRQWVHVTEDVTQTPEDVPQLNEDVPHVSDATPEMTGAVDAADAEGVASDGSLGSPPTDEGFPCGPRDPSVLTGFAEHVAHSIWSGEERPNLKFVSHGRKVDKFGRLAPEMEGMIAATGLSPLILDLYPPSSRELTITLDDVLSLLHLPITGALHAFEPLVTFDAVGLLTELLEVTPEEATAETHQAEHLNKASQTPTQQMAGYITLLQCWIYEHFLTVHQCIIDDAYAEASPRASRWLTSKAHMTRIKRAQYQARIEALTVTNVFWMPYAEHRGVRGFDLISAYTGQLRWGQIVVYVRPERVVRQFRYIQTVPPPPIRDSLTDADIDGQWLHFSDHLVPAGEICAVPVQVAPDYMDWFFWILHPFVTPTEDNAELRHPPTPHDEEFVKPPIPEVSIASDLPTYSVVDYQGCQGMAEDLGAIAEDLERVINLRMVIEGTDLYAIMARYMRRVRGDAAYGNLRPRQRRRID

SEQ ID NO: 162000 - protein, 198 aa, Glycine max
  Coding DNA Sequence Number=SeqID_70315
MGVGFLGAIMGSSSRWATGDGVLMSGLVEVGYLFCAIARSPPSTTYNGGTWRYVAGVKRPCGRQVGCYCPKPSLANPDLTRIAMAAQLIHDRVVMECLEGVWETFEGNERCRFRGTIRLTATSLPVQVIEVSSSKKDLEEDPEELPPEPAMDAPDLPEDDEDPLPDVDSPEDIMSASEADSTEESGPGGTAISDDSSS

SEQ ID NO: 162001 - protein, 54 aa, Glycine max
  Coding DNA Sequence Number=SeqID_70316
MDKSLKVGEDEWRERERGGHKFYASNEVWFSPLIQDQVQDSPLSVHRCHEAYKA

SEQ ID NO: 162002 - protein, 80 aa, Glycine max
  Coding DNA Sequence Number=SeqID_70317
MCKRETKFLAHPGVLMITMMTTKDDDKGDEQKAQRSKNISSESRTSQEFKNQGEFKTQEESLESRIKIQDLKNQDQDSRL

SEQ ID NO: 162003 - protein, 342 aa, Glycine max
  Coding DNA Sequence Number=SeqID_70318
  Gene Ontology: Mol. function=protein serine/threonine kinase activity; Cellular component=integral to membrane; Biological process=protein amino acid phosphorylation
  Homolog annotation: Hit_ID=A7Q559; Match level="QueryCoverage=59%, HitCoverage=77%, E-value=5e-43, Identity=44%"; Hit description =Chromosome undetermined scaffold_52, whole genome shotgun sequence
  Pfam annotation: Domain name=Pkinase_Tyr; Domain location=254-336; Score=-162.5; E_value=0.018; Accession=PF07714.8; Description =Protein tyrosine kinase
MLQPYGINIGLKEHSNPVTPKAYTPKSPSGPLPPDSAVDDTGSSIHMLTIVSYWMVTIHENYMLEKKASPTEIWTLTGKVWIRHVTMSFAKIQSGQEDAWGEEQFGSGTPGSATWKASSTGNRQLRNMEQADPYSEDTISCPIYMFDSDNSVLKLDLTSCTKMFDIVAPVKEFNQQDNWLALRWSKPNCTECEAKGKRCKWKNNNTGDIECFDCKGKQNGIQIPRSLIFAATDYRTEKPARFTYADVKRIMGGFKEKLGEGAHGAVFRGKLSNKILVAVKILNNTDKEGNELINEVEIMGKIHHINVVRLLGFCVEGHHRALVYCLFPKGSLQSFIFPPEDC

SEQ ID NO: 162004 - protein, 854 aa, Glycine max
  Coding DNA Sequence Number=SeqID_70319
  Gene Ontology: Mol. function=metalloendopeptidase activity; Cellular component=chloroplast thylakoid membrane; Biological process =proteolysis
  Homolog annotation: Hit_ID=A7QWR4; Match level="QueryCoverage=15%, HitCoverage=17%, E-value=1e-44, Identity=66%"; Hit description =Chromosome chr16 scaffold_207, whole genome shotgun sequence
  Pfam annotation: Domain name=Peptidase_M3; Domain location=1-314; Score=-169.8; E_value=0.065; Accession=PF01432.11; Description =Peptidase family M3
  Pfam annotation: Domain name=RRM_1; Domain location=175-245; Score =15.9; E_value=0.005; Accession=PF00076.13; Description=RNA recognition motif. (a.k.a. RRM, RB
  Pfam module annotation: Pfam domain module=Peptidase_M3::RRM_1; Domain location=1-314::175-245
MGSRSYAEFSVKPNMAVSPKVVTSFLLEMSKMVQAKSIEERKLVMKFKREKCGRSDGDLRPWDETYYMTMMKSSSYKLDASVVGSYFSLSNCIEGLKVLVQSLFGATFRIIPLAPGESWDPHVLKLSLDHPEEGEKTQRERAREGPCLSSIGIRNGHQHGYTRGNWRDHKDVVSYYFTRFPDNVTETDLWYIFKKLGDLREVFISKRRNRNGRRYGFARFKGVEDVHSLERKLDNIILGGLKLLGKSNGRAKGGGAQRWVPATAVRNECGDDGIYRRTRSTVYFDIPVTAPKWLKEAWVGRLINVALYDRIEEELPWEIAATTSPKYIGDDMILLLGLTDEQARNLMDDQVAGQESIFYSMEKWNPSLRPGHRLTWVRCWGIPLSVLDIRHIKQITAGLGEALIVEDDVENLRQLDVARVLIKTSWSPLINHTVSVHMQGEILNVYIIEESATLPDLSYWGRGREATSSEEVLSEESDTGSPWPVTESPPVAPAISVDTAAINGSSPGEKNTDSPRRTSDPDNIQVAAVAPPPTHDDNGSTLGSSNLDIGCCSTDNGGHDPLPGGSKEDHYPTGTACTQRVLLSAQAKFKIPCPEKTSQNCVSLLTPDPHINQWPLLENGQNQSAGMRTPVDSYSPLHERGNCCVKETVAFKGKEICLLTKSRDQQRSDKVGPISAIHTPTSLPAHHPVTFLEGNTNPNTSSPPHTSKQHSCATRPHALTPQKPLPHQTPTPNDPEAENNSGPVTATHTPSNTLALYHGSPLRTQLAPQNPFSCYSRGTWRKKKFPEAIIAPPLIENETSDHNQSREAQHLWNMALDLGVTSGSMQQGYMQKLMEMEYRDAKEAERLGNKRTTP

SEQ ID NO: 162005 - protein, 206 aa, Glycine max
  Coding DNA Sequence Number=SeqID_70320
  Subcellular localization annotation: CTP_CleavageSite=38; ConfidenceScore=5.18e-01
MTFSFVLLRTLKWISIIFNFFLQPSPAVIVVVGLSNVSVMGVVTYTQQYCWGTQQTVNGQYCPSTKPVPEDPSSERISERCHSGKHSEEPSSRRRRWASGRTSEYVPEGCVPKFFRKKGLSEYHFLLPEEAYVLKMDEDQWTYDYAMSQEVDMDYDYDNEEECGVNEPHVDCSNAFNTSQVFGTRDDVLQWARTIAHENGFAAVIM

SEQ ID NO: 162006 - protein, 286 aa, Glycine max
  Coding DNA Sequence Number=SeqID_70321
MEVHINVDGDDVEVMIVAKTLNLGMANLQQSLEKQGIDMFSYPCWDTSPEEEHHAFDFYGADEPVKCYKGKEVILDDEEEVVFVCFVKACPGSLFKHEFEVLKHKFGLTSLDGHVIQRFYRLQEYSSGLEPEEKPLVDAYHHEVGQCYQTLNHSCFTQETPFNMICSWQMDFYATSDRTFSFLVILLFSRFFFIHHVDLKIKEVDLDIDVASGSMVVQDCALTKKKPRKWSLIGDFFYKKASGWKPPHSPTPLGSPLTISSDFEDFGDKFLRKLNEEVAKQRGRKM

SEQ ID NO: 162007 - protein, 93 aa, Glycine max
  Coding DNA Sequence Number=SeqID_70322
MADKIKSCSLDSQLSRNGYRKSLSCTIIKIGIDPKVQFEKRPHPSSMNRSSTMEERALVSHLYGIKNRSGQSDYIDSTKKLSFPTCQSRVNMI

SEQ ID NO: 162008 - protein, 92 aa, Glycine max
  Coding DNA Sequence Number=SeqID_70323
MMTTKDDDKSDEQKAQVNQRTSISRIKIQESRRIQDSRRKPTNKDSRSQESRSRFKISRIKIKIQESRIKTQDFKNQDQDSRIKKRLNQDKY

SEQ ID NO: 162009 - protein, 87 aa, Glycine max
  Coding DNA Sequence Number=SeqID_70324
MRRVIILVVLEQVEPFGHHSMFGFLMSTIPRVSMSCHELSDWPSGVMAGRNDHAIEDALQVLAQAIENPNRGEAVGAVEYQGLDRFQ

SEQ ID NO: 162010 - protein, 177 aa, Glycine max
  Coding DNA Sequence Number=SeqID_70325
MASRKRKAISTPIQVRFDKSRFTYQEAWERYIDIIVPTKLLPERNVVVYYTEFDEFKEELERRHWDEELTNFGDGNIDVAIVKEFYANLYDPVDKSPKQVRVRGHLIKFDEDTLNSFLKTPVIVEEEESLCAYSRFSLLRPDPQELAAKLCIPEKGFELNADGEPLKILRKNMTTLA

SEQ ID NO: 162011 - protein, 77 aa, Glycine max
  Coding DNA Sequence Number=SeqID_70326
MDPASKSYIQERKGNKRKPTKEEVMILHEIRRPNSLKTVPSGVANCRNLPFGGRARRGLTGVSSMGGKCTELPPTFI

SEQ ID NO: 162012 - protein, 315 aa, Glycine max
  Coding DNA Sequence Number=SeqID_70327
  Gene Ontology: Mol. function=hydrolase activity, acting on ester bonds; Biological process=biosynthetic process
  Homolog annotation: Hit_ID=A4W7X0; Match level="QueryCoverage=66%, HitCoverage=16%, E-value=5e-95, Identity=84%"; Hit description=Amino acid adenylation domain
GRAATTDILRLKIVADSSAFSQLAQAAGQVQRTDLALALVALWLGRLTGRLDYAAGFIFMRRMGSVALTATGPVLNVLPLAVNIDPQESLPGLALRLASQLKKMRRHQRYDAEQILRDSGKAAGNEALFGPVLNVKVFDYQLELDGVEAITHTLATGPVNDLELALFPDEQGGLSIEILASKQRYDETTLKGHVARLNAMLVQFAANPDLRLWGSGNRVRARDAGRPRAGGCAHRAELPPDARAGGRAGKPAACARREAGRQRGGGPPAFGIPDAGPARHCGSRRRVVTAGHRLPGRPPADDAGGRKAVPADYHR

SEQ ID NO: 162013 - protein, 66 aa, Glycine max
  Coding DNA Sequence Number=SeqID_70328
MESSDEEESTQQCTSGSPKTKVPLPEDVVKSLMNGQLVLPFSEKSPCCQLFHALVDVEKLTIAGLC

SEQ ID NO: 162014 - protein, 119 aa, Glycine max
  Coding DNA Sequence Number=SeqID_70329
MTKARPKGIRKGKEGEACHPTLAGELGCILPKAPPSGGTSWKAQVGLNAIFTPYLLNTPPALFADFFSQCYGTSWIVQESFLLIFDMLQNFTDCATMLSFDFWHVTELHGLPNDGCQVP

SEQ ID NO: 162015 - protein, 125 aa, Glycine max
  Coding DNA Sequence Number=SeqID_70330
MPTSSRRLCGSSPESYFLYPATVILLPRTRFVIITARNIGKHDEHTQQSLFNTHIQQIFIIHIQQLLIIHPWIQSRLHKGVSRPPGCACNSPPPIGDQPGSPKVCRDHPVVHETLGHSCSISCVV

SEQ ID NO: 162016 - protein, 39 aa, Glycine max
  Coding DNA Sequence Number=SeqID_70331
MALMLMMILRRDDVDVDDVIMMDLFMRKKYLYLGACHSV

SEQ ID NO: 162017 - protein, 237 aa, Glycine max
  Coding DNA Sequence Number=SeqID_70332
  Gene Ontology: Mol. function=motor activity; Cellular component=cell projection
  Homolog annotation: Hit_ID=UPI00016621D1; Match level="QueryCoverage =92%, HitCoverage=40%, E-value=8e-18, Identity=31%"; Hit description =UPI00016621D1 related cluster
MPPNSGPRTKLGYDNVLTFEGLHALAFRGLHVLTFRELHVLHFRGLHVLHFRGLHVLPFRGLHVLAIRGLQVLAFRGLHVFTFRGLHALPFRGLHVLAFKGLHVIAIRGLHVLAFRGQHDYTFSPSENYTGLHFLAIRGLHVLAFRGLHVLTFIGLHILTFRGLHALPFRGLHILTFRGLHALAFRGLNVLAFRGLHRLAFRELHVLTFRGLHILAVRGLHVLNFRGLHVLPFRGLH

SEQ ID NO: 162018 - protein, 220 aa, Glycine max
  Coding DNA Sequence Number=SeqID_70333
  Homolog annotation: Hit_ID=UPI00006A2D9E; Match level="QueryCoverage =66%, HitCoverage=85%, E-value=4e-13, Identity=18%"; Hit description =UPI00006A2D9E related cluster
MSSLSEDYTPSPSEGYTLSPLEDYTVTRPHLQRTTLPPLLRVVCPCLQRTTRPPFQRATRPYLQWATRPPFRGLHGLTFKGLHALAIRGLHALAIRGLHILAFRGLHDLPFRGLHVHLFRGLHALAFKGLHIFTFRGLQVLIFRGLHAITFRWLHALTFRGLHVLAYIGLHILAFRGLHVLAFRGLHVPAFRGLHALSFRGLHALAFVGLHALSFIGLHI

SEQ ID NO: 162019 - protein, 112 aa, Glycine max
  Coding DNA Sequence Number=SeqID_70334
MEAMKEQMATMMEAIMSMKKIMEANAATVAATRAVAKDLGSTNGPMMCKFKTSTPSRHMACLPTIHHPMWCTLPMRMSITPLRYSLRANNLKLIMHMSLNPWGRHMECPTTI

SEQ ID NO: 162020 - protein, 145 aa, Glycine max
  Coding DNA Sequence Number=SeqID_70335
MENIRDFEFGEPIGCDGSEDDELADSCNATASAKTNCHSNNVNWLKLLSQIHDTYYFFFTHSMHQKKQACQHKHCLRGRYIVVSDMSGKAIREILVRWLDDLRQNNKEEVKQKLRRMKPETSLKIKEEVKKQFDIDFLVVVRYPE

SEQ ID NO: 162021 - protein, 197 aa, Glycine max
  Coding DNA Sequence Number=SeqID_70336
MVIDQSLFYDLTQLSSDGVPFEGALDDDWKFNFSIHDARWLVCTNQADMTERLLAGSLALESCNLHYLIIRILLLRSSNLAQVSEEDLIVMWAFHTGRQTNWAHLVWYPMHKALRLNAPLPYPHLVTLFLQHFNIPLDSEPYVPIKRSFLIDAVVAASFGYRKERDGSWVKKGTQPNDDEGQLPVEGDSSILQSILD

SEQ ID NO: 162022 - protein, 150 aa, Glycine max
  Coding DNA Sequence Number=SeqID_70337
MTGPLDGPTSCFLIKVEPWVLVPIFFRGLHVLAIRGLHVLAFRGSHALAFRGLHVFNFRGLQVLIVKGSCTFTFVGLHALTFRGLHVLAFRGLHVLAIRDYMSPIFKGRHALTFRGLHVLAIIGLHSLAFKRRHVLNFRGLHALAFRGPR

SEQ ID NO: 162023 - protein, 425 aa, Glycine max
  Coding DNA Sequence Number=SeqID_70338
MAEHNRKATGCDSTPRESAGAVRACHFPAPGFAARRAKRGFDAQKLAFTLPYRPDIVRVQLAESQQLVRQQIFHALRRAGFFQIGRTGQQANRAAAQHARAQRGVAQFTNANSDISLLLKQVDDNVIGVQLQLNLRIARAKFGNQRHDNMQGKWRIGVDAQPSGGNVAPLRDMLFGLLHRREDLPRVIEKNQPLFGQRQATRGAVQQRGLQFAFEAAQRPADAGAGLIQLFRCGAHCYFETGLSLVLTAAEVDCSTFSSGRIPQCSKMQGLSLTRVSRRHMGAAHRAVFIHGHAAMGQIGTGSDGTDRDGQRWDRSGRAAMTRLAGIKKGRRSVPFASHFEVGEVAFFLQPVAAVFRAFLRQQHLHQTTGVRIERGFAQLQRVHLTQTFKALHVRLAFFPLQLLQHALFFVFIERVIHLFTEVDA

SEQ ID NO: 162024 - protein, 296 aa, Glycine max
  Coding DNA Sequence Number=SeqID_70339
  Homolog annotation: Hit_ID=A5ATL8; Match level="QueryCoverage=29%, HitCoverage=68%, E-value=7e-20, Identity=65%"; Hit description =Putative uncharacterized protein
LFLDGGKGYNSAVECHLDVVEVISSSLIIPKPNRTPVEYEAPGYKLCLGMEENSESALSTNKEAISNATRNLMESSILAQDERWRHALHMQVGREVAEEQKEESARGGARWGIFRNGRKPDGAMPREGRRPTGHELLFRRRSNDVRRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 162025 - protein, 44 aa, Glycine max
  Coding DNA Sequence Number=SeqID_70340
MTKARQKGYRKGKEGGGCRPARPGELGCFHQKVSPSVGRSWKAQ

SEQ ID NO: 162026 - protein, 35 aa, Glycine max
  Coding DNA Sequence Number=SeqID_70341
MNSLSTEGSLSEFIANFQKTAENAVHILLKLKPLT

SEQ ID NO: 162027 - protein, 76 aa, Glycine max
  Coding DNA Sequence Number=SeqID_70342
MAEQAKQVFYVQDHCDAIWSVVLHGKTIGVNVEDDDSYIDTYQMATPPSSLPPPPTSAKSHSPSTLKQTRKATRLR

SEQ ID NO: 162028 - protein, 31 aa, Glycine max
  Coding DNA Sequence Number=SeqID_70343
MEGDIISNDFSAELPFRLKQPMVKAVVQVCS

SEQ ID NO: 162029 - protein, 74 aa, Glycine max
  Coding DNA Sequence Number=SeqID_70344
MGDFAKIFNRSSSFVVRSSSFFGLQPIYLAKKDKNNLTKYFVLKELRRSDFLITIEEYVGAKGNTLVDHKKIKI

SEQ ID NO: 162030 - protein, 108 aa, Glycine max
  Coding DNA Sequence Number=SeqID_70345
MNGDTKESKVVSPLNTFVLGKGKNQKNLKLCRFEFFDKGEGRHKRIQAVSPLFFSKREKRDTKGIQAGEENEKMNSTSFQGLENQKTSEIFWYKEEEEVQRDSRLVKD

SEQ ID NO: 162031 - protein, 99 aa, Glycine max
  Coding DNA Sequence Number=SeqID_70346
MAYFSSWHYNISENYRQLKKLVPIEEKSVSQIRNSSILRNEDYFSSCAMLSLNAKDPQELPWKKTVVPGESISTKTPSDAQEKKYKELAELGGINIGRE

SEQ ID NO: 162032 - protein, 266 aa, Glycine max
  Coding DNA Sequence Number=SeqID_70347
  Gene Ontology: Mol. function=ion channel activity; Cellular component= integral to membrane; Biological process=response to nematode
  Homolog annotation: Hit_ID=Q9LD37; Match level="QueryCoverage=94%, HitCoverage=29%, E-value=4e-43, Identity=39%"; Hit description =Probable cyclic nucleotide-gated ion channel 20, chloroplast precursor
MANFEKDEVPIFSEVHPKPSNEPVDTKFPRGVPRTRSVSISIPSTLTEPYERGNNLVGYTGPLRSQRKTPFDHMSGPLYVTNKHGNLFRHNRVASEYQTAESKAENFPSCCGMGENDLQNNYAGKNEHLVRSGPLGMCNDPYCTTCPTYFKATQQMNSKASGIFNPETFYLMNQFDNINFCYSTNFNFDYFQFRNTLYGDARDWARRLFAFLIPLVPRVMNPHNRLVQQWNKFFAICCLVAIFVDPLFFFLLSVQKLLKRPNDQTG

SEQ ID NO: 162033 - protein, 109 aa, Glycine max
  Coding DNA Sequence Number=SeqID_70348
APRVAPDPWALPVAPDPWALPVAPGAGALPPCATCRVHSGGAGANHVTPMKENWQIADENKEHFKDSEIEEDDGSSYGGKDEEGGEPHVAAKEGDEVVVVDEDKEKHVV

SEQ ID NO: 162034 - protein, 317 aa, Glycine max
  Coding DNA Sequence Number=SeqID_70349
  Gene Ontology: Mol. function=ion channel activity; Cellular component= integral to membrane; Biological process=response to nematode
  Homolog annotation: Hit_ID=A7QJZ5; Match level="QueryCoverage=66%, HitCoverage=28%, E-value=2e-65, Identity=57%"; Hit description =Chromosome undetermined scaffold_109, whole genome shotgun sequence
MANFEDRELLMMSETDAQSYDETLHSKFQRLLSRTQSASVSIPMESYERKTSIVGHSGSLYANATPGTDNLLQHSIVVTGNKTEESKTDKFATFISTDKFDSKNEHLLISGQLGICNDPYCTTCPTYFEASQLRNPKASILSDPKVSVFLPIIGYVSVAINYMFHNALYGDAKGFARKLFSFCSSFVPGVMNPHSKFIQHWNKVLATFCLVAIFVDPLFFFLLYVRQDFNCIVVNWKLTKALVIVRSMNDFIYCLNILLQFRLAFVSPESRVVGAGDLVDHPKKIALRYLKGYFLIDLFVVFPLPQLNYQLYCISDI

SEQ ID NO: 162035 - protein, 533 aa, Glycine max
  Coding DNA Sequence Number=SeqID_70350
  Gene Ontology: Mol. function=ion channel activity; Cellular component= integral to membrane; Biological process=ion transport
  Homolog annotation: Hit_ID=Q9LDR2; Match level="QueryCoverage=96%, HitCoverage=62%, E-value=1e-113, Identity=44%"; Hit description =Putative cyclic nucleotide-gated ion channel 19
  Pfam annotation: Domain name=cNMP_binding; Domain location=378-482; Score=22.7; E_value=0.0014; Accession=PF00027.20; Description=Cyclic nucleotide-binding domain
MNMNIYLRSSRQQGKERIMILFVLPKYLGLSGANYAKNLLRAAILVQYFPRLFRFLPLLIGQSPTGFIFESAWANFIINLLIFMLSGHVVGSGWYLFGLQRVNQCLRNACRDSNITGCSAFIDCGYGADDVSGRAEVWNNNVNATACLNSSSDAFKYGIYVNAVPLTIETRVVHKYVFALFWGFQDWDSCFLHFSLEIYRTFCRLLDAGHCICLVLYADEIVNSSDGETGSLVTFWFVITQHEYALDFEEISMLGCCHCDTPMDCNVKLLPEITTVNSSDQPTDMFTKRLEMQLRGRDVEQWMSHRRLPEDLRRRVRHAERYSWAATRGVNEEILLENMQEDLQTDIRRHLFKFVKKVRIFALMDEPILDAICERLKQKTYIKGSKVLSQGSLVEKMVFVVRGTLESFGDDGTMVPLSEGDACGEELLTWYLEHSSVSTDGKKVRVQGQRLLSNRTVRCLTNVEAFSLRAADLEELTILFTRFLRNPHVQGALRYVSPYWRSLAANRIQVAWRYRKKRLSRANTSQSDQTLIA

SEQ ID NO: 162036 - protein, 76 aa, Glycine max
  Coding DNA Sequence Number=SeqID_70351
  Gene Ontology: Cellular component=integral to membrane; Biological process=transport
  Homolog annotation: Hit_ID=Q1STP4; Match level="QueryCoverage=85%, HitCoverage=15%, E-value=2e-22, Identity=76%"; Hit description =Proteinase inhibitor I4, serpin; emp24/gp25L/p24
MEQITVLEQAVDVYTMELERFLTFISEVFANAPFFISAEVAGALEARKNDDYKEINVPAGKTYEQVTVMTIVVNLK

SEQ ID NO: 162037 - protein, 464 aa, Glycine max
  Coding DNA Sequence Number=SeqID_70352
  Gene Ontology: Mol. function=translation initiation factor activity; Biological process=cellular metabolic process
  Homolog annotation: Hit_ID=A9PET5; Match level="QueryCoverage=42%, HitCoverage=95%, E-value=4e-44, Identity=50%"; Hit description =Putative uncharacterized protein
  Pfam annotation: Domain name=DUF567; Domain location=29-191; Score =150.0; E_value=6.4e-42; Accession=PF04525.3; Description=Protein of unknown function (DUF567)
MTKVHPNANASVCVSETETEKPNKNSDAMAVVLTVWKKSLLPNCNGFTVFDTQRGNLVFRVDNYVARNKDQILLMDAAGTPLLTIRRKRLSLVSDTWLVFEGEGSVKQKLLFTAARKNVNAKCTLAHIFNIKKEVAYEIEGSYAQRCCTFYNNNKIKVAEMKMKETFGADIFRLFVQPHMDTTLAMAFVILLDHILPCLKFTDKMIKQERVYTGDRDCRGGEGLFYSIRKVHTKSGIVEAKFITCLAGSEVSMGNKVADVSHVIGWLYAGATSTTLVFYLPSTLLRILTTTTPSFMPSPRAPTPTITYTSFPLPLHAPPTLSHPTRQLHFYFTRAAEVNDMGALIVHLHELVRLFLDGYNVGCAFGQRSRSSVVVACDGVMVVSDTTLDDRGVARGGFVSVRKPTRINGTKAPSWTNPSIRDGYGSQVNQENGKANVRIMRMELFLKDITNPTVQIAPKHGATM

SEQ ID NO: 162038 - protein, 147 aa, Glycine max
  Coding DNA Sequence Number=SeqID_70353
  Gene Ontology: Mol. function=RNA binding
  Homolog annotation: Hit_ID=A7Q9W1; Match level="QueryCoverage=72%, HitCoverage=38%, E-value=3e-48, Identity=85%"; Hit description =Chromosome chr8 scaffold_68, whole genome shotgun sequence
MSGLYNSNFSPVRAASPQIRTNPEVDSQYLTELLAEHQKFGPFMQALPICSRLLNQEILRVSGMLSNQGFGDFDRLRHRSPSPMASSNLMSSVTGTGLGGWNSLQQEVTATSKLCIINLCLSSSVHGDVNFVFATLKDCYIFSHMLV

SEQ ID NO: 162039 - protein, 48 aa, Glycine max
  Coding DNA Sequence Number=SeqID_70354
MEGEVLAIQAVHGDDIFMLHQSMSFWEPREIIFEAANQQVLSFWGVSH

SEQ ID NO: 162040 - protein, 786 aa, Glycine max
  Coding DNA Sequence Number=SeqID_70355
  Gene Ontology: Mol. function=sequence-specific DNA binding; Cellular component=nucleus; Biological process=regulation of transcription, DNA-dependent
  Homolog annotation: Hit_ID=A7P6K1; Match level="QueryCoverage=87%, HitCoverage=45%, E-value=1e-118, Identity=38%"; Hit description =Chromosome chr9 scaffold_7, whole genome shotgun sequence
MGGGGLAAMFSRLASSCFYSTLHPGGFGMKVQEEQCLKTKTIRVWTSKNFNPEPEVEHIFKVDENKFFNCVPDSSKIISEFEASSSTINGELADPANLEDREVGAELSCVSPRNTELNFVETPTDLQDLAFGRRGTVSDCKLVSSTVEAGNTPSGAFPSDVLKPFSTVNSIRRANRILKRLKDERFLLKPEINRWLNSLENDNSTKVDHKTIDRILTKLQEQGQVKRIIVSSPVISEYSRTKKCVVVVHSSVSQSPELFDEIQDRVRSFNTCIRSKSTSYQKNDEFIPVMEDIQKNQSVIVSAGRANKAEAKHANGFVLAKMIRAKLLHSFLWDCLHREASYIDDLSSKKCVNEQTNNPHSSIKLFCLEAAIKEMSVELLLQVVGSTKKYEEMIEKCKMGLRLSDLPLEEYKCLMDAHATGRLSLVIDILRRLKLIRMITDLQSRDGVKTPHTFTHVMELRPYIEEPFSNDAPSLNFISLDLRPRIRHDFILSNRDAVDKYWHILEYCYATADRKAASYAFPGSKVNELFRFRSWTSTCLMTAEQRAELLKHVTKDNLSEKISYRNSEKIAKDLNLSLEQVLSMYSSKRRRHFLNQLDDEEKEDNSPECKGNSSRCRKKNSSEPRLAKHARIDAVTDVEDMHIEESHNFGVHSRERATHMQKFEDDYGLEDSQDCIPLINQCVLTQMKLTCQRRFVWSDKIDRLHVPQITKNLISDSNEILLQGDVGPDGLYQFPSLKFWSAVSSPAAFSTVSPCINAASIDECNDELPNSVYTWHLRLGHPNPKP

SEQ ID NO: 162041 - protein, 294 aa, Glycine max
  Coding DNA Sequence Number=SeqID_70356
  Gene Ontology: Mol. function=oxidoreductase activity; Cellular component=cytoplasm; Biological process=flavonoid biosynthetic process
  Homolog annotation: Hit_ID=A7Q8E1; Match level="QueryCoverage=93%, HitCoverage=99%, E-value=1e-81, Identity=50%"; Hit description =Chromosome chr5 scaffold_64, whole genome shotgun sequence
  Pfam annotation: Domain name=Aldo_ket_red; Domain location=25-284; Score=250.5; E_value=3.6e-72; Accession=PF00248.12; Description =Aldoketo reductase family
MVACRISGDNRNILMVGKAVPEVVLNSGHSMPMLGFGTAGVPLPPLDELVPVFVVAIEAGYRHFDTATLYGSEEALGLALAQAQRQGLIKNRGEIFVTTKLWCSDSHPDLVLLALKKSLQRLGLDYVDLYLIHYPVRLRQGIGGSISKGDVLPFDIKGTWEAMEECSKLGLTKSIGIEMNVAWQQGNLRKFCQEKGIHVSAWSPLGANGASWGSLAVIDSPVLKDIAIATGKSVAQIALRWIFEQGVTPVVKSFNKADLEKIKQIPQFRAVLAREFITEDGPYKSLEDLWDGEV

SEQ ID NO: 162042 - protein, 51 aa, Glycine max
  Coding DNA Sequence Number=SeqID_70357
  Subcellular localization annotation: CTP_CleavageSite=26; ConfidenceScore=5.14e-01
MALYGSAFAYSNPLKDTRLPCSGVFRLSRVGKGQQSVSRDPSLYLRLSLST

SEQ ID NO: 162043 - protein, 146 aa, Glycine max
  Coding DNA Sequence Number=SeqID_70358
MVHQLGFDSEQERVHLLWISSSGGYISCGSVLVEGHLIQQTRNKKRLIVEDEDRVALEKQIVVKDGTEKKREEVTDVTSQESEKPIMVEEKEINDQEKGIEVEKEKENGEKVEKNKEGKEKSRSEKAREKNKEKASNEDTKVPYPV

SEQ ID NO: 162044 - protein, 102 aa, Glycine max
  Coding DNA Sequence Number=SeqID_70359
YIRRNPHAHFSSLWSGYLPTPTPYRLVEPVHVIEVSSSEEHLEEDPEELPPEPAMDALDLPEDDEDPLPDVDSLEDIMSASEADSTEESGPGGTANSDDSSS

SEQ ID NO: 162045 - protein, 50 aa, Glycine max
  Coding DNA Sequence Number=SeqID_70360
MKSLRGKEITLVKLQWGPDEGDSTWELEDRVYWGKDTRVRLIKEEKSITG

SEQ ID NO: 162046 - protein, 154 aa, Glycine max
  Coding DNA Sequence Number=SeqID_70361
  Gene Ontology: Cellular component=chloroplast
  Homolog annotation: Hit_ID=Q49KT9; Match level="QueryCoverage=40%, HitCoverage=53%, E-value=2e-15, Identity=75%"; Hit description =Putative uncharacterized protein ORF113
MSPHGGDMDGGEKRKERDGVSLAFGIAGPGGRPARRAISSVVERAPDNCVVVPGLRIDGAIQVRSNVDPTFSSLVGIRAIRGGTTTAPSLLENSYIPYQYMDSYLSSTGLGLASMEKNGAPNNVSSQTKNYEIAPFILGDQEIGSSHKKNRMLG

SEQ ID NO: 162047 - protein, 100 aa, Glycine max
  Coding DNA Sequence Number=SeqID_70362
MASYGGCVKKGTTQAIQKQNTAPHMLSRGGYEYLEIKLMEEKKKKKVEEVAQSGSIDTVIDPLSPIRRHVKWKMAHIMKTSQMTSEAAKEIADKIDSLEE

SEQ ID NO: 162048 - protein, 80 aa, Glycine max
  Coding DNA Sequence Number=SeqID_70363
  Homolog annotation: Hit_ID=Q6VPE8; Match level="QueryCoverage=61%, HitCoverage=6%, E-value=5e-07, Identity=44%"; Hit description =Putative gag-pol polyprotein
MIMRGQDIYSWQEEATSSPSSSGSEGDAKGNKHIEEVYPYEEEHILLGRPWKFDKKAIHNDKITLTHGSKKFKLVPLTPS

SEQ ID NO: 162049 - protein, 263 aa, Glycine max
  Coding DNA Sequence Number=SeqID_70364
  Homolog annotation: Hit_ID=A5BUG6; Match level="QueryCoverage=99%, HitCoverage=18%, E-value=4e-14, Identity=25%"; Hit description =Putative uncharacterized protein
  Pfam annotation: Domain name=zf-CCHC; Domain location=143-160; Score =7.9; E_value=0.099; Accession=PF00098.14; Description=Zinc knuckle
SLTSIGESVSLQDQLDVILEGLPNEFESLVTLINSKIEWFDLEEIRALLLAHEQRLDKARITEEATSLNFTQSQPNSKTPNSVNPNSATETQIAPQANWTTGNSNSGNYDSQNDNFKNNNQSRGRGGRNGRGNRGGRGGRSTVQCQVCHRTGHDASYCYHRFNAAYGSNQPYVHGNPYQYVRNTTPNNNNWAQSNPQWQKAAPQANFTGYAPQTNFTGYAMHPTMNNNLDTTATQHVTLMQPPPGSAPPPSHLEHIFLGNGQG

SEQ ID NO: 162050 - protein, 184 aa, Glycine max
  Coding DNA Sequence Number=SeqID_70365
  Homolog annotation: Hit_ID=Q69F85; Match level="QueryCoverage=26%, HitCoverage=2%, E-value=8e-07, Identity=48%"; Hit description=Gag -pol polyprotein
MAGDEGVIRKQGQQSHSDRQQQIEAKLDQVDTFAKGGGGRGKESIPSKMTQWCQLGHRESLDRRRQLDGHPIFVHFLKGHVLIDDDTSYNVLISKSLLNALGIIVSMPHLAMKFPNHKGKIVTIKVDQVLHQARPILTQGKMRKTGGIHQPSNYLYSNWARHCTNAPGWGKNSTNTFKKGLKTC

SEQ ID NO: 162051 - protein, 239 aa, Glycine max
  Coding DNA Sequence Number=SeqID_70366
  Homolog annotation: Hit_ID=A5BSR3; Match level="QueryCoverage=68%, HitCoverage=56%, E-value=8e-08, Identity=27%"; Hit description =Putative uncharacterized protein
  Subcellular localization annotation: CTP_CleavageSite=53; ConfidenceScore=5.53e-01
MATSPSSPPPPPSGAASQSPSILKWTRNVTRLRSLVTRPVGVEIPLVHVDPVTGKADGPHSKKLRTYLGIVARDKKWALAADKESVDDTVCQKYNISKEKWVQFCQSRRDPSWEDVRKKAQTKKKLEETAQSRSTDTVIGPPSPIRRHVKWKMPCTKKTDQMIFEVAKQIADKIDSLEEQASQGSFVTHGRQDVLTAVIGRPEHQGCVHAAGAGVTIKQYFEPTPRTSRTPSSMAPKDL

SEQ ID NO: 162052 - protein, 46 aa, Glycine max
  Coding DNA Sequence Number=SeqID_70367
MVKARQKGEIGKKRELVVAQLAQASWVASTRRHRLLLEHPGRFKWA

SEQ ID NO: 162053 - protein, 78 aa, Glycine max
  Coding DNA Sequence Number=SeqID_70368
MAKQMSFAGRASSWRGFGSGPKSLDDVGHTGKHHEGRAGISAKYEPSRSESSIACTGRGNIVKLSPFQAYFNPFARKY

SEQ ID NO: 162054 - protein, 49 aa, Glycine max
  Coding DNA Sequence Number=SeqID_70369
MATIALLRRYGRWCLVSDMQQAGFVADLGVAFVDDWVFMADRVVGNEKD

SEQ ID NO: 162055 - protein, 76 aa, Glycine max
  Coding DNA Sequence Number=SeqID_70370
  Subcellular localization annotation: CTP_CleavageSite=42; ConfidenceScore=5.80e-01
MKNCRNTSSGDVSSTSRTSQSLTNSSQALRTASFSSSGGFVRAHALSATLIRSVHISEYRLSMCVSRSADGLKRCA

SEQ ID NO: 162056 - protein, 64 aa, Glycine max
  Coding DNA Sequence Number=SeqID_70371
RVPFAIQAAQLLGRAIGAGLFAITPAGERGMCCKAIKLGNARVFPVTTLNSILLEAYENSKIYK

SEQ ID NO: 162057 - protein, 202 aa, Glycine max
  Coding DNA Sequence Number=SeqID_70372
MPFITWGFSDPNARIFQGVRKAWSTVQRKDMELRGSSNGIIGGYHKWLKAQTQELVWLPKLKASSEEEAETPKESEEVQALKAKLEKANSELKLRRAERDQSRVEGMILEDKLKAYQRSKRSLSEQLSKTKENMWAIIDQYKEQLSLAVTHEQRLEEKYAKVSILFAFTLNGSQELPRLLAKAKAMADVYSAPEEVHGLLDY

SEQ ID NO: 162058 - protein, 138 aa, Glycine max
  Coding DNA Sequence Number=SeqID_70373
MNTHLVQDGVDQLALQQGKIKIMIAGEDVAEKQCHPDPCQGGHASAHDPHLSPRHTPCEVLSWNAQQLAYGLLIKSRGLAPSLTELATLPLFQDQRMPQKLINGIFIKGDPLDPHPGALIPHSFLCGPCISIELHAYF

SEQ ID NO: 162059 - protein, 112 aa, Glycine max
  Coding DNA Sequence Number=SeqID_70374
MLGHGFEPRMGFGWNDNGVAILVEFTGNLRRFGLGYEPTRTDVRRIALERRGRSMGRPQELQVKGVPLCQIDESFVSTGWMCEGWVTMIHKETPQEQPNWVRPCPPEFELRN

SEQ ID NO: 162060 - protein, 266 aa, Glycine max
  Coding DNA Sequence Number=SeqID_70375
MSRGSGDLGGVRWGAIAQNQAWPIPTQLGHSQSVRTCDVPKQESSWQSTNKRTKVHKARRLVWWLASYLVCVISEKSPLGLKIETGHSVASVNRLPMVCNRLQCYMLLVIDYQLCVIDYTVSYATERKSLEKDILTMRSRYGTHCIGTYIAMAAQLIHDRVVMECLEGVWETLEGNERCRFRGTIRLTTTSLVHPEQSARTLQQPVEWILPTPTPYRLVEPIQVIEVSSSEEDLEEVPEELPPEPAVDAPDFPEEDEDPLPDVDSP

SEQ ID NO: 162061 - protein, 248 aa, Glycine max
  Coding DNA Sequence Number=SeqID_70376
MGPSFFISSPIYSKIGEVVAAQLAQASSARPGEQGCFLQKQPPSGGIFWRAQMGLGEAKRWLHSFKGNSLRTWEDVVEKFLKKYFPEPKTAKRTWPSINFLMNPSAKRLTVSMDYSERRLHMDRGPNRNPQQASTTTTSGKSFSLFSYADRGMPHMWRSTRARIMYIVQEDPSRDVNYMGIQNRHGFQGYNQGGPPRFNQGRNFTQGSSWRNHLGNQFNKEQRIQPAQNLNQGVDLHEKTKELEETLN

SEQ ID NO: 162062 - protein, 475 aa, Glycine max
  Coding DNA Sequence Number=SeqID_70377
  Gene Ontology: Mol. function=enzyme regulator activity; Cellular component=membrane; Biological process=capsule polysaccharide biosynthetic process
  Homolog annotation: Hit_ID=Q46631; Match level="QueryCoverage=96%, HitCoverage=63%, E-value=1e-176, Identity=69%"; Hit description =Putative tyrosine-protein kinase amsA
  Pfam annotation: Domain name=Wzz; Domain location=16-251; Score =269.2; E_value=8.5e-78; Accession=PF02706.6; Description=Chain length determinant protein
MNIKNKVMTAPKEDSNGWDLAHLVGQLIDHRWIIVAVTAFFMLMATLYTLFATPIYSADAMVQVEQKNTASVLNELQDVIPTTPASDTEIQIIESRMVIGKTVNDLGLDTVIQQNYFPVIGKGLSRLMGNKPAQIAISRLEIPRSIDKRTVELEVTGPQTYTVSKDGDELFKGRVGQLEQHGDVTMLVSGIQADEGTSFSVTKLSDLQAIKTVLGALTVADKGKTTGVLGLEFQDEDQEQASRVLNQIVNNYLLQNVERKSEQAEKSLEFLRTQLPNVRAKLDDAEDKLNTFRRQNESVDMSLEAKSALDSSVSVQSQLNELTFREAEVSQLFTKDHPTYRALLEKRKTLEAEQAQLNKKISAMPQTQQEILRLTRDVQAGQEIYMQLLNRQQELGISKASTVGDVRIIDRAETSTSPVAPKKLLIIVAGLIVGLMLSVGLVLLKALFHHGIDNPEQLEELGMNVYASVPLSEWQ

SEQ ID NO: 162063 - protein, 115 aa, Glycine max
  Coding DNA Sequence Number=SeqID_70378
EALPKRFRNVFREESRKGFNRSSTFFIRPKPLEENEHVIMTENVSQFVRLIVKECINRILTECMKLRMMKAMFDCDSHLAKKLTMCLNELSLESIIHRKRGSKQICPKFGGVIIK

SEQ ID NO: 162064 - protein, 42 aa, Glycine max
  Coding DNA Sequence Number=SeqID_70379
MAAPMNTACYLDKDEIDQSIDIKKYRDIKQIPKNLTLVPLKE

SEQ ID NO: 162065 - protein, 103 aa, Glycine max
  Coding DNA Sequence Number=SeqID_70380
MCVNRFQAIRGWSFHRERRVQLREDEYTDFQEEIARRHWTPLVTPMAKFDPEIVLEFYAIAWPTEEGVRDMRSWVRGDVNLTRSGSLDTGNEDLDDATSGEER

SEQ ID NO: 162066 - protein, 53 aa, Glycine max
  Coding DNA Sequence Number=SeqID_70381
  Subcellular localization annotation: CTP_CleavageSite=41; ConfidenceScore=5.08e-01
MAESSKKRKGSSSTTAAAGHRRHGPPEAPTTFIHPSLSSPRSSTLFSSDDQRL

SEQ ID NO: 162067 - protein, 52 aa, Glycine max
  Coding DNA Sequence Number=SeqID_70382
MTRVARCLVVVHAGTLSHSTPAKVPAKRRGGQTKERKRVNNLGSRKHKTHQN

SEQ ID NO: 162068 - protein, 557 aa, Glycine max
  Coding DNA Sequence Number=SeqID_70383
  Homolog annotation: Hit_ID=A7QK99; Match level="QueryCoverage=89%, HitCoverage=91%, E-value=1e-118, Identity=50%"; Hit description =Chromosome chr2 scaffold_112, whole genome shotgun sequence
MSMTMVMEEDEEDVEIEHVFIAHEIDLDYEFDAARFFDFTRPETPSEAHEAQLWFQNAAGYPPSPFVRRLLVAREDLFLEDVSDSPKSEHVECASNVVDDEKSSVPLGIGFSDTAFENCGMAQQVYFVECRLLVLLSFLRLHATHVLTESPKTLGENISGLLAGIQQNDGTRSLQVPTGLTFGSKTISNNLNSKAKSAVPKSSTLMKPTASQLAKQNRPSKNIGSRFQKLLTRNEHNLSISSGVESQAAKRQKLEGGLLCKFLVSDVKQQTNFFHKAPMMAVAVEQNSACSKLKLTNPREPDLRTARRGQRIRPKNVREAEHVTVPAPRFKARPLNRKILEAPSLLPHKRSTPRLPEFQEFHLKTLERAMQHTSAMSSSLHYDDSDKGWDKHTTVSALENRIKDLRRPAAAAAAPTDDGLGFTHIFKAQSLNKKILPSKGNGGVFHNSKHETTVPMESDLQTEKEVQHDPPIELFSKLSLTSEGQPNNGSHFKLPQHSGMCRKLTHDAGEGFYVKGKPNFSREWQLHQFDGCKEELGNSVTKKRGKMCNLLSYGHQT

SEQ ID NO: 162069 - protein, 345 aa, Glycine max
  Coding DNA Sequence Number=SeqID_70384
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=100%, HitCoverage=100%, E-value=1e-116, Identity=49%"; Hit description=UDP- glucosyltransferase HRA25
MRVPTVLVLPFPGVGHVNPMMSLSQKLVERGCRVIFVNSDFNHKRVMSSMVYEQQGSLDDKSLMKLVSIPDGLGPDDDRMDPGALYDAVVRTMPTTLEKLLENTHEDGDNRIGFIVADLAMLWALELIDDGIINSDEWWLCNTTYELEPGVFTFAPKILPIGPLLNTNNATARSLGKFHEEDLSCMSWLDQQPHCSVTYVAFGSISLFDQNQFNELALALDLANGPFLWVVRQDNKMAYPYEFQGQKGKIVGWAPQQKVLSHPAIACFFSHCGWNSTIEGLSSVGLGLNSNESGFVSRLEIRNKLDQLLSDENIRSRSLKLKEELMNNKGLSSDNLNKFVKWLKE

SEQ ID NO: 162070 - protein, 112 aa, Glycine max
  Coding DNA Sequence Number=SeqID_70385
MTMMREGSRETRGLRNEVSIWKNENVKLAATFYVSVSVFSLFFLHTQHPDKECNDNVASVMCDFLFERREKDIVTFGTDISPMFECHPIEVRHVVVRWHRSYVVGSVRNQAQ

SEQ ID NO: 162071 - protein, 560 aa, Glycine max
  Coding DNA Sequence Number=SeqID_70386
  Gene Ontology: Mol. function=microtubule motor activity; Cellular component=microtubule associated complex; Biological process =microtubule-based movement
  Homolog annotation: Hit_ID=A7QK89; Match level="QueryCoverage=88%, HitCoverage=61%, E-value=1e-163, Identity=59%"; Hit description =Chromosome chr2 scaffold_112, whole genome shotgun sequence
  Pfam annotation: Domain name=Arm; Domain location=256-296; Score=2.4; E_value=5.6; Accession=PF00514.14; Description=Armadillobeta-catenin -like repeat
  Pfam annotation: Domain name=Arm; Domain location=307-348; Score =35.2; E_value=2.3e-07; Accession=PF00514.14; Description =Armadillobeta-catenin-like repeat
  Pfam annotation: Domain name=Arm; Domain location=349-390; Score =21.0; E_value=0.0045; Accession=PF00514.14; Description =Armadillobeta-catenin-like repeat
  Pfam annotation: Domain name=Arm; Domain location=416-456; Score=9.6; E_value=0.67; Accession=PF00514.14; Description=Armadillobeta-catenin- like repeat
  Pfam annotation: Domain name=Arm; Domain location=466-506; Score=9.4; E_value=0.7; Accession=PF00514.14; Description=Armadillobeta-catenin -like repeat
  Pfam module annotation: Pfam domain module=Arm::Arm::Arm::Arm::Arm; Domain location=256-296::307-348::349-390::416-456::466-506
MTYRLALIFVKILVDTGHEPEDMETGNKLCRSHDRCSYWLLSSITSYNILVKHIPNFAAAINIHFSRNAMKEESMVKVKEEIDYKSLCRRLDRELDKLTMEYERQQKVFEDDIERLTTEAQHCILEAQQNYSDSLEKERLKYQKDYKESIKRLEEKAFVPAEEVVILKKILQRETLLRNAAEGEINHLKNQMAELKMLEASRESDILKLRKMLEDEAHQKEKFKGEIARLQSQLLQLGFEVGKTKQQQQASGNGEKASVAKLFEQGRGLQKILSLLEAEATDARINAVKIVANLSSEAITSLNPDVAETNQKKIVEAGGLTSLLTLLKNSQDETTQRVAASAIANLAMNETNQDLIVAQGGINILSMTAANAEDPQTLRMVAGAIANLCGNDWDSNCGSDNAFNLTITLIFNLMLKYKLQIKLRGEDGIKALLGMVRCRHPDVHIQIARGIANFAKCESKASTQGTQVGRSLLIEDGVLPWIVQNANNEVSLVRRHIELALCHLAQHEANARDMISGGAILELVRISRDCSREDIRILARRTLISSPAFQAEIKRLKIDY

SEQ ID NO: 162072 - protein, 237 aa, Glycine max
  Coding DNA Sequence Number=SeqID_70387
  Gene Ontology: Mol. function=transporter activity; Cellular component= membrane; Biological process=oligopeptide transport
  Homolog annotation: Hit_ID=Q852P5; Match level="QueryCoverage=91%, HitCoverage=42%, E-value=3e-77, Identity=58%"; Hit description =Nitrate transporter
  Pfam annotation: Domain name=PTR2; Domain location=23-237; Score= -69.3; E_value=0.0024; Accession=PF00854.12; Description=POT family
  Subcellular localization annotation: CTP_CleavageSite=51; ConfidenceScore=5.62e-01
MGVAVNLATYLTGTMHLGSANSANTVTNFMGTSLMLCLFGGFVADTFIGRRCMSANNMQLMVLYIALYTTSLGIGGLKSSVSGFSTDQFDDSDKGEKKQMLKFFNWFVFFISLGTLTAVTVLVYIQDHIGRYWGYGISVCAMLVALLVLLSSTRRYRYKRLVGSPLTQIAMVFVAAWRKRHLELPSDSSLLFNLDDVADESLRKNKQMLPHSKQFRYGFSPCYTNYLAEINDISHTL

SEQ ID NO: 162073 - protein, 169 aa, Glycine max
  Coding DNA Sequence Number=SeqID_70388
MPSIDSGDGRTVLLSVVGLRSEPGVKLPAEAGAKVDYRAQSGGNTMDEPYLGVDLGNVDVLVHFVGMKDEPCEIHNVDPDKNKEELWHEPQLATPVVNEPINKGINEQSGEYSSFDEHVESIDGDVLSDFDESVDANGAGVVHSNSNMEEIYKENKLHRKQFDLDNDDK

SEQ ID NO: 162074 - protein, 78 aa, Glycine max
  Coding DNA Sequence Number=SeqID_70389
MIPASPSRRRSSFWKKVAWPEALLPLEIAPKVVPPGPVPARTEPTLAEPQPPIVDPPAAPKLETQSPPVVDPLEGLYN

SEQ ID NO: 162075 - protein, 186 aa, Glycine max
  Coding DNA Sequence Number=SeqID_70390
  Gene Ontology: Mol. function=beta-lactamase activity; Cellular component=nucleus; Biological process=beta-lactam antibiotic catabolic process
  Homolog annotation: Hit_ID=P62593; Match level="QueryCoverage=98%, HitCoverage=86%, E-value=4e-74, Identity=63%"; Hit description=Beta -lactamase TEM precursor
  Pfam annotation: Domain name=Beta-lactamase; Domain location=6-186; Score=-10.9; E_value=2.9e-05; Accession=PF00144.15; Description=Beta- lactamase
MSIQHFRVALIPFFAAFCLPVFAHPETLVKVKDAEDQLGARVGYIELDLNSVRELCSAAITMSDNTAANLLLTTIGGPKELTAFLHNMGDHVTRLDRWEPELNEAIPNDERDTTMPVAMATTLRKLLTGELLTLASRQQLIDWMEADNVAGPLLRSALPAGWFIADKSGAGERGSRGIIAATGARW

SEQ ID NO: 162076 - protein, 155 aa, Glycine max
  Coding DNA Sequence Number=SeqID_70391
  Gene Ontology: Mol. function=receptor activity
  Homolog annotation: Hit_ID=Q9FQ21; Match level="QueryCoverage=35%, HitCoverage=14%, E-value=7e-17, Identity=66%"; Hit description =Putative Hs1pro-1-like receptor
  Pfam annotation: Domain name=Hs1pro-1_C; Domain location=1-52; Score=- 173.2; E_value=0.032; Accession=PF07014.3; Description=Hs1pro-1 protein C-terminus
MKRFFYAYKQVVAVMMGSSEADNGFTQIFLEPTYFPSLDAAKTFLAYYWENNNQNVEEQCLCVGCGAVSETAEHLFFFKGLNWNGRKRDEGSLVIWQKEKGIHIGYRALTPAGSINHIFKRGLDYQAITIFAPALKKQEVKQCPVIGGKQKNLRI

SEQ ID NO: 162077 - protein, 556 aa, Glycine max
  Coding DNA Sequence Number=SeqID_70392
  Gene Ontology: Mol. function=protein dimerization activity; Cellular component=endoplasmic reticulum lumen; Biological process=proteolysis
  Homolog annotation: Hit_ID=Q6CZG0; Match level="QueryCoverage=67%, HitCoverage=97%, E-value=1e-139, Identity=66%"; Hit description =Putative peptidase
  Pfam annotation: Domain name=M20_dimer; Domain location=305-411; Score=25.9; E_value=0.00015; Accession=PF07687.5; Description =Peptidase dimerisation domain
  Pfam annotation: Domain name=Peptidase_M20; Domain location=200-505; Score=182.7; E_value=9.1e-52; Accession=PF01546.19; Description =Peptidase family M20M25M40
  Pfam module annotation: Pfam domain module=M20_dimer::Peptidase_M20; Domain location=305-411::200-505
MTLEFRQVTEDEVDTYQALMHAAYAPTLALGIKFDAATADREKTLRHLQSHGVYALYAQGVMVSSVTVRYPWGPLPGPFGLPHIGWFGAHPDYAGQQFGRQVQDRLEQEILRGQLRAPAVSLGGITRKPGMSQLNETALGEQLIAFRHELHRFPELSNQEFETTARLRQQLEQHQIRIVDLPLKTGLVAEVGPAQGPLIVLRSDIDALPIEEQSDVAFRSERPGVMHACGHDFHASAALGAAILLKQQEATLPGRVRILFQAAEETGQGAPDVIATGALQEAVAIFGIHNDPSLPPGVVGSKAGALTAAVDRFDIRITGTGSHAAKPHQGNDPIVIAAQIVSAAQTLISRNAPSADNAVVSITQLHSGSTWNVIPDSAWLEGTVRTFSQSTRERLEQRFREIVLGLGAAFAAEVEFNWHAGPPAVVNDAHWADFALQQATASGLEARVVEASPIGEDFAFYQQQLPGAFVMIGTGEPYALHHPAFRINDAVLLPTSRYLAQLAVAALRRFSGCELAGVTAAGPGQRLTGAATGLWRRQRTLTGVAAGLCRPCAGLR

SEQ ID NO: 162078 - protein, 133 aa, Glycine max
  Coding DNA Sequence Number=SeqID_70393
  Gene Ontology: Mol. function=DNA binding; Cellular component =intracellular; Biological process=regulation of transcription, DNA -dependent
  Homolog annotation: Hit_ID=Q333W8; Match level="QueryCoverage=100%, HitCoverage=99%, E-value=5e-23, Identity=43%"; Hit description=Heat -stable nucleoid-structuring protein
  Pfam annotation: Domain name=Histone_HNS; Domain location=21-128; Score=130.1; E_value=6.5e-36; Accession=PF00816.12; Description=H-NS histone family
MSDALKALNNLRTLRAEARNIEVAVLNEMLEKFAVVVAERREETAAESAAQREKEEKLALYKEMLRKDGITINELAQLNQGETKSKAKRAPRPAKYKFTDEQGNEKFWTGQGRTPSPIKSAIDAGGSLDDFLI

SEQ ID NO: 162079 - protein, 268 aa, Glycine max
  Coding DNA Sequence Number=SeqID_70394
DKSPKQVRVKGHLIKFDEDALNTFLKTIVIIEERDSLPAYSRFCRLRPNPQELAARLSIPGRGFELNEDGLLLKILRKNLTTLTQTWSILSFSNLAPTSHTSDITLDRARLLHGIIQKMDMNLRYIISSQISMIAQHDSSRLGFPALITTLCKAWGLTSDSLSFESLSPTINLAYMKKNCWNLDDPSVTFRGPRKAKGKRSETLPSSDIPPSAAPSTTVLTSSTASASAPLPALIAAPSTGPSSFTSKTLYAMLQSLHRGQVIMMQSL

SEQ ID NO: 162080 - protein, 106 aa, Glycine max
  Coding DNA Sequence Number=SeqID_70395
MAYTHISDSTSDSPQISASPYQLDLAPYASEPYNAQWNAPGLLRDKHTLRSSRILGEMEVDEPWLGLWLPLNYQAFSLQNSLLGWCFLVCAKGGVRHWKCGRQTLW

SEQ ID NO: 162081 - protein, 144 aa, Glycine max
  Coding DNA Sequence Number=SeqID_70396
MCPVRRSYDPPHVSLRSQPPGGTWGRLSIRIISDTLMHPGKVLIYPCCSSPSIDPSLTQVSETLQMNHMNICCTLVRKKGAIHQVKEVSTSCYNPPSGMTSTLIDLPKPRKSYICPMHPYDLSSSLLIRDLKQLHQQEDYLVHK

SEQ ID NO: 162082 - protein, 73 aa, Glycine max
  Coding DNA Sequence Number=SeqID_70397
MVQHRLPLNPGCSPVKQKLRRMKPEMSLKIKEEVKINLMPASWQSLDTRNGLPTLCQSLRKMGRYECAWTIGI

SEQ ID NO: 162083 - protein, 28 aa, Glycine max
  Coding DNA Sequence Number=SeqID_70398
MPTRLTCLVSIIWRSLGFEDKSFSRRRE

SEQ ID NO: 162084 - protein, 132 aa, Glycine max
  Coding DNA Sequence Number=SeqID_70399
MGCRSLLPGLSGPTTLRLHWVSRRHDPRNTQPLADGFLVKPPGLAPPLTKLIALALLQDQWMPQKLINGILIKRDPLAPHPGALVFDSLFCGLCVGVELHDYPWIILSHGCRKLSPLPPGNFLLEFGILSFP

SEQ ID NO: 162085 - protein, 102 aa, Glycine max
  Coding DNA Sequence Number=SeqID_70400
YCTPRQAQGDAPQAADAPPPPHQADPAGSFGMERYLQHLSQGFAPFACPTLDQFRAEVAWPGDWPEAQAGEVPAEAPGDADEAHMDEEMSDLLGFLGGSGAT

SEQ ID NO: 162086 - protein, 58 aa, Glycine max
  Coding DNA Sequence Number=SeqID_70401
LVMSFKTKKGEHRLKGTIKGINSSKKYQQELSQGYCASNQWGLNTPNKIDDDGSNSHQ

SEQ ID NO: 162087 - protein, 56 aa, Glycine max
  Coding DNA Sequence Number=SeqID_70402
MLPFDFGMSRNFTYCATKGAKYLEAVKQTLHAMKQWSGLHDTGNEDLDDATSGEGR

SEQ ID NO: 162088 - protein, 105 aa, Glycine max
  Coding DNA Sequence Number=SeqID_70403
RQAQGDAPQAADVPPPHQAGPAGLFDTEQYLRHLVRQQVANHRAHSQGFTSFPCPTPDQFRAEVAWPGDWPEARAGEAPAEAPNEADEAREDEEMTDFLGGSGAT

SEQ ID NO: 162089 - protein, 92 aa, Glycine max
  Coding DNA Sequence Number=SeqID_70404
MLKPLQFQAKRREGQAAGVSLSETYALSEWHPLSEALSSLSVLENPRRGSVKYVLAQRATSSFSESFVSSRAQRAQLAKPKFTCSRLASQSR

SEQ ID NO: 162090 - protein, 151 aa, Glycine max
  Coding DNA Sequence Number=SeqID_70405
MACTRIPDLHAIQISVSPHQLDLAPYALRSYSAQWNAPGLLHDMHMLCSRRILGKMETGFVVNLGMAFMDNWVVGNFMCLPHGLRDMCMISLGLLALNGYRSGVIDILIRSVRHIGWRIVERQAIWWEGVLVLNLHIMGAARTSQSFAYHI

SEQ ID NO: 162091 - protein, 82 aa, Glycine max
  Coding DNA Sequence Number=SeqID_70406
HDGSWVKKGARPVDEEGHGGEDSSLLQKILDRFDGLQTFVGERFDTLELHFNEMESRITRVEEDVSYIRTSFDLPPPPPPSS

SEQ ID NO: 162092 - protein, 118 aa, Glycine max
  Coding DNA Sequence Number=SeqID_70407
MAARVMLGNGYEPGMGLGKNNGSKTSLAQVATICEDDPPRGSVLVWPCPLGFRLGNWRVEECPDVYATSIISDDESLEGTNTRDPAIDFKQEASQTESEEDEDVGLPPELERIVAQED

SEQ ID NO: 162093 - protein, 132 aa, Glycine max
  Coding DNA Sequence Number=SeqID_70408
MVPTVEEFEEILGCPLGGRKPYLFSGFLPSLSKIAVVVGDSAKELDRMKQTRNGVVGLPRKYLEGKARDMASQEKWVPFSDILVLLIFGVVLFPNVDSLVDLAVIDAFLAYHHSKESPMVAILADLFDTFDR

SEQ ID NO: 162094 - protein, 267 aa, Glycine max
  Coding DNA Sequence Number=SeqID_70409
  Gene Ontology: Mol. function=beta-N-acetylhexosaminidase activity; Cellular component=membrane; Biological process=carbohydrate metabolic process
  Homolog annotation: Hit_ID=A4W600; Match level="QueryCoverage=100%, HitCoverage=33%, E-value=2e-75, Identity=53%"; Hit description=Beta -N-acetylhexosaminidase precursor
  Pfam annotation: Domain name=VWA_CoxE; Domain location=53-255; Score=- 87.9; E_value=0.087; Accession=PF05762.5; Description=VWA domain containing CoxE-like prote
SRLAQIPTGIAPVLPTPAQLQRDLLGGEAALWAENVNSRVIDTRLWPRAFVVAERLWSAQDVTDSENMYQRLSAIDRWGTVSVGLQQHQQAEVQMMRLANSSDITPLRVLAEVLEPAQYYTRQHLKFQAGHYDYFEPLNRLADVLPAESEPVRLLDKQVDALIANRGDHAAASALRHQLQRWQRNSDAVMPLVLGNYQLKALQPQVRQVAELSRMGLDLVNALERNQAYGAGEVAQMHARLDAAAQVQDETVLALVRPLEKLLRSSR

SEQ ID NO: 162095 - protein, 102 aa, Glycine max
  Coding DNA Sequence Number=SeqID_70410
  Gene Ontology: Mol. function=metal ion binding; Cellular component =aspartate carbamoyltransferase complex; Biological process='de novo' pyrimidine base biosynthetic process
  Homolog annotation: Hit_ID=Q9RMS7; Match level="QueryCoverage=100%, HitCoverage=66%, E-value=6e-51, Identity=92%"; Hit description =Aspartate transcarbamylase regulatory subunit
  Pfam annotation: Domain name=PyrI; Domain location=1-47; Score=8.5; E_ value=1.7e-05; Accession=PF01948.9; Description=Aspartate carbamoyltransferase regulatory chain, allosteric domain
  Pfam annotation: Domain name=PyrI_C; Domain location=49-100; Score =82.6; E_value=1.3e-21; Accession=PF02748.6; Description=Aspartate carbamoyltransferase regulatory chain, metal binding domain
  Pfam module annotation: Pfam domain module=PyrI::PyrI_C; Domain location=1-47::49-100
MGRNDLIKIENTFLTDDQINQLAVYAPHATVNRIDEYEVVAKIAPTLPERIERVLTCPNGNCISRSEPVFSSFAVKQRDDDVHLKCKYCEKEFARHVVLGHW

SEQ ID NO: 162096 - protein, 34 aa, Glycine max
  Coding DNA Sequence Number=SeqID_70411
MKVAEVAKIFHIQSLRRLGEDGGNRSTVERDGSR

SEQ ID NO: 162097 - protein, 345 aa, Glycine max
  Coding DNA Sequence Number=SeqID_70412
  Gene Ontology: Mol. function=nucleoside-triphosphatase activity; Cellular component=integral to membrane; Biological process=response to antibiotic
  Homolog annotation: Hit_ID=A8GCX5; Match level="QueryCoverage=68%, HitCoverage=36%, E-value=6e-69, Identity=54%"; Hit description=ABC transporter-related protein
  Pfam annotation: Domain name=FtsX; Domain location=134-321; Score =24.4; E_value=1.2e-05; Accession=PF02687.12; Description=Predicted permease
MADADVIARQQFVAAVSPEIIATQPIRYLANASKTSVSGVGVDYFRIQGIKLVEGSNFSDERHARQEIIIDINTRNKLFGEQGPSPIGKMIVLGSVPVRVIGVANNEDGLSPNRLSVWLPWSTVMYRISGQTALTSISIKLKDDVVSGAAVESLTQLLTARHGTKDFLMFNRDKYRKAIEGAAATLTLLILLVASIALMIGSIGVMNIMLVSVTERTHEIGVRMAVGARRSDILQQFDRIGAGLPARWCTRHRRGPCVGRGSGAGRCGLQPGVLRQLDSGRLRLFQPDRRWLRIPAGTTCRTARSGGGTGPIANASTCIDSRFAQCPQCVLRLPRMSAQELDDVS

SEQ ID NO: 162098 - protein, 337 aa, Glycine max
  Coding DNA Sequence Number=SeqID_70413
  Gene Ontology: Mol. function=serine-type endopeptidase activity; Biological process=proteolysis
  Homolog annotation: Hit_ID=A4WA60; Match level="QueryCoverage=71%, HitCoverage=87%, E-value=1e-122, Identity=85%"; Hit description =Peptidase S1 and S6, chymotrypsin/Hap precursor
  Pfam annotation: Domain name=Asr; Domain location=12-33; Score=24.2; E_value=0.00049; Accession=PF06392.2; Description=Acid shock protein repeat
  Pfam annotation: Domain name=Asr; Domain location=34-57; Score=19.6; E_value=0.012; Accession=PF06392.2; Description=Acid shock protein repeat
  Pfam annotation: Domain name=Asr; Domain location=58-76; Score=20.8; E_value=0.0052; Accession=PF06392.2; Description=Acid shock protein repeat
  Pfam annotation: Domain name=Trypsin; Domain location=107-332; Score=- 23.8; E_value=0.0039; Accession=PF00089.17; Description=Trypsin
  Pfam module annotation: Pfam domain module=Asr::Asr::Asr::Trypsin; Domain location=12-33::34-57::58-76::107-332
ATTTAAPAKAVHHKKHHKAAKPAAEQKAQAAKKHHKKAVKQDATKPAVEQKAQAAKKHHKKATKPAVEQKAQAAKKHHKKAVKHEAAKPAAQPAAAKELKTLFFGHDDRTRVADPTQAPWDAIGQLETASGNLCTATLITPQLALTAGHCLLTPPNGKPDKAVALRFVSQKGTWRYEIHGIEGRVDPSLGKRLKPDGDGWIVPPGAASWDFGLIVLRYPPSGITPLPLFDGDKAALTAALKAADRKVTQSGYPVDHLDTLYTHTDCIVTGWAQTSVLSHQCDTLPGDSGSPLMLKTENGWQLIGVQSSAPAAKDRWRADNRALSVTGFRDQLEALAQ

SEQ ID NO: 162099 - protein, 93 aa, Glycine max
  Coding DNA Sequence Number=SeqID_70414
MQRGGEAGIAAAHHAHVTADRLVKRRERLQGNPDGFQFSKFFKRVQGLIATVAALLIAAKGDGHITVVIVIDEDRACFQAAAHAMRAGEIAGP

SEQ ID NO: 162100 - protein, 46 aa, Glycine max
  Coding DNA Sequence Number=SeqID_70415
MEVELQAMLPAQENAPKGLMFVSVGDLVLWQLTEELGWMMKGCHRF

SEQ ID NO: 162101 - protein, 114 aa, Glycine max
  Coding DNA Sequence Number=SeqID_70416
KFLKKYFPESKTAEGKAAISSFHQFSNESLSEALERFRGLLRKTPTHAGSKIKMKTLDEAMDLIESMDASDIAILRDRARIPTKKSLLELTSQDTLLAQNKLLSKKLETLTETL

SEQ ID NO: 162102 - protein, 91 aa, Glycine max
  Coding DNA Sequence Number=SeqID_70417
MPVNDHTILRDRMHQPTKKSLLELSSQDAVLAQNKLLSRKLEILIETLSCTICGGTHESGLCIPFEEQMQEVSYMGNQQRQGYNQGGFSGF

SEQ ID NO: 162103 - protein, 111 aa, Glycine max
  Coding DNA Sequence Number=SeqID_70418
MKLPRYGELNPLLVLPSLPSNTSSPRVRYSVLTVLYYLITYLGPLGSFNMKQPARLGELGGNLLPYFSYKRAWEAEGKGFSTLSEQIPLKLVRRRSKKRKNQGRGASVTLL

SEQ ID NO: 162104 - protein, 155 aa, Glycine max
  Coding DNA Sequence Number=SeqID_70419
  Homolog annotation: Hit_ID=Q2HSY1; Match level="QueryCoverage=73%, HitCoverage=76%, E-value=7e-09, Identity=31%"; Hit description =Putative uncharacterized protein
MADCFRNDVAGSCIQIHKKDEWIWKIDPTRQYSENEAHVFLTCDRILPLWWESMTWVNIHGAFPQKPWQHFSQHAFCLPSRIRLNRWRSWWLALTWTLWQHRNKIIFSNQTFDGNKLMEDVIFTLWTWLKNFDKDFAFTYSYWSSNIASGFVFSG

SEQ ID NO: 162105 - protein, 55 aa, Glycine max
  Coding DNA Sequence Number=SeqID_70420
MNYESSDFHQTVLIIQLGKCVTSPTTRNPGLSEPFYPHVVVFMPKEIKSISSDGG

SEQ ID NO: 162106 - protein, 167 aa, Glycine max
  Coding DNA Sequence Number=SeqID_70421
  Homolog annotation: Hit_ID=A7PRC0; Match level="QueryCoverage=80%, HitCoverage=43%, E-value=7e-19, Identity=42%"; Hit description =Chromosome chr14 scaffold_26, whole genome shotgun sequence
MEISIARSHLETQGIFFSNISRTIGWESIRKLPCNVAAQGSRRDFHRLASSCQAFTAVYPRRSFICRANSMPISLQESASYGDNSIEDEDPYTDLEEEALAKPPTSEQIMTLLADTQRAKLTKKLSEANQQNRFLKRQHLFKYDIDRLHRVNANRVKAALDIGSKRR

SEQ ID NO: 162107 - protein, 131 aa, Glycine max
  Coding DNA Sequence Number=SeqID_70422
MLLINLFTNICYIFILRKGIGLNTKDYTTLLDDDDDAGNERVFEDENDDGLPWDVVFEASGIGQPMTYTRQRIQKRKKPLSVEDVAPKTKRGQRRVRAQGLEVEGEGLERKGGRESEADAKLPPWREVVRD

SEQ ID NO: 162108 - protein, 125 aa, Glycine max
  Coding DNA Sequence Number=SeqID_70423
MELELVIWNRVIGKENGVVEFQVRESFKRMKVRGRGRGMKEKSRGHTVIRRKMPMIEYSSCIEQTPYTRKSGARTLHRLRVLGTQNDPGLHLFYNHLFPHAPLFLFFLNPSNHSTDSRIMPSPLH

SEQ ID NO: 162109 - protein, 498 aa, Glycine max
  Coding DNA Sequence Number=SeqID_70424
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A2Q370; Match level="QueryCoverage=100%, HitCoverage=100%, E-value=0.0, Identity=73%"; Hit description =Glycoside hydrolase, family 17; Virulence factor, pectin lyase fold; X8
  Pfam annotation: Domain name=Glyco_hydro_17; Domain location=23-344; Score=326.3; E_value=5.6e-95; Accession=PF00332.9; Description =Glycosyl hydrolases family 17
  Pfam annotation: Domain name=X8; Domain location=359-444; Score =175.4; E_value=1.5e-49; Accession=PF07983.4; Description=X8 domain
  Pfam module annotation: Pfam domain module=Glyco_hydro_17::X8; Domain location=23-344::359-444
MAKHFLLLLFAVYVAAIDEEPFIGVNIGRDLSDMPHPTQVVALLKAQQIRHVRLYDADQAMLIALANTRIQVAVSVPNQEILAIGQSNTTAAKWVSHNVIAHYPATNITTICVGSDVLTTLPYAAKVLVSALKFIHSALVASNLDHQIKVSTPLSSSMILDSFPPSQAFFNRSLNPVLVPMLDFLQTTGSYLMLNIYPYYDYMQSNGVIPLDYALFKPLPPNKEAIDSNSLLHYSNVFDAAVDAAYVAMAFLNYTNIRVVVTETGWPSKGDSNEPDATVENANTYNSNLIKHVLNITGTPKHPGIGVSTYIYELYNEDAKAGPLSEKNWGLFDANGKPVYVLHLTESGGVLANDTTNQTYCVAKDGADPKMLQAGIDWACGPGKVDCSPLLQGQPCYEPDNVVAHANYAFDTYYHQMGKSPQSCDFNGMATISTTNPSHGSCVFPGSLGNNGTFPNVTLSSMNSTNSDSSACNLHSGELGIRSLLMVIVLLLWGVALL

SEQ ID NO: 162110 - protein, 142 aa, Glycine max
  Coding DNA Sequence Number=SeqID_70425
  Gene Ontology: Mol. function=protein serine/threonine kinase activity; Cellular component=integral to membrane; Biological process=recognition or rejection of self pollen
  Homolog annotation: Hit_ID=A7P7C1; Match level="QueryCoverage=100%, HitCoverage=18%, E-value=3e-31, Identity=52%"; Hit description =Chromosome chr9 scaffold_7, whole genome shotgun sequence
MSPECAMMGVISTKTDVYSFGILLLEILSGKKNNNYHPFNLVAYAWKLRSEGEALKLMDTTLDGSYSPTKVIRYILIDLLCTQDQARDRPTMLEVVSFLSNESAHLPPPKQPGFCIIRVMEEIEKHNSCSINEITNSLTSGR

SEQ ID NO: 162111 - protein, 73 aa, Glycine max
  Coding DNA Sequence Number=SeqID_70426
MEGVRKDLALPNVVDDSSGKDDSSKRQWLLHLPLWPQWPPLRLLTPWEEKTEFNFVIEGVLSNAGITMIKDCG

SEQ ID NO: 162112 - protein, 363 aa, Glycine max
  Coding DNA Sequence Number=SeqID_70427
  Homolog annotation: Hit_ID=A7PIT9; Match level="QueryCoverage=95%, HitCoverage=52%, E-value=3e-47, Identity=35%"; Hit description =Chromosome chr13 scaffold_17, whole genome shotgun sequence
  Pfam annotation: Domain name=XH; Domain location=260-363; Score=77.4; E_value=4.6e-20; Accession=PF03469.5; Description=XH domain
MAFVSLKEVVENQKQKIIDVEDNNLLKADCKSELNKSLKIVMKMVKKEAMLDKECQKELKQIKVLNSKMSRDIECIKKENEKITKELEESKALQKKFTQQNGLIMKELGESRALNDMQHKNFTEEIRKNVMQIGSLQVALKLKKDNNVSALDKELKVENERLNAKVIQLEKQLESIQELELENQQLKEKLDVMKHMEDEFLNMVGALHMNVVEKERSLRDSEDFNQSLIIKEREINDELQKARKTLIKGIAEISSLDGNIDVKQMGQIDTEPFVKALTGRRRYNKEEAEQIALETCSLWQKDLGDPHWYPFKIVTIGGKSKEIINDEDGRLKRLKKEMGVGAYKAVVAALIEMNEYNPSGRFM

SEQ ID NO: 162113 - protein, 300 aa, Glycine max
  Coding DNA Sequence Number=SeqID_70428
  Homolog annotation: Hit_ID=A7PIT9; Match level="QueryCoverage=47%, HitCoverage=23%, E-value=5e-11, Identity=31%"; Hit description =Chromosome chr13 scaffold_17, whole genome shotgun sequence
MTNHSYVEEALSKQNEAIVRVEKDIQNHIQNSLDMEHMHSEKATIMSKLIPELVENIESMQRSVPEMENKYKESLNIIKKLTSEGDTKHEECHKEVQQLKVMNSIISHEMECMKKEHEQISMELKENKAISDLQQKNFTEVIQKNVMEISSLQFAALKQQDEYENVLKLAEVLKEKNEQLNAPPASVPAPSGTSMQSSDVLVLMLQSLYHGLCLLMQNIHDLAQHRPIMSMEAFMAQVAWPGVQFFPLGGGEAPTAQEPQPEAYPESEVTPEATPQISPAATPLVEVFEDEDDFYLDFYD

SEQ ID NO: 162114 - protein, 270 aa, Glycine max
  Coding DNA Sequence Number=SeqID_70429
MSTSDYELIKIETFVLKTQMNCQGCMNKGGVCSVLDAAICISGSGGAATNCGKKGLTWLVLPAPTAAPARHLTTRQCQWRDIMQEERGVVLHREKTGCFEIIMLRKRNSGTRCTAIDVGGTQPRVCKVDINAEEQTAIVTGIVNPSTLVQKLAKFGKHAEIWDAGYNGDQNNNQAQLINNHSDYENQYMIPPFGENHWGPQWGFNAGLENSETIYAGLENQEWARNFPGESSTSKYGHQPSPMANIHEYHHEFHPSNMMQFSSHIMDLNN

SEQ ID NO: 162115 - protein, 60 aa, Glycine max
  Coding DNA Sequence Number=SeqID_70430
MLRASLGVRLGHATKCWPLSGISGVKLEVDQSMVLGLLAFKGNKSRVVSILVEHMYNIGW

SEQ ID NO: 162116 - protein, 494 aa, Glycine max
  Coding DNA Sequence Number=SeqID_70431
  Gene Ontology: Mol. function=ATPase activity, coupled to transmembrane movement of substances; Cellular component=integral to membrane; Biological process=two-component signal transduction system (phosphorelay)
  Homolog annotation: Hit_ID=A6THR2; Match level="QueryCoverage=95%, HitCoverage=28%, E-value=1e-124, Identity=67%"; Hit description =Putative ABC-type multidrug transport system, ATPase component; Permease component of an ABC-transporter
  Pfam annotation: Domain name=ABC2_membrane; Domain location=53-254; Score=28.9; E_value=1.8e-05; Accession=PF01061.15; Description=ABC-2 type transporter
ELDRRMRNGELAVAIEIPPNFGRDIARGTPVQIGVWVDGAMPNRAETVRGYVQAMHLAWLQEMAGQQSSPNRDTSLISIETRYRYNPDVKSLPAIVPAVIPLLLMMIPAMLSALSVVREKELGSIINLYVTPTTRSEFLLGKQLPYIVLGMFNFFLLCALSVFVFGVAHKGSFLTLTLAALLYVTIATGLGLLISTFMKSQIAAIFGTAIITLIPATQFSGMIDPVASLEGPGRWIGQIYPTSHFLTIARGTFSKALNIAICGLLGDKAMLALIVFAFTVSVYSSATVMPGSLHLAPIAIADMDKSQLSSRIINGFYRPWFLTPELISADEMDAGLDAGRYTFAINIPPNFQRDVLAGRQPEVQVNVDATRMSQAFTGNGYIQNIISGEVNSFVARYRDNSALPVELAVRMRFNPNLEQERFGAVMAIINNITMLAIVLTGSALIREREHGTIEHLLVMPVTPFEIMMAKIWSMGLVVLVVSGLSLLLMVQEFC

SEQ ID NO: 162117 - protein, 242 aa, Glycine max
  Coding DNA Sequence Number=SeqID_70432
  Gene Ontology: Mol. function=motor activity; Cellular component=cell projection
  Homolog annotation: Hit_ID=UPI00006A2D9E; Match level="QueryCoverage =79%, HitCoverage=98%, E-value=1e-12, Identity=15%"; Hit description =UPI00006A2D9E related cluster
MPSPLEDYTSSPSEDNMSRPSEGCTPSPLEDYTSSPSEDFTGLHVLAFRGLHALTFRGLYILAFRGQHVPAFRRLHAFTFRGLHVLAIRGLHALAIGGLHVLAIRGVHVLAIRGLHAPAIRELHVLAIRGLHALTFRGLHVLAFRGLHVLANRGLHVLAFRGLHTLAFRGLHALTFRGLRALTFRGLHVLANRGLHVLTFRGLHVLAIRGLHVLTTRGLHVLKGLHVVRSSGGLNKLLLDLY

SEQ ID NO: 162118 - protein, 87 aa, Glycine max
  Coding DNA Sequence Number=SeqID_70433
MTLGNGYLGSCIDEERSEMRYLPRSRPITCEPVSSGPIDDPLRARTLPTRPQVRRGYPLSLSISISGGKETNKDSLSNGERTGKSPP

SEQ ID NO: 162119 - protein, 83 aa, Glycine max
  Coding DNA Sequence Number=SeqID_70434
  Subcellular localization annotation: CTP_CleavageSite=38; ConfidenceScore=5.15e-01
TYQGNPCGVYPDLSSFTGSGVYPDLSSSTGSGVYPDLSSFTGSGVYPDLSSFIGSGVYPDLSSFTGSGVNQKLYSLYQAIRAP

SEQ ID NO: 162120 - protein, 125 aa, Glycine max
  Coding DNA Sequence Number=SeqID_70435
MALKKLSTKRSRRDVPGEGSSAAPDFDSHHFRSVEHQQCFEAINGWSFHGERRVQLREDEYTNFQEEIARRRWTPLVTPMAKFDPEIVLEFYANALPTEEGVRDMHSWVRGQWIPFDADALSQFL

SEQ ID NO: 162121 - protein, 83 aa, Glycine max
  Coding DNA Sequence Number=SeqID_70436
MYVVVQEKEKLSAERQLSLAHQLAKRASIAKRSFSALSAVEESGRASISRPHAKHEISALSAAVVFSQAQRMTGAMLKSTYSR

SEQ ID NO: 162122 - protein, 137 aa, Glycine max
  Coding DNA Sequence Number=SeqID_70437
  Homolog annotation: Hit_ID=Q6UUU1; Match level="QueryCoverage=43%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKNYKDTRAFPPGGSPRALSCSCFSVYRGHSAVMA

SEQ ID NO: 162123 - protein, 347 aa, Glycine max
  Coding DNA Sequence Number=SeqID_70438
  Gene Ontology: Mol. function=protein transporter activity; Cellular component=membrane; Biological process=protein secretion
  Homolog annotation: Hit_ID=A9CFN8; Match level="QueryCoverage=100%, HitCoverage=96%, E-value=1e-137, Identity=78%"; Hit description =Efflux protein
  Pfam annotation: Domain name=HlyD; Domain location=43-327; Score=0.4; E_value=0.0056; Accession=PF00529.11; Description=HlyD family secretion protein
MALLSCQEKREAAAEAPRPVLSVVVEEKSADALQLTGTVESRIQTDLGFRVLGRIIARNVDVADLVKKGDVVASIDPLALELSVKSAQSDLSNAEAQLANAVTTEQRQRVLAEARSGTEAALEEAQQATRTANASVAKARANLDKAEEQLGYAQLHAEFDGVVTATSGEIGQVVSAGQTVVTIARPEVRDVVVDVPQFAAQRLDIGSTFEIALQLDPKIRTTGVVREIAPAAETATRTRRTKISLQDAPAAFRLGSVVTASVLAASEPRIMLPASALLKTEGGWSVWIVNADTATVTARPVTIEGEPAEGGSVRITGGVKPGERVASAGVHKLKDGQAIRIDQEVRQ

SEQ ID NO: 162124 - protein, 120 aa, Glycine max
  Coding DNA Sequence Number=SeqID_70439
MLPFDFRCVTETYGLCINIFLVFRHVLEFHKLPNDGCQAPHKDQRKVACHQAKRIHLLRDCYTENKRGYISCGSVQVEGTSTWFFKENKGRYIPCGSLTCKGFYKVERNLKNHRLLGDWM

SEQ ID NO: 162125 - protein, 131 aa, Glycine max
  Coding DNA Sequence Number=SeqID_70440
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=65%, E-value=2e-33, Identity=100%"; Hit description=LacZ protein
MEIEEELKNITKGDPPQRERSEKIAIKKKFKKMAQGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 162126 - protein, 72 aa, Glycine max
  Coding DNA Sequence Number=SeqID_70441
MDPTTMLRMMHAPDLNSQMQCVFVEATQSYTVTPHLLGDQPGPQRSFLPGDTPPSTKYILPQFILFPVSYVA

SEQ ID NO: 162127 - protein, 42 aa, Glycine max
  Coding DNA Sequence Number=SeqID_70442
MTYLGFSTGGKNWNFSLPISFSSDEFQTSRVPNSRRPKIGMP

SEQ ID NO: 162128 - protein, 73 aa, Glycine max
  Coding DNA Sequence Number=SeqID_70443
MATPPSSPPPPTGVASESPQKEAESDIPEASDLRTKKKILQTESVDDIVCEKYDISKEKWAQLCQTRRDPSWE

SEQ ID NO: 162129 - protein, 149 aa, Glycine max
  Coding DNA Sequence Number=SeqID_70444
  Subcellular localization annotation: CTP_CleavageSite=28; ConfidenceScore=5.70e-01
MLVRIIHTRLPAAVWAKSCTTAGRSPPRQSRRPAQNSRTISGSNLAMGVTRVLILYVLSPVTVELRRGAGAFPMGVPPVPLCGELLRSHLLLGMNNNAKWNQKTLRNGGARPGELTSPRQANPGLLNMRSQSQDDDLLTISLVPARTRP

SEQ ID NO: 162130 - protein, 205 aa, Glycine max
  Coding DNA Sequence Number=SeqID_70445
  Homolog annotation: Hit_ID=UPI00016621D1; Match level="QueryCoverage =86%, HitCoverage=40%, E-value=3e-13, Identity=30%"; Hit description =UPI00016621D1 related cluster
IFRELHALAFRGLHALAFIGLHVLAFKGIHLLAIRGVHVLILRGLHALTFRGLRLLSIRGIHVLTFRGLHVLTLRGLQALAFVGLHAQAFRGLHVLAIRGLHVLALRGLHVLTFKGLHTLTFRGQHVLAFRGIHVLTCRGLHVIPFRGIQALASIGLHALTFRGLHILAFRGLHGLPFKWLHRTTCPNLQRAACPPLHRAARARL

SEQ ID NO: 162131 - protein, 137 aa, Glycine max
  Coding DNA Sequence Number=SeqID_70446
  Gene Ontology: Mol. function=tRNA (guanine-N7-)-methyltransferase activity; Biological process=tRNA modification
  Homolog annotation: Hit_ID=Q666M5; Match level="QueryCoverage=100%, HitCoverage=57%, E-value=1e-63, Identity=86%"; Hit description=tRNA (guanine-N(7)-)-methyltransferase (EC 2.1.1.33) (tRNA(m7G46)- methyltransferase)
  Pfam annotation: Domain name=Methyltransf_4; Domain location=42-137; Score=-7.5; E_value=6e-07; Accession=PF02390.8; Description=Putative methyltransferase
MINDVISPEFDENGRAMRRIRSFVRRQGRLTKGQQHALENYWPVMGVEYQADAVDLAALFGREAPTVLEIGFGMGASLVTMAGNNPQQNFLGIEVHSPGVGACLADAHEAKLSNLRVMCHDAVEVLENMIPDGSLDM

SEQ ID NO: 162132 - protein, 683 aa, Glycine max
  Coding DNA Sequence Number=SeqID_70447
  Gene Ontology: Mol. function=ornithine decarboxylase activity; Cellular component=cytoplasm; Biological process=spermidine biosynthetic process
  Homolog annotation: Hit_ID=A6TDX3; Match level="QueryCoverage=38%, HitCoverage=36%, E-value=1e-128, Identity=83%"; Hit description =Ornithine decarboxylase isozyme
  Pfam annotation: Domain name=OKR_DC_1; Domain location=1-172; Score= -56.7; E_value=9e-08; Accession=PF01276.11; Description=OrnLysArg decarboxylase, major domain
  Pfam annotation: Domain name=OKR_DC_1_C; Domain location=180-278; Score=110.4; E_value=5.5e-30; Accession=PF03711.6; Description =OrnLysArg decarboxylase, C-terminal domain
  Pfam module annotation: Pfam domain module=OKR_DC_1::OKR_DC_1_C; Domain location=1-172::180-278
SVYPLFASLDVNAKIHEGESGRRLWAECVELGIEARKAILAQCKLLRPFVPPLVGGKPWQEHSTATIASERRFFSFEPGASWHGFSGYADNQYFVDPCKLLLTTPGIDADSGDYTEFGIPATILAHYLRENGIVPEKCDLNSILFLLTPAESAEKLARLVAMLAQFEQHIEADSPLAEVLPTIYNKYPVRYRDYSIRRLCQEMHDLYVSFDVKQLQKEMFRQDHFPPVVMNPQDANVEFIRDNVELVPIGQAEGRIAAEGALPVGRRGAALLPGAGRGHQPPAGLLAGVAGGLHREKRSRLEAHLRLYDQAIEKGPVRTGPSHLSTRNALLSAVALLRGIHFHQIAARLGGRVLGGQRLIHVARLHGVDDAHRARSVAGEHPQHAAGAAVVGGDHRIAARGRVLNAAQVVVLQDRQVGGAGVDVVLRIEQVAAARGAPLAAHLEHILAGGVLHHLHQAQRVRTAHRIRVEARFGLHDSQDQRLVHAVFFRRLAHHRQIFVRTFVQVVRHQLDGDRVDHVQAGGAFLQLGLQQVIGEVRRAPFPADRRALVIQHLAVQERFFADLDIVGVGIEIDGARIVTHQQRADDRLAQVRGRIGGGDGLDGNGAGVEVDVAAGLVLVGIFDVVFRPGDQNFVQTPDVLDVVGELAHQNVEAVGIFNPGFVDFFTFFAGTGDQQRRYYEQS

SEQ ID NO: 162133 - protein, 140 aa, Glycine max
  Coding DNA Sequence Number=SeqID_70448
  Gene Ontology: Cellular component=cell projection; Biological process= cell adhesion
  Homolog annotation: Hit_ID=Q01092; Match level="QueryCoverage=98%, HitCoverage=95%, E-value=2e-34, Identity=47%"; Hit description=SmfF protein precursor
  Pfam annotation: Domain name=Fimbrial; Domain location=19-140; Score =11.8; E_value=5.7e-07; Accession=PF00419.11; Description=Fimbrial protein
GAAMALLIVFTPHARAEDNLYFHGELVAEPCVIPPGSEIVPLDFGTVIDKYLYSYQRTLPIPLAIQLAECDLSLGQSLTVTFVGSENGSLPGYLALDTGSQARGVAIGLESMEGEPLALQSRTIVRGDFSAAVTFNLEYE

SEQ ID NO: 162134 - protein, 16 aa, Glycine max
  Coding DNA Sequence Number=SeqID_70449
MADSGDKNFLLYDIHE

SEQ ID NO: 162135 - protein, 183 aa, Glycine max
  Coding DNA Sequence Number=SeqID_70450
YWIYEHFPSVGFALAAKDYDERRPRACQWTSGKALPVLTYRMRLNRLTPDVVCWISYDDHHSFREFETILPHPTMPSVFVEEMDDRWMQFGDYIAPLGDPPRVSSVQQYDTFVEPDVHQQPVGAAAPDGADVDVHHPGHAVVAIADKLERLLNLRILTEGTEAYTIAEECLSIARSYISQPTV

SEQ ID NO: 162136 - protein, 109 aa, Glycine max
  Coding DNA Sequence Number=SeqID_70451
MDIKRKGIALRASSSVIQEESDKEDLTETEEDDDDFRLFVKRFNKLMRNKRNKRKSNINTKKKEEDSSLAPSCYESNQPGHMRSDYLVFERRIEKSDKRNLKEKKEKKT

SEQ ID NO: 162137 - protein, 233 aa, Glycine max
  Coding DNA Sequence Number=SeqID_70452
MAPKQIFAKRSRKDAAAEGTSAAPEFDSHHFRDDEYTDFQEKIARRHWMPLATPMAKFDPEVVLEFYANVWPIEEGVWDMRSWVRGQWIPFDADALSQLLGDPLVADGFDEEAIAQLLCIPGQDFARTAAGRRVRIMRTSMTTLTQMWMTLLLSNVLPTDHNFDLPLPKCQLVYAILTRMSVHVAQLIADAIYLFAGMPPTRHLLDPDKSNRALGFPALITGLCQLFGVPVTP

SEQ ID NO: 162138 - protein, 90 aa, Glycine max
  Coding DNA Sequence Number=SeqID_70453
  Subcellular localization annotation: CTP_CleavageSite=54; ConfidenceScore=5.27e-01
GGTVWLSAPFINQGQTSPLTRRLTSSSAPLVIQGQRVRWQAEIPYGRPHLSSTKANEFDGIRMIHSSPTMHEIPLCWAGTIKFNSVWKRL

SEQ ID NO: 162139 - protein, 67 aa, Glycine max
  Coding DNA Sequence Number=SeqID_70454
MSNPGQQYIETLKIKQWKLSRKSNGHNFSLGCPIQAHNISRCSKLNMEALGKFKRQYLLTRMSDSGQ

SEQ ID NO: 162140 - protein, 177 aa, Glycine max
  Coding DNA Sequence Number=SeqID_70455
  Pfam annotation: Domain name=RRM_1; Domain location=53-117; Score =8.3; E_value=0.025; Accession=PF00076.13; Description=RNA recognition motif. (a.k.a. RRM, RB
RERRRVTDKDRRNERWSETDTARTSVKQYRNTARTSTNRRTPNGSPSRRWRNNDYANEELLWRHFKKWGDVRDVYIAKRLNKDGRRYRFMRFKGVSDAKGLEVRLDNIFINDCKLFVNLPRFDKPVRNTELQKKNPIGRKYTDEASKPCGETKRTAEANTKEVNLIIPMMIEGTGIT

SEQ ID NO: 162141 - protein, 99 aa, Glycine max
  Coding DNA Sequence Number=SeqID_70456
MMSMKKVMEVNAAVVDATNTVAEVDPTPPSGLNQRNHLTSNVVGQGGKELGSTGGPHYVQIQNKHSFPPYGLPPNYTPPNMAHTPDENVNNSTPILIES

SEQ ID NO: 162142 - protein, 102 aa, Glycine max
  Coding DNA Sequence Number=SeqID_70457
MAFAKSTIAVILLLFMVTAAIVCYAASKGNTDCEFGPRVQGEWGDSSATLETSQASPGGFPLPLLFPIAIFCVLLFFGSKFLVFGVPILFVLLLVVAFLGLR

SEQ ID NO: 162143 - protein, 222 aa, Glycine max
  Coding DNA Sequence Number=SeqID_70458
  Homolog annotation: Hit_ID=A7P0S2; Match level="QueryCoverage=57%, HitCoverage=13%, E-value=6e-11, Identity=29%"; Hit description =Chromosome chr19 scaffold_4, whole genome shotgun sequence
MNFVMYMGEGIMCLVTITFNQLSDQVLSFKLRHVLKFRQLELSGLGVKGLFQFQIREHGSNRELAPLNLDLTHAVLRDLPEFEFIWKGTTNFLSLQMLDMIYVNGCPKLKTIFSPTIVRSLPMLNTLRITNCEELEHIFDSGDSEEFKCLYTFSQQVCFPNLEWIEVENRNKLKCLFYNFVAGHFPSLSDLDIAECSQLEKVFAFEHEAGDDGQEGTGKDGE

SEQ ID NO: 162144 - protein, 114 aa, Glycine max
  Coding DNA Sequence Number=SeqID_70459
MSEEKEEDDESKKMNGVRWCGQAVGSDGCHYGERQRLWFRFDDNLCCWLVAPFADICLVFLRFFTCLVSGLCLNFLVESRFVGEIQKRKKILEHLTRYWCFKLCCSAREEILYK

SEQ ID NO: 162145 - protein, 1270 aa, Glycine max
  Coding DNA Sequence Number=SeqID_70460
  Gene Ontology: Mol. function=nucleotide binding; Cellular component =cytoplasm; Biological process=defense response
  Homolog annotation: Hit_ID=A5BH36; Match level="QueryCoverage=94%, HitCoverage=73%, E-value=7e-95, Identity=27%"; Hit description =Putative uncharacterized protein
  Pfam annotation: Domain name=ABC_tran; Domain location=129-260; Score= -42.7; E_value=0.0024; Accession=PF00005.18; Description=ABC transporter
  Pfam annotation: Domain name=LRR_1; Domain location=1085-1109; Score =0.7; E_value=2.3e+02; Accession=PF00560.24; Description=Leucine Rich Repeat
  Pfam annotation: Domain name=LRR_1; Domain location=1172-1192; Score =3.1; E_value=82; Accession=PF00560.24; Description=Leucine Rich Repeat
  Pfam annotation: Domain name=LRR_1; Domain location=545-565; Score =4.9; E_value=38; Accession=PF00560.24; Description=Leucine Rich Repeat
  Pfam annotation: Domain name=LRR_1; Domain location=567-588; Score =10.0; E_value=4.3; Accession=PF00560.24; Description=Leucine Rich Repeat
  Pfam annotation: Domain name=LRR_1; Domain location=590-616; Score =0.9; E_value=2.1e+02; Accession=PF00560.24; Description=Leucine Rich Repeat
  Pfam annotation: Domain name=LRR_1; Domain location=735-758; Score =2.5; E_value=1.1e+02; Accession=PF00560.24; Description=Leucine Rich Repeat
  Pfam annotation: Domain name=LRR_1; Domain location=794-815; Score =2.4; E_value=1.1e+02; Accession=PF00560.24; Description=Leucine Rich Repeat
  Pfam annotation: Domain name=LRR_1; Domain location=819-843; Score =4.9; E_value=37; Accession=PF00560.24; Description=Leucine Rich Repeat
  Pfam annotation: Domain name=LRR_1; Domain location=845-868; Score =0.1; E_value=2.9e+02; Accession=PF00560.24; Description=Leucine Rich Repeat
  Pfam annotation: Domain name=LRR_1; Domain location=886-907; Score =6.9; E_value=16; Accession=PF00560.24; Description=Leucine Rich Repeat
  Pfam annotation: Domain name=LRR_1; Domain location=912-936; Score =3.0; E_value=87; Accession=PF00560.24; Description=Leucine Rich Repeat
  Pfam annotation: Domain name=LRR_1; Domain location=950-973; Score =4.1; E_value=53; Accession=PF00560.24; Description=Leucine Rich Repeat
  Pfam annotation: Domain name=NACHT; Domain location=130-280; Score= -27.0; E_value=0.0077; Accession=PF05729.3; Description=NACHT domain
  Pfam annotation: Domain name=NB-ARC; Domain location=100-391; Score =192.0; E_value=1.4e-54; Accession=PF00931.13; Description=NB-ARC domain
  Pfam module annotation: Pfam domain module=ABC_tran::LRR_1::LRR _1::LRR_1::LRR_1::LRR_1::LRR_1::LRR_1::LRR_1::LRR_1::LRR_1::LRR _1::LRR_1::NACHT::NB-ARC; Domain location=129-260::1085-1109::1172 -1192::545-565::567-588::...
  Pfam module annotation: Domain location=590-616::735-758::794 -815::819-843::845-868::886-907::912-936::950-973::130-280::100-391
MGDIVFSIVAKLAEYTVGPILHHARYLCCFNNIAGNLPNAKEELELTRNSVKERVEEAIKRTEKIEPAVEKWLKDVEKVLEEVHMLQGRISEIAELPGMKYYSSKDFVLFKSTESTYKKLLEALKDKSACTIGLVGLGGSGKTTLAKEVGKKAEELKLFEKVVMVTVSQTPNIRSIQVQIADKLGLKFEEESEEARAQRLSETLIKHTTLLILDDIWEILDFEAIGIPYNENNKGCRVLLTTRSRDVCISMQCQKIIELNLLAGNEAWDLFKLNTNITDESPYALKGVARKIVDECKGLPIAIVTVGSTLKGKTVKEWELAFSRLKDSEPLDIPKGLRSPYVCLGLSYDNLTNELAKSLFLLCSIFPEDHEIDLEDLFRFGKGMGLPETFGTMEKARREMQIAVSILIDSYLLLQASKKERVKMHDMVRDVALWKASKSGQAILASTGMDPKMLDENETIKDKRAISLWDLKVDKLLIDDDQLNCPTLEILLFHSSKVDFKVSNACFERLKMIKILAFLTSSYNLRSGMTYGTLSLPQSIESLQNLRTLCLRGYKLGDISILESLKALEILDLRGSTFKELPNGIALLKKLKLLDLFRCIIQEENAYEVIGRCLQLNELYLYIGSYAYQEFPHNLSFSRLQRYVLIFEMHPSFVDRWNLHRWIWHREFSDYQTYIFEEHRPTRVLRIDGFNASVQSFISLPIKDFFQKAEYLHLRHLEGGYEDVLPSMDPKGMNHLIFLFLKYCPEIKCLSDSTNIDLLQTEDAFSSLVILMLSELDSLQEVFHDPSSRCSLKNLEKVIIDGCRQLYNISFPKNSKLCHLKDLRIYNCPMLTCIFKPSIVQTLELLEVLKISDCYELKQIIEEVEEGSVDYVSSQSHNNTSLMLPKLRKLTISGCHSLEYIFPICFAQGLVSLEELSIEYCDKLKYVFGSEKEHDLTVYQHQNIHINFLNLETLRLIRLPNLKELHCNYCPRLPDSCVRRVMIIDSDLQQDSTATEKELLCLVATTFNQLSDQVLSSKLGHVLKFRYLRLHGLGVKGLFQFQIRENKSNRELAPLNLDLTHADLWDLLELEFIWKGPTNFLSLQSLDMIYVNRCPKLKVIFSPTIVRSLPMLKQLSIIDCEELEHIFDSGDAQSLYTCSQQVCFPNLRTIRVLKCNKLQYLFHNFVAGHFHRLNYLEIEHCSQLQKVFAFECETDADGQEGIVKDGEKVLLHNLLCITLRSLPNFKEIHHGFKLKDDVMRHDITDCPKYSPSLYLHTVLIYTRIYAAHKG

SEQ ID NO: 162146 - protein, 263 aa, Glycine max
  Coding DNA Sequence Number=SeqID_70461
  Gene Ontology: Mol. function=zinc ion binding
  Homolog annotation: Hit_ID=A7NY08; Match level="QueryCoverage=85%, HitCoverage=81%, E-value=2e-49, Identity=44%"; Hit description =Chromosome chr6 scaffold_3, whole genome shotgun sequence
  Pfam annotation: Domain name=FYVE; Domain location=143-200; Score= -8.0; E_value=0.0068; Accession=PF01363.12; Description=FYVE zinc finger
MDDHMNKALQEKPILIGLEDLYQGIPDESVNLTFQHLAEVKTSDKRKPTTTTTTPSRSIAKLPSLDFTKGLQASNHQHHEHYLQDFGHGEPSPLGHSGHFISHASGGAQRQSPRLMAGNDHLGHGMSFDGVSVASGRGSRRRRPGIPHSKICTICNTYVYIFRTRCLVCGRVYCRQCVERGMGEMIEGRKCIECLGLRFSQRYIERAGKVGCCSWRYPNTLKQAELKCAEKGPRRSVRHGHSGMANSTRSRSPISPRRTHNAI

SEQ ID NO: 162147 - protein, 82 aa, Glycine max
  Coding DNA Sequence Number=SeqID_70462
MAEALVVLLKKMSVQIESKKKKEILVGVCSAVSNRGRESGNFGWSISSGTVYLMREVKKKREKQEKQRLSPLSFNDSQTQKN

SEQ ID NO: 162148 - protein, 139 aa, Glycine max
  Coding DNA Sequence Number=SeqID_70463
MESKRNTITLVNKTHLLCNVSFFLFLICTLAFCSITIASSIPCLDTRCPMLANADIDFEELKGNIGQSLVSKGKIEVFSMNLGLSRGILSGPGSVPPTCHSKCCKCTPCKPTLCSVHNEGGTYYPLRWLCKCGNKFYNP

SEQ ID NO: 162149 - protein, 548 aa, Glycine max
  Coding DNA Sequence Number=SeqID_70464
  Gene Ontology: Mol. function=transferase activity; Cellular component= membrane; Biological process=metabolic process
  Homolog annotation: Hit_ID=A7NSL2; Match level="QueryCoverage=80%, HitCoverage=99%, E-value=0.0, Identity=70%"; Hit description =Chromosome chr18 scaffold_1, whole genome shotgun sequence
  Pfam annotation: Domain name=Exostosin; Domain location=177-483; Score=76.3; E_value=1e-19; Accession=PF03016.6; Description =Exostosin family
MGALPTNAFLVTGLYPTLTSLQALSLNPWNIYSKIRTLHVDIMAYYQHSKSHRPGRLISWETTPTLPFVKFNTDGSSFGNLGIAGFGVKSNGEPISVKSRTFVPKAASMSASNKWRAMSHHQHQPLCTRTHQIGALLLVATTFFFTRMLSTSTLSTSVVHVSQPRFQWGQSQLSLKIYVYQEDEIDGLKELLRGRDAKITDEACLKGQWGSQVKIHKLLLQSKQRTWKKEEADLFFVPSYVKCARMMGGLNDKEINSTYVKVISQMPYFRLSGGRNHIFVFPSGAGAHLFKSWATYINRSIILTPEGDRTDKRDTSAFNTWKDIIIPGNIDDGMTKTGDTTVQPLPLSKRKYLANYLGRAQGKAGRLKLIELSKQFPEKLECPDLKFSGPDKLGRKEYFEHLRNSKFCLAPRGESSWTLRFYESFFVECVPVILSDQIELPFQNVIDYSQISIKWPSSQIGPELLQYLESIPDEEIEKIIARGRQVRCWWVYASDSESCSAMRGIMWELQRKVRQFHHSAETFWLHNGSIVNRNLVEFPKWELPVPLP

SEQ ID NO: 162150 - protein, 89 aa, Glycine max
  Coding DNA Sequence Number=SeqID_70465
  Gene Ontology: Mol. function=oxidoreductase activity; Cellular component=extracellular region; Biological process=response to oxidative stress
  Homolog annotation: Hit_ID=Q9XFL4; Match level="QueryCoverage=59%, HitCoverage=16%, E-value=3e-19, Identity=84%"; Hit description =Peroxidase 3
  Subcellular localization annotation: CTP_CleavageSite=50; ConfidenceScore=5.15e-01
MALSSSSSTSIFALALFTTLLLIGSSSAQLSENFYDSKCPKVFYAVKSVLQSALAKEPRQGASIVRLFFHDCFVNGNTFILSAIKGNNT

SEQ ID NO: 162151 - protein, 61 aa, Glycine max
  Coding DNA Sequence Number=SeqID_70466
MSEAFIYCQCCRKALGVFKEIRQRMAGEGGSSQRQQTVINLIPGSMRIKLIRKLLNDQVDP

SEQ ID NO: 162152 - protein, 973 aa, Glycine max
  Coding DNA Sequence Number=SeqID_70467
  Gene Ontology: Mol. function=protein binding; Cellular component =viral envelope
  Homolog annotation: Hit_ID=O24293; Match level="QueryCoverage=100%, HitCoverage=100%, E-value=0.0, Identity=71%"; Hit description =Chloroplast inner envelope protein, 110 kD (IEP110) precursor
  Subcellular localization annotation: CTP_CleavageSite=34; ConfidenceScore=5.46e-01
MNPSTLTPSHTHRPLLLPSPFYSRRHRFRVSLPRCSSDAAAPSPPPPTPPQRPPKDLKGIELLVDKLSPPARLATSAVIVAGAAAAGYGLGSRFGGSRYAALGGAVALGAAGGAAAYALNAAAPQVAAVNLHNYVAAFDDPSKLKKEEIEAIASKYGVSKQDEAFKAEICDIYSEFVSSVLPPGGEELKGDEVDRIVSFKNSLGIDDPDAASMHMEIGRKIFRQRLEVGDRDADVEQRRAFQKLIYVSNLVFGDASSFLLPWKRVFKVTDSQIEVAVRDNAQRLFASKLKSVGRDIDAEQLVALRKEQQLCRLSDENLPCLIICEFFSPGVSQAIAELDRVLAFNNLLISFKTHPDVDRFARGVGPVSLVGGEYDGDRKIEDLKLLYRAYVSDALSGGRMEDDKLAALNQLRNIFGLGKREAEAISLDVTSKVYRKRLAQAVADGELEMADSKAAFLQNLCDELHFDPQKASELHEEIYRQKLQKCVADGELNEEDVAALLRLRVMLCIPQQIVETAHSDICGSLFEKVVKEAIASGVDGYDAEIQKSVRKAAHGLRLTREVAISIASKAVRKIFINYIKRARAAGNRTESAKELKKMIAFNTLVVTNLVEDIKGESADISTEEPVKEDITQTDDEEWESLQTLKKIRPNKELTEKLGKPGQTEITLKDDLPERDRTDLYKTYLLYCLTGEVTRVPFGAQITTKKDDSEYLLLNQLGGILGLSSQEIVEVHRGLAEQAFRQQAEVILADGQLTKARVEQLNNLQKQVGLPQEYAQKIIKSITTTKMAAAIETAVTQGRLNMKQIRELKEANVDLDSMVSENLRETLFKKTVDDIFSSGTGEFDNEEVYEKIPSDLNINKEKARGVVHELAKSRLSNSLVQAVSLLRQRNHKGVVSSLNDLLACDKAVPSQPVSWEVPEELADLYTIYLKSDPTPENLSRLQYLLGINDSTAAALREMGDRLLNTTAEEEKFVF

SEQ ID NO: 162153 - protein, 36 aa, Glycine max
  Coding DNA Sequence Number=SeqID_70468
MIMVVIVKIVASIMVVTNNNQDGIRFSHGGGGRATM

SEQ ID NO: 162154 - protein, 113 aa, Glycine max
  Coding DNA Sequence Number=SeqID_70469
MGLTKPVDRPDHDVNDPLYLMTLTIPQLFLKLLQVMWDATVFGVFNDNFLLYIKHEDLSKIADDGKVVAGQKYRNDNNSSYRAPNENKVEDERKEGRNYSFRCGQHTKVVKVL

SEQ ID NO: 162155 - protein, 70 aa, Glycine max
  Coding DNA Sequence Number=SeqID_70470
MEIISMQFEQLDVCGKDSIENIIDVKADGGCGYCAIATLLGYHREVDEYYGYEVFFMRSLSFTTIGVVME

SEQ ID NO: 162156 - protein, 41 aa, Glycine max
  Coding DNA Sequence Number=SeqID_70471
MIPLKLLQEHNKGLDQTYLREVAKEKKHRLLTMLECDEHDV

SEQ ID NO: 162157 - protein, 105 aa, Glycine max
  Coding DNA Sequence Number=SeqID_70472
MWTGAASGQLQGGLGIKEISKFNVALLGKWIWALASGQQYLWARIINSKYGGWTEFQFGREKRGFSYWWRDLRKLYHQKCGYPRNVAMSSLGGSSRTGSLLRVIS

SEQ ID NO: 162158 - protein, 60 aa, Glycine max
  Coding DNA Sequence Number=SeqID_70473
MAENGKLDQIEERLKVIEGSGDYAFANLEELFLVPDIITPPKFKVPDFDKWGHTQKMRNC

SEQ ID NO: 162159 - protein, 212 aa, Glycine max
  Coding DNA Sequence Number=SeqID_70474
MIFVPYVERITILSEEQERVTEPVSHGPTSERQFPAQQFHMLQSSIETQGIDRRRDIVEAEEYSQQMAERGHGMYYTPQTFAEYPTQMYQYPFQGHHTDTSASQQSFGGVAETQAHFSWPTMTPSQQYHGPIPTPNAPLGTQWNVTGQIPNTGDLFGVDLRHAFLRRLTKKKRGGIGAEEILIAKHEDGIDHVAHPHDITDTKMNDLHVFVY

SEQ ID NO: 162160 - protein, 118 aa, Glycine max
  Coding DNA Sequence Number=SeqID_70475
  Gene Ontology: Mol. function=two-component response regulator activity; Cellular component=cytoplasm; Biological process=two -component signal transduction system (phosphorelay)
  Homolog annotation: Hit_ID=Q0TKP2; Match level="QueryCoverage=99%, HitCoverage=48%, E-value=5e-61, Identity=97%"; Hit description =Phosphate regulon transcriptional regulatory protein PhoB
  Pfam annotation: Domain name=Response_reg; Domain location=3-117; Score=137.0; E_value=5.5e-38; Accession=PF00072.15; Description =Response regulator receiver domain
MARRILVVEDEAPIREMVCFVLEQNGFQPVEAEDYDSAVNQLNEPWPDLILLDWMLPGGSGLQFIKHLKREALTRDIPVVMLTARGEEEDRVRGLETGADDYITKPFSPKELVARIKP

SEQ ID NO: 162161 - protein, 92 aa, Glycine max
  Coding DNA Sequence Number=SeqID_70476
  Homolog annotation: Hit_ID=A5AK77; Match level="QueryCoverage=84%, HitCoverage=9%, E-value=1e-07, Identity=37%"; Hit description =Putative uncharacterized protein
MAQPPPRERNLRKMAAPDFTYESLCIQYPNEDVPYVLKTGLIHLLPKFHGLASEDPHKHLKEFHIAYSTMKPPDVQEDHIFLKVFPHSSELN

SEQ ID NO: 162162 - protein, 97 aa, Glycine max
  Coding DNA Sequence Number=SeqID_70477
MARRDKLWSFCTLLSSRGGEPDDMQRQIMVIARTFSPSGDDRVRWHAETNYGHSAPFRHPETIVSDGTQRQIMVILRLVSTERNEFGSIRMMLVVQC

SEQ ID NO: 162163 - protein, 409 aa, Glycine max
  Coding DNA Sequence Number=SeqID_70478
  Gene Ontology: Mol. function=motor activity; Cellular component=cell projection
  Homolog annotation: Hit_ID=P15305; Match level="QueryCoverage=98%, HitCoverage=81%, E-value=8e-22, Identity=23%"; Hit description =Dynein heavy chain
ALTFRGLHVLAIRGPHALTIRGLHVLAFRGLHVFTFRRLHVLAIRGLHVVTFRGLHVFAIRGLQALTFRGLHVLAIRGLHVLTFRGLHVLAIRGMHILTFRGLHVLAISGLHMLTLRGLHVLAFRGPHALPFRGLHVLAIRALHALPFRRLHILAIRGLHVLTFRGLHVLACRGLHPLAFRGLHVIAIKRLHVLAFRGLHVLAFRGLDVLAYRGLQVLAIGGLHALTFRGPHVLTIRGGLHAFTFRGLHVLAFRGLQAHIFEGQHAFSFRGLHVLTFRGLHVLAFRGLHILAIRGLYALAIRGLHVLAIRGPHVFTFRGMHVLAIRGLHALAIRGLYVLAFRGLHVLAFRGLDVLAYRVLHVLAIGGLHALTFRGPHVLAIRGLHALTFRGLHVLPIRGLHALTFRGLH

SEQ ID NO: 162164 - protein, 82 aa, Glycine max
  Coding DNA Sequence Number=SeqID_70479
WTQYVDFPHGEGPRGAQTVKIFRRSVWHVCKLLALHASPGKVEGVCSECWPRLLDDGLELPNLLGASQLGEHVFLSIAFTKD

SEQ ID NO: 162165 - protein, 346 aa, Glycine max
  Coding DNA Sequence Number=SeqID_70480
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=71%, HitCoverage=86%, E-value=1e-128, Identity=93%"; Hit description=Beta- lactamase TEM precursor
  Pfam annotation: Domain name=Beta-lactamase; Domain location=31-268; Score=152.5; E_value=1.2e-42; Accession=PF00144.15; Description=Beta- lactamase
  Pfam annotation: Domain name=Peptidase_S11; Domain location=29-251; Score=-123.1; E_value=0.037; Accession=PF00768.11; Description=D -alanyl-D-alanine carboxypeptidase
  Pfam module annotation: Pfam domain module=Beta-lactamase::Peptidase _S11; Domain location=31-268::29-251
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGARCVRPRRKDQRIFLRSFFSARNLLLANKKTTATSGGLFAGSRATNSFSEGNWLQQSADTKYCSSSVAVVRPPLQELCSTAYIPRSANPVTSGCCQWR

SEQ ID NO: 162166 - protein, 39 aa, Glycine max
  Coding DNA Sequence Number=SeqID_70481
MSKRLQEDWATAIEEGPRVLMNLRVGVRFRQVHQIAQVV

SEQ ID NO: 162167 - protein, 130 aa, Glycine max
  Coding DNA Sequence Number=SeqID_70482
MENWRTALGINSRGSRLDGGGHMTSATQSIHGSPNKMENGELANSARESIRGAPDSMAINLRGSRLDGGGHMNSARQSIHGSPNKIENGELASSARQSIHASPNKIGEWELANSARQSIRGAPDLMVEDA

SEQ ID NO: 162168 - protein, 50 aa, Glycine max
  Coding DNA Sequence Number=SeqID_70483
SIKNNSRVQDKNQEEFKTQEENLESRIKIRGSRSRFKTQDSRIKIRLNQD

SEQ ID NO: 162169 - protein, 66 aa, Glycine max
  Coding DNA Sequence Number=SeqID_70484
MYSDEDVRKTKKRSANIEKKGLGVVYAWGRQLYNTSDRLRLNFTKKKRLLMIDGEDECEHNNKGDP

SEQ ID NO: 162170 - protein, 93 aa, Glycine max
  Coding DNA Sequence Number=SeqID_70485
  Subcellular localization annotation: CTP_CleavageSite=45; ConfidenceScore=5.22e-01
MSLPSAVHVSYTFEFGAMLHDWLTPSMSLPSAVHVSSTFESGAPRMSLPSAVRQFSILHFFSEPHECHCLALFMHPPPKEFGAMLHDCLVWTL

SEQ ID NO: 162171 - protein, 386 aa, Glycine max
  Coding DNA Sequence Number=SeqID_70486
  Gene Ontology: Mol. function=phosphotransferase activity, for other substituted phosphate groups; Cellular component=integral to membrane; Biological process=lipopolysaccharide biosynthetic process
  Homolog annotation: Hit_ID=A6TF99; Match level="QueryCoverage=82%, HitCoverage=97%, E-value=1e-146, Identity=79%"; Hit description =Undecaprenyl-phosphate 4-deoxy-4-formamido-L-arabinose transferase
  Pfam annotation: Domain name=Glycos_transf_2; Domain location=69-233; Score=121.9; E_value=1.9e-33; Accession=PF00535.17; Description =Glycosyl transferase
MEQLKIHDIGTGLHFRAAHTHKYYRERYPQLSLPATEWNSERICSLPLFPDMLDDDPEMLEEKPIRKVSVVIPVYNEEQSLPELVRRTDAACRTLGLDYEILLVDDGSADRSAQMIADAADMPGSHVVGVLLNRNYGQHSAIMAGFSHVSGDVIITLDADLQNPPEEIPNLVKAAQQGYDVVGTVRQNRQDSWFRRRASRTINHLIQRVTGKAMGDYGCMLRAYRRHIVDAMLNCHERSTFIPILANTFARRTIELPVTHAEREFGDSKYSFMKLINLMYDLVTCLTTTPLRLLSIVGSLIALAGFAFSLILIVLRLFLGASWAGDGVFMLFAVLFIFVGAQFVGMGLLGEYIGRIYNDVRARPRYFIQRVIHPQQDAPSVQEIKQ

SEQ ID NO: 162172 - protein, 192 aa, Glycine max
  Coding DNA Sequence Number=SeqID_70487
MAIGDHTILCDRVHIPTKKSLLELSSQDALLAQNKLLFKQLEALAEILSKLPTQLHASQPLPSSVLQVTGCTLCGGAHESGLCIPTEGTTHEVNYMGNQHRQNFNASGFSRFQHGQPYQQHNQWRTHPGNHFNKDQGGPSTRPLQQQGLGIYERTTKLEETLAQFMQESLSNHKSTESAIKNLEVQVGQLAK

SEQ ID NO: 162173 - protein, 226 aa, Glycine max
  Coding DNA Sequence Number=SeqID_70488
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=96%, HitCoverage=7%, E-value=3e-16, Identity=26%"; Hit description=CTV.20
MEKATPSDPRPAPIIEDIKQDNSGKVEITFNRRNSFSSRIEASRSEYESARRSFSVRTRSIPVGLTRSELHNQFPTVNLQGLDTTSSIPRTTYNQDQEDNQNIDKETLRKDFYSPANEPQRRWFFQNYRGTNRKQIQDKFYEFVERVKVNVLFFDWFHAYNIKKDIDYPWKQDIIGDPSTNVISNWQVRDGEMIQSELPPTTKYQLPNIKDSNNKPVMATPFKTRY

SEQ ID NO: 162174 - protein, 58 aa, Glycine max
  Coding DNA Sequence Number=SeqID_70489
MDKSLKVGEDEWRERERRGTKFMPQMSPLIQDQVQDSPLSVLRCHKACQAMKDIAPKC

SEQ ID NO: 162175 - protein, 85 aa, Glycine max
  Coding DNA Sequence Number=SeqID_70490
PIYNSMPQETQHKDAQVKVEYVKRLYDQVKVQIAKKNESYTKQANKKRKEVAKYSLKAQVEKDEGPSGEGQSPRVEKDEGPSGEG

SEQ ID NO: 162176 - protein, 69 aa, Glycine max
  Coding DNA Sequence Number=SeqID_70491
MDEDQWMYDSIMSEEVDIDYQNEEECGVNEPHVDCSDAFNNSQVFDCRDDVLQWARSVAHENGFVAMII

SEQ ID NO: 162177 - protein, 217 aa, Glycine max
  Coding DNA Sequence Number=SeqID_70492
  Homolog annotation: Hit_ID=A2Q4S5; Match level="QueryCoverage=50%, HitCoverage=16%, E-value=8e-14, Identity=40%"; Hit description=IMP dehydrogenase/GMP reductase, putative
MFHVVFLDTLQDLSQTGRYAWGAAALVHMYDHLNDACINSSRQLAGYATLLQHFPSVAECIADPDYDEVSPHACRWISMKKTVKTISTKTYRQHLDRLRILDVCWMPYGEHRLFGYIQSIPAQLVNSWESFDEIDDRWMHYSDHLAPAGPGANSCIDTCLSEVEQPRHVVEACQAIAERLERHLNLRIVTLGIETHEVIEQCLKIARGVIEDRIVYV

SEQ ID NO: 162178 - protein, 77 aa, Glycine max
  Coding DNA Sequence Number=SeqID_70493
MTETVCIDNRLGISACHLTSRVMMIETVCTDNRLGISIRHLNSQARMTETVCTVNRLGISIRHLTSRVRMAESAEDD

SEQ ID NO: 162179 - protein, 125 aa, Glycine max
  Coding DNA Sequence Number=SeqID_70494
MWLDLSDNALEVISSTFGNLSLEYLDLSLIKFEGSTFREFGAFKSLKTLNLSNNMLVGEGTSTWVVVTENKRGYISCGSVQVEGTSTWLFKENKGGYIPCGSLLVKDFTRLKRNLKDRRSLGDWM

SEQ ID NO: 162180 - protein, 36 aa, Glycine max
  Coding DNA Sequence Number=SeqID_70495
MANGHEQEKIRKKQKEVMSDEKGLKEKVALGDEDGY

SEQ ID NO: 162181 - protein, 162 aa, Glycine max
  Coding DNA Sequence Number=SeqID_70496
MWAFLTDRQIDWAHLVRYLMHKALQANAPLPYPQLVTLFLCHFQIPLDDEPFVQVKRSFAIGAGAVTSFGYHKDRNGQWTKKDALPPQDKHTPSPPPQRDDSALMTEVLSELRGLRTYVVERFDSLDGCFAGMDIYLTQLEEDVVYIRQSSIFHHHHHPLSV

SEQ ID NO: 162182 - protein, 52 aa, Glycine max
  Coding DNA Sequence Number=SeqID_70497
MKKRWWLRNVTSFLKYSSKVYDQEGFHSQIVVASSIKFGHNNYQQKYIPLQQ

SEQ ID NO: 162183 - protein, 134 aa, Glycine max
  Coding DNA Sequence Number=SeqID_70498
  Homolog annotation: Hit_ID=UPI00006A17C9; Match level="QueryCoverage =68%, HitCoverage=69%, E-value=4e-08, Identity=31%"; Hit description =UPI00006A17C9 related cluster
  Subcellular localization annotation: CTP_CleavageSite=19; ConfidenceScore=5.20e-01
RACSPLKVRECSPLKERTCSSLKARACSPLKARTCSPLKARAGSPLKARTCSPLKVRARSPLKMRTGSPLKARTSSLLKARACSPLMARTCSPLKVGFVVDLGMAFVDNWVVGKEKGCYWLSNDIVGLVGNLAV

SEQ ID NO: 162184 - protein, 138 aa, Glycine max
  Coding DNA Sequence Number=SeqID_70499
MATKMKRCPFEALGSIAPITSMPHIENDYNAANMFNDQSNTISWFLLYKTFPLKRKLIANQRNVLLSLSEASGGYSLLSDPNFIRGLPFTDILILGSRITILSASYSAKQGITQYFDQEYKRIPRKGAKGSFLDFSEP

SEQ ID NO: 162185 - protein, 68 aa, Glycine max
  Coding DNA Sequence Number=SeqID_70500
MRFCNVIVVTTTMNVAVSNSKVVALWGLMPLFDGRTEKQREGRERKANGNKSDKDYIWHHTWHACVAG

SEQ ID NO: 162186 - protein, 141 aa, Glycine max
  Coding DNA Sequence Number=SeqID_70501
  Subcellular localization annotation: CTP_CleavageSite=66; ConfidenceScore=5.77e-01
MKDCRNTSSGDVSSTSRTSQSLTNSSQALRTVSSQALVSVDLHTTKSLKLSGTWTFLSLELSRHAEASRKGQTLLENLISGLNRWLCSCSGWTKAVCLAGWPFTQRTSTAHPSSRFFLTLSRGLLRSADSSLSQSVGLARG

SEQ ID NO: 162187 - protein, 118 aa, Glycine max
  Coding DNA Sequence Number=SeqID_70502
MPQYAFGLLTSHTSSKEIIRTYFEQVWIIPNVMPGIIEESLSLLPIEIFRYDTCCLEIIYISEPGSPYNQKQRFIRKFMMQSFSIRALGRRLQVDWARDPREDPRVLMSLRVDFEPMG

SEQ ID NO: 162188 - protein, 81 aa, Glycine max
  Coding DNA Sequence Number=SeqID_70503
MIFKVPHSNESPSINYVIWMVAEWRRKRERRRHFKEKMSLEEAHHHRRPWIRAWRKKEMNEGRGREEHEILCSQRALKSEV

SEQ ID NO: 162189 - protein, 71 aa, Glycine max; identical to SEQ ID NO: 113925
  Coding DNA Sequence Number=SeqID_70504

SEQ ID NO: 162190 - protein, 157 aa, Glycine max
  Coding DNA Sequence Number=SeqID_70505
  Homolog annotation: Hit_ID=A5B8Z2; Match level="QueryCoverage=70%, HitCoverage=35%, E-value=2e-08, Identity=34%"; Hit description =Putative uncharacterized protein
MELEFWDKNPFKAIAKAFSPSFHFKPSATNKTRIFYEFILIDSNSVSIKHFKDSNDTNLNTHSTVQILKFQAHPKFLKTANPETSLFLNQKSQLASFLASSRSKESLAKNLKEVLQLLQQEEDEGFSSKKEDNNSSEENDPFYQNEDECFGFSLNDD

SEQ ID NO: 162191 - protein, 108 aa, Glycine max
  Coding DNA Sequence Number=SeqID_70506
  Subcellular localization annotation: CTP_CleavageSite=31; ConfidenceScore=5.14e-01
MAEPSKKRKGSSSRSQQNSESQDTPIPPSISSSTLFSSEEQRIWYTTLFSSCSIIDPKFMDMEFFSDEMFECVQAFQNSGSSFSKKPLEKASQRSHEEASRESYMKLP

SEQ ID NO: 162192 - protein, 213 aa, Glycine max
  Coding DNA Sequence Number=SeqID_70507
MEDMLTSRRFILEALCEAGMIRLDGNKGDSCLIHLGASHDVETCPMAGELLQGMMDRGLIEVCSARKGEGDVCMQSIHKSSSKPKPLVIHFTRDVATHKPRGFQSVPVKKPTPSPYKSDKDDLSSTKVTNIFSTSGMTCSGRIFAALEPLVRSKDPKGKVKANVEESGKVGLILNNEVLVGRFAKEEDDFSKKELYAEEEIEFLRIIQQSEFK

SEQ ID NO: 162193 - protein, 159 aa, Glycine max
  Coding DNA Sequence Number=SeqID_70508
KCLQGGMKVTKNTSSLHFRLLARDAMKLMYAGNTFHIVARKVLIVKEVIRGWREAGIVIGSGDIGGERKNSVVSPMGMATPKLGLADHRARAISPLALARCSLLTGAASPSGGIGAVHFGMLFLFMMRLNIRSEIGFKASCRCSQVAHALLVHDETKHK

SEQ ID NO: 162194 - protein, 110 aa, Glycine max
  Coding DNA Sequence Number=SeqID_70509
MDNCLFAKSMNTLEVPSLLKSLQVWAHIRDLAPFRRRFTSLQCITDSLIRGRSTSRVQGKFRCLTIAIIVYCIWLSRKKLIFEDYQFSVIEVISKIKFLMYRQAHLLHLF

SEQ ID NO: 162195 - protein, 59 aa, Glycine max
  Coding DNA Sequence Number=SeqID_70510
MNPEEGAGLTLVQMAQAKKKTYLVLQWKALAQVEWDLRPLECHPPGPTEAPVLDQVASE

SEQ ID NO: 162196 - protein, 59 aa, Glycine max
  Coding DNA Sequence Number=SeqID_70511
MAGAGGGGDEYHQLDGAQRLLLDAMNALMQRLLNCNNEGGGNRGNNGGNDGPRQNRVEE

SEQ ID NO: 162197 - protein, 216 aa, Glycine max
  Coding DNA Sequence Number=SeqID_70512
MPSPRRREFEIMRSWVRGQLIPFGTDALSQFLGHPLILEEDQRCEFSQRRDQASGFDEEAIAQLLCIPGQDFAWTAAGRQVWIMRTSMTTLTQIWMTLLLSNILPNDHNFDLPLPKCQMVYTILTRMTVHMAQIIAYAIYLFAGAAPTRHPLEPERSNRALGFSALITGLCQFYGVLVIPSKVIQPPITRAFIEKYCTPRQAKGDTQQAADAPPPQ

SEQ ID NO: 162198 - protein, 86 aa, Glycine max
  Coding DNA Sequence Number=SeqID_70513
MGESLTEQCRVKVEGLRVMNFFSRRRSNDAAAVRQRMQALSGMIGRKASVGGFLSSPSNPRAQTWTGGGNYQAWSTVGAEGISGGA

SEQ ID NO: 162199 - protein, 86 aa, Glycine max
  Coding DNA Sequence Number=SeqID_70514
MGGTKRLLVIIPKVVISLLMVSRGTTSNNMLSKRKTLDEGSLLSSKSETQHDHRFTSTPYVPMDPSIGPLFNSPCVQIVLVFVCIK

SEQ ID NO: 162200 - protein, 31 aa, Glycine max
  Coding DNA Sequence Number=SeqID_70515
MKNQFDAGFLAVARYPEWVTNIVPVPKKDRK

SEQ ID NO: 162201 - protein, 92 aa, Glycine max
  Coding DNA Sequence Number=SeqID_70516
MMTKSPKNDCKKIQDSRIIKIKIQDSKIQESREDLIKIKGTSTWVVVTENKRGYISCGSVQVEGTSTWLVKENKGVYIPCGSFLVKDFTRLK

SEQ ID NO: 162202 - protein, 94 aa, Glycine max
  Coding DNA Sequence Number=SeqID_70517
MVRGRRHKSPRVNELGPRLTKGAEDVDVEDDVSLCTSPDFRVSVTEISLPEDADISGKGADDYIGLCVSIGLGVCAGYRRVSPHATGILGHGSK

SEQ ID NO: 162203 - protein, 202 aa, Glycine max
  Coding DNA Sequence Number=SeqID_70518
MSANDHAILCDKTHKPTKKSLLELSSHDTLLAQNKLLSKQLEILKETLGCTICGEAHETGQCIPIEENTQEIHYMGNQQRQGYTQGGFSGFHQGPYNQQGQWRSHPGNQFNKDQGGPSNRPIQQGPNIFQRTTKLEESLTQFMQIADKSSNSFVANTEKNPKEECIAVMTRSKRFVEAKDEESVVHKKKAVKRKVPMATKMM

SEQ ID NO: 162204 - protein, 84 aa, Glycine max
  Coding DNA Sequence Number=SeqID_70519
  Homolog annotation: Hit_ID=A5BAF5; Match level="QueryCoverage=76%, HitCoverage=11%, E-value=3e-08, Identity=50%"; Hit description =Putative uncharacterized protein
MVEAHSISTLMVTNCKLSKHGADLFHDPTLYRSEVGALQYATLTRPEISYAVNKTFHIRSSYLSWLKLDILVIQEAESHSKVQH

SEQ ID NO: 162205 - protein, 66 aa, Glycine max
  Coding DNA Sequence Number=SeqID_70520
  Subcellular localization annotation: CTP_CleavageSite=49; ConfidenceScore=5.19e-01
MSTLSRATIPKYVLNFFLWGPSTFPVAGSTCTTGLSTPGGLVDNDRRCVAVYVCVCVEDAHKVMQC

SEQ ID NO: 162206 - protein, 363 aa, Glycine max
  Coding DNA Sequence Number=SeqID_70521
  Gene Ontology: Mol. function=nucleotide binding; Cellular component =cytoplasm; Biological process=mitotic chromosome condensation
  Homolog annotation: Hit_ID=Q1CA55; Match level="QueryCoverage=90%, HitCoverage=24%, E-value=1e-121, Identity=66%"; Hit description =Chromosome partition protein mukB
MLQLELEERLEALSQNVSEAGERRMEMRQELEQIQQCIRELTARAPVWLAAHDALSQLMRSERRAGGKQPAVEAQIERLRQPGGAEDQRLVTLAERFGGVLLSEIYDDVTIDDAPYFSALYGPSRHAIVVPDLSLVREMLEGLEDCPEDLYLIEGDPQSFDDSVFAVEEQEKAVVVKIADRQWRYSRYPEVPLFGRAARENRLEVLHAERETLAERYATLSFDVQKTQRSHQAFSRFIGTHLAVAFDADPEAEIRGLNARRGEIERALNNHEAQNQQQRQQYDQAKEGISALNRLMPLVSLLNDETLQDRVDDMREELEEAQDAARHIQQHGVSLAKLEPLLSCCRAILSIMNSCSRITRSCK

SEQ ID NO: 162207 - protein, 177 aa, Glycine max
  Coding DNA Sequence Number=SeqID_70522
  Gene Ontology: Mol. function=methyltransferase activity; Cellular component=integral to membrane; Biological process=metabolic process
  Homolog annotation: Hit_ID=A8GCJ0; Match level="QueryCoverage=97%, HitCoverage=28%, E-value=1e-82, Identity=83%"; Hit description =Peptidoglycan-binding domain 1 protein precursor
MDLHYLSTLAPLYAANHMQPMWQDRETVQQFQQQLAELAMSGVQPQFTQWVKMLTDPALSEAGRDAVLSDAMLGYLQFVSAIGANGNNWLYSNIPYKLGLPPTAVINQWQLAVRQARTLSYVNSLAPQHPQYAKMHQALRDMLADNRPWPQVGSGPSLRPGQMSNDIPALREILTRT

SEQ ID NO: 162208 - protein, 131 aa, Glycine max
  Coding DNA Sequence Number=SeqID_70523
MAANATYECVKIHEEVQYMNNQRQGNYQNYNNQGYKPHPSKGVFPMPCLGRTSMKSKRGHATYECVKVHEEMQCMNNHRQGSYKNYNNQGYRPHPSIGEEQRSISNVMPRENLYENTSKLEKTLTQLMQIF

SEQ ID NO: 162209 - protein, 90 aa, Glycine max
  Coding DNA Sequence Number=SeqID_70524
EETEETLVRQVVAATPERSIEATSEPSALVVNLPSPQPAADPSTPLLQMLEDPTTPVLAMDTSPRTTPVLQLTHKEDSQTQDTQDQSQEF

SEQ ID NO: 162210 - protein, 66 aa, Glycine max
  Coding DNA Sequence Number=SeqID_70525
  Subcellular localization annotation: CTP_CleavageSite=9; ConfidenceScore=5.44e-01
MPDPGPMTRAFNNNNNNNKNNNNNKNKINNNKNKNNNKNKNKNKNKNNNNKNKNKNNNNNNNIQGI

SEQ ID NO: 162211 - protein, 69 aa, Glycine max
  Coding DNA Sequence Number=SeqID_70526
MQKKLSNFAANLPIMQKKNGCAVLIFAVTGKGSFMTNGIELFGYCESLAGLMGTQAERNEEKATCVHVS

SEQ ID NO: 162212 - protein, 68 aa, Glycine max
  Coding DNA Sequence Number=SeqID_70527
MSTPTNVQDEQSLIERSWKLTLKSAASPHQLDLAPYASGSYSAQWNAPGLLHDMHMLRSSRILRKMEV

SEQ ID NO: 162213 - protein, 118 aa, Glycine max
  Coding DNA Sequence Number=SeqID_70528
MKAYMEAMKEKMTIMMEAMMSVRKMMEVNTATVVAASTAIEVDPTHPSGLNQVNRPVSNMVGPEQAFLPTCGLPPNYTPPNVAHTPDENVDKSTPIPFETEQPQSSHAQVPQPMRKDT

SEQ ID NO: 162214 - protein, 181 aa, Glycine max
  Coding DNA Sequence Number=SeqID_70529
  Homolog annotation: Hit_ID=A5AJ42; Match level="QueryCoverage=24%, HitCoverage=4%, E-value=7e-10, Identity=70%"; Hit description =Putative uncharacterized protein
MVIGSRTQGAPAFSGRYSAEVIHAILPGKARTTFNKWVPVPETDTGVPPHKGGRSDQARATVYQKHRSPQSREPTTEAPVNGGRNYNGPKVAKFLVGAKKASFLGGPEPSVRYHSGRARILTLCQDLRAEGQSQASQKVTEACKGFLGPDGDWPSSAKAEGSLTARPTRRAGTKVGLSDPT

SEQ ID NO: 162215 - protein, 211 aa, Glycine max
  Coding DNA Sequence Number=SeqID_70530
  Homolog annotation: Hit_ID=UPI00006A2939; Match level="QueryCoverage =74%, HitCoverage=75%, E-value=8e-10, Identity=28%"; Hit description =UPI00006A2939 related cluster
AHLGGEAFSSMAYSLKGWRLLSPLFLCLPLHLHGGKSPLKNPIKAQRSSLHRSPTSKLPSSGNQSTRELHALAFKGLHVLAIRGLHAITFRGLHVLGIRGLHVLTVKELHALTFRGLHVLTSRGLHTLTFAGLHVFAICGLHLLAIRGQDVLAIEAARRRHQRLHTLSIRGYTSSPSEGYTPSPLEDYTSSPLEDYTSSPLEDYTSSPSEA

SEQ ID NO: 162216 - protein, 369 aa, Glycine max
  Coding DNA Sequence Number=SeqID_70531
MAAVQLIGQRLADGDQQAAAHALQGAPADQRADAVGVAGAEGAQHEQRQRQQEHPPPTDALRQPGAERDHQRQAENIAVADPRQLADRRPHRLADGGVGDVGDKHIDQIDEKAEQIDDCHFAAIRHGASAGERAGGVTAGAQHPAAVADRRRRTLLPAQPATAAGGGKRAGRRAPRSPRAERRAAHHQYAGVWRAGGGAGAGGVFAAASAAAHPASGGFQPPRGADRQFRHFSGGVAGLPGRATDSFADRAGAGAVDRPQPAQFAAQLAGGHAAARSGAVQGGGRCDAHRRQRRGIAGIRPAWRRGGAAAGVAGAARNRRRPAAAVAAGSPFPRAEHLRALPEYPPRAGKGAGVYRFSTHAGGGQPLAK

SEQ ID NO: 162217 - protein, 219 aa, Glycine max
  Coding DNA Sequence Number=SeqID_70532
PGPPSGPGGGPPMQVQPEEEAIVQLLCIPGQDFTRAAAKKQVRIMRTNMTTITQIWMTLLLSNILPSDRNADLPLQKDRAHKTPSGPGEVQQGPRVSNFGYGPLSVLQGIVPTRHPVDPEKSNRVLGFPALITSLCQFYGVLVTPSKVIKTPINRAFMKKYCAPQTGAGRDTTAAWGWPAAGNKCTPVTSRVHLSSSTKRLECCLRPVVDQQATKSKVK

SEQ ID NO: 162218 - protein, 99 aa, Glycine max
  Coding DNA Sequence Number=SeqID_70533
MTNYYPPDLPPSIGVPRGSQGAVLKKVLHRIAVQSSNFLDPGIKFPPQRHYFMTREKMVGCRFNLTLAEGAEVILKDNLPPNKVFLRWKPIPEKSPSKS

SEQ ID NO: 162219 - protein, 223 aa, Glycine max
  Coding DNA Sequence Number=SeqID_70534
  Homolog annotation: Hit_ID=Q6WAY6; Match level="QueryCoverage=95%, HitCoverage=37%, E-value=4e-22, Identity=31%"; Hit description =Putative uncharacterized protein
MGSNQTPLLKKRFYQVKIKSLEVTSLRELGQLMGQLQRKAFHKAYGKIWDLAMVEVSMEAIASLTQYYDQPLRCFTFEDFQLVLTMEEFEEILGCPLGGRKRYLFSGFYPSMARVAKVVKISAQELDRVKQNRNGVVGVPRRCLEEKAKAMANQSEWASFIDILALLIFGVILFPNVEGLVDLAAIDAFLAFHHSKEIPVVTILADMYDMFDRRCEKSSARIV

SEQ ID NO: 162220 - protein, 78 aa, Glycine max
  Coding DNA Sequence Number=SeqID_70535
MVPSGVANCRSLPFGGRATRGLMGASSKKEKCAESPPTFIRGKRRKNRKGINETLGLIRILVMDLKRANKAVLTLVNF

SEQ ID NO: 162221 - protein, 286 aa, Glycine max
  Coding DNA Sequence Number=SeqID_70536
  Gene Ontology: Mol. function=receptor activity; Cellular component =plasma membrane; Biological process=amino acid transport
  Homolog annotation: Hit_ID=A6TAH5; Match level="QueryCoverage=82%, HitCoverage=88%, E-value=7e-89, Identity=69%"; Hit description =Putative outer membrane lipoprotein
  Pfam annotation: Domain name=Lipoprotein_9; Domain location=21-256; Score=360.7; E_value=2.5e-105; Accession=PF03180.5; Description=NLPA lipoprotein
MKKTWLTALLAASVTLLSALAINTGPDEALWQTVKQVAHDKYQLDVDVVAFNDYVQPNEALFNKDVDANAFQSLPYLEMQSKERGYKFAVVTNTFVFPIAGYSRKIKSLQDLPDGATVTVSNEATTLGRSLLLLQAQGLLKVKPEAGLLPTTLDITDNPKKLKIVEVDTPQLARTLDDPQVYLSIINNNFAALVNLSASRDGMFMEGKASPYVNAIVAREDNKDSPNVQKLKEAFQSQPVLDKANEIYKGDIIKGWMVVPKYNAARIVAAQFIAHSGSCAVFHSAR

SEQ ID NO: 162222 - protein, 239 aa, Glycine max
  Coding DNA Sequence Number=SeqID_70537
MLMPRPPSFTMQLCLSESKHVPRLSSSERQSGIPILQGKRIPSTEPPNREKLRVLGNQTILKIGGQTQLRPKKLHRFERHPAIDAEHEQLPQVSNQEGLHLGSGMGLLLGQAEGPGREGDGRGRAGDAEEGGMLLHEAHEGPFADEAHVLLEVAEEEGLGLGLDEGAEVENHGWLLAELHYSVKFGHSVVRFLLRPSSAARFLPYGETSVFRVAERNAVAKHRTETQDLLVRCIICDQS

SEQ ID NO: 162223 - protein, 152 aa, Glycine max
  Coding DNA Sequence Number=SeqID_70538
  Homolog annotation: Hit_ID=A2Q1D6; Match level="QueryCoverage=75%, HitCoverage=18%, E-value=1e-14, Identity=39%"; Hit description =Ovarian tumour, otubain, related
  Pfam annotation: Domain name=AFT; Domain location=45-141; Score= -44.8; E_value=0.042; Accession=PF08731.2; Description=Transcription factor AFT
  Pfam annotation: Domain name=FAR1; Domain location=59-143; Score= -14.4; E_value=0.0022; Accession=PF03101.6; Description=FAR1 family
  Pfam module annotation: Pfam domain module=AFT::FAR1; Domain location= 45-141::59-143
MDEDQWIYDGIMSEEVDMNEQNEDEVVVNEEHVDCFDAFNTSQVFATQDDVLHWTRSVAYEIGFVAIIMRSNTNTGMRGRTSFVLIGYEKSGQYRSRKKDFVRRDIGSRKCGCPFKLCGKPVVGDQGWMVKLMCENHNHEMTKSLVGHPYVG

SEQ ID NO: 162224 - protein, 1039 aa, Glycine max
  Coding DNA Sequence Number=SeqID_70539
  Gene Ontology: Mol. function=nucleotide binding; Cellular component =intrinsic to membrane; Biological process=defense response
  Homolog annotation: Hit_ID=Q2HVE0; Match level="QueryCoverage=78%, HitCoverage=94%, E-value=1e-131, Identity=34%"; Hit description =Leucine-rich repeat; Leucine-rich
  Pfam annotation: Domain name=LRR_1; Domain location=602-623; Score =3.1; E_value=83; Accession=PF00560.24; Description=Leucine Rich Repeat
  Pfam annotation: Domain name=LRR_1; Domain location=625-646; Score =2.9; E_value=90; Accession=PF00560.24; Description=Leucine Rich Repeat
  Pfam annotation: Domain name=LRR_1; Domain location=648-670; Score =9.2; E_value=6; Accession=PF00560.24; Description=Leucine Rich Repeat
  Pfam annotation: Domain name=LRR_1; Domain location=672-691; Score =5.0; E_value=36; Accession=PF00560.24; Description=Leucine Rich Repeat
  Pfam annotation: Domain name=LRR_1; Domain location=695-717; Score =6.3; E_value=21; Accession=PF00560.24; Description=Leucine Rich Repeat
  Pfam annotation: Domain name=LRR_1; Domain location=739-760; Score =11.2; E_value=2.6; Accession=PF00560.24; Description=Leucine Rich Repeat
  Pfam annotation: Domain name=LRR_1; Domain location=762-781; Score =8.7; E_value=7.5; Accession=PF00560.24; Description=Leucine Rich Repeat
  Pfam annotation: Domain name=LRR_1; Domain location=783-808; Score =5.0; E_value=36; Accession=PF00560.24; Description=Leucine Rich Repeat
  Pfam annotation: Domain name=LRR_3; Domain location=602-621; Score =31.4; E_value=3.3e-06; Accession=PF07725.3; Description=Leucine Rich Repeat
  Pfam annotation: Domain name=NB-ARC; Domain location=210-451; Score =28.3; E_value=4.5e-12; Accession=PF00931.13; Description=NB-ARC domain
  Pfam annotation: Domain name=TIR; Domain location=55-185; Score =158.6; E_value=1.6e-44; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_3::NB-ARC::TIR; Domain location =602-623::625-646::648-670::672-691::695-717::739-760::762-781::783 -808::602-621::210-451::55-185
MPYSYSFRVVSHTIIKHVLVCLLLAIAKIDNNNSSNPVTCFTCRPNDTPQIKYDVFVSFSGADIRQDFLSHLVEGFYRRQIHAFVDYKILKGDQLSEALLDAIEGSLISLIIFSENYASSHWCLFELVKIVECRKKDGQILLPIFYKVDPSNVRYQKGTYGDAFAKHEVRHNLTTMQTWRSALNESANLSGFHSSTFRDEAELVKEIVKCVSLRLNHVHQVNSKGLVGVGKRIAHVESLLQLEATDVRVIGIWGMGGIGEEDLKIDTPNGLPQYVERRLRRIKVLIILDDVNDSEQLEILAGTRDWFGLGSRIIITTRDKQVLAKESANIYEVETLNFDESLRLFNLNAFKEVHLEREYHELSKKVVNYAQGIPLVLKVLGHLLHGKEKEIWESQLERLKKVQSKKVHDIIKLSYNDLDQDEKKIFLDIACFFDGLNLKVNKIKILLKDHDYSVAAGLERLKDKALISVSQENIVTMHNIIQETAWQIARQESIEDPRSQSRLLDPDDVYLVLKYNKGNEAIRSIVINLSGIKQLQLNPQVFAKMSKLYFLDFYNKGSCSCLREQGGLYLPQGLESLSNELRYLRWTHYPLESLPSKFSAENLVELNLPYSRVKKLWQAVPDLVNMRILILHSSTQLKELPDLSKATNLKVMDLRFCVGLTSVHPSVFSLKKLEKLYLGGCFSLRSLRSNIHLDSLRYLSLYGCMSLKYFSVTSKNMVRLNLELTSIKQLPSSIGLQSKLEKLRLAYTYIENLPTSIKHLTKLRHLDVRHCRELRTLPELPPSLETLDARGCVSLETVMFPSTAGEQLKENKKRVAFWNCLKLDEHSLKAIELNAQINMMKFAHQHLSTFGDAHQGTYVYPGSKVPEWLVHKTIQRDYVTIDLSFVLAPHSSDHLGFIFGFVVPEVPNEGLVLEFKISTGGEGEGSNINVYLDRPRHGIKSDHVYLMYDQACSRYLNSRAKHHPRLKIKVTVASRTHTSKYVPLQLRGFGVSTINTTQYLSFVRKVELGDELLPGIREDAEAGTLPANVVAGMEGFYNI

SEQ ID NO: 162225 - protein, 348 aa, Glycine max
  Coding DNA Sequence Number=SeqID_70540
  Gene Ontology: Mol. function=transcription factor activity; Cellular component=nucleus; Biological process=regulation of transcription, DNA-dependent
  Homolog annotation: Hit_ID=Q93ZH2; Match level="QueryCoverage=81%, HitCoverage=81%, E-value=5e-53, Identity=45%"; Hit description =Nuclear transcription factor Y subunit A-3
  Pfam annotation: Domain name=CBFB_NFYA; Domain location=182-238; Score=137.5; E_value=3.8e-38; Accession=PF02045.6; Description=CCAAT- binding transcription factor (CBF-BNF-YA) subunit B
  Subcellular localization annotation: CTP_CleavageSite=27; ConfidenceScore=5.07e-01
MKNLCENGSGPTHLTSYALGCSSWGTSSESDVQQSSMSKSLSLKMSVLPQQCHKTKPLSFQYQDRDSSSTQSTGQSYPEVGSAQSGQISVQCSNSSASSTHNTTGGKSVEGVIGSTVGIQDCTFPPSQLCYNQSLAHTAFHFAEPCFSGLLAAPFVPQSNIHHAQLLGMTPARIPLPLDLSEEPMYVNAKQYHAILRRRQYRAKLEAQNKLIKERKPYLHESRHLHALKRARGSGGRFLNAKKLQELKLTSANRGLDVSGCTQLNLSGNMSESKVQAVENLNYRNGASTTTCSDVISTSNSDDVFQQHESDFRLCGYPSHIGRNMQGYSADIGGGGGGGNQHRLSVLM

SEQ ID NO: 162226 - protein, 368 aa, Glycine max
  Coding DNA Sequence Number=SeqID_70541
  Gene Ontology: Mol. function=metal ion binding
  Homolog annotation: Hit_ID=A7P6K9; Match level="QueryCoverage=100%, HitCoverage=100%, E-value=1e-159, Identity=77%"; Hit description =Chromosome chr9 scaffold_7, whole genome shotgun sequence
  Pfam annotation: Domain name=DZC; Domain location=156-191; Score =84.5; E_value=3.4e-22; Accession=PF08381.2; Description=Disease resistancezinc fingerchromo
  Pfam annotation: Domain name=DZC; Domain location=332-367; Score =81.5; E_value=2.6e-21; Accession=PF08381.2; Description=Disease resistancezinc fingerchromo
  Pfam module annotation: Pfam domain module=DZC::DZC; Domain location =156-191::332-367
MLTCIACTKQLNNGSLRQEEGEEAVHTPSTKQAIKALTSQIKDMAVKASGAYKSCRPCSGSSNGNRNRKYADSDMGSDSARFNWAYRRTGSSNSTPRMWGKEVENGRVKGLSSGEGTPASVSGRTESVVFMEEDEPKEWIAQVEPGVLITFVSLPQGGNDLKRIRFSREMFNKWQAQRWWAENYDKVMELYNVQRFNQQAVPLPTPPRSEDESSKIESARDSPATPPLSKERAPRHFHHPMGMGYSSSDSLDRHQMQPHPCYETSGLASTPNLSNISAPKTERSSLDGSVRTSSSGEDHSGEFSISNASDMETEWVEQDEPGVYITIRALPGGTRELRRVRFSRERFGEMHARLWWEENRARIQEQYL

SEQ ID NO: 162227 - protein, 129 aa, Glycine max
  Coding DNA Sequence Number=SeqID_70542
MMSNSKQEKKWWEKVMNSIGNWMAHKKKDEWLKDMRGNLSLLATVIATMTFQSAINPPGGIRPASETGEITCPDIQAKTLRMFGLVIFIWIILLGIVAIFLSLRLVVWIVTKRRIEKRTEQGDRRSKPK

SEQ ID NO: 162228 - protein, 259 aa, Glycine max
  Coding DNA Sequence Number=SeqID_70543
  Gene Ontology: Mol. function=membrane alanyl aminopeptidase activity; Biological process=proteolysis
  Homolog annotation: Hit_ID=A7P6P0; Match level="QueryCoverage=88%, HitCoverage=31%, E-value=1e-59, Identity=45%"; Hit description =Chromosome chr9 scaffold_7, whole genome shotgun sequence
MKASLQFDCGKPYNITACGQQINLACFSTGILDDGNALCQACEQSLSSLLMLKDVYRKEIDYVIVSKLIDVCYDVLKITTDAIPDSVNELKQYFISLLMCSAEQLGWDSISGEDHSISLLRGEVFQALATFDHAKTQQDALCRFQILLDGRNTSLLPANIRRVAYIAVMRNTTTENRTGLESLLSFYRSTDVLLEREKYYDNWERILARYGAGLLLTNFISQMFPLVNSDEKADEIEEFFASHMNHSIIMNLKLSIEQI

SEQ ID NO: 162229 - protein, 466 aa, Glycine max
  Coding DNA Sequence Number=SeqID_70544
  Gene Ontology: Mol. function=nucleoside-triphosphatase activity; Cellular component=intracellular; Biological process=regulation of transcription, DNA-dependent
  Homolog annotation: Hit_ID=A7P6L7; Match level="QueryCoverage=82%, HitCoverage=19%, E-value=3e-63, Identity=50%"; Hit description =Chromosome chr9 scaffold_7, whole genome shotgun sequence
  Pfam annotation: Domain name=AAA_5; Domain location=277-438; Score= -15.0; E_value=0.039; Accession=PF07728.5; Description=ATPase family associated with various
MAIDGSFSLHSSLRRFLDRCPKLQCFPPLESLERMGDLVTEEEVVNVLVGVFLHPSYTIPLIGCFRPIAQHIVDKAVALLRLVPNLMSIPKDTAREDDRDRVLDGVVNVIEFYSQQGRGLDLHELACLAFCRALDMGPFLLSWEEFCQDTSLEKAGWYVKPIADIMSDSLDKRMDFKNGNCLKSFGLNNQLVSSPKLLELQPRFKSQLLTTRDDVSVSNTFVFTSAVKRSYDRVLLAVSQKWPVLLYGPSGSGKSALIAKLAQDSGNQGGCFTLDISVVVVGLIGPLVLDLLQTWLLGLSWGQTQILRVLSIQMDDQIDGRTLVGSYVCADRPGEFRWQAGSLTQAVQNGLWIVFEDINKAPSDLHSILMPLLEGAGSFATGHGENKDDPNSNRFDYRRKGFMKIKTMNLMKSLGYQSSFEPVNGTISIFLYPENPFTANSLPIRSMWLGKKMVTAFKNGNAGGFP

SEQ ID NO: 162230 - protein, 71 aa, Glycine max
  Coding DNA Sequence Number=SeqID_70545
MDRSGLLGGKGYIFWVICSYADILKKKKRGGKEFKVEEVVGGKNSMVVLERVLQGDVLDNVGDERMVVTGT

SEQ ID NO: 162231 - protein, 224 aa, Glycine max
  Coding DNA Sequence Number=SeqID_70546
  Gene Ontology: Mol. function=RNA-directed DNA polymerase activity; Biological process=RNA-dependent DNA replication
  Homolog annotation: Hit_ID=A5BLS7; Match level="QueryCoverage=43%, HitCoverage=19%, E-value=1e-10, Identity=40%"; Hit description =Putative uncharacterized protein
MLFFENQVTQYTYLWREGVPKKVVDKLVRLQRSFLWGEGEGQRKLAWVKWDTICLPKEKGGLGVLESKYGGWRNLDEARRYHKESIWWRDLSFMCSSEEEGGWLNEGVKWKIGCGSRQHHTIQQMGVEVGESWEWNFEWQRLILEGEMELAASFMEDRGVEVVADENEDGALTLIWKMKIPSKVAHFVWRLEEASQTFFGRQRIMPLWWESLAWTEVVTVPCIT

SEQ ID NO: 162232 - protein, 499 aa, Glycine max
  Coding DNA Sequence Number=SeqID_70547
  Gene Ontology: Mol. function=protein transporter activity; Cellular component=cytoplasmic vesicle; Biological process=intracellular protein transport
  Homolog annotation: Hit_ID=A7P7E9; Match level="QueryCoverage=98%, HitCoverage=46%, E-value=0.0, Identity=81%"; Hit description =Chromosome chr9 scaffold_7, whole genome shotgun sequence
  Pfam annotation: Domain name=Coatomer_WDAD; Domain location=1-366; Score=524.9; E_value=9.3e-155; Accession=PF04053.5; Description =Coatomer WD associated region
MKFCIFQEKKSIRPTFSAERIFGGTVLAMCSNDFICFYDWAECRLIRRIDVNVKNLYWADSGDLVTIASDTSFYILKYNHDVVASYLDSGGPVDEQGVEDAFELLHEMNERVRTGIWVGDCFIYSNSSWRLNYCVGGEVTTMFHLDRPMYLLGYLASQSKVYLIDKEFNVVGYTLLLSLIEYKTLVMRGDLERANEILPSIPKEYHNSVARFLESRGMIEDALEVATDPDYRFDLAIQLGRLEVAKGIASEVQSESKWKQLGELAMSTGKLEMAEECLKHATDLSGLLLLYSSLGDAEGISKLATLAKEQGKNNVAFLCLFMLGKLEDCLQLLVESNRIPEAALMARSYLPSKVSEIVAIWRKDLSKVNPKAAESLADPEEYPNLFDDWQVALAVESKATEARGVYPPASEYVNQADKSHITLVEAFRNMQIEEGDQPLENGDSNHELTEQNGEEHYTEEHEEHEEQNGEEGSQEEAVVVDADSTDGAVLVNGNEADEE

SEQ ID NO: 162233 - protein, 213 aa, Glycine max
  Coding DNA Sequence Number=SeqID_70548
  Gene Ontology: Cellular component=integral to membrane
  Homolog annotation: Hit_ID=A5AQS9; Match level="QueryCoverage=33%, HitCoverage=40%, E-value=2e-14, Identity=53%"; Hit description =Putative uncharacterized protein
MRQQYGLKGNGCTDCLLHCCCESCTLSQEYRELKQRGFDMIIGMVAWKCRATKSEVAMTAATAPLVEKGMSCAGKSKGFKDGLDEDGHAPSSPTEVKHSVEPLNTRRRGEEDDGLIHHDSDSKSPTNCPVSVLCGPDSGTNFTGSSSGGSSSSNNNSSNSGGCCSGNVTEVEVEGDEGPLKCDLALSKPYGFSEYDIDHAISARFTLSMPSGF

SEQ ID NO: 162234 - protein, 518 aa, Glycine max
  Coding DNA Sequence Number=SeqID_70549
  Gene Ontology: Mol. function=RNA-directed DNA polymerase activity; Cellular component=exocyst; Biological process=exocytosis
  Homolog annotation: Hit_ID=A7P6G0; Match level="QueryCoverage=88%, HitCoverage=75%, E-value=0.0, Identity=80%"; Hit description =Chromosome chr9 scaffold_7, whole genome shotgun sequence
  Pfam annotation: Domain name=Exo70; Domain location=1-505; Score =598.5; E_value=6.4e-177; Accession=PF03081.6; Description=Exo70 exocyst complex subunit
MESLPLETAEKIILRWDSTASEEARDKMIFSGGVTALLPLFRSSVNSVNSSSYRSTSSIREIDLIPSDAVYDLRCIAERMVSSGYLRECIQVYGSVRKSSVDASFRKLQIEKLSIGDVQRLEWEQLENKIRRWIRAAKVCVRTLFASEKKLCEQIFDGVGTSIDDACFMETVKGPAIQLFNFAEAISISRRSPEKLFKILDLHDALTDLMPDIDVVFDSKSSESIRVQAAEILSRLGEAARGILSEFENAVLREPSRVAVPGGTIHPLTRYVMNYISLISDYKVTLNELIVSKPSTGSRYSGDPGIPDMDLSEFEEKTPLDVHLIWIIVILQFNLDGKSKHYRDASLAHLFVMNNVHYIVQKVRGSPELREMIGDDYLKKLTGKFRQAATSYQRATWVRVLYCLRDEGLHVSGGFSSGVSKSALRERFKAFNAMFEEVHRTQAVWLIPDLQLREELRISISEKLIPAYRSFLGRFRSHIESGRHPENYIKYSVEDLEDAVLDFFEGIPVSQHLRRRAE

SEQ ID NO: 162235 - protein, 294 aa, Glycine max
  Coding DNA Sequence Number=SeqID_70550
  Gene Ontology: Mol. function=RNA splicing factor activity, transesterification mechanism; Cellular component=ribonucleoprotein complex; Biological process=mRNA metabolic process
  Homolog annotation: Hit_ID=A7P6G3; Match level="QueryCoverage=72%, HitCoverage=83%, E-value=3e-68, Identity=59%"; Hit description =Chromosome chr9 scaffold_7, whole genome shotgun sequence
METRIGKEVMPREEFSDWPHGLLAIGTFGNKSEIKEDLDDQNTQEDPSSSEEIADFTPEEIGNLQKELTKLLRRKPNVEKEISELPLDRFLNCPSSLEVDRRISNALCSESEDKEEDIEKTLSVIIDKCKDICADKRKKAIGKKSISFLLKKIFVCRSGFAPTPSLRDTLQESRMEKGIEDKKMTRKRNEDESDERNGDGCKWVKTDSESNAVLEGACERVIVGDLYCDIPLGLYVIRGENVVLIGELDLEREELPEHMTRVSTAEIKRAQKAEREASDLKGTMRKRMEFLDFD

SEQ ID NO: 162236 - protein, 187 aa, Glycine max
  Coding DNA Sequence Number=SeqID_70551
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=45%, HitCoverage=71%, E-value=2e-24, Identity=69%"; Hit description=LacZ protein
MTASDLRLSSEATATSEGEGEEKEKEKEKGKGEEDSEEEGDGGLEGKKEKRGRRNKESKKKKTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 162237 - protein, 152 aa, Glycine max
  Coding DNA Sequence Number=SeqID_70552
  Gene Ontology: Mol. function=oxidoreductase activity
  Homolog annotation: Hit_ID=Q2HRI0; Match level="QueryCoverage=40%, HitCoverage=18%, E-value=4e-11, Identity=54%"; Hit description =Immunoglobulin/major histocompatibility complex; 2OG-Fe(II) oxygenase
MESGLILVFMFLILASDAFKVWSNDRIHCCEHRVMIINAKKERYSMGLFSLGGKMVQTPEELVDEIININYATSEEQWWGFSLFCSSSIARSSDCDAMSERIEGKLCANAALPTKRSFFCILKLQDSIISKTLQRFTTFRRWPRLRKKDEQE

SEQ ID NO: 162238 - protein, 1030 aa, Glycine max
  Coding DNA Sequence Number=SeqID_70553
  Gene Ontology: Mol. function=catalytic activity; Cellular component =nucleus; Biological process=metabolic process
  Homolog annotation: Hit_ID=A7P7N4; Match level="QueryCoverage=75%, HitCoverage=89%, E-value=0.0, Identity=56%"; Hit description =Chromosome chr9 scaffold_7, whole genome shotgun sequence
  Pfam annotation: Domain name=PPR; Domain location=173-207; Score =49.0; E_value=1.7e-11; Accession=PF01535.11; Description=PPR repeat
  Pfam annotation: Domain name=PPR; Domain location=274-308; Score =34.0; E_value=5.3e-07; Accession=PF01535.11; Description=PPR repeat
  Pfam annotation: Domain name=PPR; Domain location=375-409; Score =40.8; E_value=5e-09; Accession=PF01535.11; Description=PPR repeat
  Pfam annotation: Domain name=PPR; Domain location=476-509; Score =22.5; E_value=0.0016; Accession=PF01535.11; Description=PPR repeat
  Pfam annotation: Domain name=PPR; Domain location=510-544; Score=1.0; E_value=5.9; Accession=PF01535.11; Description=PPR repeat
  Pfam annotation: Domain name=PPR; Domain location=575-609; Score =38.7; E_value=2e-08; Accession=PF01535.11; Description=PPR repeat
  Pfam annotation: Domain name=PPR; Domain location=610-644; Score =19.2; E_value=0.016; Accession=PF01535.11; Description=PPR repeat
  Pfam annotation: Domain name=PPR; Domain location=646-679; Score=9.3; E_value=0.62; Accession=PF01535.11; Description=PPR repeat
  Pfam annotation: Domain name=PPR; Domain location=712-746; Score =14.2; E_value=0.16; Accession=PF01535.11; Description=PPR repeat
  Pfam annotation: Domain name=PPR; Domain location=72-106; Score=4.9; E_value=2; Accession=PF01535.11; Description=PPR repeat
  Pfam module annotation: Pfam domain module=PPR::PPR::PPR::PPR::PPR::PP R::PPR::PPR::PPR::PPR; Domain location=173-207::274-308::375-409::476- 509::510-544::575-609::610-644::646-679::712-746::72-106
  Subcellular localization annotation: CTP_CleavageSite=13; ConfidenceScore=5.71e-01
MAAFAKPSHSQLRAQRDHPLLPSTSTSTSSNFKLKTFTFSHNLHTLHPPFRKAKHICVSNSATTTTSLSSNHNPNSHIYQLCLLGNLDRAMSYLDSMHELRIPVEDDAYVALIRLCEWKRARKEGSRVYSYVSISMSHLSLQLGNALLSMFVRFGNLVDAWYVFGRMEKRNLFSWNVLVGGYAKAGLFDEALDLYHRMLWVGVKPDVYTFPCVLRTCGGMPNLVRGREIHVHVIRYGFESDVDVVNALITMYVKCGDVNTARLVFDKMPNRDRISWNAMISGYFENGVCLEGLRLFGMMIKYPVDPDLMTMTSVITACELLGDDRLGRQIHGYVLRTEFGRDPSIHNSLIPMYSSVGLIEEAETVFSRTECRDVVSWTAMISGYENCLMPQKALETYKMMEAEGIMPDEITIAIVLSACSCLCNLDMGMNLHEVAKQKGLVSYSIVANSLIDMYAKCKCIDKALEIFHSTLEKNIVSWTSIILGLRINNRCFEALFFFREMIRRLKPNSVTLVCVLSACARIGALTCGKEIHAHALRTGVSFDGFMPNAILDMYVRCGRMEYAWKQFFSVDHEVTSWNILLTGYAERGKGAHATELFQRMVESNVSPNEVTFISILCACSRSGMVAEGLEYFNSMKYKYSIMPNLKHYACVVDLLGRSGKLEEAYEFIQKMPMKPDPAVWGALLNSCRIHHHVELGELAAENIFQDDTTSVGYYILLSNLYADNGKWDKVAEVRKMMRQNGLIVDPGCSWVEVKGTVHAFLSSDNFHPQIKEINALLERFYKKMKEAGVEGPESSHMDIMEASKADIFCGHSERLAIVFGLINSGPGMPIWVTKNLYMCQSCHNIVKFISREASALARMKLIGASLISRKTRCNSANSVIAVCKLSGDLFPEREASAMHVSVSVGLMNFVGCWFGAMPCTSGGLAGQYRILGQFPIEILGVLLLFAGIELAMAAKDMLVCEAVSLTGSSGALGFFVGIVLGVMRAPGFLPNYDAMDCWRAVGLGNIRTWLKILRTSQSIIQCFGIWMYSL

SEQ ID NO: 162239 - protein, 486 aa, Glycine max
  Coding DNA Sequence Number=SeqID_70554
  Homolog annotation: Hit_ID=A2WT83; Match level="QueryCoverage=78%, HitCoverage=64%, E-value=8e-53, Identity=34%"; Hit description =Putative uncharacterized protein
MVKDKLKKHVLTAFTPNEDSVAILSANEVAKGTSLLALSTIDGSVIAVDVSTGERKLTTSHPGGICGLSFANKGRLLRIVGHNGVAYEVNTETGEVLKEFKISKKSITSLAFSNDEKYLAIVSSRLRIISWEIGKEILKFPNDLGNVQLISISSDAKNLVTSDFEGKHLQVWKCDLNSGNVGRVTGRGSAYIWNLNASSEDQIQPTKLNTKTKIVETEKENGVSSKKRHASIIASRLQPVEEDKQIKALVTYGSVDHPQFSVLNISNSGENIVLYVGDETDSVQQHDSPSGKAAIPMESKKVKKRQATSDPDPPTSTDEEDLDQHEAAEGVLLDDDLNEPTMGEKLASLSLLDENKSRSEIEQESSVPAKPPSADSVHVLLKQALNADDRTLLLDCLYTQDEKLIESRVSTFKSAIQLSSCLDTLHIGAIDEEEDEGEMVPVIYEDKDSSDEESDDTMETDPDEQQPEEQFHAARYIDASDDDMSD

SEQ ID NO: 162240 - protein, 658 aa, Glycine max
  Coding DNA Sequence Number=SeqID_70555
  Gene Ontology: Mol. function=triacylglycerol lipase activity; Cellular component=integral to membrane; Biological process=lipid metabolic process
  Homolog annotation: Hit_ID=A7P6G7; Match level="QueryCoverage=97%, HitCoverage=96%, E-value=0.0, Identity=64%"; Hit description =Chromosome chr9 scaffold_7, whole genome shotgun sequence
  Pfam annotation: Domain name=Lipase3_N; Domain location=43-130; Score= 78.6; E_value=2e-20; Accession=PF03893.7; Description=Lipase 3 N -terminal region
  Pfam annotation: Domain name=Lipase_3; Domain location=183-324; Score= 128.4; E_value=2.1e-35; Accession=PF01764.16; Description=Lipase (class 3)
  Pfam module annotation: Pfam domain module=Lipase3_N::Lipase_3; Domain location=43-130::183-324
MATAAGAAALLYYTLNRKLQTHDVIDEENGSDPPADTPLGIGRVSHRLIQAPATWLETISTLSETLRFTYSETLGKWPIGDLAFGISFLLKRQESNMAKGNYHVGSEFCGKDSVQLKGSEITAELKYLLNLLTLCWHFSKKPFPLFLEETGYTEENVLLREAKAGILKPAFTIIADHEMGCLLLLIRGTHSIKDTLTAVTGNVVPFHHTVVNQGGVSDLVLGYAHCGMVAAARWIAKLATPCLLEALGHYPDYKVKIVGHSLGGGTAAILTYVLRERKELSVTTCVTFAPAACMTWELAESGDSFITSIINGADLVPTFSAASVDDLRSEVTASAWINDLRNQIEQTRILSTVYRSASALGSRLPSIATARAKVAGAGAILQPVSNGTQVVMKRAKSMAQAAWARPNLNLSSWSCMGPRRRAMSAHYSRDGGNSPTSSSSTNIESSDPLLGSPTKAINAKNMNLPVSSSIEEWSSEIECGNESSSDTEVDVDHDDSLNMMDSDRYEDQMSEVELWHQLEHELYDGLEGEETDVAKEIREEEAAIAEEVGQTRSSAPKMKEIHRFFPPGKIMHIVTLHSDAAEHESDGSRTSASSESSELNETKIGIFLTSRSLYSKLRLSQRMISDHFMPVYRRQIERLIKEFEEESTEGHNTQEVVL

SEQ ID NO: 162241 - protein, 93 aa, Glycine max
  Coding DNA Sequence Number=SeqID_70556
MDGGGYNLTTTSLSSSMEQVMRPKSPLPGLVDFHGKRKQMVKIQVLEREIVFHGFAAPTVACCIRKQQKVVVGTAVLHQTPSVVTVVAAAAAA

SEQ ID NO: 162242 - protein, 119 aa, Glycine max
  Coding DNA Sequence Number=SeqID_70557
  Homolog annotation: Hit_ID=A7QIP3; Match level="QueryCoverage=37%, HitCoverage=34%, E-value=8e-13, Identity=72%"; Hit description =Chromosome chr9 scaffold_104, whole genome shotgun sequence
  Subcellular localization annotation: CTP_CleavageSite=51; ConfidenceScore=5.71e-01
MALVSVTTANSSKFILLRTLSRSHAFSFALHRQFQLLSSSSAVLRRLPRFLAASPGSPLPPSENDSSRHLEGADVATSLAKIQDRIQIFFAVLFWISLFFWASAWDGRNRPNKGSRFRR

SEQ ID NO: 162243 - protein, 111 aa, Glycine max
  Coding DNA Sequence Number=SeqID_70558
  Homolog annotation: Hit_ID=A0MDL4; Match level="QueryCoverage=57%, HitCoverage=57%, E-value=3e-07, Identity=35%"; Hit description =Putative uncharacterized protein
  Subcellular localization annotation: CTP_CleavageSite=38; ConfidenceScore=5.33e-01
MAPPAARSYPLHGLKLPITVLFVFFLSFLPSKSGGSVMVETREGLEQRKMVIGSKPPACVNKCKSCRPCMATLVVPNHQKRKGFKVSSRGDDDTYYLLSWKCKCGDKLFQP

SEQ ID NO: 162244 - protein, 125 aa, Glycine max
  Coding DNA Sequence Number=SeqID_70559
  Homolog annotation: Hit_ID=A7QIM2; Match level="QueryCoverage=79%, HitCoverage=40%, E-value=1e-44, Identity=86%"; Hit description =Chromosome chr9 scaffold_104, whole genome shotgun sequence
  Subcellular localization annotation: CTP_CleavageSite=44; ConfidenceScore=5.27e-01
MDQNLTNMQGFLGSGVDFPVGNVSFFLFFSGHVAGSVIASLDMRRMQRWELAWTFDVLNVLQAVRLLGTRGHYTIDLAVGVGAGILFDSLAGKYEDSKRNAALSTTHRAQFDCVNNVDIAKKINK

SEQ ID NO: 162245 - protein, 169 aa, Glycine max
  Coding DNA Sequence Number=SeqID_70560
  Gene Ontology: Mol. function=transcription coactivator activity; Cellular component=nucleus; Biological process=positive regulation of transcription
  Homolog annotation: Hit_ID=A7PW26; Match level="QueryCoverage=88%, HitCoverage=88%, E-value=2e-66, Identity=83%"; Hit description =Chromosome chr8 scaffold_34, whole genome shotgun sequence
  Pfam annotation: Domain name=MED7; Domain location=1-169; Score =273.1; E_value=5.7e-79; Accession=PF05983.2; Description=MED7 protein
MATATYPPPPPYYRLYKDYLQNPKSAPDPPPPIEGTYLCFGANYTTSDVLPTLEEQGVRQLYSKGPNVDFKKELRSLNGELQLHVLELADILIERPSQYARRVEEISTVFKNLHHLLNSLRPHQARATLIHILELQIQRRKQAVEDIKRNLVLWYHDSEMSLFYQFESL

SEQ ID NO: 162246 - protein, 398 aa, Glycine max
  Coding DNA Sequence Number=SeqID_70561
  Gene Ontology: Mol. function=diacylglycerol kinase activity; Cellular component=nucleus; Biological process=activation of protein kinase C
  Homolog annotation: Hit_ID=A7QIK1; Match level="QueryCoverage=100%, HitCoverage=87%, E-value=1e-167, Identity=56%"; Hit description =Chromosome chr9 scaffold_104, whole genome shotgun sequence
  Pfam annotation: Domain name=PPR; Domain location=164-198; Score=7.4; E_value=1; Accession=PF01535.11; Description=PPR repeat
  Pfam annotation: Domain name=PPR; Domain location=230-264; Score=2.7; E_value=3.7; Accession=PF01535.11; Description=PPR repeat
  Pfam annotation: Domain name=PPR; Domain location=97-131; Score=40.7; E_value=5.2e-09; Accession=PF01535.11; Description=PPR repeat
  Pfam module annotation: Pfam domain module=PPR::PPR::PPR; Domain location=164-198::230-264::97-131
MIDGYLRMNHFIGALALFREMQMSNVKPDEFTMVSILIACALLGALELGEWVKTCIDKNSNKNDSFVGNALVDMYFKCGNVRKAKKVFKEMYQKDKFTWTTMIVGLAINGHGEEALAMFSNMIEASVTPDEITYIGVLCACMVDKGKSFFTNMTMQHGIKPTVTHYGCMVDLLGCVGCLEEALEVIVNMPVKPNSIVWGSPLGACRVHKNVQLADMAAKQILELEPENGAVYVLLCNIYAASKKWENLCQVRKLMMERGIKKTPGCSLMELNGNVYEFVAGDQSHPQSKEIYAKLENMMQGLIKAGYSPDTSEVFLDLGEEDKETALYRHSEKLAIAYALISSGPGVTIRIVKNLRMCVDCHHMAKLVSQAYNRELIVKDKTRFHHFRHGSCSCNNFW

SEQ ID NO: 162247 - protein, 1708 aa, Glycine max
  Coding DNA Sequence Number=SeqID_70562
  Gene Ontology: Mol. function=binding; Cellular component=kinesin complex; Biological process=protein amino acid phosphorylation
  Homolog annotation: Hit_ID=A5BZB0; Match level="QueryCoverage=100%, HitCoverage=100%, E-value=0.0, Identity=58%"; Hit description =Putative uncharacterized protein
  Pfam annotation: Domain name=PAM2; Domain location=1432-1449; Score =9.1; E_value=0.35; Accession=PF07145.6; Description=Ataxin-2 C -terminal region
  Pfam annotation: Domain name=PAM2; Domain location=1521-1538; Score =14.1; E_value=0.057; Accession=PF07145.6; Description=Ataxin-2 C -terminal region
  Pfam annotation: Domain name=TPR_1; Domain location=1014-1047; Score =8.4; E_value=0.53; Accession=PF00515.19; Description=Tetratricopeptid e repeat
  Pfam annotation: Domain name=TPR_1; Domain location=930-963; Score =19.8; E_value=0.0099; Accession=PF00515.19; Description =Tetratricopeptide repeat
  Pfam annotation: Domain name=TPR_2; Domain location=1014-1047; Score =16.3; E_value=0.12; Accession=PF07719.8; Description=Tetratricopeptid e repeat
  Pfam annotation: Domain name=TPR_2; Domain location=888-921; Score =4.3; E_value=8.8; Accession=PF07719.8; Description=Tetratricopeptide repeat
  Pfam annotation: Domain name=TPR_2; Domain location=930-963; Score =24.6; E_value=0.00037; Accession=PF07719.8; Description =Tetratricopeptide repeat
  Pfam annotation: Domain name=TPR_2; Domain location=972-1005; Score =4.3; E_value=8.9; Accession=PF07719.8; Description=Tetratricopeptide repeat
  Pfam module annotation: Pfam domain module=PAM2::PAM2::TPR_1::TPR _1::TPR_2::TPR_2::TPR_2::TPR_2; Domain location=1432-1449::1521 -1538::1014-1047::930-963::1014-1047::888-921::930-963::972-1005
MPPRSGKGKSNKAKAEKKKKEEKAAAAPSLVDITVVTPYDTQIVLKGISTDKILDVRKLLAVKVETCHFTNYSLSHETKGQRLNDRVEVVTLKPCLLRMVEEDYTDEAQAIAHVRRVLDIVACTTRFGRPKRSVASSESRPKKNGKAQHQNQTSLSPPGTPNGESRVGSPSSEAPPSAILDNVGMKAIHPTPKLSDFYEFFSFSHLSPPILHLKRCEVKDEEDRRKGDYFQLQVKICNGKVIEVVGSEKGFYTVGKQSLHSHTLVDLLQQLSRAFATAYESLMKAFLERNKFGNLPYGFRANTWLVPPSVAESPSIFPALPAEDENWGGNGGGQGRNGEFELRPWATDFAILASLPCKTEEERVVRDRKAFLLHSQFVDTSIFKGVAAIQHAMESKLNTKNELNSYPDSVLHEDHVGDLSIIVKRDIQDGNAKYNSLLDESSMHKVDAQKNLLKGLTADESVIVHDMSSLAVVVVHHCGYTATVKVVGNVNTRKPKVRDIEIDDQPDGGANALNINSLRVLLHKSGAESLEGTLSSLSNSNDLDASKVLVRKVVQECMEKIKEEPSASERSIRWELGSCWIQHLQKQETSTDNSSKNKEDGNDLEQAVKGLGKQFKFLKRREKKSNNLDGADSREQNDSRLANMNDVADKVEPNNDDLSNSNELEKLLSEEAFLRLKESGTGLHTKSVDELISMAHKFYDEVALPKLAMDFGSLELSPVDGRTLTDFMHLRGLQMRSLGKVVKLAENLPHIQSLCIHEMITRAFKHLLKAVTASVDNVADLSAAIASTLNFLLGGSRTEDGADQILIDDHNLRIQWLHLFLSKRFGWTLNDEFQHLRKLSILRGLCHKVGLELFPRDYDMESSKPFGKNDIISLVPVCKHVGCSSLDGRNLLESSKIALDKGKLEDAVNYGTKALAKMMAVCGPFHQNTASAYSLLAVVLYHTGDFNQATIYQQKALDINERELGLDHPDTMKSYGDLSVFYYRLQHIELALKYVNRALFLLHFTCGLSHPNTAATYINVAMMEEAMGNVHVALRYLHEALKCNKRLLGADHIQTAASYHAIAIALSLMDAFSLSMQHEQTTLKILQAKLGSEDLRTQDAAAWLEYFESKAIEQQEATKNGTPKPDASIASKGHLSVSDLLDFISPNPKGNDARRKQRRTKILSTSDNNSQEHDEAIADETILFDNSKDALSMIQGKIEETNGKLDSQVQKQNGDFTGYRPVTSEPVYEASSDEGWQEANSKGRSGNAANRKFGHKKRHHLSKLSINGSNNYIYREGSSRNEITSPPQRGVPKVMLDMSSPSRQSKSRNLTLNEDSVNHSTKASVSKISSPASLSSLASKSISYKEVALAPPGTVLKPLLEKADMERVNAGDEICCNPAVTSISEGSCQSSITNTVCQHDETEETHENEPQQESSGSELEKVSDQAKSTAETNGSKLSAAAKPFNPGMLSMSHHLNSASFTSMYDTDVSQGMHVETVLPPAVARVPCGPRSPLYYRTNYTFRMKHGSTKGQTSIRERSGFGSPRIMNPHAPEFVPRNASQIEANDANSNVSNEHNSLSDIGMSEENKLDENFVEINGSSNKNSISESEKSEIARQILLSFLVKSVKENIDSVDESKDGEGKIEILESCSDEIAKDSAVINIMYGNEEKNKTVPHSSDSDEQEKLGVTEKKNGDGEGFIVVSKRRKNRQKITNGVTELYNQQSICASVR

SEQ ID NO: 162248 - protein, 288 aa, Glycine max
  Coding DNA Sequence Number=SeqID_70563
  Homolog annotation: Hit_ID=A7PIW0; Match level="QueryCoverage=85%, HitCoverage=54%, E-value=2e-64, Identity=52%"; Hit description =Chromosome chr13 scaffold_17, whole genome shotgun sequence
  Pfam annotation: Domain name=DUF247; Domain location=2-287; Score= -93.0; E_value=6.1e-06; Accession=PF03140.6; Description=Plant protein of unknown function
MEEYPTIQVSKSAHLLDFLYHMIVPNILEGQDTIEVEFKQGEEEEEGNEESNADFSQVKQLYSELWKRLSKLNKGPVKLIIVSRRFKVLKQPLEYLFSQNGGESENSSSNSSLKNKPPSVEEITVPSVTELLNSGVRFLPTNGSILNITFDAKTCTFYLPTIGLDANTEVFLKNLVAYEASVASGPLVVTRYTELMNGIIDSDEDAKILREKGIILNHLKSDKEVANLWSGMSKLLRLSREPLLDKNEGLSCEVHQGLCAWFMADFNVPYYHHALALDDLASLLLCLY

SEQ ID NO: 162249 - protein, 38 aa, Glycine max
  Coding DNA Sequence Number=SeqID_70564
MVMNRDCQRSVNAWKKKDNAGLLKNCESQLHQLSSLCS

SEQ ID NO: 162250 - protein, 69 aa, Glycine max
  Coding DNA Sequence Number=SeqID_70565
MEESGENWPSDNSYLDEVNDEFGSEDEEGGSFSGMGETDRKKRKRELAERFLALSATIPGFTKVGTKFF

SEQ ID NO: 162251 - protein, 57 aa, Glycine max
  Coding DNA Sequence Number=SeqID_70566
  Gene Ontology: Mol. function=3-oxoacyl-[acyl-carrier-protein] synthase activity; Cellular component=mitochondrion; Biological process=fatty acid biosynthetic process
  Homolog annotation: Hit_ID=Q8L3X9; Match level="QueryCoverage=91%, HitCoverage=11%, E-value=4e-16, Identity=71%"; Hit description=3 -oxoacyl-[acyl-carrier-protein] synthase, mitochondrial precursor
MINKEFEHAKNRGSKIYAEVRGYGMSGDAYHLTQPPSEGRGAILAMTRALRQRFSVG

SEQ ID NO: 162252 - protein, 160 aa, Glycine max
  Coding DNA Sequence Number=SeqID_70567
  Gene Ontology: Mol. function=transcription regulator activity; Cellular component=nucleus; Biological process=regulation of transcription
  Homolog annotation: Hit_ID=A7R3U8; Match level="QueryCoverage=87%, HitCoverage=41%, E-value=1e-12, Identity=31%"; Hit description =Chromosome chr7 scaffold_572, whole genome shotgun sequence
MVERQKWQRRVGLTIERIIMTDKTSILANASSYVKQLQQRVRELEQEVQSNVSSNEGATSSCEVNSSNDYYSGGGPNEILPEVKVRVLQKDVLIIIHCEKQKGIMLKILSQLENVNLSVVNSSVLRFGKITLDITIIAKMGEGYKMTVDELVKTLRVAIS

SEQ ID NO: 162253 - protein, 248 aa, Glycine max
  Coding DNA Sequence Number=SeqID_70568
  Gene Ontology: Mol. function=transcription regulator activity; Cellular component=nucleus; Biological process=regulation of transcription
  Homolog annotation: Hit_ID=O81348; Match level="QueryCoverage=97%, HitCoverage=70%, E-value=3e-37, Identity=36%"; Hit description =Symbiotic ammonium transporter
  Pfam annotation: Domain name=HLH; Domain location=82-131; Score=44.6; E_value=3.4e-10; Accession=PF00010.17; Description=Helix-loop-helix DNA-binding domain
MNDDFSCTNAVSSEEMVRLNNDSSNVVAAIGPKVEYTDSYLKSSEEKLGSCYWRKRGVENHELEAKARDNERGTKRARTSSETQYHVMSERKRRQDIAEKFIALSATIPGLKKVDKATVLREALNYMRQLQQRIAVLEKGSNNKSIKSLIITKSRLCSASCETNSNEVLPQVEARGLEKEVLIRIYCEKRKDIMLKLLALLKDVHLSIASSSILQFGNSILNIIIIAQMSEKYNLTVNDLVKTLKQIF

SEQ ID NO: 162254 - protein, 171 aa, Glycine max
  Coding DNA Sequence Number=SeqID_70569
MLCITSQHNTTNNTTQHHHSTRHPKSKRVQVGYYETAPDPRSPPFLLAITVISEREAARKKREKGTERKLRKAFTAEMVGGDQRGVGVALVAVDGGGGGPGEGSGGGVPGAADGEPWGAALAVDPAADDGGSVVVVVTEEEELVGDEGVVGHDHCNPLVIDLRHDNGRRVG

SEQ ID NO: 162255 - protein, 219 aa, Glycine max
  Coding DNA Sequence Number=SeqID_70570
  Gene Ontology: Mol. function=peptidase activity; Cellular component =cytoplasm; Biological process=protein targeting
  Homolog annotation: Hit_ID=A7Q914; Match level="QueryCoverage=78%, HitCoverage=75%, E-value=2e-72, Identity=75%"; Hit description =Chromosome chr9 scaffold_65, whole genome shotgun sequence
  Pfam annotation: Domain name=DUF862; Domain location=16-153; Score =241.6; E_value=1.8e-69; Accession=PF05903.5; Description=Eukaryotic protein of unknown function (DUF862)
MLCRKSSKNDVGSGSVPVHLNVYDLTPINGYAYWFGLGVYHSGVQVHGVEFAFGAHEYSLTGIFEGEPKRCEGFAFRKTILIGKTDMRPGEVKAVMEELAAKYRGNAYNLITKNCNHFCNDACLRLTGNPIPSWVNRLARIGFMCNCVLPVTLNSTKVRHHKMEEKQCEGEKQALATKAKKLSASNSSSSSPEGLRRGRSRNRRALPPSSPLIIGSSSS

SEQ ID NO: 162256 - protein, 94 aa, Glycine max
  Coding DNA Sequence Number=SeqID_70571
ILKMGFFLNNFWDGSVFDVNFQRKRQQQWRFEHAATRGGKIANISGDFVSPGLASLTGELHPVSPDTVATCLQASASAGLASSGIAECTPKSLS

SEQ ID NO: 162257 - protein, 20 aa, Glycine max
  Coding DNA Sequence Number=SeqID_70572
MEKNEWRKKKKDLKHLKCIN

SEQ ID NO: 162258 - protein, 95 aa, Glycine max
  Coding DNA Sequence Number=SeqID_70573
MVYNDGPGPTCHHNGSTTVVPQPRRQPAEGTLVVGPGLCCATQEDPDHQTREPQVSYECKDEGRWWGFGRSVGGWNYSKSFQYGINFAIKGCLGL

SEQ ID NO: 162259 - protein, 52 aa, Glycine max
  Coding DNA Sequence Number=SeqID_70574
MEMQSVHPSISSDNPSNVAATMISDYKKGETMKKKKKKKKKKTEKRGTWMIR

SEQ ID NO: 162260 - protein, 231 aa, Glycine max
  Coding DNA Sequence Number=SeqID_70575
  Homolog annotation: Hit_ID=A7QLB6; Match level="QueryCoverage=71%, HitCoverage=26%, E-value=6e-55, Identity=66%"; Hit description =Chromosome chr11 scaffold_118, whole genome shotgun sequence
MSQLQWTTALKKILISANLRLKRVGKSSANRSAQQKANHLALGKYLETDLACEAEPIQRPALPQALSSELEEKKRKLDSWSRDLNKREALTDQEKKKLEEDNKKKDLRNESLLLASKEQKIAHESVLRLVEEQKREKEEAYNKILQLEKQLDAKQKLEMEIEELKGKLQVMKHLGDEDDAAVQNKTEEMNDELQEKVDNLENMEAMNQILVVKERQSNDELQEARKELIIV

SEQ ID NO: 162261 - protein, 228 aa, Glycine max
  Coding DNA Sequence Number=SeqID_70576
  Gene Ontology: Mol. function=transporter activity; Cellular component= integral to membrane; Biological process=transport
  Homolog annotation: Hit_ID=Q6J1S8; Match level="QueryCoverage=93%, HitCoverage=65%, E-value=2e-74, Identity=66%"; Hit description =Nodulin 26-like protein
  Pfam annotation: Domain name=MIP; Domain location=2-213; Score=98.0; E_value=2.9e-26; Accession=PF00230.11; Description=Major intrinsic protein
LEQSFWARSLLMSAAIGAAIEKEKSQGSVVGCAVISGVTVMIIICSIGHISGAHLNPAVTISFAVIKHMPWKNVPVYIGAQVLASVSAAFALKLIFHPFMSGGVTVPSVGYGQAFAAEFMVSFTLMFVVTAVADGTRVVREFPGIIMVQVRLFAGIVVGATVMINILMAGAATGSSMNPARTLGPAIAAHNYKGIWIYLTAPILGSLCGAGAYTVLKLPDRNTTMQEE

SEQ ID NO: 162262 - protein, 59 aa, Glycine max
  Coding DNA Sequence Number=SeqID_70577
MGETLTSRNSTRNPPHQLIVNTSLATIWKVFPGYMSFMASLAKRRKCKEDVFYVTFMPP

SEQ ID NO: 162263 - protein, 177 aa, Glycine max
  Coding DNA Sequence Number=SeqID_70578
MNVGLLVVYWISRTLGVGLGRQNPMVDLLHYSSGEGHDGQPVSGRSLGSWSKHKLTNFLDHACDVNFEAEQDQYSVGLILGSQNFAEKLEPIEIVAKQEAAHGVEELTAGLGRWKQTITMIRKVYLSSCLWVFDLDHTWMKKTQQMQVVILAESFQANVVFLLGSMDHNKWWESVPS

SEQ ID NO: 162264 - protein, 152 aa, Glycine max
  Coding DNA Sequence Number=SeqID_70579
  Gene Ontology: Mol. function=binding
  Homolog annotation: Hit_ID=A7P5X1; Match level="QueryCoverage=82%, HitCoverage=12%, E-value=3e-14, Identity=43%"; Hit description =Chromosome chr4 scaffold_6, whole genome shotgun sequence
MPNPDESERNAAARKLGRVGEKLLKNSSVHKLLPLLQLLYFSDSYEFCLWYFWFSNFLKLELLLSTLGQELTEPIQESLVSSKKALISIKLLRLTDEDVKISVTSCLIEITRITDVPYDDGQMKEIFKLIVASFEKFSHISGHEKALDIPGY

SEQ ID NO: 162265 - protein, 64 aa, Glycine max
  Coding DNA Sequence Number=SeqID_70580
MKKYKSSGENWKTEKPQTRTEMLTFYGNQNYTTTTTPYPTRWGRLHGSTSAIMFCQVPYFYPNH

SEQ ID NO: 162266 - protein, 75 aa, Glycine max
  Coding DNA Sequence Number=SeqID_70581
  Homolog annotation: Hit_ID=A9NJR9; Match level="QueryCoverage=77%, HitCoverage=90%, E-value=7e-15, Identity=67%"; Hit description =Putative uncharacterized protein
MDHFVYISEQASTQATAMGIIRSTFSFIAGTAFGVYLAQNYQIPNIRKLADTALLQAKQIEEKYRKSKKKGGDDD

SEQ ID NO: 162267 - protein, 273 aa, Glycine max
  Coding DNA Sequence Number=SeqID_70582
  Homolog annotation: Hit_ID=A7QFZ7; Match level="QueryCoverage=41%, HitCoverage=42%, E-value=2e-24, Identity=46%"; Hit description =Chromosome chr9 scaffold_90, whole genome shotgun sequence
  Pfam annotation: Domain name=DUF1995; Domain location=50-200; Score= -15.7; E_value=1.4e-05; Accession=PF09353.1; Description=Domain of unknown function (DUF1995)
MVMGISSPSYKLKFLRPRQLEPLSLTPPSSSFRALELKEKVQPLIPWPVSPFTNLNPTNSLSYALQDGKIRLEIDFPYYLINQKAEPLSCSKQLYILSVRNTLDFDFEDDNEGRWQSTEPPSLYIFINCSTRELAYIEKYVCRFRPSGLPSQRFAVPLSFSIHSIRIREYSKVMLKQADGSYACIAESANCFSLGELHTNPLTDIGQRGIVEGLGTSRRRGKFSRISSKRLQGVLLQARGGKKILIQKYLMDGGVELCTVRRDCFTASACSGH

SEQ ID NO: 162268 - protein, 572 aa, Glycine max
  Coding DNA Sequence Number=SeqID_70583
  Gene Ontology: Mol. function=transferase activity, transferring glycosyl groups; Cellular component=integral to membrane; Biological process=cell wall organization and biogenesis
  Homolog annotation: Hit_ID=A7LIE5; Match level="QueryCoverage=77%, HitCoverage=73%, E-value=1e-130, Identity=51%"; Hit description =Alpha-1,2-fucosyltransferase
  Pfam annotation: Domain name=XG_FTase; Domain location=71-543; Score =658.4; E_value=6e-195; Accession=PF03254.4; Description=Xyloglucan fucosyltransferase
  Subcellular localization annotation: CTP_CleavageSite=35; ConfidenceScore=5.12e-01
MEIFQATADKMRMSSKRFATLFVVFFISFSVFLIVSSIYRNSSYYAIFEGLSKGREAGESAQNVTINRFPLEGTVHNTSEENLVSEHGPKNVSLTSSTTESTPDLEDKDKLLGGLLTTGFDEASCISRMQSQLYRKASPHKPSPYLISKLRNYEDIHRRCGPNSRAYDRSMRKIVRSKNKGAAATLCKYLIWTPANGLGNQMISMAATFLYAMLTDRVMLVKFDKDKQGLFCEPFLNSTWVLPEKSPFWNEKHIETYQTMLEKDRNRTSNSKDDLPSVLFINLQHTLSEPEKFFHCDHSQYLLREVPLLILQSDQYFVPSLFMNPFFNQEVTKMFPEKDTVFHRLGRYLFHPSNEAWKLISDYYQEHLAKADKRIGLQIRVFSPVSTPQQTVMDLVLSCTLKHKILPQVDLQTSAGKNHSVKAVLVASLHREYGDNLRSMYLKKATVSGEVIEVYQPSHEEHQKFNDNKHNLKAWIDMYLISLSEELVTTSLSTFGYVAQGLGNLKPWLLYRLVNNDTHFPSCERDFSSEPCYHVPPKHYCNGKPIKDVVSSFPYLRECKDYCYGLKLVNST

SEQ ID NO: 162269 - protein, 633 aa, Glycine max
  Coding DNA Sequence Number=SeqID_70584
  Gene Ontology: Mol. function=transferase activity, transferring glycosyl groups; Cellular component=integral to membrane; Biological process=cell wall organization and biogenesis
  Homolog annotation: Hit_ID=A7LIE5; Match level="QueryCoverage=71%, HitCoverage=73%, E-value=1e-130, Identity=50%"; Hit description =Alpha-1,2-fucosyltransferase
  Pfam annotation: Domain name=XG_FTase; Domain location=133-601; Score= 647.4; E_value=1.2e-191; Accession=PF03254.4; Description=Xyloglucan fucosyltransferase
  Subcellular localization annotation: CTP_CleavageSite=22; ConfidenceScore=5.03e-01
MEINPKRFTTLFFVVLFISFPVAFIVSSIYRNSSFAIFYEGLTESSAQNVTNNGFPLGGRVHNTTSDDEIETHLRTRHNDTVSVVLPGNIQNGSTVEERARTMNSTASGIGGVKDLQERSQNNFATEGRSENITAAYAGSKNASLASSTNVSTTEPVNLDDNDKLLGGLLTSGFDEASCKSRMQSHLYRKASPHKPSPYLISKLRKYEEIHRRCGPNTRDYDKSMKKIVSSKNNGAATKCKYIIWNTANGLGNQMISIAATFLYAILTDRVLLVKFNKDKHGLFCEPFLNSTWILPQKSPFSSWNEHNTETYQTMLDKDRASNSKKGLPSVLFINLQFSFENPEKYFHCDHSQDLLRKIPMLILRSDQYYVPSMFMNPFFNLEIANMFPERDIIFHHLGRYLFHPSNDAWELISSYYQAHLASASERIGLQIRVFNAATTPKQAIMNLVLSCTLQQKILPEVDLKTSVSSAGKNMTTVKAVLVASLHKEYGDNLRSMYLKKPTVSGEVIEVYQPSHEGKQKFNDNGHNLKAWTDMYLLSLSDVLVTTSLSTFGYVAQGLGNLKPWLLYRLVGNHSGDFPRCERDFSTEPCFHMPPKHYCNGEPMNDIVSSFPNLRECKDLRFGVKLAAVNGSM

SEQ ID NO: 162270 - protein, 43 aa, Glycine max
  Coding DNA Sequence Number=SeqID_70585
MTTMWMHGKLLSCTTREGKKENRDGLGRIHTCGPFPSMLIKVQ

SEQ ID NO: 162271 - protein, 969 aa, Glycine max
  Coding DNA Sequence Number=SeqID_70586
  Gene Ontology: Mol. function=mannosyl-oligosaccharide 1,2-alpha -mannosidase activity; Cellular component=membrane; Biological process=metabolic process
  Homolog annotation: Hit_ID=Q9SEH8; Match level="QueryCoverage=56%, HitCoverage=99%, E-value=0.0, Identity=90%"; Hit description =Mannosyl-oligosaccharide 1,2-alpha-mannosidase
  Pfam annotation: Domain name=Cation_efflux; Domain location=600-892; Score=110.6; E_value=4.7e-30; Accession=PF01545.12; Description =Cation efflux family
  Pfam annotation: Domain name=Glyco_hydro_47; Domain location=113-516; Score=551.6; E_value=8.6e-163; Accession=PF01532.11; Description =Glycosyl hydrolase family 47
  Pfam module annotation: Pfam domain module=Cation_efflux::Glyco_hydro_ 47; Domain location=600-892::113-516
MARGSRSVTSSSKWRYCNPSYYLKRPKRLALLFIVFVGVSFIVWDRQTLVREHQVEISELRKEVTGLQNLLDDLNNKQGGTSGKTDLRKATKTSKEVLDDPIDIERREKVKEAMLHAWGSYEKYAWGQDELQPQSKNGVNSFGGLGATLIDSLDTLYIMGLNEQFQKAREWVANSLDFNKDYEASVFETTISAYDLSGDKVFLNKAIEIADRLLPAWNTPTGIPYNIINLSHGRAHNPSWTGGESILADSGTEQLEFIVLSQRTGDPKYQQKVENVIAQLNKTFPDDGLLPIYINPHSGAAGYSPITFGAMGDRDMWEKSMKGLSSLIRRSTPSSFAYICEKNGGSLTDKMDELACFAPGMIALGSFGYSADDDSQKFLSLAEELAWTCYNFYQSTPTKLAGENYFFHSGQDMSVGTSWNILRPETVESLFYLWRLTGNKTYQEWGWNIFQAFEKNSRIESGYVGLKDVNSGVKDNMMQSFFLAETLKYFYLLFSPSSVIPLDEWVFNTEAHPLRIVTRHEEGLVKNLNEKQKPFSRIGGRKEGRSACKMSAFPHCEGPPSTSYHSLTFTVPSSRLQCSSSQAKPATNIEFNDRHSQRAVKTALWCNFLVFSLKFGVWLASSSHVMLAEVVHSVADFANQALLAYGLSSSRRAPDAIHPYGYSKERFVWSLISAVGIFCLGSGATVVNGVQNLWIAQPPENMQYAALVICGSFIIEGASLIVAIQAVKKGAAAEGMKLRDYIWRGHDPTSVAVMTEDGAAVTGLVIAGASLVAVNVTGNAIYDPIGSIVVGNLLGMVAIFLIQRNRHALIGRAMDDHDMEKVLQFLKKDPVVDSLYDCKSEVIGPGFFRFKAEIADHSNETDFNGEKVVQNYLKRTGREEWARQFREAAKQKDDTALMKIMSNYGEEVVTALGSEVDRLEKEIQNLVPGIRHVDIEAHNPPTEATFITSSEGNTKLSYMPRVELTLDSS

SEQ ID NO: 162272 - protein, 616 aa, Glycine max
  Coding DNA Sequence Number=SeqID_70587
  Gene Ontology: Mol. function=sequence-specific DNA binding; Cellular component=nucleus; Biological process=regulation of transcription, DNA-dependent
  Homolog annotation: Hit_ID=A7P7A6; Match level="QueryCoverage=90%, HitCoverage=77%, E-value=0.0, Identity=75%"; Hit description =Chromosome chr9 scaffold_7, whole genome shotgun sequence
  Pfam annotation: Domain name=Homeobox; Domain location=94-150; Score =85.6; E_value=1.6e-22; Accession=PF00046.20; Description=Homeobox domain
  Pfam annotation: Domain name=START; Domain location=265-489; Score =301.8; E_value=1.3e-87; Accession=PF01852.10; Description=START domain
  Pfam module annotation: Pfam domain module=Homeobox::START; Domain location=94-150::265-489
  Subcellular localization annotation: CTP_CleavageSite=39; ConfidenceScore=5.03e-01
MGVNMSNTPPHTKDLFSSSSLSLSLAGIFRHAGEAAETSGMEVAGGNEVRREDTVEISSDNSGPVRSRSEEDFDGEGLHEDDDDGDDKNRKKKKRKYHRHTAEQIREMEALFKESPHPDEKQRQQLSNQLGLAPRQVKFWFQNRRTQIKAIQERHENSLLKTELDRLREENKAMRETINKSCCPNCGMVTATIDASMSTEEKQLLIENAKLKAEVEKLRTALGKFSPRTTSPTTSSAGHHDEEENRSSLDFYNGIFGLDKSRIMDIANRATEELIKMANMGEPLWVRSVETGRDILNYDEYVKEFEVENSGSERPKTFIEASRETEVVFMDLPRLLQSFLDVNQWKEMFPCLISKAATVDVICNGEGSNRNGAVQLMFAELQMLTPMVPTREVYFVRCGKQLSDEQWAIVDVSIDKVEDNIDASLVKCRKRPSGCIIEDKSNGHCKVIWVEHLECQKSTIHTMYRTIVNSGLAFGARHWIETLQLQCERLVFYMATNVPMKDSTGVATLAGRKSILKLAQRMTWSFCHAVGASSFHTWTKVTSKTGEDIRISSRKNLNEPGEPLGVILCAVSSVWLPVSPNVLFDFLRDEARRNEVQYKCTTLLHPFFNKPRVFLG

SEQ ID NO: 162273 - protein, 496 aa, Glycine max
  Coding DNA Sequence Number=SeqID_70588
  Gene Ontology: Mol. function=transporter activity; Cellular component= membrane; Biological process=oligopeptide transport
  Homolog annotation: Hit_ID=Q2HU48; Match level="QueryCoverage=99%, HitCoverage=82%, E-value=0.0, Identity=67%"; Hit description=TGF -beta receptor, type I/II extracellular region
  Pfam annotation: Domain name=PTR2; Domain location=1-391; Score =197.1; E_value=4.3e-56; Accession=PF00854.12; Description=POT family
  Subcellular localization annotation: CTP_CleavageSite=51; ConfidenceScore=5.07e-01
MALLCLTAIIPQARPPPCNPATERCKPATAGQMTMLISSFALMSIGNGGLSCSIAFGADQVNKKDNPNNQRALETFFSWYYASTAFSVIIALTVIVYIQDHFGWKVGFGVPAALMFMSTFFFFLASPLYVKNKVQGSLITGLAQVIVVAYKNRKLPLPPRNSAAMYHRRKDSDLVVPTDKLRFLNKACITKDPEKDIASDGSASNPWSLCTIDRVEELKAIIKVIPLWSTGIMVSVNIGGSFGLLQAKSLNRHITSHFEIPAGSFAVVIVFIIFIWVALYDRVIIPIASKLRGKPVRISAKRRMGIGLVFSFLHLATAAIVENERRRRAIREGHINDTHAVLNMSAMWLVPQLCLSGMAEAFNAIGQNEFYYTEFPRTMSSIAACLFGLGMAAGNVLSSLIFSIVENATSRGGNEGWVLDNINKGRYDRYYWVLASLSAVNILYYLVCSWAYGPTVDQLFKVSDENSSNEKEFTQLGNMGQVDVSEGIGSNEKRVN

SEQ ID NO: 162274 - protein, 646 aa, Glycine max
  Coding DNA Sequence Number=SeqID_70589
  Gene Ontology: Mol. function=transporter activity; Cellular component= membrane; Biological process=oligopeptide transport
  Homolog annotation: Hit_ID=Q2HU48; Match level="QueryCoverage=97%, HitCoverage=92%, E-value=0.0, Identity=67%"; Hit description=TGF -beta receptor, type I/II extracellular region
  Pfam annotation: Domain name=MFS_1; Domain location=36-556; Score= -11.4; E_value=0.045; Accession=PF07690.7; Description=Major Facilitator Superfamily
  Pfam annotation: Domain name=PTR2; Domain location=154-548; Score =229.2; E_value=9.5e-66; Accession=PF00854.12; Description=POT family
  Pfam annotation: Domain name=Voltage_CLC; Domain location=155-452; Score=-182.9; E_value=0.075; Accession=PF00654.11; Description =Voltage gated chloride channel
  Pfam module annotation: Pfam domain module=MFS_1::PTR2::Voltage_CLC; Domain location=36-556::154-548::155-452
MEKELELSSAQSRMDSQRISQPQRCGKGGLVTMPFIIANEALARVATLGLLPNMILYLMGNYNLHLGKATKILLLSVATTNFMPLPGAFIADSYLGRFLAVGLGSFITFLITMSLKDVFRDSIPEDHVHVYRKASLCGERSVPQNLTGSKKNGMPLGMTLLWLTAMIPQARPPPCNSETERCESATPGQMAMLISSLALMSIGNGGLSCSLAFGADQVNRKDNPNNQRALEMFFSWYYASSAISVIIAFTGIVYIQDHLGWKLGFGVPAALMFLSTFFFFLASPLYVKNKTHNNLLTGFACVIVVAYKNRKLRLPHKISDGMYHRNKDSDLVVPSDKLRFLNKACFIKDSEKDIASDGSAYNRWSLCTVDQVEELKAIIKVIPLWSTGIMMYLNIGGSFGLLQAKSLNRHITPNFEVPAGSMSVIMIFTIFIWIALYDRVIIPLASKLRGKPVRISAKRRMGLGLLFSFLHLVTAAIVETTRRRRAISEGHINDTHAVLNMSAMWLFPQLCLGGIAEAFNAIGQNEFYYTEFPKTMSSIASSLFGLGMAVGYVLSSLVFSIVEKVTSRGGKDGWVSDNINKGRFDKYYWLLATMSAVNVLYYLVCSWAYGPTSDQESKVTEENGSNEEELPLIQSRTKGQFDKVSQ

SEQ ID NO: 162275 - protein, 461 aa, Glycine max
  Coding DNA Sequence Number=SeqID_70590
  Gene Ontology: Mol. function=metal ion binding; Cellular component =peroxisomal membrane; Biological process=peroxisome organization and biogenesis
  Homolog annotation: Hit_ID=A7P782; Match level="QueryCoverage=29%, HitCoverage=39%, E-value=3e-66, Identity=89%"; Hit description =Chromosome chr9 scaffold_7, whole genome shotgun sequence
  Pfam annotation: Domain name=Pex2_Pex12; Domain location=324-460; Score=33.4; E_value=8.3e-07; Accession=PF04757.5; Description=Pex2 Pex12 amino terminal region
  Subcellular localization annotation: CTP_CleavageSite=30; ConfidenceScore=5.31e-01
MAFSLFQNPTFLKLKPPTIATPRWGYVRVRCGGPRSQRSPLMKGRILSIEAIQAIQTLKRLHRTNPPNLSSLVSNTLTRLIKSDLLATLRELLRQQHCTIALRAFSTLRSEYGADLSLYAEIISALAAAAAAAEMTDHVDRLILDLEAENEEIKCDDHKGLASLIKAVVAARSRESTVRIYGLMKKSGYGSVTEPDEYVVKVLVNGLKSFGEEALARELQDEYKIALAMVGQTSACDGLIRDFKGKLSKASIKILIKVMSFGQNCGESIRVVHQLFVSRSPKLAKIGSIKSRSSLSAINSAISSFDRQQSTLPISISRVNQVDAARLDVEMSAMLKEQLVKVFLLMKPGMLFQYEAELDAFLEFLIWRFSIWVDKPTPGIALMNLRYRDERAVEPRDKVRTGLEGPGLTVAQKLWYCVATVGGQYIWARLQSFSAFRRWGDTEQTVGSTFMDLDTADRRNI

SEQ ID NO: 162276 - protein, 103 aa, Glycine max
  Coding DNA Sequence Number=SeqID_70591
MGTLFGFIVVAEVEGFPMALNWGDCDFGRVELGDGVLEMLLKVLLSIHGFGLRLGFCGGDGEGQLLRGKWRKKTKKINSIPGIIICPKKYQLFSTLINYSSKF

SEQ ID NO: 162277 - protein, 173 aa, Glycine max
  Coding DNA Sequence Number=SeqID_70592
  Gene Ontology: Mol. function=electron carrier activity; Cellular component=anchored to membrane; Biological process=electron transport
  Homolog annotation: Hit_ID=Q9SQN9; Match level="QueryCoverage=67%, HitCoverage=65%, E-value=2e-15, Identity=36%"; Hit description =Putative uncharacterized protein F19K16.24
  Pfam annotation: Domain name=Cu_bind_like; Domain location=35-108; Score=-12.1; E_value=0.0013; Accession=PF02298.8; Description =Plastocyanin-like domain
MASLFSILCTASIVVFLAVKFAAAREFKMGGDLGWHEHAPTSLHFIIIGMQGTGSKLVTLWLRKWNYFHCDSNSPIDIFDDGNSTVILEGPGVFYFISGTEDHCQNSEKLIVEVMSPHSIPNSPPPQAQGFSSLAPSPSHSSGVSVSILLGSVFMALLTTFPTLNFSSSGHSA

SEQ ID NO: 162278 - protein, 421 aa, Glycine max
  Coding DNA Sequence Number=SeqID_70593
  Gene Ontology: Mol. function=sequence-specific DNA binding; Cellular component=nucleus; Biological process=regulation of transcription, DNA-dependent
  Homolog annotation: Hit_ID=A7P754; Match level="QueryCoverage=82%, HitCoverage=100%, E-value=4e-83, Identity=50%"; Hit description =Chromosome chr9 scaffold_7, whole genome shotgun sequence
  Pfam annotation: Domain name=GATA; Domain location=313-348; Score =66.3; E_value=1e-16; Accession=PF00320.18; Description=GATA zinc finger
MFVCVCMKKDAPMREKFHLCHSFTPQNPTISVSHSKPKQRNPHSFHQNGALRSLSLKPTHTTSLQLLPLKHTIYMEVPEYFVGSFFGTGGAEQFCPPEKRHSDQKTGEPFAIDDLLDFSHADAIMSDGFFDNVAGNSTDSSTVTAVDSCNSSISGSDNRFATTIVPRGFPSDPQFSGELCVPYDEMAELEWLSNFVEDSFSAEEELKTLQLLSGAAAASTAIGAKPQTPESSSSTDTLPPFASDDTLRNAPFLHSETPLPGKARSKRSRAAPGDWSTRLLHLVATEQEKLPQLKAEPAKKREGTNAECSGRKCLHCGTEKTPQWRTGPMGPKTLCNACGVRFKSGRLVPEYRPAASPTFMSTKHSNSHRKVLELRRQKELQRQQHQQLMSQSSIFGVSNGGDEFLIHHHHQHCGPDFRHVI

SEQ ID NO: 162279 - protein, 215 aa, Glycine max
  Coding DNA Sequence Number=SeqID_70594
  Gene Ontology: Mol. function=nucleoside-triphosphatase activity; Cellular component=integral to membrane; Biological process=response to salicylic acid stimulus
  Homolog annotation: Hit_ID=A7P7M7; Match level="QueryCoverage=95%, HitCoverage=14%, E-value=4e-84, Identity=74%"; Hit description =Chromosome chr9 scaffold_7, whole genome shotgun sequence
MVGNEMLGSISGGQRKRVTTGEMLVGPTNALFVDEISTVLDSSTTFQIVRSLRQYVHILNGTAVISLVQPAPKTYELFDDIIFITEGQIVYQGLREYVLEPFESVGFKCRERKGVADFLQEATSRKDQEQYWAHRDEPHRFVTVTQFAEAFQSFHFGRIIREELATPFDKSKNHPAPLTTKRYGVDKKELLKANFSRGYLLTKRNSLFTSSTYAK

SEQ ID NO: 162280 - protein, 826 aa, Glycine max
  Coding DNA Sequence Number=SeqID_70595
  Gene Ontology: Mol. function=protein serine/threonine kinase activity; Cellular component=cytoplasm; Biological process=protein amino acid phosphorylation
  Homolog annotation: Hit_ID=A7P4B5; Match level="QueryCoverage=79%, HitCoverage=84%, E-value=0.0, Identity=77%"; Hit description =Chromosome chr4 scaffold_6, whole genome shotgun sequence
  Pfam annotation: Domain name=Pkinase; Domain location=160-445; Score =37.1; E_value=7.4e-11; Accession=PF00069.16; Description=Protein kinase domain
  Pfam annotation: Domain name=Pkinase_Tyr; Domain location=160-427; Score=-157.2; E_value=0.0087; Accession=PF07714.8; Description =Protein tyrosine kinase
  Pfam module annotation: Pfam domain module=Pkinase::Pkinase_Tyr; Domain location=160-445::160-427
MPVLRSGARKGRAAAKQQQQEQQQQQQKQQQQQHSPVVEGEAIATRTRRRRAAAAAAAAVPESNNNNNNNNTNNQQQQPEQVAVVNENVAIAVREEENNRVAEEGVVGGGGAEREGVAEKEMGGCDSGGPSNDKANAAGEDDANAPQVPEKIQVGNSPWYKVERKLGKGGFGQVYVGRRTGGNLNERTGSGAVEVALKLEHRTSKGCTYGPPYEWQVYNTLGGSHGVPQVHYKGRQGDYYVMVMDMLGPSLWDVWNNSNHHMTTEMVACIAIEAISILEKMHSRGYVHGDVKPENFLLGAPGTPDEKKLFLVDLGLATKWRDSTTGSHVEYDQRPDVFRGTVRYASVHAHLGRTASRRDDLESLAYTLIFLLRGRLPWQGFQNCWSLTLFSQGENKGFLVCKKKMGTSPETLCCFSPLPFKQFVEHVVNLKFDEEPNYAKYISLFDGIVGPNPDIRPINTEGAQKLIGHKRGRLAMEEEDDDQPKKKIRIGLPASQWISVYNARRPMKQRHFKLIHRVIGMIIAHFPILEIKGGEGDSSSHTISWNLFYNLLYHYNVSDTRLSQHIEKGNEDGLYISGVASCQNLWALIMDAGTGFTAQVYELSPFFLHKKTCLLHTFQPTYNSPNNEEEWIMEHWEKNYYISAIAGAVNGSSLVVMSKGTQYLQQSYKVSDSFPFKWINKKWREGFYVTSMATSGSRWGVVMSRGAGFSDQVVELDFLYPSEGIHKRWDCGYRITATAATWDQAAFVLSVPRRKPLDETQETLRTSAFPSTHVKLIRSLLRCHTLLYRRSGQRTSTLLPFATDVQFLNPANVAAAEKHDPGPKKF

SEQ ID NO: 162281 - protein, 103 aa, Glycine max
  Coding DNA Sequence Number=SeqID_70596
  Subcellular localization annotation: CTP_CleavageSite=30; ConfidenceScore=5.18e-01
MRISVTSSDSDAPIPLSGRRGRAMTMKDTRAESTTGSSLASEASRTKMATTKYAGGMRGRHFATRLERRVAAVAMQWHDSMRCCGAATRQSWPSGAVALRNWR

SEQ ID NO: 162282 - protein, 36 aa, Glycine max
  Coding DNA Sequence Number=SeqID_70597
MAERMKKKNMEGGRVGMPQKTCHSLVEENSGRLYGN

SEQ ID NO: 162283 - protein, 224 aa, Glycine max
  Coding DNA Sequence Number=SeqID_70598
  Subcellular localization annotation: CTP_CleavageSite=45; ConfidenceScore=5.63e-01
MAISSSTQQLAPVSPSSMACCTKLGLASLTGELRVGVCSSQATCSSSAGGGTAFWWKTPVLLAICAAGSRYSFKVHDEFDYNSVVFQWKGSKKAIQIKRGISFNALKKKIGDKVKLQNNEIISAISCRFLVSGKYTSLQICDDEDVETMLESFKQQQEMSVLELYIEKDVAGGSMFHSANSLTSCGNYVSNDDTQPPTNMSNLNLDEDDDDDDYLVSNSYVEES

SEQ ID NO: 162284 - protein, 115 aa, Glycine max
  Coding DNA Sequence Number=SeqID_70599
MTRGNPGDLQPFDPKIDRTFHRLVRHSVHPDHSMHFEHSEYYVAGDSKYSDFEHSTTNFHTENMAQPPPRERTLREMDALDFTYESLCIQYPDEGVPYVLKIGLIHLLPKFHGLA

SEQ ID NO: 162285 - protein, 244 aa, Glycine max
  Coding DNA Sequence Number=SeqID_70600
  Pfam annotation: Domain name=Retrotrans_gag; Domain location=86-160; Score=3.9; E_value=0.023; Accession=PF03732.8; Description =Retrotransposon gag protein
MEVNGGLRSTYLKLLRRGERRRHPLENKPWKKKLHHQESVLDKKLREESSIEEENEREREKVAWKIEGRKGEKLNFEVCFTRLSFIKVVTSVTHVSIYSLDLINTWGDMKRIFLEKFFPASRTTSIWKEIYVIRQQPGETLYEYERDSTTSGGALMDKNPMAARQLISNMAANYQQFGTRGVATSKDVANEVSISMVADNQRLENKLTKLTSLVRQLAIGQQHNMMAEHAAHVYAMQYGQPFRP

SEQ ID NO: 162286 - protein, 131 aa, Glycine max
  Coding DNA Sequence Number=SeqID_70601
MSSRLSQRTPPRIKRKFDFKNPRIKFKESRIKNRQVEDSRIKKRLNPDKGYISCGSVLVEGTSTRLFKENKGWYIPCGSLLVKEFYKVEKKSQGPQVAWGLDVGTGCCRTSIKLLCVCLLLPYSFNFRCAL

SEQ ID NO: 162287 - protein, 69 aa, Glycine max
  Coding DNA Sequence Number=SeqID_70602
MMTTKDDDKGDEQKAQRSKNNSTESKNNSRVQESRRIQDSRRKPRIKIQDLKNQDQDSRMKKRLNQDKY

SEQ ID NO: 162288 - protein, 159 aa, Glycine max
  Coding DNA Sequence Number=SeqID_70603
  Homolog annotation: Hit_ID=Q6WAY4; Match level="QueryCoverage=75%, HitCoverage=21%, E-value=3e-10, Identity=31%"; Hit description =Putative uncharacterized protein
MVSNQAPSFKKRFYHVKVKILELAGLQELGQRMGQVRRQAFHKAYGKIGYLAMIEVFVEAITSLTQYYDQSLRCYTFGDFQLVPTIEEFEAILGCPLEGRKPYLFFGLYPSMARMAKVVKISAQELDQVKQNRNGVVGIPRKRQKLWQIKESGLYSLMF

SEQ ID NO: 162289 - protein, 193 aa, Glycine max
  Coding DNA Sequence Number=SeqID_70604
  Homolog annotation: Hit_ID=Q6WAY4; Match level="QueryCoverage=94%, HitCoverage=33%, E-value=3e-09, Identity=25%"; Hit description =Putative uncharacterized protein
MGSNQAPSFKKRFYHVKIKSLEVADLQELGQLMDQLLCQAFRKTYGKIWDLAMIEVFVEAIASLVQYYDQPLRSFTFGDFQLVPTVEEFEEILGCILGGRKLYLFSGLYPSMARITKVVKVLAQELDRVKQNRNGVVRIPRKHLKEKAKALADQGEWASFIDVLALLLFGFVLFPNVEGLVDLAAIDAYDTFD

SEQ ID NO: 162290 - protein, 82 aa, Glycine max
  Coding DNA Sequence Number=SeqID_70605
MEEGYEAAPSAPSDLSDSKWRLLSLAEIAYSGWSFASLTLLRKVEEEPQLLVVFVVTAAIAAAVLEEEHMACLDQQHSGKEG

SEQ ID NO: 162291 - protein, 108 aa, Glycine max
  Coding DNA Sequence Number=SeqID_70606
MRKKSGTSNNNPNKAQNAKAIVIVKRSGGGGLLTNLVRDGVEGIEELVGKTLILELVSNELDSNGDIFLHIAHSIPRLSQQLSYESFPSFRKAHAFLYLAPLYQINAW

SEQ ID NO: 162292 - protein, 543 aa, Glycine max
  Coding DNA Sequence Number=SeqID_70607
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q45HK6; Match level="QueryCoverage=74%, HitCoverage=46%, E-value=1e-137, Identity=57%"; Hit description =Lipoxygenase LOX2
  Pfam annotation: Domain name=Lipoxygenase; Domain location=210-543; Score=34.3; E_value=7e-20; Accession=PF00305.10; Description =Lipoxygenase
  Pfam annotation: Domain name=PLAT; Domain location=96-198; Score =57.9; E_value=3.5e-14; Accession=PF01477.14; Description=PLATLH2 domain
  Pfam module annotation: Pfam domain module=Lipoxygenase::PLAT; Domain location=210-543::96-198
MGVGGDGVAKPEVMKGLPKMVEREGGRMRSLPSLFAPPITPSSSPPSTTSPSNLDDVNGSVDMEECGVKEQVSKVDLEYLAQKKLPWPMAHGNGGGVIIVVVDVVNSDDDECDGYLVVRGVMIVEFETEEKEDEVYYEATFELPTEFGKVGAVLVENEHHNEMFLKSIVFDGFPDGPVHLTCDSWVQPKYDNPVKRVFFTDKSYLPSQTPSGLRRLREEELELLRGNGEGERKSSDRIYDYDVYNDLGDPDSNINLKRPVLGGSKQYPYPRRCRTGREHTDSDPSSEKRSLDFYVPRDETFSDVKQSQFTMSTISSGLSAILESLDAILTDQNLGFRSFEDIDTIYKEGFKLPPLKGNGLNFLQRTVPRLIEAANDSQNLLRFDTPETLKNEEFARETLAGEWPLRSKLESQIYGPPESAITREVIEPHILGYGTIEEAIKEKKLYMLDYHDLLLPYVSKVREIEGTTLYGSRTLFFLTKQGTLKPLAIELTRPPIDGKPQWKQVFTPASYSISHSTNLWLWRLAKAHVLAHDAGVHELINHW

SEQ ID NO: 162293 - protein, 104 aa, Glycine max
  Coding DNA Sequence Number=SeqID_70608
MACVADKIKLIDGSREAFKLSVRITDLWFIRIPEKSEQVEMVVVDSDWTGAILYTMGKLLMEACLWGFYGGWIFELQWGPLMVIFHHGDAAEDKGKEVRGGAIH

SEQ ID NO: 162294 - protein, 56 aa, Glycine max
  Coding DNA Sequence Number=SeqID_70609
MDFELIGFQLLDFLFDAILPRKGPVTRSMSQRLQEDWARVAKEGPRVLMNLKDSII

SEQ ID NO: 162295 - protein, 60 aa, Glycine max
  Coding DNA Sequence Number=SeqID_70610
MEVPHDAQEFKVTSVSFDGRGNVLSLRFEELPFVLVVLPFRLKSVAGGSYPNSAQYAGCI

SEQ ID NO: 162296 - protein, 273 aa, Glycine max
  Coding DNA Sequence Number=SeqID_70611
MPNKGPKDNIALCPFPYYWSRNFAKEVTTKSIELKPSDKEDNFYLMCMVHILRPTKIYCLKDWYFEDAMRRAIFTAWTRFHALKDRLYFPYQNPWVSWQMSFYENKTKLFNNLHVHLGTQVNVVEPPLIEVTSQLPPIVEDALAIVSTSITPREITPLTTFAPSIRFIVERIETNMLIKNTLESSLKSFNDFVPYNMNLLMQQRLPPFVQHQSTPIPQPPPPTPTTVVQPHPEVLAQMIPASEVAIPIDHVLVPLPSPPKSPPPITQPPSTEG

SEQ ID NO: 162297 - protein, 92 aa, Glycine max
  Coding DNA Sequence Number=SeqID_70612
  Homolog annotation: Hit_ID=A7PWL9; Match level="QueryCoverage=30%, HitCoverage=2%, E-value=8e-07, Identity=82%"; Hit description =Chromosome chr19 scaffold_35, whole genome shotgun sequence
MQLMSQMTSWTSMSYETLGWSTKESIVLGGHGKTTLAQLIYNDERVVNHFEIRIWKLSKQRAFGPNEEERVELVVISVEANDFGVLMMIMMI

SEQ ID NO: 162298 - protein, 108 aa, Glycine max
  Coding DNA Sequence Number=SeqID_70613
MAQYPCFMGIGEGRLAIEDCDGNSIHVWYQPWLKTIDNDYVISTCSNGNNFDLKVGDLIDHVTCTWKLNEVAEISITKIDMNGSGMEKEEREEMPLQGEDESRRSSPP

SEQ ID NO: 162299 - protein, 213 aa, Glycine max
  Coding DNA Sequence Number=SeqID_70614
GRPLVGSHNGKKDGQECYAHVKGAPSEETIAPFIARGFNEANAKTLQRVCKAWNEVERKDNELRGSGNGVIGGYHKWLKSRMQGITWLPKLKSLSREEAKVPDEITRVWKECDELKDINMTTVEALEREMKKARKEEWSRNKFRGALWGSKLLEVEEKFERTQLSKIEGSMLIIIDQYKEKVNLAASHGQMLEDEMAKVSALQVEMEAREGVI

SEQ ID NO: 162300 - protein, 157 aa, Glycine max
  Coding DNA Sequence Number=SeqID_70615
  Gene Ontology: Mol. function=aspartic-type endopeptidase activity; Biological process=RNA-dependent DNA replication
  Homolog annotation: Hit_ID=Q6WAY3; Match level="QueryCoverage=37%, HitCoverage=2%, E-value=9e-09, Identity=51%"; Hit description =Gag/pol polyprotein
MPEPHTEKQVWGFLGRLNYIASIRDELLIARKDMLCLGMDSSLFKAVYVELHYLVGVQNGSHKVHFRKACSYWENSLVACSVVRIRYRLRHSEGDKGSTLADYLAQPPINDYQPMHPEFPDKDIMALFEEEAEDEGRDKWVVWFNGVSNALGHGSEA

SEQ ID NO: 162301 - protein, 170 aa, Glycine max
  Coding DNA Sequence Number=SeqID_70616
  Homolog annotation: Hit_ID=A5AL43; Match level="QueryCoverage=81%, HitCoverage=44%, E-value=8e-16, Identity=36%"; Hit description =Putative uncharacterized protein
MLEVTHEGTTNVRRAGKHTLVSKYEAFQIKNGETISELQTRFTHILNHLFGLGKMFEDEELNIKILNCFTRTWEPMITTMKESKNIATMTMEALFVEAMPSNIILMMPKNQELSKFKESGVKKLQQSSFKIQDSRTIKFQESRFKNNQDKDSRLKIQDSRFKNQEKNQSR

SEQ ID NO: 162302 - protein, 107 aa, Glycine max
  Coding DNA Sequence Number=SeqID_70617
  Pfam annotation: Domain name=zf-CCHC; Domain location=69-86; Score =19.7; E_value=0.0016; Accession=PF00098.14; Description=Zinc knuckle
MVHLLWISSSGGYIHLVFFKENKGGYIPCGSLACKGFYKEFENFLRRTKDIKFSKSSKKIENNNNNNNFTCFECVKQGHIKFECPIYLKKYVGGKKERRVENKRKPT

SEQ ID NO: 162303 - protein, 128 aa, Glycine max
  Coding DNA Sequence Number=SeqID_70618
MKIDPRSFDDNKFDDNKDDDKKPKRISSRLSQEHFKNQEKFDFKIQESSFKIQGTSFVVQVKGTSTWVVVTKNKRDYISCGSVLVEGTSTRLFKENKGGYIPCGSLLVKEFTRLKRNLKDRRSLGDWM

SEQ ID NO: 162304 - protein, 123 aa, Glycine max
  Coding DNA Sequence Number=SeqID_70619
MGWVTFWEISKKVWLPVEGFEWWSDEDTTKGKDHEALEGPKTRDRLKQAQHSDEDTTKGKDHEALEGPMTRGRLKQAQHSDEDTTKGKDHEALEGPMTRGRLKQAQHIIETRLVICIAAIDDD

SEQ ID NO: 162305 - protein, 102 aa, Glycine max
  Coding DNA Sequence Number=SeqID_70620
MSSEMKAVAEKHTEKETAARIGDWKLLPNNAKHIDGQQCWWWGHLLESLPELRQRTGAAARKGGKSQEKGKKGNKWRAVGPCGLNNLKRDRLRMQKKQQQSI

SEQ ID NO: 162306 - protein, 260 aa, Glycine max
  Coding DNA Sequence Number=SeqID_70621
MVQKKGSEIGENNGTSEFYTNLFDLEDNSPKQVKVGGHLIMFNADTLNTSLGTPVVLGLRETIPTYSRFCRLRMDPQEIMARLCIPGRGFVLNAEGMPWKLLRRDLSTLAHTWSVLSYSNLASTSHTSNLNLDRAWLVYGLVTRMDMNIGALIAQSNSSRLGFPALITALCTARGVTSNSLSYESLSPTINFAYIKKKFWNLDQPSVYFPRTREARAKAAEIPSSSTPRVPPVPTSTPPPASAHLGPSIDVIMAMLQSFY

SEQ ID NO: 162307 - protein, 45 aa, Glycine max
  Coding DNA Sequence Number=SeqID_70622
RGVNSNSNLGPSGTFWKLGCLRRKQLGEKLLHLVEKWFAWLPWLP

SEQ ID NO: 162308 - protein, 53 aa, Glycine max
  Coding DNA Sequence Number=SeqID_70623
EEAVAQEHTSPVPISPTPISEDTMPSAPAMEPEQPILQDVPAAPVLDLNEDQP

SEQ ID NO: 162309 - protein, 105 aa, Glycine max
  Coding DNA Sequence Number=SeqID_70624
  Homolog annotation: Hit_ID=A5AZ88; Match level="QueryCoverage=72%, HitCoverage=7%, E-value=5e-10, Identity=34%"; Hit description =Putative uncharacterized protein
MLTKKNRYIHSDRIVVEADFVVIDIEEDADIPLILGRPFMSITSYVVDMGKKILQMGIEDQKISFDLFQEDKDPPSQNVYFKVDVMEEKRPEKKVLEVGTLLDLG

SEQ ID NO: 162310 - protein, 45 aa, Glycine max
  Coding DNA Sequence Number=SeqID_70625
MESGGATSYQAYRYRRPRGGARYQLLFPLVRVNFELGVIMVIAVS

SEQ ID NO: 162311 - protein, 81 aa, Glycine max
  Coding DNA Sequence Number=SeqID_70626
MVKNLHGHTAHPFAKHKLPAKCIFGHALSRESLELSAQPLHLRLTWSAKLACSLSALHSLAKRNTSLLSSFPCGQNWVSLS

SEQ ID NO: 162312 - protein, 269 aa, Glycine max
  Coding DNA Sequence Number=SeqID_70627
LSFNDFEEFQGDLNRRNWHKKIENLEEGSIDVALVKEFYANVYDLEDKSPKQVKVRGQWIPFDSVALNSFLETPVVIEEGESLPAYAKFVLLRPNQQELAAYLCIPGKGFELNLDGLPLKILRKNLTTLAQTWSVFSFSNLAPTSHTSSQITLMAQHDSWRLGFPALITALCKARGVHSDSLTHERLSPAINLAYIKKKCWNLDDLSVTFRGSHKAKGKSAMEKEKDDWRCHYKEKMSLEEAHHHRRPWIRAWRKKKMNEGRGREKHEI

SEQ ID NO: 162313 - protein, 167 aa, Glycine max
  Coding DNA Sequence Number=SeqID_70628
MRKSVGLKKKAVEKKGTDGKENDERAVNEVAEVPYPVVPSKKDKDHHLMRILDIFRKLEQLPLYSKFLKDMLTRKHKYIHQEHIIVEGNCSAMIQKGLGTTKLEETLTQFMQITMSNHKNTMSALKNLEVQVGQLAKQIAGKMRKSVGLKKKAVEEKGRDGKENDER

SEQ ID NO: 162314 - protein, 569 aa, Glycine max
  Coding DNA Sequence Number=SeqID_70629
MSMSGHSQHLGQGLCGLRALQADAPLQVREMVVVDLDRLGHLPLFHQVDDLHVFAMLAGGVAGRFIQRHDQRAARHQFGQVAVQDGVARQFAQAHMEGAGLARPGRLAGAVQQGMLVAQLLAQRGVVGLGGARGRQRQQGRFQRAPRLEDLARVLGGGFGHHRAAVVVQVDHMLVGKALQRLARDRARNAEDVAQRRLGQLGAGRQPLAHDTFIDRLANAALHVGIGGRVLQVFGHGGGGPARRRRPGTGFGGIAGRHGGLGGNEGKGSINGKTVRSPVAAHRRARRSGPAWRTRSRPGRARPPTGPAPGAGAAGGRAAPRYTDAARCPSPGAGAAPGAAFPRTGNRPQIAGTRAHARGLVVVAPVQGVAVAGLGEQVRGGAAFRNPRRQPAGRGAAGVAADAVAAVFQQRPFLRFAQPPLAMRVAVAVADQLVAARQAGIDQFRTMVIQRGVDQGADRQTQGVEQFQAAPGAHPVAVLAPGVIEHIGMRRGWPQLGAQPLAEGEMLDVEPQVDGQPRAVGPGVVRAAGDGLVGETVVAGQRRGSPGRGRPRISALKQGWIHFGANHDA

SEQ ID NO: 162315 - protein, 121 aa, Glycine max
  Coding DNA Sequence Number=SeqID_70630
  Subcellular localization annotation: CTP_CleavageSite=40; ConfidenceScore=5.02e-01
MNPKRIKVIPAWPTPPSIRKIWGFHDLTNSYKRCGGKKPRVSRTSGFEIKVVSDSLTFERLSPVINLAYIRKNCWNPEDLTVSIRGVRRAKARPVELPSTSVAPTPASMSAAPSFPAQINS

SEQ ID NO: 162316 - protein, 48 aa, Glycine max
  Coding DNA Sequence Number=SeqID_70631
MASYGVASPFIFLLHSSAIRPQEANESIDEEDPRPTSSTWSYISYDCL

SEQ ID NO: 162317 - protein, 38 aa, Glycine max
  Coding DNA Sequence Number=SeqID_70632
MHGVATNVYLRKTSEKPERCGLRTLSVKGSRVVFTHGE

SEQ ID NO: 162318 - protein, 33 aa, Glycine max
  Coding DNA Sequence Number=SeqID_70633
MWVSRDRYPADFRWEEKDKTDFRKEEKDKREGK

SEQ ID NO: 162319 - protein, 196 aa, Glycine max
  Coding DNA Sequence Number=SeqID_70634
MSIHVAQLIADAIYLFAVMAPTRHPLDPDKSNRALEFPALITGLCQSFGVPVAPSKVIRPSITRAFIEKYCTQRQAQGDAPQAAHAPPPHQAGPAGSFDTEQYLRHLVHQQAADHRVHVQTHDCLYQLSLSLQSQGFTYFPCPTPDQFRAEVAWPGDWPEARAGEAPAEALDEADEAREDEEMTDLLDFLGGSGAT

SEQ ID NO: 162320 - protein, 191 aa, Glycine max
  Coding DNA Sequence Number=SeqID_70635
MTTLTQIWMTLLLSNILPSDHNADLPLWKDRAHKTPSGPGEVQQGPGVSSSGYGPQSVLQGARPPQQGIAPVRHLVDPEKSNRVLGFPALIMGLCQFYRMPFAPSRVISPLLSQPTLWREGNARAHGYIFHERKMRGVATNFYSRKMSKKPERRGLRTLSVKGSGVVFMHGEGCFPCSYVFLNCDKKIIPT

SEQ ID NO: 162321 - protein, 160 aa, Glycine max
  Coding DNA Sequence Number=SeqID_70636
MWAFLTDRQIDWAHLVRYRMHKALRANAPLPYPQLITLFLRHFQIPLDDEPFVQVKRSFAISAGAVTSFGYRKDRNGQWLKKDALPPQDERTPSPPPQRDDSALMNEVLTELQGLRSYVDECFDSFDTRFAGMDIRLTQLEEDVGYIRQSFDLPPPSPPS

SEQ ID NO: 162322 - protein, 123 aa, Glycine max
  Coding DNA Sequence Number=SeqID_70637
MASRKRRASTSRPQEPYDISRFVSEVAWEHYEKNVHTRNILPERNVELSITQYDEQPDNHIDVAPVKEFYANLFDPEDKSPRKSRVRGKLIKFDAATLNEFLETPVGAPWKLQRKDLTTLAQT

SEQ ID NO: 162323 - protein, 76 aa, Glycine max
  Coding DNA Sequence Number=SeqID_70638
MYLQFMAKEEKVKATDDSLSEADWLSEMHPLSEASSLLSGWETLEEDKSEIFTPSTQQARPSRTMSLLALSAPKLA

SEQ ID NO: 162324 - protein, 71 aa, Glycine max
  Coding DNA Sequence Number=SeqID_70639
MAPRKLFAKRSRRDAVAEGTSAAPEFDSHRFRSVEHQQRCRNLPFGGRATRDSRDAYSTKGIRAESPPTFI

SEQ ID NO: 162325 - protein, 252 aa, Glycine max
  Coding DNA Sequence Number=SeqID_70640
  Gene Ontology: Mol. function=transketolase activity; Cellular component=cytoplasm; Biological process=metabolic process
  Homolog annotation: Hit_ID=A3BZR5; Match level="QueryCoverage=94%, HitCoverage=38%, E-value=1e-119, Identity=84%"; Hit description =Putative uncharacterized protein
  Pfam annotation: Domain name=TPP_enzyme_C; Domain location=19-160; Score=-31.5; E_value=0.0021; Accession=PF02775.12; Description =Thiamine pyrophosphate enzyme, C-termina
  Pfam annotation: Domain name=Transketolase_N; Domain location=1-251; Score=468.1; E_value=1.2e-137; Accession=PF00456.12; Description =Transketolase, thiamine diphosphate b
  Pfam module annotation: Pfam domain module=TPP_enzyme_C::Transketolase _N; Domain location=19-160::1-251
MSELQNFRQLHSKTPGHPEYGYTAGVETTTGPLGQGIANAVGFAIAERTLAAQFNRPGHDIVDHHTYVFMGDGCMMEGISHEVCSIAGTLKLGKLVAFYDDNGISIDGHVDGWFTDDTAKRFEAYGWHVVRGVDGHDADAIKKAVEEAKAVTDKPSLLMCKTIIGFGSPNKAGTHDSHGAPLGDDEIALTRKQLGWNYAPFEIPSDIYAQWDAKEAGQAKEKAWDEKFAAYAAAHPELGHRVQTPREQRAAR

SEQ ID NO: 162326 - protein, 89 aa, Glycine max
  Coding DNA Sequence Number=SeqID_70641
  Subcellular localization annotation: CTP_CleavageSite=23; ConfidenceScore=5.03e-01
MLVRMIRTRLFVVAQVKSCPNMHSSYVKAPLSGCARTVGRPPISGGEGVQPSEDEDVQSSKGEGVQPSEDEDVQSSEGEDMQSSDDEDV

SEQ ID NO: 162327 - protein, 468 aa, Glycine max
  Coding DNA Sequence Number=SeqID_70642
  Homolog annotation: Hit_ID=Q6WAY6; Match level="QueryCoverage=92%, HitCoverage=76%, E-value=8e-31, Identity=26%"; Hit description =Putative uncharacterized protein
MGQLQRQAFRKAYGEIDLGLGYDRSLCKGDRFPHLLVPTVEEFKEILGCPLEGRKPYLFSGFYLSMSRIARVVRILAQELDRVKQNRNGVVGIPRKCLEERARALASQNEWPPFIDIMALLIFGVVLFPNVDGLVDLAAIDAFLAFHHSKESPVVTVLADIYDTFDQRCEMSNTRIVCCMSALYVWLVSHLFRQDARHTCPLQSHRSCAEKREANWDQFLASIKGASVNWFPRWKEGRSGILFSCGEFPNVPLMGTRGCINCNPVLAISQLGYPMRGAPLVESLTPFITRGFSDPNARDRELRGSSNGTVDGYHRWLRAYTRGLDWLPKLRAAKEEEAEAPEESEEVQALKAELEKAQAVKERFKTRAVRIQRENDERMDINAATAKALEQETKRARKGKHARKELCGAATTSLNSGEKKETSHESLSQQLSETEANMLALIGKYKEELDLATAHEHKVVDEYAQLYA

SEQ ID NO: 162328 - protein, 117 aa, Glycine max
  Coding DNA Sequence Number=SeqID_70643
  Homolog annotation: Hit_ID=Q7CS05; Match level="QueryCoverage=100%, HitCoverage=83%, E-value=3e-29, Identity=54%"; Hit description =Putative uncharacterized protein
  Pfam annotation: Domain name=VanZ; Domain location=5-114; Score=-7.0; E_value=0.022; Accession=PF04892.3; Description=VanZ like family
MMTNRFPKYVAWSLLLLIVIVTVSPIGLRPHTLTTVGIDRAGAFALCSAAFVLAYPRYWLAIVVAGIVAAFGIEALQFLSPTRHPHLTDAAVKAAGAVAGGLAAYSYLMLRAKMAAG

SEQ ID NO: 162329 - protein, 249 aa, Glycine max
  Coding DNA Sequence Number=SeqID_70644
  Gene Ontology: Mol. function=N-acetyltransferase activity; Cellular component=cytoplasm; Biological process=metabolic process
  Homolog annotation: Hit_ID=A8GLH8; Match level="QueryCoverage=57%, HitCoverage=45%, E-value=2e-75, Identity=97%"; Hit description =Thioesterase domain, putative
  Pfam annotation: Domain name=Acetyltransf_1; Domain location=152-228; Score=60.6; E_value=5.3e-15; Accession=PF00583.15; Description =Acetyltransferase (GNAT) family
  Pfam annotation: Domain name=Tyr_Deacylase; Domain location=2-105; Score=131.3; E_value=2.8e-36; Accession=PF02580.7; Description=D-Tyr- tRNA(Tyr) deacylase
  Pfam module annotation: Pfam domain module=Acetyltransf_1::Tyr _Deacylase; Domain location=152-228::2-105
GDNEQKAQRLCERVLGYRIFGDENDKMNLNVQQAGGSVLVVSQFTLAADTQKGMRPSFSRGAAPLVADRLYQYFVGQCRERGVETQTGEFAADMQVALVNDGPASMYHLRVPVTEQELKEYYQFRWEMLRKPLHQPVGSEKDAYDAMAHHQMVVDEAGKIVAIGRLYINADNEAAIRFLAVDPTLQDKGLGTLVAMTLESVARQEGVKRVVCSAREDAVDFFAKLGFVNQGEITAPQTTPIRHFLMIKP

SEQ ID NO: 162330 - protein, 56 aa, Glycine max
  Coding DNA Sequence Number=SeqID_70645
  Gene Ontology: Mol. function=transferase activity, transferring phosphorus-containing groups; Cellular component=membrane; Biological process=regulation of transcription, DNA-dependent
  Homolog annotation: Hit_ID=A4TSG2; Match level="QueryCoverage=100%, HitCoverage=15%, E-value=9e-12, Identity=66%"; Hit description =PAS/PAC sensor signal transduction histidine kinase precursor
MATGKLPDAGQILNSLINSILLLDDSLAVHYANPAAQQLLAQSSRKLFGTPLPDKL

SEQ ID NO: 162331 - protein, 180 aa, Glycine max
  Coding DNA Sequence Number=SeqID_70646
MASRNKNVLVIVYYDAYVAYCDKGIEFKGGNNVLVSMRRGMTFNVLKTKIQCPSSYTPIPYITTNDYYVPHFEPIEFDTHITSYTQLLGGSSNYCEMNPQLNVPSQLNADPTTDIHVAQSESNEMSHDYCSIGSTCYCEYKILSASVPSRASNNKMMFMCSMLREKTPNHDFSHEWTNPI

SEQ ID NO: 162332 - protein, 122 aa, Glycine max
  Coding DNA Sequence Number=SeqID_70647
MNLGIKGHVAPHATGLLGHGNKRWGGRQKQGFCSYVSSICDEELRPTLLWCFALRLPGGAVLLDESSISWGPDDLAGGKRHSVRTCSPLKARTCSRLTARTCSPLKVRTCSPLKVRTCNPLK

SEQ ID NO: 162333 - protein, 53 aa, Glycine max
  Coding DNA Sequence Number=SeqID_70648
MIEIVLDQRHKQQVGEGVLGRAGRDGRAAGVGLFGDGIEAVVRALLQAVGRKA

SEQ ID NO: 162334 - protein, 34 aa, Glycine max
  Coding DNA Sequence Number=SeqID_70649
MTLLMKKIYGFVIGKEDWCHPLKNLSQEARGQPP

SEQ ID NO: 162335 - protein, 89 aa, Glycine max
  Coding DNA Sequence Number=SeqID_70650
MFLIFNTSALKGLDDTPQSKSKAAARWIVVKCNRQKGITECGYYVMHWMSTIILGSFRNNWETSFICSNILVFRAEVQDPWIPKLRWLP

SEQ ID NO: 162336 - protein, 195 aa, Glycine max
  Coding DNA Sequence Number=SeqID_70651
  Homolog annotation: Hit_ID=A7QRK4; Match level="QueryCoverage=49%, HitCoverage=17%, E-value=6e-09, Identity=43%"; Hit description =Chromosome undetermined scaffold_151, whole genome shotgun sequence
MVLTKIDVEIRYSALVLTKIEGDNHGDGEHDRESEDEREQSLQEVEVVKKEEESEEGDSDSDAKDDKYSSADLRRINMLTMMTGKKKSTKPEALGIQELETLELLDKPSLVPIKNESFSEIDVHSENVCIEEDVLAPFLKFFKGSSDSVVEEEEVGGVLEGSKERGDESEEAKKVCAEYPEPKPGHFVVGVVVID

SEQ ID NO: 162337 - protein, 240 aa, Glycine max
  Coding DNA Sequence Number=SeqID_70652
  Gene Ontology: Mol. function=RNA binding; Cellular component=exosome (RNase complex); Biological process=rRNA processing
  Homolog annotation: Hit_ID=A9PA72; Match level="QueryCoverage=100%, HitCoverage=99%, E-value=1e-112, Identity=83%"; Hit description =Putative uncharacterized protein
METKSTSSFTNLVDQSVCPGDVVLDLSKMINQTIKLGGGLRQDCDAISVMKAGRLRFSKPHKYWVENSQKRYVPYAEDSVLGIVVDSRSDNFLVDIKGPTLAFLPVLAFEGGTRRNIPRFEIGTLIYVRVIKANPGMNPELSCTDASGKAAEFGALKDGYMFECTTGQSRMLLSSPTCPVLDALGKKLSFEIAVGLNGRVWVDAASPHTTIVVANAIMNSETLSGAQQRIMVEKLLQRIQ

SEQ ID NO: 162338 - protein, 360 aa, Glycine max
  Coding DNA Sequence Number=SeqID_70653
  Gene Ontology: Mol. function=4 iron, 4 sulfur cluster binding; Cellular component=cytoplasm; Biological process=metabolic process
  Homolog annotation: Hit_ID=Q6YNR9; Match level="QueryCoverage=28%, HitCoverage=12%, E-value=3e-18, Identity=51%"; Hit description =Putative aconitase
MAGTDSHTTMIDGLGVAGWGVGGIEAEAAMLGQTCVVLTIGGVIPMSMVLPGVVGFKLLGKLRDGVTTTDLVVITKKTIFLLGSINCHAVILLVKWVPMSMVLPGVVGYKLLGKLRDGVIATDLVLIVTQMLRKHGVVGKFVDFYGSINCHAVTFLVKWVSMHPKVIFTRNCKNANISSKGVVPMYSEAKLEFFIFLWYPKTKLHPRGSIQHTDIDSYFCTTSKISHLVFKLLAYPNTSGCIQCHKKTDVNLGNGYCTPAQLRNHQLQPISKMSITLSTMTSRWAPHYPNFAHFSYDGAMYEVQIRQDQGKFFFADGLKTFRKDLGIYESTTINFLAYEQKWIFNLHFTPPLDQQSCDRH

SEQ ID NO: 162339 - protein, 81 aa, Glycine max
  Coding DNA Sequence Number=SeqID_70654
MDGEMYLWRRERIGGARGSDIEKATRKKCESNGAENGREAQEAVMAFVGFAWWGLVGCSHCGRWWIWVGLCGECRGRDNGG

SEQ ID NO: 162340 - protein, 147 aa, Glycine max
  Coding DNA Sequence Number=SeqID_70655
MVPCMHSLSHSPYTMQRIDVVNANNTLKHGLRNPNERAHWQLVALCPMQDVVVWFCSLRKKPNIHIKAAINNAMNKLKTTLHGDTKQAGPKWIEVKSHVQTGGFECGYYIMHWMWNIVSGELKTNWTMWYGDGTPLDKETMTTIRKK

SEQ ID NO: 162341 - protein, 42 aa, Glycine max
  Coding DNA Sequence Number=SeqID_70656
MKMDSVSFYDWSSSLLGVVLKQSVSATLMKRCCKSGLVILLS

SEQ ID NO: 162342 - protein, 206 aa, Glycine max
  Coding DNA Sequence Number=SeqID_70657
MPEIVPKGPHLGNKFAKGNHFGKFAASGGPGLPQRVVRQFGYTQTIPAPPIDSWVSYDDIHDRWMHYEDHIVPAGEVCVVPGACSSDYIDWFIRISYPFMTPGHALDPLPHGHTPQPRVVPQAPHTDIPRVPEPGASSTSAEEPKHTMEVCDDIAERLERHLSLGVVTLGSSTHEVIEECLKLARSVTHDHLVYVRCRRRRRTDQA

SEQ ID NO: 162343 - protein, 313 aa, Glycine max
  Coding DNA Sequence Number=SeqID_70658
  Homolog annotation: Hit_ID=A4PP05; Match level="QueryCoverage=29%, HitCoverage=25%, E-value=4e-11, Identity=44%"; Hit description=IMP dehydrogenase/GMP reductase, putative
MDPITILVAQKLVTLNESYNCVIAQFIAHNTYNISTHMYFTIHHRRCYTFHSFEQLHVDDVVDMLVELLKASKSTPRQLTGYITLLQCWIYEHFPPVASALVVEDYDKRRPRACRWTSGKALPMSTYRRRLERLTPDVVCGPLTVIHRPERVVRQFGYNQTIPPHPTAPLVSVEEMDDRWMQFSDYIAPQYDTFVEPDVHQQPVAVAVAAPDEAGVDVHHLGHAVVIYFFDGYVAIVDKLERLLNLKILTKGTKVYTVGEECLSIARSYISQPTVGHRLRHRWRTNDHCLFLPKMSQFLIKLRMYAFCNTEAS

SEQ ID NO: 162344 - protein, 99 aa, Glycine max
  Coding DNA Sequence Number=SeqID_70659
GQRGWLAIMKTKARSRITDNIVSEIKPEAPYQDDELVGLQEVLELDPDVINESLANVDGGGEEIDANLLKQLDLVEPDEDECMLSEKDIESDFDDTYTS

SEQ ID NO: 162345 - protein, 106 aa, Glycine max
  Coding DNA Sequence Number=SeqID_70660
  Subcellular localization annotation: CTP_CleavageSite=65; ConfidenceScore=5.02e-01
MLPLLLKTRLPLKLRQPQCFKGYWTLQLPKARFAKRELVNFRLARVGALSTRRDNVLAGRAGCALGEQVSDLSSSRVFHLLSELDASLNGCISLSRSFSLSDSLAA

SEQ ID NO: 162346 - protein, 163 aa, Glycine max
  Coding DNA Sequence Number=SeqID_70661
  Homolog annotation: Hit_ID=A7PN85; Match level="QueryCoverage=100%, HitCoverage=100%, E-value=1e-65, Identity=71%"; Hit description =Chromosome chr1 scaffold_22, whole genome shotgun sequence
  Pfam annotation: Domain name=DUF538; Domain location=17-162; Score =177.1; E_value=4.4e-50; Accession=PF04398.3; Description=Protein of unknown function, DUF538
MERALTKVSSMKVGLGSSWITKKAKEEFSNISEDFSVSKPQKSLPDLLREYNLPPGLFPQNIICYEFDETKGKLIVYLPSTCEVSFKDSSVLRYATRVKGVLTRGKLSAIDGMKTKVLVWVKVTNVAVEGYKSDKLWFTAGVKKSRTKDAYDTPRDAVRVSEF

SEQ ID NO: 162347 - protein, 110 aa, Glycine max
  Coding DNA Sequence Number=SeqID_70662
MTKSKGKDPLEGLGGPMTRARARKAKEALQQVLSILFEYKPKFQGEKSKVLLSLGEIIGRPVRIMLFYKNAPTMWDLHKLKGTLKSSVFTPKAQTSRSPLRPLPPDSGPT

SEQ ID NO: 162348 - protein, 376 aa, Glycine max
  Coding DNA Sequence Number=SeqID_70663
  Gene Ontology: Mol. function=protein binding; Cellular component =chloroplast; Biological process=chloroplast fission
  Homolog annotation: Hit_ID=Q45RR9; Match level="QueryCoverage=51%, HitCoverage=83%, E-value=4e-97, Identity=93%"; Hit description =Plastid division regulator MinE
  Subcellular localization annotation: CTP_CleavageSite=59; ConfidenceScore=5.65e-01
MAISGDLRVSATLPLYRSHSPPLRTSSLPSPKVSFSLISLVTNASRSLSQYAYILIAIPLMMISTPNYTQTAPFEGSGIRLGDCWWYLWLASIVVYYGLGGTCLIFLKKVLGLSFVKTAKIVIILVGFFKHANLYDKLEFLRLCDTQPTTSSPLSLHDPSLSDVLDGLNFLLSVTTTLLPNPLTGACSISEFTPKCPCLTIVRCNKRGYCKPVSAVFGGPKFTSDSVSQEAENFLLDAVKMNFFERLNLAWKIIFPSATSRKTSNARIAKQRLKMILFSDRCEVSDEAKRKIVSNVVRALSDFVEIESQDKVQLSVSADTDLGTIYSVTVPVRRVKPEYQEMDEFGTITNVEYKDTGESSGSVDVRFDFYVADESS

SEQ ID NO: 162349 - protein, 39 aa, Glycine max
  Coding DNA Sequence Number=SeqID_70664
MAMTHSDDVGGSCHTHTDLIWMKKGEATGPSVDCEGGVG

SEQ ID NO: 162350 - protein, 622 aa, Glycine max
  Coding DNA Sequence Number=SeqID_70665
  Gene Ontology: Mol. function=metal ion transmembrane transporter activity; Cellular component=membrane; Biological process=metal ion transport
  Homolog annotation: Hit_ID=A7NX02; Match level="QueryCoverage=26%, HitCoverage=50%, E-value=1e-31, Identity=49%"; Hit description =Chromosome chr5 scaffold_2, whole genome shotgun sequence
  Pfam annotation: Domain name=CorA; Domain location=222-544; Score= -1.0; E_value=3.5e-06; Accession=PF01544.9; Description=CorA-like Mg2+ transporter protein
  Pfam annotation: Domain name=FlaC_arch; Domain location=346-477; Score=-14.8; E_value=0.081; Accession=PF05377.2; Description =Flagella accessory protein C (FlaC)
  Pfam annotation: Domain name=Homeobox; Domain location=492-547; Score= 18.1; E_value=0.00019; Accession=PF00046.20; Description=Homeobox domain
  Pfam module annotation: Pfam domain module=CorA::FlaC_arch::Homeobox; Domain location=222-544::346-477::492-547
ASLEEQTRQGTFVPHGREDILNTAIGRPDHGGCVRALGSGVTISQYFGRAPRGSSCSSGSINQVQLAEIIGILQEQWKNDIQVLKHELKEQIILEMSQRGSPISEPIQPNIHVLGARVSTKGSNAEAIVNPSPPNHVAPSKPTMGLYVHCQDSTELVALGKTYDGGSTIYNVAYADDVVRVSVDKVINGDTEVPFLTSEIKYVRQALHTFVAWPTTLVKLASNEHEGTSPSKVTDEAVESVNDVVVDDPLREFIKTLVDIYEKPVELVWDVTKFGIPNAAASLFVTCANVLLRDPTDENVIHVVEELQRWLPRLSATSLQQKGDGKEYLGGQNDVEAAEEDDGPYPALDELTSKISSRNLDRVRKLKSAMTRLTARVQRVRDELEQLLDDDDDMVDLYLSRKVGSSSPVSGSGAANWFAASPTIRSKISRASLATIHLDENDVEELEMLLEESTVVKIANFNNGHDVSIDETLFFYNGGLETDVETFNFQQHPIQHRLTTDVKYGFPPMLKHKYPTEEMKLVLAEELGLTEKQISGWFCHKRLKYKRLMKDEVVANGRQDCSSGVIQDRGSGLGQDSCGSSKHADHRYLDSKEVESHGLYNLGQFATLDSLCGTKIDNNAPH

SEQ ID NO: 162351 - protein, 315 aa, Glycine max
  Coding DNA Sequence Number=SeqID_70666
  Homolog annotation: Hit_ID=A7PLD9; Match level="QueryCoverage=30%, HitCoverage=23%, E-value=4e-16, Identity=42%"; Hit description =Chromosome chr7 scaffold_20, whole genome shotgun sequence
MQINVGLIQAKVIHLMDLSLSILVSSPHGNLWIILWQSIGKIIELIEGITILAEDYHNSDSLYKRDRNIRSHKNQGIPTGYMVRVFQWKTFELSNVLQQFVHDVSRMRDAIKKQFHWDETLSENEAEIGIGSGEQKSILSRSGSAEKLAERQETILNLGKQFKALAAPKDAYLFDNMLADDDTKVKARMIVPVLILWTLYQLLENILLLNELKNVQYKHNITAEDASLRACTKVQLPIKDVPNANNPFTFVTADFSTKVQLTDECAACHYHRGGQCQLDSREKFCCTNATLQQNPGKHPRMQCTKTCFFYLFFTF

SEQ ID NO: 162352 - protein, 55 aa, Glycine max
  Coding DNA Sequence Number=SeqID_70667
MDIIETIFSHKDIKAIILTSLLHPRDEGKPILNFTPNGLEAQYSTENKTLPLENS

SEQ ID NO: 162353 - protein, 654 aa, Glycine max
  Coding DNA Sequence Number=SeqID_70668
  Gene Ontology: Mol. function=metal ion binding; Cellular component =integral to membrane; Biological process=protein palmitoylation
  Homolog annotation: Hit_ID=A7QSP4; Match level="QueryCoverage=90%, HitCoverage=87%, E-value=0.0, Identity=60%"; Hit description =Chromosome undetermined scaffold_161, whole genome shotgun sequence
  Pfam annotation: Domain name=zf-DHHC; Domain location=165-229; Score =101.2; E_value=3.1e-27; Accession=PF01529.11; Description=DHHC zinc finger domain
MALNCPYHIPFLAFLIILATTTLLCQNWDAFMEDTLNVLLKESDSEFFNGFNILLKGTATSDPADPGVFKSKKYLKIPDSKKLDGLKNSKLGGESTSSMHDGNASTVGPKSADKEELGTEASFKDASIFTEKKNASSPSSSCLLLVCSPCAYICGCSSSSNESSEQQASEDGMFYCSLCEVEVFKYSKHCRVCDKCVDRFDHHCRWLNNCIGKRNYRKFFTLMVAALLLFPCKILDILPSKSQKLNHPKTQLVGSSMPKPEENPRLILQWLTGILVLICCFVEKKKFSVDISSKLGSSFSLVPFVIVVAVCTILAMIATLPLAQLFFFHILLIKKGITTYDYIIALREQEQQGIGGQQSPQMSPVSSLTGMSSASSFTTFHRGAWCTPPRLFLEDQFDVVPPETASVSSLGKKTMRDEPVKKKNTGAVKISPWTLARLNAEEVSKAAAEARKKSKILQPVTRHNNEPFRLDPDHNSGSSGRRMSPRIETNRRRPGKRIRLPADLPVEAMPKFSASNTDKIFSGTSSFALLQLEARSAFQPSQAVSSSAGIVASSPESSLDSPDIHPFRVSTTEAEEARRLAGLSAAATANLKGIPLSRSTSDGYEASGGEDSDRVPTRIVQRSTNWTNLLFSADQEERAFETKSSSSMVYSRKL

SEQ ID NO: 162354 - protein, 105 aa, Glycine max
  Coding DNA Sequence Number=SeqID_70669
  Gene Ontology: Mol. function=RNA binding; Cellular component=ribosome
  Homolog annotation: Hit_ID=A7QRK4; Match level="QueryCoverage=88%, HitCoverage=27%, E-value=7e-19, Identity=41%"; Hit description =Chromosome undetermined scaffold_151, whole genome shotgun sequence
MEHLLCDVNNVEECSTIQGKIGILKNDDAINGIKQLGEPIEVRITKWNTKGLLTRIEGLRAFLPKVELMRRVNSFTELKENAQLKSFLALVSLSVIGRSLYELSY

SEQ ID NO: 162355 - protein, 76 aa, Glycine max
  Coding DNA Sequence Number=SeqID_70670
  Homolog annotation: Hit_ID=Q9M0T9; Match level="QueryCoverage=98%, HitCoverage=9%, E-value=4e-07, Identity=41%"; Hit description =Putative athila transposon protein
MADEQHQRITLEDYSSSSVPQLFTSIARPEVQAHNINYPHSLIHLIQGNLFQGLPNEDPYAHLATFIEICNTVKIV

SEQ ID NO: 162356 - protein, 73 aa, Glycine max
  Coding DNA Sequence Number=SeqID_70671
VHPLWYKKRVHLLGLLTENKRGYISYGSVLVEGTSTRLFKENKGGNFRRLKRNLKDCKSLGDWMWAQVVAEPV

SEQ ID NO: 162357 - protein, 70 aa, Glycine max
  Coding DNA Sequence Number=SeqID_70672
GQNHLRPWSDARTKLKAETNQGKMVTRSQFAAQCRFLLSAEDKGEEVRGGAIHKGISHGRRSFTTKMSLG

SEQ ID NO: 162358 - protein, 184 aa, Glycine max
  Coding DNA Sequence Number=SeqID_70673
MVIDQSLLFELTQLSSDDVPFEGTLDDEWKFDFSVSDARQMVSTNQADMIGRLLAGSLAFECRIMHYLIVLILLPRSSNLAHVSEEELIIIEEWFLGEEGRTSIGRRRPFSITTSQGDDSSSLMHNILDRLDGLHTFVSECFDSFDSRIDAMDARFPGMDTRITKLEEDVSYVHQCFDLPPSSS

SEQ ID NO: 162359 - protein, 72 aa, Glycine max
  Coding DNA Sequence Number=SeqID_70674
MKDFWHCHKIGLIKVILVASNLTYLPSPEVASTQTYLPLPEVASTPTYLPSPEVASTLTYLPSPEVASSKSS

SEQ ID NO: 162360 - protein, 135 aa, Glycine max
  Coding DNA Sequence Number=SeqID_70675
MAKSMDNSSTFEETEVNPKLEEVLEAFNEMHQEAQRLDVLNKKLKSDLKLHITKLASTQRKSDLNHMLSMQKHTTDKAVKAMPSKVILMMPKNQELSKFQRFKNQVSRIKIQDSRFKNQDSRIIKIKIQDLRFKT

SEQ ID NO: 162361 - protein, 111 aa, Glycine max
  Coding DNA Sequence Number=SeqID_70676
MEHFLEQVAWPEAQLPLVRPNEAAPPEPTLVQVDPELADPFSPVVNPLSFPEREVVPPSPPLIIISDASSDEATAPPDSPVGETADLLTSLVGGIFDSSSGEVVALTDSPV

SEQ ID NO: 162362 - protein, 94 aa, Glycine max
  Coding DNA Sequence Number=SeqID_70677
MSLHCYQASRRPYMTTDRPPLLMAHTDPGIGPNISIGVAICHNLPYDGSAGQKPKEHLPKRKMRESRHQRLFEENVRKTKKRSTNIEKKGSRIV

SEQ ID NO: 162363 - protein, 105 aa, Glycine max
  Coding DNA Sequence Number=SeqID_70678
MDICEDNDIPIILGRPFMLTTSCIVDMGRKKLELGFEDQKIDFDLFVEDKPAPEQNVCLQLILKDRYKGFNFLRKRLKNNLEIFFLKIVLSLTASLVLTAFFVML

SEQ ID NO: 162364 - protein, 78 aa, Glycine max
  Coding DNA Sequence Number=SeqID_70679
MKSVSVVVYYDGDLISSFEWILFECPRGPKVVTISEDIVFDALRKTIMDVIEDDSCVEYKCMKLKHDNDVGKIFFIFS

SEQ ID NO: 162365 - protein, 108 aa, Glycine max
  Coding DNA Sequence Number=SeqID_70680
MWAIIDQYKEKLSLVASHEQILEDEHVKVSVLQVEREARERVTDSLHKEAMMWMDRFAFTLDGSQELPRLLAKAKAMVDVYSAPEEVHGLFYYCQHIIELMSHIIRNR

SEQ ID NO: 162366 - protein, 150 aa, Glycine max
  Coding DNA Sequence Number=SeqID_70681
MQSQFQSEMQSHGLALPLEPEVGPSAARVSTKESYVDPSGNDPDMGDSDKCGLYIEQNPPHLVALGRVYEGSTTIHNIPLLHDQVKVGVEEVKHADAPIPVPTNEGVVGPAKLADRSDHEVDDPLYLMTLTIPQLFLKPFQVMWDATVFR

SEQ ID NO: 162367 - protein, 115 aa, Glycine max
  Coding DNA Sequence Number=SeqID_70682
MYPPLELIHKRCTLSCSQSNPSRCTLYLYHKGCTLQCVKTKILGGRRETQKEFRRLVLGEFFWAKGERNEKMNSTSFQGLENQKTSESFWYKEEEEEVQRFKACKGLYELVFKIE

SEQ ID NO: 162368 - protein, 100 aa, Glycine max
  Coding DNA Sequence Number=SeqID_70683
MERKNRSFEEDARTLLNETRAYKVFNKRTLNVEEFVHVVCDETNSIVQENSLEEDAGFEEKDSTLEDDIKAEELEQNKEISTTMCKEFPREWRTQKFWIT

SEQ ID NO: 162369 - protein, 62 aa, Glycine max
  Coding DNA Sequence Number=SeqID_70684
MEKSEKKNINEKKLKKAYITWDENDMESSEDSENEEINLCLMEKSYESDEEENKDMPPIRLD

SEQ ID NO: 162370 - protein, 312 aa, Glycine max
  Coding DNA Sequence Number=SeqID_70685
  Gene Ontology: Mol. function=inositol or phosphatidylinositol phosphatase activity; Cellular component=plasma membrane; Biological process=carbohydrate metabolic process
  Homolog annotation: Hit_ID=A1FX34; Match level="QueryCoverage=64%, HitCoverage=75%, E-value=2e-99, Identity=90%"; Hit description =3'(2'),5'-bisphosphate nucleotidase
  Pfam annotation: Domain name=Inositol_P; Domain location=114-312; Score=69.3; E_value=1.3e-17; Accession=PF00459.16; Description =Inositol monophosphatase family
  Pfam annotation: Domain name=NUDIX; Domain location=1-121; Score =30.1; E_value=8.3e-06; Accession=PF00293.19; Description=NUDIX domain
  Pfam module annotation: Pfam domain module=Inositol_P::NUDIX; Domain location=114-312::1-121
MLDDETVLLVREYAAGMHRYELGLVKGRIDAGETPEQAADRELKEEAGYGARRVDVLRAMTLAPTYMSHQSWLVVARDLYPEKLAGDEPEELEVVPWKLAELDQLMLRIAMIKLTTDLRETAIAIAQEAGQAIMQVYADGFEVQIKDDNSPVTSADLAANQVIEQGLQQLTPDLPILSEESAQVGWEQRRHWGAYWLVDPLDGTREFVKRNGEFSVNIALIYQGAPAFGVVLAPVTGIVWHAMRGELAYRRQGLHDTVLRTRTPATAPLRVAASRSHRSPETEALLARMGRIETIAQGSSLKFCRIAEGGLD

SEQ ID NO: 162371 - protein, 87 aa, Glycine max
  Coding DNA Sequence Number=SeqID_70686
MEAPRLGTPSFFTPPSIYSKIGEELATQLAQASQESIRGVRLDGGGHMNNARQSIHRVSETRFEGGGQANNARQSIRGALDSMVEDT

SEQ ID NO: 162372 - protein, 118 aa, Glycine max
  Coding DNA Sequence Number=SeqID_70687
MRRIALERRERSAGQPQGLQVGRIPFCHIDEIFVSVGWMCEGRVAVINDETPQGQSNWMRSCPPQFELGNWRVVKQPGISVENSMEVKPHQEETKVVKFGVGKERKKVKVGTDMSANV

SEQ ID NO: 162373 - protein, 84 aa, Glycine max
  Coding DNA Sequence Number=SeqID_70688
  Subcellular localization annotation: CTP_CleavageSite=13; ConfidenceScore=5.07e-01
MATPAASPLPPPPADASASPSTLKRTPEFEIPKASDSRIKKKVLQTVGKRWRQFKSDLTRKLALAADKEIGTCSRQGQCGRHCL

SEQ ID NO: 162374 - protein, 97 aa, Glycine max
  Coding DNA Sequence Number=SeqID_70689
MTLSLRKTRQQVSISPCRAQATTLHGDQPESQGSSKSSDMPPRISNMVITPPMYIHSIHHQHQHHLISMSLSTSTPSHLSIIININIIINITSNHIP

SEQ ID NO: 162375 - protein, 150 aa, Glycine max
  Coding DNA Sequence Number=SeqID_70690
MPPTRHPLDPDKSNRAPGFSTLITGLCQSFGVPVTPSKVIRPPITRAFIEKYCMPRQVQGDAPQAADAPPPPHQDDPTGSLGMECYRQHLVRQQAANHQGQFRAEVAWPGDWPEAQAREAPAGSPDDAEEARMDEEMTNLLGFLGGSGAT

SEQ ID NO: 162376 - protein, 121 aa, Glycine max
  Coding DNA Sequence Number=SeqID_70691
  Homolog annotation: Hit_ID=UPI0000ECBAF8; Match level="QueryCoverage =33%, HitCoverage=48%, E-value=1e-16, Identity=100%"; Hit description= UPI0000ECBAF8 related cluster
MTYTFVATYPSTRGRRGAHGCVFQERKMCKVATNVYLRKMSQKPERVFPSLLCILNCDEEGILYSRPAGMQAWHWPSFYNVVTGKTLALPNLIALQHIPLSPAGVIAKRPAPIALPNSCAA

SEQ ID NO: 162377 - protein, 142 aa, Glycine max
  Coding DNA Sequence Number=SeqID_70692
MGVSCAEADRECEPLDGTLHDVETYPIVEELLQGMMNKGQIEVYSAKKGEGDICMHSDDKNPCKPKPLVIHFTRDVTTQRPQGFHPFTVKTPVPFPYRSDKVVPWKYAAQGSDGRKDAPVIRVKEDLLFTSLHYCEIYQQVY

SEQ ID NO: 162378 - protein, 32 aa, Glycine max
  Coding DNA Sequence Number=SeqID_70693
MAESLFLDDGNLSQPMAGYQGIGNFFLPQIHI

SEQ ID NO: 162379 - protein, 217 aa, Glycine max
  Coding DNA Sequence Number=SeqID_70694
MVVNLYGARERRIADLAEGLRAGIDAVGLADEGHFAFLKRLCAARHLVDIRLAQARHADPIDVADLEVTVQRRRGLIIAVRFQFDFALRTQLEAGNQRESVRPQFAGLLIVLQRKGQDDAVVIFIVRRQAPGLVAGKTVGGLRHRAEPRPADRHAAADGLAFGEGGIVAEPNHRLLTAGLPGQQMGALQRDGRAHFRMRHHNHAQLIELPLADGDPL

SEQ ID NO: 162380 - protein, 29 aa, Glycine max
  Coding DNA Sequence Number=SeqID_70695
MDNSLKVGEDEWREKERMSTKFYASNEEW

SEQ ID NO: 162381 - protein, 81 aa, Glycine max
  Coding DNA Sequence Number=SeqID_70696
MSREFSLILTRLRSQMSLVELSLTGQHYSYNIPKNQVTALCVQIYDTLALSYQALRIKPFPNEDDPKYICVCMINTKTCEN

SEQ ID NO: 162382 - protein, 386 aa, Glycine max
  Coding DNA Sequence Number=SeqID_70697
MRIDADSLNTFLETLVVLEEGETLPTYSRFTRMRIDPQEFVARLCILERGFVLNAEGHPWKLLRKDLTTLAQTWSVFSYSNLTPTSHTSDLNMDRARLVYGLVMGMDMNIGALISGQISTIAQSNSSRLEFPALITALCRARGVTSDSLTYESLSPAINLAYIKKNCWNVDDLTVNFKRARKVRARPTDIPSSSAPLTPSTFSPPAPPTSVTPTPAAQDPQRFEAMLQSIHQGQILLLQSLQVVAPPGSILLVEQFIKKVSWLGTLPSVVREGEGPSAQVPQQVQDASFEATIPGAFDFSGADVEMRPDEVVPPEPIVPVIHETVEEGMDLFFAQQVADPPTPIMEMPEDPTTPVLRLSSTPPATLVLHLTDEKDMQDTQDQSQEF

SEQ ID NO: 162383 - protein, 53 aa, Glycine max
  Coding DNA Sequence Number=SeqID_70698
MEGWNPPPEGSIGFDACLRDAGEHFVQAIMSFVKAICQSRKERPMQFYRFLNR

SEQ ID NO: 162384 - protein, 147 aa, Glycine max
  Coding DNA Sequence Number=SeqID_70699
  Subcellular localization annotation: CTP_CleavageSite=11; ConfidenceScore=5.46e-01
MAAKKATHTIPESKKRKFVNSQPTSSGVTKPLGFPALITSLYKFQRVQIPPHPGPASRPQPPPRAQPSNFFALQSYMTTHFTHVEQLLATNHCAYTPLNDSFYRDSPIFPEGMDAFHGAHVARPKHEAQQEGQEDVEGKQVLDTVDD

SEQ ID NO: 162385 - protein, 160 aa, Glycine max
  Coding DNA Sequence Number=SeqID_70700
MPTKILLWTPADLLQVVVVTVAGLVGGDEQRSWMYDSVMYKEVYVNNQNEDEGGVNEEHVNCFDSFNTSQVFATRDDALRWARSLAYEIGFVVVIMRSDTNNDKGGEANLPRWQHPYALYRSPIPSNPSTVNAQIKEEKPTYHDGDNNATTVAAQRQHEQ

SEQ ID NO: 162386 - protein, 89 aa, Glycine max
  Coding DNA Sequence Number=SeqID_70701
MGRCNNDAILSQPTLRREGDARAHGCVFQERKMRGVTTNVYSRKTSEKPERCGLRTLSVKGSGVIFTHGEGCFPRSYAFLNCDKEIRPT

SEQ ID NO: 162387 - protein, 406 aa, Glycine max
  Coding DNA Sequence Number=SeqID_70702
  Pfam annotation: Domain name=DUF1723; Domain location=35-82; Score =14.8; E_value=0.0094; Accession=PF08330.1; Description=Protein of unknown function (DUF1723)
MNHVVDEPHEEPYDPVTSDEHAELKLASHGSKVTKFGKPAPEIKERWHKETSSFHLPIGEMSITLNDMCHTLISSGDHCLVACNLRLVASRYSTPIVRKSVKFRDIPKVKKKHCCAIHKVLQHSGSQKESCCVIRKVSQHSERKMDTPVSPRVALPSKGRLRQLATPLGLHTTPEPFILGSMLESFIFMKCCRSIGDRNFHSLDYRVEPSSCFLEKVHRVKVKYGKHALRRPYRTRARARVMGELEEVQEQMKADMEAMKEKMTTMMEAMMSMKKIMEANAVAIAATSAVAKVKPMPPFGLNQMNNPTSDMVGKDLGSTGGPHYAQIQNKHAFPPYEVPTIHHPMWHTLLVRMSITPLPYSLRADNPKLIMHMSLKPWGRHMKFPTTILPTSSLASDMPLKGKQVV

SEQ ID NO: 162388 - protein, 131 aa, Glycine max
  Coding DNA Sequence Number=SeqID_70703
  Subcellular localization annotation: CTP_CleavageSite=49; ConfidenceScore=5.23e-01
MFAHSIKGCRPLGRTCGVLIPSPSRLFRFFRRFPQINVGGDSARIPFVEHASRESRVALPPKVKNHQKLLPNIENGMTLSSPCEGMVYWLSLQRYFTRRNIFKNWNYGGGMMMRMLENRHYGGRILLQKGI

SEQ ID NO: 162389 - protein, 52 aa, Glycine max
  Coding DNA Sequence Number=SeqID_70704
MWNSKSVQKPSWKANTFHDARPSRDYDDSQLDLSGFGQPKSSSKPAGFSPEA

SEQ ID NO: 162390 - protein, 527 aa, Glycine max
  Coding DNA Sequence Number=SeqID_70705
MTLFPPMHALSRMSRCTPFRGGVDGGRARQRDDSEDSDGDHDDDDWEGMESTELDEAFSVATALVDAAAVDRLSQKVSRAKPFIHIMSLTITIQVAHADEELLMLLSRIINNLLLNAAMSEYVPAGVDGKRCLENVVNEVVLLAARRAPQNFRQLSLSLTQPSSSFLPSTIVAQQSFNLWCSFLLQIAKGEHFRSREVRGYEWDFENSGLGGLLSLLNFVVDPTVNELDRRNCYCGLYVRKAVILVDLERIDGDPVLRKTRIWATWEYVSSVGGGQQGMVGLCAHCGCGKLVVHHRPTATYGTWRYVAGVRRPWGRQASSWQSTDKRKTRPQSKEACGGWPAEAKMVSACVIDYTEEWVTGNRLPGMCNRLHSVLLHISCPEIVMAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 162391 - protein, 76 aa, Glycine max
  Coding DNA Sequence Number=SeqID_70706
MFNIFYNNPPLPFMVLFAIICDNNNPPSNQHDSTSNPEDLSDEYESCWVKNHGSDTDSSSEPKGSNMTPSHETIFK

SEQ ID NO: 162392 - protein, 62 aa, Glycine max
  Coding DNA Sequence Number=SeqID_70707
MTMEEGGVKKEDYTQDGTNVAPCRTCRSIVAEWRRRKGDWRCHFKEMSQEHVHHHRKSWIRA

SEQ ID NO: 162393 - protein, 93 aa, Glycine max
  Coding DNA Sequence Number=SeqID_70708
MARDSVLTRVATGAAVGGAIGGAVSVNFGTGVLHAGAVYGTYDAIRYKRPCSSSLPNNMILSTDFPLGIDVQGVCIPMIGGLVNAVNNSALLG

SEQ ID NO: 162394 - protein, 189 aa, Glycine max
  Coding DNA Sequence Number=SeqID_70709
MAPRKLPAKRARKDATRKGSSAAPQVDVEFDGHRFRSEEHQPRFEAIKGWLFLKERQVQLRDGEYAEFLEEMAKKQWTQLAAPMAKHDPEIVMEFYANAWPTKEGVTDKCSWVRGQWIPFDEDAINQFLGYPLVLEEGQRYEFSQRRSQASGFDEVAISQLLCVPGQDFVGSMAGRQVRIMRTSMTTLT

SEQ ID NO: 162395 - protein, 101 aa, Glycine max
  Coding DNA Sequence Number=SeqID_70710
MEGLMTLLGATGTLWNWQRLVIKARNPRALLDFFGSKGCLDVAEQQRHPYLGQGGHVVEHDPPSPPYSGSGEVLPRCAHQLGNGLLVETVSLVPPLAISHY

SEQ ID NO: 162396 - protein, 39 aa, Glycine max
  Coding DNA Sequence Number=SeqID_70711
MADGTPFVGCLKASGCWIDGGGKSTHVAIANATASKVAP

SEQ ID NO: 162397 - protein, 215 aa, Glycine max
  Coding DNA Sequence Number=SeqID_70712
MEITTIHTNNKATIMLNFNKPQFIRMFQRNSVLLNNKVIVSKVLGVKAEKGPMIHVARALYNENAEKVGDQKTIVYNIMCKRANIWANILNKSILHKASSKTSLSDLHNTYGQETNWIEASPPFEVPRRIKIRATKDNPKIIDKEWAPSKKVDKEWAPPSPPSTSSSETMHDAPILMQSYPPRALDRRLQEDWARDAREGLRVLMSLRVDFRPLG

SEQ ID NO: 162398 - protein, 106 aa, Glycine max
  Coding DNA Sequence Number=SeqID_70713
MGLNQALVFKERFIKSRASMEVTSLQKKECALWRPYRTRARARVMSEIEEVQEQMKTNMKATKDQMVIMMEDIMSMKRMRDVNTATVIATSTATEVDPTHPSGLNQ

SEQ ID NO: 162399 - protein, 119 aa, Glycine max
  Coding DNA Sequence Number=SeqID_70714
  Homolog annotation: Hit_ID=A5C693; Match level="QueryCoverage=55%, HitCoverage=30%, E-value=7e-09, Identity=40%"; Hit description =Putative uncharacterized protein
MKRVHLLGLLTENKREYISCGSVLVEGTSTRFKENKGGNRIFHDDDEDQVNLYLMTKSDENNKEDSVRKTWYIDSGCSKHMTSDVSKFTTISPKKSGHVTYGDNNISKISKEATSKPSL

SEQ ID NO: 162400 - protein, 59 aa, Glycine max
  Coding DNA Sequence Number=SeqID_70715
MQQAFRRTATQISKLVDDMANTMAKQEEERVEIETYQGIFQVTSIHHQMTTEEETSEVS

SEQ ID NO: 162401 - protein, 109 aa, Glycine max
  Coding DNA Sequence Number=SeqID_70716
MPFGPDYYNLLCHPETIEFVGRQRQIMVICPLFEDFHVFRSRLLQSPLPSRDKRVCWHPETNYGHLPPFRRLPCLSIKTIAVSFAIQRQASPLVLLIGLVVGLVVKSLE

SEQ ID NO: 162402 - protein, 51 aa, Glycine max
  Coding DNA Sequence Number=SeqID_70717
MDNSSFFQIHPRAQPRSVTLNGWLAKPANWLSEKHKLNRCFMSKILVMKGG

SEQ ID NO: 162403 - protein, 141 aa, Glycine max
  Coding DNA Sequence Number=SeqID_70718
  Subcellular localization annotation: CTP_CleavageSite=41; ConfidenceScore=5.34e-01
ANVPDDARRVTSSSAPFVVLTRDSGDMRGYLMVTRTFGQPVANKLVDARRLTSSVAPFVVLTRLPYGYPHHSSTMGKQAHRCTETNIIFCTFCRPDPLKSGDLRGYLRVSRTFGQLGGNEPVDTRGQTSSSAPFVVLTREV

SEQ ID NO: 162404 - protein, 206 aa, Glycine max
  Coding DNA Sequence Number=SeqID_70719
  Homolog annotation: Hit_ID=A1FX22; Match level="QueryCoverage=100%, HitCoverage=46%, E-value=1e-99, Identity=91%"; Hit description =Putative uncharacterized protein
MGGSVLDGLKLIVREPLLRWLAIMVVFGVGVGTLLYNQQASIVRAAFNDAGAATAFFSRIDLAVNALALLMQLGLTRWLLSRHGIAPALLIPGFAILIGFSVLAASPMPLMVAVVQVMTRASEFALAKPARETIYTRVDRQWRYKAGAAIDTVVYRGADLSFAWVHKGLSLFGSHVVFIGGVVVAACMTAAAFGVLREEKKLPRDR

SEQ ID NO: 162405 - protein, 202 aa, Glycine max
  Coding DNA Sequence Number=SeqID_70720
  Homolog annotation: Hit_ID=Q6WAY6; Match level="QueryCoverage=89%, HitCoverage=34%, E-value=7e-13, Identity=29%"; Hit description =Putative uncharacterized protein
MRCLEEKAKALANQGEWASFIDILVLLIFGVVLFPNVKGLVDLAAIDIFLAFHHGKESPVVAILANMYDTPICLLQGHYLCIEKGKANWDQLLASMEGASINWFPRWKEGKIGNLCSCEGFPNVPLMGTRGCINYNLVLAIRQLGYPMRGAPSEESIAPFIARGFSDPNAGVLQGVHNAWDVLPKLKAARPEEAEAPEESEE

SEQ ID NO: 162406 - protein, 34 aa, Glycine max
  Coding DNA Sequence Number=SeqID_70721
MGPFQNILEAGLLMEEATQLAWASWAATSSPFSL

SEQ ID NO: 162407 - protein, 89 aa, Glycine max
  Coding DNA Sequence Number=SeqID_70722
MLNPFLFTPPPTYNRLLEEESGRPNFRRSYGNSRIAQQHLLLISATLRNFTDRVTLLPFDSRRISGLTYCATKGAKYLEAANQRLHVIK

SEQ ID NO: 162408 - protein, 48 aa, Glycine max
  Coding DNA Sequence Number=SeqID_70723
MALYRLAFAYSNPLKLPCSDVFRLSSAGKRRQSVGRDPILYLHPSLST

SEQ ID NO: 162409 - protein, 431 aa, Glycine max
  Coding DNA Sequence Number=SeqID_70724
  Gene Ontology: Mol. function=adenylate cyclase activity; Cellular component=cytoplasm; Biological process=cAMP biosynthetic process
  Homolog annotation: Hit_ID=P0A1A8; Match level="QueryCoverage=100%, HitCoverage=50%, E-value=0.0, Identity=95%"; Hit description =Adenylate cyclase
  Pfam annotation: Domain name=Adenylate_cycl; Domain location=1-431; Score=615.6; E_value=4.6e-182; Accession=PF01295.9; Description =Adenylate cyclase, class-I
MMQSYRNLIRFARRNNLSVSASPQDIGVLTRKLYAAFEALPGKVTLVNPQISPDLSEPNLTFIHVPPGRANRTGWYLYNRAPDMESIISHQPLEYNRYLNKLVAWAWFNGLLTSRTRLFIKGNGIVDLPKLQEMVADVSHHFPLRLPAPTPKALYSPCEIRHLAIIVNLEYDPTAAFRNQVVHFDFRKLDVFSFGEEQKCLIGSVDLLYRNSWNEVRTLHFNGEQAMIEALKTILGKMHQDAAPPDSVEVFCYSQHLRGLIRTRVQQMVSECIELRLSSTRQDTGRFKALRVSGQTWGLFFERLNVSVQKLENAIEFYGAISHNKLHGLSVQVETNHVKLPAVVDGFASEGIIQFFFEDADNNDSGFNIYILDESNRAEVYHHCEGSKEELVRDVSRFYSSSHDRFTYGSSFINFNLPQFYQIVEVDGRTQ

SEQ ID NO: 162410 - protein, 44 aa, Glycine max
  Coding DNA Sequence Number=SeqID_70725
ENEGGSCHPTCPGELGCFIQKAVPSGELPGRPKWAWLLFAPPIY

SEQ ID NO: 162411 - protein, 147 aa, Glycine max
  Coding DNA Sequence Number=SeqID_70726
MAPKKLSAKRSRRDTAAEGTSAAPEFDSHRFRSTEHQQCFEAIKGWSFHRERCVQLRDDEYTDFQEEIACQYWTSLVTPMAKFDPDIVLEFYANAWPTEEGVRNMWSWVRGQWIPFDADAHSQFLGDPLVLEEGQECEFSQRRNRAN

SEQ ID NO: 162412 - protein, 132 aa, Glycine max
  Coding DNA Sequence Number=SeqID_70727
MLRLKRTSAAPEFDSHRFRSAEHQQHFEAIKGWSFHRERRVQLRDDEYTDFQEEIARRHWTSLATPMAKFDPDIVLEFYANAWPTEKGVWDMRSWVRGFRPDRCREAGADHAHQYDHLDPDVDDIAAQQCPA

SEQ ID NO: 162413 - protein, 110 aa, Glycine max
  Coding DNA Sequence Number=SeqID_70728
MNRGARGQVRADARPVISRSSSRVRLRTIKKHYWEAAYVLDHSIQEMSPKKLSMKRSRKDDTGEGSSAALEFDSHRFWSAEHQQRFKAIKEWSFHKERRIQLREDEYPNF

SEQ ID NO: 162414 - protein, 56 aa, Glycine max
  Coding DNA Sequence Number=SeqID_70729
MDQSSFKNIWDILIRVLDAQAFVGEIRMFKIRMLKTIMLKITNNRMLGMLKRIKGL

SEQ ID NO: 162415 - protein, 123 aa, Glycine max
  Coding DNA Sequence Number=SeqID_70730
MVRLMKQANVFPLKKTLNKFTICEINRDKDILKEDSQASSRVLITNKDSGDHTLTINSTRTRVTMSNHKSIKSALKNHEVQVGQLAMQIADKSSNSFVANIEMNPKEEVKAMMTRSNLDKERY

SEQ ID NO: 162416 - protein, 352 aa, Glycine max
  Coding DNA Sequence Number=SeqID_70731
  Gene Ontology: Mol. function=GTP cyclohydrolase II activity; Cellular component=nucleus; Biological process=riboflavin biosynthetic process
  Homolog annotation: Hit_ID=Q57NU9; Match level="QueryCoverage=55%, HitCoverage=100%, E-value=8e-99, Identity=90%"; Hit description=GTP cyclohydrolase-2
  Pfam annotation: Domain name=GTP_cyclohydro2; Domain location=158 -326; Score=416.4; E_value=4.2e-122; Accession=PF00925.11; Description=GTP cyclohydrolase II
  Subcellular localization annotation: CTP_CleavageSite=31; ConfidenceScore=5.12e-01
MTSVAQTNSTTTVTTCRRGHNRPITSSAQLAANMVWPDGKAKPVSNAHKNRAVHDNQQQNGRPEAKAQAPQYPAAQNQAGQRAPRTGDGFGDPEQHAQQMPALPRLPLPAGKPYAQRHQHGPGSGYGTISAVSSGQSGPCVIMMIAHPLKVLESHMQLKRVAEAKLPTPWGDFLMVGFEELATGHDHVALVYGDISDHNPVLARVHSECLTGDALFSLRCDCGFQLEAALTAIAEEGRGVLLYHRQEGRNIGLLNKIRAYALQDKGYDTVEANHQLGFAADERDFTLCADMFKLLGINEVRLLTNNPRKVEILSEAGINIVERVPLIVGRNPKNAHYLDTKAEKMGHLLPKS

SEQ ID NO: 162417 - protein, 194 aa, Glycine max
  Coding DNA Sequence Number=SeqID_70732
DAGSRQARQGASAGVGGCRGWLNYAASEQIVLRVHHMRAIGAGLFAITPAGERGMCCKAIKLGNARVFPVTTLELVLALVEVRATNGSLEQNACASSNEISSLKELLLAAEKKCSDAEEKAQQATMLKRRDDAVCVLGALPLPRSLTRCARSFGCGERYQLTQRRSFAPSWAVCTNPRSADRCALSGNYRLESP

SEQ ID NO: 162418 - protein, 94 aa, Glycine max
  Coding DNA Sequence Number=SeqID_70733
MSKCMQTRSQKPELLEEPEIERLPHRLRKEQREKIMVEAKDATRTLMEYLTHHLRETNNIQLSALPRGVTLEFKHGFLQMIETTCSTKLHMRTP

SEQ ID NO: 162419 - protein, 69 aa, Glycine max
  Coding DNA Sequence Number=SeqID_70734
MALGIGQKHQWNGETTEAREKTQKHGGDGADEIMRKLRKERRAYLQRGKRRRRRGGSLAAKRRRDFRFR

SEQ ID NO: 162420 - protein, 129 aa, Glycine max
  Coding DNA Sequence Number=SeqID_70735
  Homolog annotation: Hit_ID=O69419; Match level="QueryCoverage=47%, HitCoverage=93%, E-value=2e-09, Identity=65%"; Hit description =Putative uncharacterized protein
LGHHFKNSVAPPTYLALLILLPVAAASGDKSCLTGATLPEGRKADRYPVSGRVGTGERTRELPGGNAWGAEPMEKRQQRGLFTVPGLLLAFCSHVLSCVITLILWITVLPPLSELIPLAAAERPSAASQ

SEQ ID NO: 162421 - protein, 187 aa, Glycine max
  Coding DNA Sequence Number=SeqID_70736
MALKKLSTKRSRRDATGEGSSAAPEFDSHCFWSAEHQHRFEAIRGWSFHRERRVQLREDEYTDFQEEIARRRWTLLVTPMAKFDPEIWIPFDADALSQFLGDPLVLEEGQQCEFSQRRNRADGFDEEAIAQLLCILGQDFARTAVERRVQIMRTSITTLTQTWMTLLLSNVFPSDHNSDLPLPKCQL

SEQ ID NO: 162422 - protein, 223 aa, Glycine max
  Coding DNA Sequence Number=SeqID_70737
  Gene Ontology: Mol. function=succinyl-diaminopimelate desuccinylase activity; Biological process=lysine biosynthetic process
  Homolog annotation: Hit_ID=A5EHZ6; Match level="QueryCoverage=84%, HitCoverage=42%, E-value=3e-43, Identity=48%"; Hit description =Putative Acetylornithine deacetylase/Succinyl-diaminopimelate desuccinylase and related deacylases
  Pfam annotation: Domain name=Peptidase_M20; Domain location=96-220; Score=-10.8; E_value=0.0076; Accession=PF01546.19; Description =Peptidase family M20M25M40
MQENSSLQRALTHIADDQAQILDDLQRMLAVDTCFPPGLGYAEFADLLSTMLQPMQFSLQRVSVPDALWQTPDGSARGERVNLLAALDAGASENCNLYFHTDTVPAGDGWRFPPLALSVAENKLFGRGAADMKGTIVAALAAVRAAQRYQLSLRYNPVFLLCTDEEGGLYPGIRYLAEQQLFHGHLLSFNGGAVPRIWARLFWQYRYQNIVSGRSRTPAIRCR

SEQ ID NO: 162423 - protein, 155 aa, Glycine max
  Coding DNA Sequence Number=SeqID_70738
MAPTRHPLDPDKSNRALGFPALITGLYQSFGVPVAPSKVIRPPITRAFIEKYCTQRQAQGDAPQAADGPVGSFDTEQYLRHLMSLSLQSQGFTSFPCPTLGQFRAEVAWPGDWPEARAGEAPSEAPAEAPDEADEARDDEEMADLLDFLGGSGAT

SEQ ID NO: 162424 - protein, 152 aa, Glycine max
  Coding DNA Sequence Number=SeqID_70739
MVESPQEQVQMVEMVVGTELEWSPSLLLLMMVLVLVAPQRAGSGIYVGAGGITGISVDEEGGSVEEAGAGASDGAEVEGASDLFPLAFLGPLKVIAGSSKFQQFFLMYAELMAGLRLSWVKESEWTPQDLHKAVIRAGKPSLKESYYAMSVI

SEQ ID NO: 162425 - protein, 234 aa, Glycine max
  Coding DNA Sequence Number=SeqID_70740
  Gene Ontology: Mol. function=amino acid binding; Cellular component =membrane; Biological process=pathogenesis
  Homolog annotation: Hit_ID=A6VC28; Match level="QueryCoverage=100%, HitCoverage=99%, E-value=4e-78, Identity=64%"; Hit description =Putative uncharacterized protein
  Pfam annotation: Domain name=MgtC; Domain location=10-140; Score =183.2; E_value=6.7e-52; Accession=PF02308.7; Description=MgtC family
MDWKIFLLRVTVALILGALIGSERQLRQRLTGLRTNALVSTGACLFVLMTQSVPGIAADASRVAAYVVSGIGFLGGGVIMRDGLNVRGLNTAATLWCTAAIGVLCSMGLLLEAGIGCVVILCANILLRELAQGINRQSIIIAEDASQYYKVQIICLAADEVQVRSLMLHSLGGSGLRLQSLHSEDLEPSHRMAVNAEVLGKPSLTDQLENLVSRISLEKGVSSVRWQVCEPETD

SEQ ID NO: 162426 - protein, 395 aa, Glycine max
  Coding DNA Sequence Number=SeqID_70741
  Gene Ontology: Mol. function=two-component response regulator activity; Cellular component=intracellular; Biological process=two -component signal transduction system (phosphorelay)
  Homolog annotation: Hit_ID=Q9HZG3; Match level="QueryCoverage=49%, HitCoverage=94%, E-value=3e-24, Identity=33%"; Hit description =Probable two-component response regulator
  Pfam annotation: Domain name=Response_reg; Domain location=2-115; Score=111.4; E_value=2.8e-30; Accession=PF00072.15; Description =Response regulator receiver domain
MANFVIVDDHPIVRVAIRLVLENAGHRVSAEAGDGDNIISLVKEQSADAAIIDIDLPGIGGIEAVKNLRTVGSLIPVIVMSGKNAEFYAYESKKAGANGFISKKNNLNDLAHAVDAVLSGYGYFPLRLSHQAEGDQLVQDSDKLLLLSHREYEVLRYLGEGTEIVKIANRMKLSNKTQLNYQPNDLPAMPAPMLNDSDWHWLGQKRDSVIGIYGPDRPPMLRTNPEGRVFGYIPDAAYAALHSLGISFRVKHYDTAPEAFAALAREELDMIFVPAGEAVPAHVNDTISVTALKASPVRVVRSSSNPLAGQEFLPGPAITSPYSQLPQVAMGTLPYADVPAVEAYYLIERNYLNTLTIDHILPDLSSPYRFVVNSKEHVLARAMRIAFDALQRHAA

SEQ ID NO: 162427 - protein, 129 aa, Glycine max
  Coding DNA Sequence Number=SeqID_70742
MIKLRAMLSIIFGMTPICGSCAVTRFLGDAFQTMRLTQSYNSVILSHQVAILAYRGHLTRCLTTVSIGPPSSRMRGESVALVSLVREQAAHFHGDSKCLNNPCLESLEPSLVIKAPIFVVKVDWSFCGD

SEQ ID NO: 162428 - protein, 56 aa, Glycine max
  Coding DNA Sequence Number=SeqID_70743
MWYHMSVKNLVRHLGVHDKTNHTLTSQVTLTRLKGALKLGDPQGLHSKESIRVSPS

SEQ ID NO: 162429 - protein, 551 aa, Glycine max
  Coding DNA Sequence Number=SeqID_70744
  Gene Ontology: Mol. function=binding; Cellular component=chloroplast thylakoid membrane; Biological process=embryonic development ending in seed dormancy
  Homolog annotation: Hit_ID=A7R8D4; Match level="QueryCoverage=73%, HitCoverage=91%, E-value=1e-127, Identity=56%"; Hit description =Chromosome undetermined scaffold_2463, whole genome shotgun sequence
  Pfam annotation: Domain name=PPR; Domain location=115-149; Score =24.2; E_value=0.00049; Accession=PF01535.11; Description=PPR repeat
  Pfam annotation: Domain name=PPR; Domain location=150-184; Score=1.7; E_value=4.8; Accession=PF01535.11; Description=PPR repeat
  Pfam annotation: Domain name=PPR; Domain location=189-223; Score =15.0; E_value=0.13; Accession=PF01535.11; Description=PPR repeat
  Pfam annotation: Domain name=PPR; Domain location=236-270; Score =29.1; E_value=1.6e-05; Accession=PF01535.11; Description=PPR repeat
  Pfam annotation: Domain name=PPR; Domain location=307-341; Score=2.0; E_value=4.4; Accession=PF01535.11; Description=PPR repeat
  Pfam annotation: Domain name=PPR; Domain location=378-412; Score=9.6; E_value=0.56; Accession=PF01535.11; Description=PPR repeat
  Pfam annotation: Domain name=PPR; Domain location=44-77; Score=13.5; E_value=0.19; Accession=PF01535.11; Description=PPR repeat
  Pfam annotation: Domain name=PPR; Domain location=79-113; Score=4.2; E_value=2.5; Accession=PF01535.11; Description=PPR repeat
  Pfam annotation: Domain name=PPR; Domain location=9-43; Score=16.8; E_ value=0.08; Accession=PF01535.11; Description=PPR repeat
  Pfam module annotation: Pfam domain module=PPR::PPR::PPR::PPR::PPR::PP R::PPR::PPR::PPR; Domain location=115-149::150-184::189-223::236 -270::307-341::378-412::44-77::79-113::9-43
YPNYYHNGPVYATMISILGTSGRLNEMRDVIEQMKEDSCESKDSVFVSVIKTYVNAGLVDEAISLYKSIPRFNCVNWTESFNTMLQIMVKENRLEIAHRLFVESSCGWEVRSLVRALNLLMYALCQKSRSDLALQLFQEMDYQSCYPNRDNYAILMKGLCQDRRLHEATHLLYSMFWRISQKGNGEDIVVYRTLLDALCDAGKFEEAEEILDGKDIENAKRIIHEALIKGSVPSLASYNAMVVDLYSEGKIDEADKVIIEMQVRGFKPTHSIFEAKVAALCKVSKVDEAIKVIEEDMVKVNCLPTAKMYNILLKNLCNVGNSTTILESLNKMSSKVGCTGDRDTHSILLEMLCGERRQYEAVMWLENMISQGKLLEISVWNSLASLFCNSEKIKVSSETFSRLRRKTLIVSGLAESKKEHGVELLNKLEAEHIGAKTEYDFGRVRVYGERSLGNNRRARFNALYQVPEFCDINKIKGKFDGKTVIITIPTIPGKVPKKETQPTEQEPPKEPSQETESNPEEEKEGTPPSYDNQESKEEAGHATSTSNPPNI

SEQ ID NO: 162430 - protein, 204 aa, Glycine max
  Coding DNA Sequence Number=SeqID_70745
MTRKEIQEGRMMEKILESSKMEDMLTLLEKGFVAGGPISNAQKRYAREISRDKDLDGFSSHAITPFGYLKLRVTFRKYPLAKAIMRKARQCYKNSLKVMTYKKKSREVPSPEKLVPIPGKKEILVAVLDYGVEEHDNKFDRPILEGELIQVKNRLEEIKVVKVGFKLPTPILDKLSCFGADNACIFAWTPAYIVEASFMMMNQV

SEQ ID NO: 162431 - protein, 140 aa, Glycine max
  Coding DNA Sequence Number=SeqID_70746
MPEPSKKRKGSSSRSQRHSEAQETQIPSSISSSSLFSSEEQRIRYTNLFSSCSIIDPKFIDMDFFSNESFECIQAFQNSNLIPFMSLKLPVYSELVKAFYTNVKIQESTLISEVYGIKMVIDQSLFYDLTQLSSEGVPFE

SEQ ID NO: 162432 - protein, 85 aa, Glycine max
  Coding DNA Sequence Number=SeqID_70747
  Subcellular localization annotation: CTP_CleavageSite=45; ConfidenceScore=5.07e-01
MGEINFVGGENNSYNQYPNNFNQGQGFRQSQGMYRPQTMQNQRPRQEERQPTLQETMLQYMAKNDQRMKLVESQLTNIQSLLSQR

SEQ ID NO: 162433 - protein, 104 aa, Glycine max
  Coding DNA Sequence Number=SeqID_70748
  Gene Ontology: Mol. function=ubiquitin-protein ligase activity; Cellular component=ubiquitin ligase complex; Biological process =protein ubiquitination
  Homolog annotation: Hit_ID=A7Q1S3; Match level="QueryCoverage=69%, HitCoverage=8%, E-value=3e-11, Identity=52%"; Hit description =Chromosome chr7 scaffold_44, whole genome shotgun sequence
  Pfam annotation: Domain name=U-box; Domain location=4-62; Score=11.7; E_value=2.8e-05; Accession=PF04564.6; Description=U-box domain
MAECPVVKNGQTYERQSIQKWLDHGLNVCPKTHQRLTLTNVIPNYTVKSHVIRLIEDLHRWNLEMSSMLEGSIQIMSKAETGTTMFLVWTSYCPIAVAEPLCDL

SEQ ID NO: 162434 - protein, 209 aa, Glycine max
  Coding DNA Sequence Number=SeqID_70749
  Homolog annotation: Hit_ID=A2Q1D6; Match level="QueryCoverage=68%, HitCoverage=25%, E-value=3e-11, Identity=28%"; Hit description =Ovarian tumour, otubain, related
  Pfam annotation: Domain name=AFT; Domain location=73-157; Score= -46.6; E_value=0.063; Accession=PF08731.2; Description=Transcription factor AFT
  Pfam annotation: Domain name=FAR1; Domain location=85-159; Score= -1.0; E_value=9e-05; Accession=PF03101.6; Description=FAR1 family
  Pfam module annotation: Pfam domain module=AFT::FAR1; Domain location= 73-157::85-159
MEVHHRGGSFVVRDYRHGGCCGATTEEVLWTKIGGYMHNIMSQEINMNEDNGEEPVVFKNIDGSDAFNTSQVFVTHDDVLHWARSLAYDIGFVVVIMRLATNTGKRGMTSYVLIGYEKSGKYSSRKCGCSFKLRVKPVLGGERWMVKLICENHNHSLAKSFIEHPYVGQLIEDENIIIGDMTKSMVKSKNILFTLKEHNANNERRRCCT

SEQ ID NO: 162435 - protein, 258 aa, Glycine max
  Coding DNA Sequence Number=SeqID_70750
  Gene Ontology: Mol. function=endonuclease activity
  Homolog annotation: Hit_ID=Q2HUP4; Match level="QueryCoverage=55%, HitCoverage=54%, E-value=7e-55, Identity=66%"; Hit description =Endonuclease/exonuclease/phosphatase
  Pfam annotation: Domain name=Exo_endo_phos; Domain location=109-255; Score=-2.8; E_value=0.005; Accession=PF03372.14; Description =EndonucleaseExonucleasephosphatase family
MGCTNLKEFAPRGTIRFDIIVWIWFAADQFLAMLHDSDLHLVHGGDEGGERLLGAVDLAITEGRLFEGHDGDLSEALKILDGVVAKGNDITNIEGLDEAVKKLVHDRRIRFGTWNIGTLTGKSMEIVDVMVRRKINFMCLQETKWTGEKAKELDNLGFKLWYTGKIRLRNGVGIIVDKEWKKDVVDDTFNVISGYAPQVGLAEHFKVKFWEDLEGVLQDIPQGEKVFLGGDLNGHVGSVARGFEGVHGGFGLGEMNGE

SEQ ID NO: 162436 - protein, 116 aa, Glycine max
  Coding DNA Sequence Number=SeqID_70751
  Subcellular localization annotation: CTP_CleavageSite=20; ConfidenceScore=5.16e-01
MVPRLHFFLLFFFFLRFSFCSSENQPLKPFPYMTICRKRPFVEGINSPRRAGCLRLKVFHGIGEPDASLGELGSRNFQKMTIFPLSLWFFFPGLTIKHQFERSLDLALQPVPNTVI

SEQ ID NO: 162437 - protein, 48 aa, Glycine max
  Coding DNA Sequence Number=SeqID_70752
MVDTLPMFYYEKMVGYMPSSFADLVFAGERIEVGLRRGKFDYASTTTS

SEQ ID NO: 162438 - protein, 167 aa, Glycine max
  Coding DNA Sequence Number=SeqID_70753
  Subcellular localization annotation: CTP_CleavageSite=13; ConfidenceScore=5.05e-01
MNDTHSPWLAKVSAFSSRHFLGIPATPFLLCFTQSNSHSEILTIPATLAIERKKCITPTWFVYNHFHDTQHMQLRTRCKLSRFIEALMAKKRTKSMSKYMAGVCMSEHNMQLMTTEGKQNTGLPAIVHHQKKKTLDEASLLSSELETQHDHRSTSSPYGSHRPGHRA

SEQ ID NO: 162439 - protein, 179 aa, Glycine max
  Coding DNA Sequence Number=SeqID_70754
  Subcellular localization annotation: CTP_CleavageSite=35; ConfidenceScore=5.18e-01
LKGLLKKAIGCPFYDKTTPMPTPDASVSMVKGRVKSNKSSVKGIFCHRPAQRCRDGRVPVNKLMIKFGEALEDYGMGDNWIAWTFTKTGSTPLTETKWPRYSTCDLSTTSIQPRLQFHVSENAGKDMGEHLQAQSWEEDEYGDWVVWVERSYVGIMQIWKNSLAPALWTRRRSYGGVMK

SEQ ID NO: 162440 - protein, 72 aa, Glycine max
  Coding DNA Sequence Number=SeqID_70755
MMTKVMTKSSKINQRTTQVIKIESRTIQDSRRKLKSQESRFKVQDPKNQDQDSRIKRRLNQDKYEKVFPKIE

SEQ ID NO: 162441 - protein, 69 aa, Glycine max
  Coding DNA Sequence Number=SeqID_70756
MQKSEDLYIRQAEVFCGEVLVEDVVTSQHAEKPLEVLDIVVVAGKDAGEDLDSGERVVGAALPEDVGDV

SEQ ID NO: 162442 - protein, 101 aa, Glycine max
  Coding DNA Sequence Number=SeqID_70757
MASSSSCPSSIQTRSGPLDGDVLWMQPKHVSEHVWNGEPDRKLHIRRAVPTYQGEEQIPEEIVPLLRQCGFYWIMKMGYLKINAALITAFKDGGPKLTRFT

SEQ ID NO: 162443 - protein, 304 aa, Glycine max
  Coding DNA Sequence Number=SeqID_70758
MSSVGVIPASTEYGQRSDDRLVILVRDRTVITFGKLRVWCPGNRDLTVRSQLNHNPASSCKIYFPVMVIGKMNPLCIEETLAASFQRLPQTVRFQCLNFVRILIEDQAFRHTMVFCNDVQEERCNSIGGIPTMKSKNKSSQGLAGIGNGSSNPTNFLGSYLVNACKSLGQNCLLKKAMGWPFCDKTALIPTPEASISKVKGHSLELVLYLVPTPHDLNTQSSVEQKSIWITKGKTSRSIATRMFVQDEFTQKRHDPSPFLTKKTGDENGLEVDSMISVARWGELNGHDSNVEEGIRPIGPGQSS

SEQ ID NO: 162444 - protein, 162 aa, Glycine max
  Coding DNA Sequence Number=SeqID_70759
  Subcellular localization annotation: CTP_CleavageSite=51; ConfidenceScore=5.27e-01
MSLSTNSSSSVIKRKNLEEHRWPRLNFSSQLKQSPFSWCAANSSFNRPRVEVAARVEVGLVGIYPKGFTIKVQYFEFHAIRVYRQGKGGWVRRGRRRKGMLVCFQESHFLVGIVEFSGHCVLCGSEIELGGGEFGYDVFKAIHVGLGAHRFDHWSSMKAPNC

SEQ ID NO: 162445 - protein, 184 aa, Glycine max
  Coding DNA Sequence Number=SeqID_70760
MTQELGARGNTLRLSAPRHSVTPSVIDEQRLMWSSAPFPEMSASSGGDFFKSHKIRRSKNIAFVGRPTKSVILTLRSCDMRRQNLVIPHPFAIQTQSCPMARRDKIWSFCTLVSSRSGGLDDTRRHLTVIHTLLSSKGGGLDDTRRHLTVIRTLLSSRGGGPDDTQRPNLVILDPCVIQRRWAR

SEQ ID NO: 162446 - protein, 110 aa, Glycine max
  Coding DNA Sequence Number=SeqID_70761
MVRTRRLGRALGHVTGRGVGRGDRDDSDDASQRRRPTAFVRRQRATVIAAHDEPVVPAPDVGADVFSNDPMVPADVEDIVVDIPANTGAEAAEDEHERFLGGPSDPSVLT

SEQ ID NO: 162447 - protein, 100 aa, Glycine max
  Coding DNA Sequence Number=SeqID_70762
  Gene Ontology: Mol. function=aspartic-type endopeptidase activity; Biological process=DNA integration
  Homolog annotation: Hit_ID=Q69FA4; Match level="QueryCoverage=57%, HitCoverage=4%, E-value=2e-17, Identity=77%"; Hit description=Gag -pol polyprotein
MQLRHNVVKHLLKDRTISIDYVKSEGNLVDPLTKPLGRNMILETLRGMRLKPLENKQDALDEITYMSVKWSRLHEILTTITRQVSLGSVTVTSQEVQPRS

SEQ ID NO: 162448 - protein, 503 aa, Glycine max
  Coding DNA Sequence Number=SeqID_70763
  Gene Ontology: Mol. function=protein dimerization activity
  Homolog annotation: Hit_ID=A5ASU7; Match level="QueryCoverage=43%, HitCoverage=48%, E-value=2e-16, Identity=28%"; Hit description =Putative uncharacterized protein
  Pfam annotation: Domain name=zf-C2HC_plant; Domain location=79-134; Score=53.3; E_value=8.5e-13; Accession=PF07567.3; Description =Protein of unknown function, DUF1544
MGGIVEDHRRRSSSSKLNSNLDKSHDDPDIWTKKRGKPPQEKKEKIDRKDIPPSEKLFLENVASLAGSALVKPNGDNLDMAWEWNSLKDISNKRAVTCDFCLKTTNGGITRAKKHQIGLEGDVSACKKIPPSIKLKIKQAYEKKKAVKFGLEEENDDDEVEATEEINLRAGKRRAKGSITQGSIHGHMNTLKIIELSNKLTLGMAKRKTCIRDASIKKARAKANRCIAQFIRENEIPFEVACSKGFKMMIEAVGDYGQQLNPPSYHKLRAPLLKEQSELTKEKHKPHEIEQTQYGEAIEDEPVVEPLRLTCGVVDDAIKLGEPSRLTIEAPIEEEKEEAKQEENPKPKPEINKSGDREFELVVQRENISGGHNRSSGNNSGGDNGDVCGGDDNNESEIMMATIVAMVECRVAYRIDHVLNLGQLGRVTPKGEKYVGSCGSIKTNDGSDDNSGGIVVAVTTMVCGGGGGGGGRGKGRDNDGCGMVMVKDTMEIAHNDRVYQQLC

SEQ ID NO: 162449 - protein, 145 aa, Glycine max
  Coding DNA Sequence Number=SeqID_70764
MGSITQIQGSCLDNVPVHVISMETVLMEGSGATQDGGERSPRGCEKINSLKETNGQGQIDLPESAKFLVVTHSTAPKTNLQVVPMMVKGESGDNVALYDSELLSLEMGWDLMESCSSGGKLRVPLVKPDDDSMDAKFVALVFKSI

SEQ ID NO: 162450 - protein, 297 aa, Glycine max
  Coding DNA Sequence Number=SeqID_70765
MRSSSSLSEVEELALSGMLLLPYQIWNLAGERVHGNRGGSHCHAQHTHSEMITKDDDKGDDKKLKGQSKNEFKIFKKESRTLQDSRGKLISRIKNQDSRDQAVISGNDALCHISLNFCPNHSPQSPNFFFFHSLSFEPIEISKNPFKWLNLQRSERALQVGVNDFPGHRKCQFLPPFPLDHCFHQRNNIYEIHEGTLMSEVYGIKMVIDQSLFYDLTQFPSEGVPFEGHDGEDSSFLSKILDRFDGLQTFVGERFDNLELQVDMRFNEMESRITKVEEDVSYIRSSFDLPPLPPPSS

SEQ ID NO: 162451 - protein, 286 aa, Glycine max
  Coding DNA Sequence Number=SeqID_70766
MDIMKKELKEAIKIELSQMASQHSPPVDAPDPDVLAARVSTKGSCAEATGNVVAEEPSVVDVTSMGLYIAGEDCTRLVSLGKVFDSATMIHNVPYTNDVVQVSVLTVYDGGARVPFPTSEIQYVREATNTFIGWQTHLMKPISDDSDHNVPKPMGHVDGCTAGDKCLNISILQLWMMFMDGCGRSRGHGLVYGFLEPQSIHNAKDRCQHYIETWVKESQRQLYLGAYLNYAMKIITSTFEGMSDQAAPRWIEPKWFFDGTALDVEAITTLRKKWASYFLAIKNMGC

SEQ ID NO: 162452 - protein, 260 aa, Glycine max
  Coding DNA Sequence Number=SeqID_70767
MDHQQVSQAHLYVLNNTIEVIAYIDAHKESATATHPNMNMMRGYDINNYSFYTKSQDDKSTVQNSGKSVSLVMVNLECLSSSASGLMEISVFVKTKWGIPYNIDASTLDVNEMSTPHGNTPEFPSTFKCSKRNYKKEDRQTTQLRRLTGRSLDQPRPTVNVNPITGLIAKKKVMSTVATRWRQFKSSLTTKYVYADKDGEDNHDPSAKYGLDPETWEQFAKSRQTPNWQGIRKKAQEIQKFNDCPHLLSHGGYNLLENED

SEQ ID NO: 162453 - protein, 94 aa, Glycine max
  Coding DNA Sequence Number=SeqID_70768
  Subcellular localization annotation: CTP_CleavageSite=19; ConfidenceScore=5.24e-01
MQTPLRALAPLRWRIGLAQSMMRRSRQSRWWGVAFARRRTVFPTWRRLAPIAVVLRKCVHHWCDEKGDITCEICLSESWMPRYRWGVPRWGLGR

SEQ ID NO: 162454 - protein, 329 aa, Glycine max
  Coding DNA Sequence Number=SeqID_70769
  Gene Ontology: Mol. function=transferase activity, transferring groups other than amino-acyl groups; Cellular component=1-2nm peptidoglycan-based cell wall; Biological process=lipopolysaccharide core region biosynthetic process
  Homolog annotation: Hit_ID=A8GCZ7; Match level="QueryCoverage=93%, HitCoverage=100%, E-value=1e-128, Identity=68%"; Hit description =Lipid A biosynthesis lauroyl (Or palmitoleoyl) acyltransferase
  Pfam annotation: Domain name=Lip_A_acyltrans; Domain location=26-320; Score=442.4; E_value=6.4e-130; Accession=PF03279.4; Description =Bacterial lipid A biosynthesis acyltransferase
MGFCVVLANICAEMLFVDIDISMTQLPQFTRELLHPRYWLTWLGIGFLYVLVLLPYPLLYVTGCGLGRLAMRFMKRRVQVAQRNLALCFPDMPTSEREAMVKHNFESVGMGLIETGMAWFWPDWRIRKWVSTSGLEHVTEALAQKRGILLIGMHFLTLELGARVFGMYNPGIGVYRPNDNKLLDWLQTWGRMRSNKSMLDRKDLKGMIRAMKNNDIIWYAPDHDYGPRSSVFAPFFAVQEAATTTGTHMLIRLANPSVVPFLARRLPHGRGYELKMMPDIRHKFSLESELDTAIVMNKVVEETVLLAPEQYMWLHRRFKTRPEGQPSRY

SEQ ID NO: 162455 - protein, 161 aa, Glycine max
  Coding DNA Sequence Number=SeqID_70770
MGREVKGERFILRKFAGQFTQHAGEFKPVAAQAGDNQSVRLAGQGIDNKIFIRRVVIAAGFTMQAHAYAWQKLAQEAKGFVTVSGDAAERFAVCWRLHRLTAIVASHFQGIIVCREAVEMAAIRHLYRKAGELVIFAVAPIGLIPGKHLAHGVRADCPPAD

SEQ ID NO: 162456 - protein, 198 aa, Glycine max
  Coding DNA Sequence Number=SeqID_70771
  Gene Ontology: Mol. function=ribosomal-protein-alanine N -acetyltransferase activity; Cellular component=ribosome; Biological process=metabolic process
  Homolog annotation: Hit_ID=A8GFK6; Match level="QueryCoverage=97%, HitCoverage=100%, E-value=3e-90, Identity=79%"; Hit description=GCN5- related N-acetyltransferase
  Pfam annotation: Domain name=Acetyltransf_1; Domain location=81-163; Score=45.7; E_value=1.6e-10; Accession=PF00583.15; Description =Acetyltransferase (GNAT) family
MMFGYRSAGPRVRLTTDRLVVRLVHERDAWRLADYYAENRAFLKPWEPVRDESHCYPSGWQARLGLIADMHKQGSAFYFVLMDPEEHEVRGVANFSNVLRGSFHACYLGYSLGEKWQGQGMMFEALQAAIRYMQRQQRIHRIMANYMPHNQRSGDLLARLGFEKEGYAKDYLLIDGRWQDHVLTALTWREWNPDRRGQ

SEQ ID NO: 162457 - protein, 114 aa, Glycine max
  Coding DNA Sequence Number=SeqID_70772
MEDLFKRWIDHLDSTRSRNSWHTMLALKPIKTQCKIRKFNLARAIPWKIIKGDRSYNLTIKIKKKEVDKLAEEVTKVMARREENFVEVEAQVESPIKEHDSREKDEEEIEEEAQ

SEQ ID NO: 162458 - protein, 47 aa, Glycine max
  Coding DNA Sequence Number=SeqID_70773
MSIGGADIEEEEPIDLRSNPLQGGGDDTILPRKGPITRAMSKRLQED

SEQ ID NO: 162459 - protein, 120 aa, Glycine max
  Coding DNA Sequence Number=SeqID_70774
MSSSAPLSSRDGESDDMWRYLMVIHTFCQPDASEPVDTQRLTSSSAPLSSRDGESDDIRRYLMVIRTFCQLEASEPIDTQRLMSSSAPLSSRDGEPDDMQRYLMVIRAFCQPEASEPVDT

SEQ ID NO: 162460 - protein, 91 aa, Glycine max
  Coding DNA Sequence Number=SeqID_70775
MSTNNCPETKLGYDVEAKLHDESTMIQSPSESKNIHLKRIKNKLRVQESRRIQDSRRNPTIKNQDSRFKISRIKIKIQDSRFKNEEKTQSR

SEQ ID NO: 162461 - protein, 136 aa, Glycine max
  Coding DNA Sequence Number=SeqID_70776
SPAERYSQQMMECGHGMYYMPATFSEYPSQMYQYPFAGHHTDTSETSHSFGGVVETQPHFSWPTMTPSQQHDAPMATPNAPFAPQWNVPGAIPDMGNLLGVDLRQEFSTEVEQAEAGRQRSGKRNPDRQARRWDQP

SEQ ID NO: 162462 - protein, 152 aa, Glycine max
  Coding DNA Sequence Number=SeqID_70777
  Gene Ontology: Mol. function=transmembrane receptor activity; Cellular component=intrinsic to membrane; Biological process=innate immune response
  Homolog annotation: Hit_ID=Q2HVE1; Match level="QueryCoverage=58%, HitCoverage=50%, E-value=2e-27, Identity=62%"; Hit description=TIR
  Pfam annotation: Domain name=TIR; Domain location=46-151; Score=66.7; E_value=7.5e-17; Accession=PF01582.11; Description=TIR domain
MAYSSSGASQIKYVFLLLCDLLLVSGLTGEISVQISDNIPRIKYDVFVSFRGEDIRQGFLGYLTEAFHQKQIHAFIDDKLEKGDEIWPSLVGAIQGSLISLTIFSENYSSSRWCLEELVKIIECRETYGQTMYDIKRGVMKKLLLNMKRNII

SEQ ID NO: 162463 - protein, 157 aa, Glycine max
  Coding DNA Sequence Number=SeqID_70778
MGMRGCISYNPVLAIRQLGYPMRGVPLEDELAPVISRGFNKTNVETLQKDKELRGSNNGPIGGYHKWLKAHVQGLDWLPSLRTAKREEVEASEEDKEVQALRAELEQAQTIKERFKSAALKIRKENTELRDVNVATTKALEQETKRACREEHGRNKF

SEQ ID NO: 162464 - protein, 31 aa, Glycine max
  Coding DNA Sequence Number=SeqID_70779
MEEKAGSLSFNEVLQWWLSTMEMQRKIKDKR

SEQ ID NO: 162465 - protein, 109 aa, Glycine max
  Coding DNA Sequence Number=SeqID_70780
MTKKKILQIVGERWRQFKSDLTRKWALAADQDSVDDTVCEKYDISKEKWAQFCQTRRDPSWEDVRKKTQAIQKQNTAPHNTKNKLEETAQSGSTEGIIDPPSPIRRHVK

SEQ ID NO: 162466 - protein, 101 aa, Glycine max
  Coding DNA Sequence Number=SeqID_70781
MKGRMSTFSFEMNIQGKRRVKLKLGIKSLVLYKNSQSFSIHYSLALEEILMSSSSGGGMRILFMGQGSRVSVSGYTPILFPRGARNNDDLETTRKISHAYS

SEQ ID NO: 162467 - protein, 72 aa, Glycine max
  Coding DNA Sequence Number=SeqID_70782
MMGRIKRILKLCRFEFFDKGEGRHKRIQAKTRKLQKAFGTKEEEEELQRDFKACKGLIGKAKVFKIVVGKND

SEQ ID NO: 162468 - protein, 332 aa, Glycine max
  Coding DNA Sequence Number=SeqID_70783
MGSSQAPLLKKRFYQVKVKSLGVTSMKELGQLMGQLHQQAFHKAYGAPLEEDLTPIIARGFNSTNAEALQKVRKAWEMVQKKDKEFRGSSNGPIGGYHRWLKAYMQGLDWLPNLRTTKGVEVEAPEEDEEVQALRTELEKAQTVKEKFKSTALRIRKENVKLRDINIATTKALEQETKRACREEHDRNKFRGALWGSNSELKLWREKRDQTRVDSLILKDELRICLRSNRSLSQRLCETETNMLAIISKYQEELNIATAHEHKVADEYARVYVEKEARGRVIDSLHQEATMWMDQFALTLNGSQELPRLLAKSKAMADAYSAPEEIHGLLSY

SEQ ID NO: 162469 - protein, 127 aa, Glycine max
  Coding DNA Sequence Number=SeqID_70784
MVQVEGTSTWVVVTEDKRGYISCGSVLVDGTSTRLFKENKGGYIPCGSLLASRCCNLLHLQLKLGQSSSDVNAPKPSPVLASTLSLSSVDARGLSPVPTSTPSPSPPVGNLPIDEDVVNLAMEDPPS

SEQ ID NO: 162470 - protein, 282 aa, Glycine max
  Coding DNA Sequence Number=SeqID_70785
  Gene Ontology: Mol. function=DNA replication origin binding; Cellular component=cytoplasm; Biological process=regulation of DNA replication
  Homolog annotation: Hit_ID=A7FG40; Match level="QueryCoverage=84%, HitCoverage=99%, E-value=1e-112, Identity=83%"; Hit description=DnaA- homolog protein hda
  Pfam annotation: Domain name=Bac_DnaA; Domain location=62-266; Score=- 52.9; E_value=4.6e-07; Accession=PF00308.9; Description=Bacterial dnaA protein
SVTSGRSGAGRRRKTRALKDPAGREARFISAEDRDKLARFSARSSVEVLLNTPAQLSLPLYLPDDETFASFWPGENPSLLAALQGALAQQHGSYLYFWSREGGGRSHLLHAACAEMSARGEAVGYVPLDKRTWFVPEVLEGMENLALVCIDNIECIAGEAEWEMAIFDLYNRILETGKTRLLITGDRPPRQLNLGLPDLASRLDWGQIYRLQPLSDEDKLQAMQLRAGLRGFELPEDVGRFLLKRLDREMRTLFDTLDRLDRASISAQRKLTIPFVKEALGL

SEQ ID NO: 162471 - protein, 208 aa, Glycine max
  Coding DNA Sequence Number=SeqID_70786
  Gene Ontology: Mol. function=transferase activity, transferring glycosyl groups; Cellular component=nucleus; Biological process =nucleoside metabolic process
  Homolog annotation: Hit_ID=A7ZPU1; Match level="QueryCoverage=100%, HitCoverage=100%, E-value=1e-106, Identity=93%"; Hit description =Uracil phosphoribosyltransferase
  Pfam annotation: Domain name=Pribosyltran; Domain location=34-179; Score=66.9; E_value=6.9e-17; Accession=PF00156.18; Description =Phosphoribosyl transferase domain
MKIVEVRHPLVKHKLGLMREHDISTKRFRELASEVGSLLTYEATADLETERVTIEGWNGPVDVDQIKGKKITVVPILRAGLGMMEGVLEHVPSARISVVGVYRDEETLEPVPYFQKLVSNIEERMALVVDPMLATGGSMIATIDLLKKAGCNSIKVLVLVAAPEGIAALEKAHPDVELYTASIDQGLNEKGYIIPGLGDAGDKIFGTK

SEQ ID NO: 162472 - protein, 118 aa, Glycine max
  Coding DNA Sequence Number=SeqID_70787
MKLYPLFVMNPKDVGLLCLVINQEANPASCNEPKERWSLVFSVKPRRPSLEKQSPRVVIKLFWASSNQLPESKNSGLGSSSSMDSFASWKMNGSRMEKEEIEETPLQGEDESRRSSPP

SEQ ID NO: 162473 - protein, 160 aa, Glycine max
  Coding DNA Sequence Number=SeqID_70788
  Gene Ontology: Mol. function=peptidase activity
  Homolog annotation: Hit_ID=A5BKT6; Match level="QueryCoverage=46%, HitCoverage=8%, E-value=1e-10, Identity=42%"; Hit description =Putative uncharacterized protein
GTSFVVQVEGTSTWVVVTENKRGYISCGSVQEKGTSTWLFKESKGGYIPYESLLVKDITRLKRNLKDRRYLVESLITSRFMASSNSLFPKENSIHRSPIFNGEGYHYWKTRMQIFIEVIDLNIWEAIEIGPYIPTVIDVSTSTTTQKPRDKWTEEDRRRI

SEQ ID NO: 162474 - protein, 169 aa, Glycine max
  Coding DNA Sequence Number=SeqID_70789
  Gene Ontology: Mol. function=protein binding; Biological process =xylan catabolic process
  Homolog annotation: Hit_ID=Q9SDM7; Match level="QueryCoverage=84%, HitCoverage=24%, E-value=2e-67, Identity=86%"; Hit description =Putative uncharacterized protein
  Pfam annotation: Domain name=LRR_1; Domain location=27-48; Score=2.5; E_value=1.1e+02; Accession=PF00560.24; Description=Leucine Rich Repeat
  Pfam annotation: Domain name=LRR_1; Domain location=3-25; Score=14.2; E_value=0.5; Accession=PF00560.24; Description=Leucine Rich Repeat
  Pfam module annotation: Pfam domain module=LRR_1::LRR_1; Domain location=27-48::3-25
MKLLESLDLSLNNISGQIPQSLSDLSFLSFLNLSYHNLSGRIPTSTQLQSFDELSYTGNPELCGPPVTKNCTNKEWLRESASVGHGDGNFFGTSEFYIGMGVGFAAGFWGFCSVVFFNRTWRLAYFHYLDHLRDLIYVMIVLKDSAVSKLFHIFPLAVPYSDTFHIPIS

SEQ ID NO: 162475 - protein, 154 aa, Glycine max
  Coding DNA Sequence Number=SeqID_70790
MRKGLQKYVILLDIWGFHGGADNMEFFQMFMRVFTCKAMKLWKQMDQSSFKSIWDILIRVLDAQAFVGSKGCKSSGFPLVIHYIHHAQLVAFCRNLPFGGRATRDSRVHVPRKEYARSRHQRVFEENVGKTGKRRDLRTLSEKFGSCIYARGRY

SEQ ID NO: 162476 - protein, 54 aa, Glycine max
  Coding DNA Sequence Number=SeqID_70791
MEIASQNLLEIQKLKSLLSSEFEMKDMGAIEKTLGINEALGLNLELGLDLKRAD

SEQ ID NO: 162477 - protein, 108 aa, Glycine max
  Coding DNA Sequence Number=SeqID_70792
  Gene Ontology: Mol. function=triose-phosphate isomerase activity; Cellular component=cytoplasm; Biological process=fatty acid biosynthetic process
  Homolog annotation: Hit_ID=Q5JZZ3; Match level="QueryCoverage=84%, HitCoverage=36%, E-value=2e-23, Identity=61%"; Hit description =Triosephosphate isomerase
  Pfam annotation: Domain name=TIM; Domain location=3-104; Score= -102.5; E_value=0.00022; Accession=PF00121.9; Description =Triosephosphate isomerase
MDNGTTEEVKKIVTTLNEAKIPGDDVVVKISNWDNVNLSYEPVWTIGTGKVATPAQAQEVHANLRKWVHDNVSAEVASIRIIYGGNLTSTLPKEYSYGNLAFILHHAL

SEQ ID NO: 162478 - protein, 126 aa, Glycine max
  Coding DNA Sequence Number=SeqID_70793
  Gene Ontology: Mol. function=oxidoreductase activity; Cellular component=extracellular region; Biological process=hydrogen peroxide catabolic process
  Homolog annotation: Hit_ID=A7P681; Match level="QueryCoverage=33%, HitCoverage=13%, E-value=2e-10, Identity=72%"; Hit description =Chromosome chr4 scaffold_6, whole genome shotgun sequence
  Subcellular localization annotation: CTP_CleavageSite=77; ConfidenceScore=5.30e-01
MVLLENIVPPSKSISEPYPSTIVLSSLEGSLVFNFYAASCPTTKFTVRNTVSSSSFDPSIPGKLLCLFFHDCFVEVSSSASAPVDVDLDDINHKGKAVIVLQASQVEVRGNGLSVAAEKTSDDGYN

SEQ ID NO: 162479 - protein, 371 aa, Glycine max
  Coding DNA Sequence Number=SeqID_70794
  Gene Ontology: Cellular component=integral to membrane
  Homolog annotation: Hit_ID=A7P951; Match level="QueryCoverage=99%, HitCoverage=99%, E-value=1e-135, Identity=68%"; Hit description =Chromosome chr3 scaffold_8, whole genome shotgun sequence
  Pfam annotation: Domain name=DUF677; Domain location=39-365; Score =582.3; E_value=4.8e-172; Accession=PF05055.3; Description=Protein of unknown function (DUF677)
  Pfam annotation: Domain name=DUF793; Domain location=23-365; Score= -201.7; E_value=0.0016; Accession=PF05633.2; Description=Protein of unknown function (DUF793)
  Pfam module annotation: Pfam domain module=DUF677::DUF793; Domain location=39-365::23-365
MGGHMSKKTPETSSGININADMATELRSYEAACKLDSDLQSFNTTIQARANQVINTLAVGVEVRSLSFESLKQVTECLLEMNQEVVKVILDCKKDIWKNPELFELVEEYFDNSLQTLDFCTALEKCLKRARDNQLLILMALQQFEEETSLGETRYTRTLQELKNFKAAGDPFTEEFFQMYQSVYNQQILMLEKLRVRQSKLDKKVKQIHTWRKVSSVIFAATVAAVLICSVVAAAIATPHVAAALAAVTAIPIGSMGKWIDSLLKNYENAMKGHKEVAISMQVGAYVAIKDLDNIRVLIDRLEVEIESLFQNVEFALEEEAVKVAIEEIKKKLGVFMKNVEDLGLQADTCSRDIIRARTVVLQKIIKLPHT

SEQ ID NO: 162480 - protein, 152 aa, Glycine max
  Coding DNA Sequence Number=SeqID_70795
YILCGTSRGYIYLGLTENKRGYISCGSVLVEGTSTRFKENKGGLKEISRIAGRLGTGDKLILAKFYLPIDDKEKPWFQGLNKVAKTKAKKDTKENITSLKGTILNLTNPLKESFEKQKSYNKGFIVDLKSFAHAVMVGIQIARGGMKEMLRE

SEQ ID NO: 162481 - protein, 150 aa, Glycine max
  Coding DNA Sequence Number=SeqID_70796
  Gene Ontology: Mol. function=protein binding; Cellular component =nucleus; Biological process=nucleosome assembly
  Homolog annotation: Hit_ID=Q2V4C7; Match level="QueryCoverage=68%, HitCoverage=39%, E-value=6e-36, Identity=73%"; Hit description =Uncharacterized protein At1g74560.2
  Pfam annotation: Domain name=NAP; Domain location=2-136; Score= -123.0; E_value=0.027; Accession=PF00956.9; Description=Nucleosome assembly protein (NAP)
MEGLLFGRICWGCEGLGFCLIMSHPALCELLNVEDQKIFKFKYLGSLDVEDNKDVKSGYSITFNFNPNPYFQNTKLTKTFTFLEEGTTKITATPIKWKEGKGLPNGLDHDKNGNKQARIDIAYDETEEGSPVHGRESEEGCCRGLQGSCV

SEQ ID NO: 162482 - protein, 56 aa, Glycine max
  Coding DNA Sequence Number=SeqID_70797
MQAKKKRKVSKHKELEKMAKKLDQVKKKDPKKVHDDPKLLHKSIHKEKKQQKNAKK

SEQ ID NO: 162483 - protein, 372 aa, Glycine max
  Coding DNA Sequence Number=SeqID_70798
  Gene Ontology: Mol. function=nucleic acid binding
  Homolog annotation: Hit_ID=A5C599; Match level="QueryCoverage=15%, HitCoverage=16%, E-value=1e-07, Identity=49%"; Hit description =Putative uncharacterized protein
MHIHGEDHKGKGDGKMKILKLMKSKQMMIFQENGELLDIILLITSLQTKNGIFVNQSKYCKELIHRFGMENAKHMATPMSTACYLDKDETDQSIDIKQYQDDQRQRYYSQFCNRVILDPKYLDLDFFDGETFDCYQVFQNSGLTELMSLKLPHFPELVRVFYNNLKIHDGVIYFEGTLVNDWKFDYSCHDFRRMVCIDQTDMTGRLLAGSLTFDFCIMHYIIYRMHKPLRDNAPLPYPHLVTLFLHHFKNPLDDELFVQVKRSFSIGAGVVTSFGYRKDDDGQWVRKQDFPLPIPDERTPSPPPQRFDSSSLLNDVLTELHGLRAFMGDRFDAIDTHLDAMNALFDGIDTRITQLKDDISFIRHCFDPPTNS

SEQ ID NO: 162484 - protein, 313 aa, Glycine max
  Coding DNA Sequence Number=SeqID_70799
  Homolog annotation: Hit_ID=A5B5V0; Match level="QueryCoverage=61%, HitCoverage=41%, E-value=8e-09, Identity=26%"; Hit description =Putative uncharacterized protein
  Subcellular localization annotation: CTP_CleavageSite=14; ConfidenceScore=5.22e-01
MAKPSKKRKGTSSRSQRHSGSQEAPIPPSIPSGLLFSSEEQRIRYTNLFSSRSIVDPKFIDMEFFSNENFECFQAFENSNLIPFMSLKLPIYSELVKAFYSNLEIHEDVLMSEIYGIKMVIDQSLFYDLTKLPSEGMPFEGALIDEWKFDFSVHDACRLVCTNQADMTGRLLAGSFSFESRILHYLIVRILLPRSSNLAQVSEEDLIVMWAFHKGASVIASFGYVKEHDGSWIKKGARNVGEEGHEGEDSSLLSKILERFDGLQTFVGERFDTLELQVDMRFNEMESRMIKVEEDVSYIRSSFDLPPPPPSSS

SEQ ID NO: 162485 - protein, 69 aa, Glycine max
  Coding DNA Sequence Number=SeqID_70800
MGSRMGTGTRRRTPSYPTTAQGMAQTLYDGEHLHHVIGNDDCSPDWRVQFYLSPTPAPDRHSMSSNGVS

SEQ ID NO: 162486 - protein, 71 aa, Glycine max
  Coding DNA Sequence Number=SeqID_70801
MTDSHRDLHENRLGLPDAHDQIGATPLEVLTQLALSLKIQLPQRSLPGFIEASIVVEASIAAEAALPPYYY

SEQ ID NO: 162487 - protein, 97 aa, Glycine max
  Coding DNA Sequence Number=SeqID_70802
  Subcellular localization annotation: CTP_CleavageSite=23; ConfidenceScore=5.40e-01
MSVMPRRSPTWPVPISSCPIRISSSTIRPFTPLGTFHGPPSGAFGVDSSPLWVNEGVPLEGGEDPNMPVILYPGCKSCRYEYISGICDGSWVNACGV

SEQ ID NO: 162488 - protein, 120 aa, Glycine max
  Coding DNA Sequence Number=SeqID_70803
MDEDQWIYKSIMFEEINMNEDNGEELGIFENIDCSDAFNTSQVFATREDVLQWARTVAYDISFVTVRMSLLMVIFHHGDAAEDKGEKLGEDASMEEKKEGEKERGGSTKLKEEKGREVEL

SEQ ID NO: 162489 - protein, 149 aa, Glycine max
  Coding DNA Sequence Number=SeqID_70804
TIPPHYPGSRLCLEDIGDRWMHFSEYLAPCASYFMDWFYMISHPFMRSAQLGDPVKHPPVMQDDTYVKPGMPQYPVTTATMEEALVQAPSHVEQPRHAVEAFQAIAERLEQLLNLRKMAKGTETYDVMQDYLRIARGVTVDRNVYVRSQ

SEQ ID NO: 162490 - protein, 89 aa, Glycine max
  Coding DNA Sequence Number=SeqID_70805
MTKGTETYDVMQDYLRIARGVTVDRNLTLTTHVTLNPTYYSNPKSFECKEAATIAEDVHHVDDAADKVFQQPLEAIVDAQGFLGGLHDT

SEQ ID NO: 162491 - protein, 81 aa, Glycine max
  Coding DNA Sequence Number=SeqID_70806
MALQQFGYVQSIPPLPTTPSLSIEEIGDKWLQFSQYLAPATCQKITESLEHMINMRMLTIGTNAYTITKHCLTLARAVTEQ

SEQ ID NO: 162492 - protein, 27 aa, Glycine max
  Coding DNA Sequence Number=SeqID_70807
MAPKDMEKTTFITFWGTFCYKHTSRPW

SEQ ID NO: 162493 - protein, 70 aa, Glycine max
  Coding DNA Sequence Number=SeqID_70808
MAKRDMITMIMDTLPMFYYEKMVVMQSYPARALARRLQVDWARDPRKGHRVLMSLRLSSSFSSQGGELSY

SEQ ID NO: 162494 - protein, 79 aa, Glycine max
  Coding DNA Sequence Number=SeqID_70809
  Subcellular localization annotation: CTP_CleavageSite=33; ConfidenceScore=5.47e-01
MTKLFWKKCISSFSSFTYAPIFLSQCALRGRARARLTGALSKGGKMRGVATNVYLWKTSGKSKETGQNEYSKFGNCIYA

SEQ ID NO: 162495 - protein, 75 aa, Glycine max
  Coding DNA Sequence Number=SeqID_70810
MIEVLDEAIASLTQYYDQSLRCFTFRDFQLTPTINEFEGILGCPIGGRKPYLFSGYYPSMVRVARVVKISKRELD

SEQ ID NO: 162496 - protein, 47 aa, Glycine max
  Coding DNA Sequence Number=SeqID_70811
MATKIKRCPFEALGLIALITSMPHIENDHGADNIFNDTGGALTLSVK

SEQ ID NO: 162497 - protein, 90 aa, Glycine max
  Coding DNA Sequence Number=SeqID_70812
MAIYRKRPFGIWEARPGKLELAQASWFLIVEGINSPRQAGARPGCLSDPAFQLDARENKEAKLKKQKDVEVLQNIKWRTLESYSIRAEDT

SEQ ID NO: 162498 - protein, 184 aa, Glycine max
  Coding DNA Sequence Number=SeqID_70813
  Gene Ontology: Mol. function=RNA-directed DNA polymerase activity; Cellular component=intracellular; Biological process=RNA-dependent DNA replication
  Homolog annotation: Hit_ID=A7NWR8; Match level="QueryCoverage=68%, HitCoverage=23%, E-value=1e-39, Identity=66%"; Hit description =Chromosome chr5 scaffold_2, whole genome shotgun sequence
  Pfam annotation: Domain name=PPR; Domain location=116-150; Score =13.8; E_value=0.18; Accession=PF01535.11; Description=PPR repeat
  Pfam annotation: Domain name=PPR; Domain location=46-80; Score=5.8; E_ value=1.6; Accession=PF01535.11; Description=PPR repeat
  Pfam annotation: Domain name=PPR; Domain location=81-115; Score=20.2; E_value=0.0078; Accession=PF01535.11; Description=PPR repeat
  Pfam module annotation: Pfam domain module=PPR::PPR::PPR; Domain location=116-150::46-80::81-115
MVAASRRLRDLQSSAVWFRRFSTDSATTLGFFKWAKSQTGYRHSPELYYLMVDVLGKCKSFDSMSELVEEMARLEGYVTLETMTKVMRRLARTRKHEDAIQAFRRMEKFGVKKDTTTLNVLIDALVKGDSVEHAHKVVLEFKGSGCSFVGYGATQEIGPFLVDTDGRGHKFNNFSWNKGMKREI

SEQ ID NO: 162499 - protein, 170 aa, Glycine max
  Coding DNA Sequence Number=SeqID_70814
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=60%, HitCoverage=17%, E-value=1e-24, Identity=47%"; Hit description =Chromosome chr9 scaffold_7, whole genome shotgun sequence
MTNANSPQESLHSVSNGNLRGLGLCLCVCDEGVCVDVIRGLSMCLRVSSGCVWFLSVCESHQGVCVCVRRIAQGMHYLYTVLASSVLPHQYLKSSNVLVGPDNEPMLVDYRVPEATQQGQVSRSCSVYCLGVVIVEILTARFPSQYVSNGKGGDDVVQWVETAISEGRES

SEQ ID NO: 162500 - protein, 681 aa, Glycine max
  Coding DNA Sequence Number=SeqID_70815
  Gene Ontology: Mol. function=catalytic activity; Cellular component =external side of endosome membrane; Biological process=metabolic process
  Homolog annotation: Hit_ID=Q2R2L5; Match level="QueryCoverage=99%, HitCoverage=99%, E-value=0.0, Identity=65%"; Hit description=AMP -binding enzyme family protein, expressed
  Pfam annotation: Domain name=AMP-binding; Domain location=79-568; Score=264.1; E_value=2.9e-76; Accession=PF00501.19; Description=AMP -binding enzyme
MPEVYTVKVEEGRPATDAKPSAGPVYRSIYAKDGLLEVPSDFESPWDFFRDSVKRNPNNKMLGRRQKTESKVGSYTWLTYQDVYDAALKMGSAMRSRGVNPGDRCGIYGSNCPEWIIVMEACNSCAASYVPLYDTLDTNSIIYHQLGNEFDLGLCLLGPNAVEFIINHAEVSIAFVQEKKIPSILSCLAQCSSNLKTIVSFGSVSTTQKKEAEEHGASCFSWGEFLQLGCLDWDLPSKKKNDICTIMYTSGTTGDPKGVVIKNEAFMAEVLSVDHIIMLTDRVVGEDDVYFSFLPLAHVYDQIMETYCIYKGSSIGFWQGDVRFLLEDVQALKPTIFCGVPRVFDRIYAGIKSKVSSAGGLQSTLFQCAYNYKLKSLEKGLPQHKAAPLFDRLVFDKTKLALGGRVRILLSGAAPLPRHVEEFMRVTSGSTLSQGYGLTESCAGCFTAIGDVYSMTGTVGVPMTTIEARLESVPEMGYDALSNVPRGEICLRGNTLFSGYHKREDLTKEVMVDGWFHTGDIGEWQSNGAMKIIDRKKNIFKLSQGEYIAVENIENKYLQCPLIASIWVYGNSFESFLVAVVIPERTVIEDWAKEHNVTDDFKSLCDNLKARKYILDELNSTGQKHQLRGFELLKAIHLEPIPFDMERDLITPTFKLKRPQLLKYYKDRIDQLYKEAKGAMA

SEQ ID NO: 162501 - protein, 124 aa, Glycine max
  Coding DNA Sequence Number=SeqID_70816
MSTEKLVFSGGSREVVPVRANLVLHDWNLVQITRPSKPTLGVVKCSVDDAFFHYNRKTEFGCCLRDDEGTFIQAHTRGLLARFGVGGPRGRGICIVIKFEMDGRITLSRSYFGNRLQRDGGPAR

SEQ ID NO: 162502 - protein, 117 aa, Glycine max
  Coding DNA Sequence Number=SeqID_70817
MTSKLQMLITIATVVRLRPTIYQNAQNSKENLDKGIWSGSFDTGYGGLDDATSGEGRYVRVDATRITLISLRLVQQGTQRETLTKFYQMPKVFLFKTKTNTYSVSEQKDKNRHGPSK

SEQ ID NO: 162503 - protein, 95 aa, Glycine max
  Coding DNA Sequence Number=SeqID_70818
MAVIADWLELPAVFILLIVAAPDFFTNTFIRNKVGGMTRTKGKEPLERLGGPMARARTKKAKEDLQQVLTMLFEFRPKLQVAKLQIVNCIMFQEE

SEQ ID NO: 162504 - protein, 138 aa, Glycine max
  Coding DNA Sequence Number=SeqID_70819
MVAISPTKIPQPPFPRGYNSNVTCAYHGGVLGHSIEDYMTLKHKVQSLIDAVTCAPELIFKSAQSEIAHSTRLVGVPTCTIYFISSCYKVMTNDKKTYTSEPYIGAMVGTMHELQVNIGADKKSSPDRLKTQKGGLGK

SEQ ID NO: 162505 - protein, 82 aa, Glycine max
  Coding DNA Sequence Number=SeqID_70820
MPLGEFSSTDSPSTEKPLVIDNMDDREGGGNRPPRRTLARGTMMSKSLKEAIAIIDSIAASDYQSHHDKAPVHERYNVVGYS

SEQ ID NO: 162506 - protein, 165 aa, Glycine max
  Coding DNA Sequence Number=SeqID_70821
MAFCSSPLSSSFVVIIVIIKTPLNLIHHEALLLHYPYGLPPNYTPSVIHDDAGHVPSPILEGEPPGQSDEVHEEHREYAQGDINFYPPVPVEGSAPNTLPQPNLPAQPIFLSTEGAPPAAEERRKLDLIEERLRVVEGFGDYPFADMADLCLVPGRCHPPKIQGT

SEQ ID NO: 162507 - protein, 174 aa, Glycine max
  Coding DNA Sequence Number=SeqID_70822
MPYTVTRPHSFAIRQTQSLVERRDLRCLLHLLSSRGDEPDDIWGYRMVIRTFCHPEAMSPMTCGGIICKPDDIRGYRMVIRIFFQPGANEPVDAQRLTSSPAPFVAQGQTSSLARRDLCHLLHLLSSQGNEFDDMRGYRMVIRTFRHPEVARPMTCRGTIWLSAPFVILRWQAR

SEQ ID NO: 162508 - protein, 207 aa, Glycine max
  Coding DNA Sequence Number=SeqID_70823
  Gene Ontology: Mol. function=transporter activity; Biological process= transport
  Homolog annotation: Hit_ID=A5FA64; Match level="QueryCoverage=99%, HitCoverage=45%, E-value=3e-36, Identity=41%"; Hit description=Outer membrane efflux protein precursor
  Pfam annotation: Domain name=OEP; Domain location=14-206; Score=71.0; E_value=3.9e-18; Accession=PF02321.9; Description=Outer membrane efflux protein
IANINAQEKKQLSLDEAVRLGIQNSKNLKIDAAKIEEATADLLEAKNKQLPDFKLSGQYMRLTNAKVDVKFLNESGSGGGVASPKSVFLGQANLSMPIYAGGRIKYGIESAKYLVEASKLSTENDKTAIAYNVAQAYNNLFKANQSIKVLEENLTASNQRDETFLKMENNGLIARNDRLKANLQTSDIELQLLEAKNNYNIANINMD

SEQ ID NO: 162509 - protein, 58 aa, Glycine max
  Coding DNA Sequence Number=SeqID_70824
MVSGNRLPRGVIDYQASERNWNTVEASGNRLPACVIDYTEEWVTGNRLPDRDGGAANP

SEQ ID NO: 162510 - protein, 118 aa, Glycine max
  Coding DNA Sequence Number=SeqID_70825
MDGQWLKKDVQPPQDERAPSPPPQQDDSSALMNEVLSELRGLHTYVGEHFDSLDGRIDAIDARLEGMDTCITQLEENELNCHHQKWGDCRSKDFDVLMMPKDHMLLKFNSRGSYASQG

SEQ ID NO: 162511 - protein, 309 aa, Glycine max
  Coding DNA Sequence Number=SeqID_70826
DSLEDHASQGSFVAYGRQDVLTVAIGRPEHPGRVHVVGVGVTIKQYFGPAPRTSRTSSSMAPEDLECNHKDSHCLLSQRLVLQLLVSIKESYVYPSSNDPYTGDSEKYGLYVEENLPRLVALGRLYEGSTTVHNMSLCHDQLKVGVEEVRDVDALIPIPTQKGVLGPTKPIDRPDHDVDDPLYLMTLTIPQLFLKPLQVMWDAIVFGMFNDDFPLYIKHEDLFEIAHGGQCLNISVIQLWILAYWQMVVILSKENVVIWFCSLHNRPNNYLKGIINRQKGSTECGYYIMHWMSTIILGSFKNNWETIIV

SEQ ID NO: 162512 - protein, 180 aa, Glycine max
  Coding DNA Sequence Number=SeqID_70827
MTGRLLAGSLAFDCRILHYLNVRIFLPRSSNLAQVSEEDLIIMWAFLTDRQINWAHLVRYRMNKALRSNAPLPYPYLISLFLHHFEVPFVQIKKSFSIGATVVASFGYRKERDGSWIKKDAQPHDVEGCSPAREDSSLLQSVMDSQVDIRFGEMDSRITKIEGDITYIKDCFDLPPPPSP

SEQ ID NO: 162513 - protein, 271 aa, Glycine max
  Coding DNA Sequence Number=SeqID_70828
  Homolog annotation: Hit_ID=A5AHQ6; Match level="QueryCoverage=90%, HitCoverage=22%, E-value=4e-07, Identity=20%"; Hit description =Putative uncharacterized protein
SSTWFSSDDQRLRYLSQFSSRIILDPKYLDVEFFNDETFDCYQVFQNSGLVDFMSFKLPYYPELVKVFYCNLKIQDGIIMSEVHGTSMVIDQSLFFSLTHLPSQGAPFEGTIVDDWKFDYSSHDARRMVCNDQADMTAQASEEDLILMWAFLTGRQIDWAHLVRYRMHKALRANAPLPYPHLITLFLRHFQIPLDDEPFVQVKRSFAIGAGAVTSFGYRKDRNGQWLKKDALPPQDERTPSPPPQREDFALMNEVLSEFFGFLMFQKGEKK

SEQ ID NO: 162514 - protein, 120 aa, Glycine max
  Coding DNA Sequence Number=SeqID_70829
  Pfam annotation: Domain name=zf-CCHC; Domain location=48-65; Score =34.2; E_value=4.8e-07; Accession=PF00098.14; Description=Zinc knuckle
MQEEEESNDEEGFSLFVKKFHKFIKNRRRERSHNFNNGKRSQEVSPTLKCYKCNQPGHIKANCPSNESWPEKNEKKSYKEKRSKKAYIAWDDNDSSDGSEKEINLLSKDYESDENISQEV

SEQ ID NO: 162515 - protein, 103 aa, Glycine max
  Coding DNA Sequence Number=SeqID_70830
LIKFDAATLKEFLETPMVLEPGERKDLTTLAQTWSVLSYFNLAPTSHTSDLNMDRARLVYGIVIKMDIDEEREETPLQGEDESRRSSPAKEAMDKSLEEEGDE

SEQ ID NO: 162516 - protein, 62 aa, Glycine max
  Coding DNA Sequence Number=SeqID_70831
MALEWWPQMTHPPHVVVPGLWDLNLLCEEKGVVEVDVGVGVADVEGSSAGLALALLAPRIET

SEQ ID NO: 162517 - protein, 41 aa, Glycine max
  Coding DNA Sequence Number=SeqID_70832
MNSARQSIHGSLNKIENGELANNASARQSIRGAPDSMVVDA

SEQ ID NO: 162518 - protein, 308 aa, Glycine max
  Coding DNA Sequence Number=SeqID_70833
MASRKRKSIGSRPTSQYGTRRFSSLDAWTRYIDNVLGRNILLERKVEIYHSKLDEFKVELERRNFHKRLTNLVDGSIDLALVKEFYANLYSSEDHPPKQSRVRGHLVKIDVGSLNTFLETPVLPIDYREIEVALCIPGRGFILNSEGHPGKILRKDMTPLAQVWSVLSYSNLAPTSHTSDLTVDRARLIFDLVSRLDMNIGALIFGQMTSIAQSNTSRLVFPALIIALCRARGVVYDSLTFERLSPIINLAYIRKNCWNPEDLIVSIRGARRARARPAELPSTFAAPTPASTSAALSVPVQTDSQRFE

SEQ ID NO: 162519 - protein, 50 aa, Glycine max
  Coding DNA Sequence Number=SeqID_70834
CNRQKGSTECGYYVMHWMSTIILGSFKNNWEAYFNDPRPLEPQRLKALQI

SEQ ID NO: 162520 - protein, 62 aa, Glycine max
  Coding DNA Sequence Number=SeqID_70835
MIAKKDFVVGQKVLLYNSRLGLKSELQGQWTPAETIPDKSLLSGCSGGGDLLTSPYFSSAMT

SEQ ID NO: 162521 - protein, 581 aa, Glycine max
  Coding DNA Sequence Number=SeqID_70836
  Gene Ontology: Mol. function=DNA-directed DNA polymerase activity; Cellular component=intracellular; Biological process=nucleobase, nucleoside, nucleotide and nucleic acid metabolic process
  Homolog annotation: Hit_ID=A7P230; Match level="QueryCoverage=99%, HitCoverage=64%, E-value=0.0, Identity=70%"; Hit description =Chromosome chr19 scaffold_4, whole genome shotgun sequence
  Pfam annotation: Domain name=DNA_pol_A; Domain location=256-581; Score=-88.7; E_value=3.4e-09; Accession=PF00476.11; Description=DNA polymerase family A
MARLWDSSRHLDGGYSLEGLTGDRRVMSRAQLNHEKDLIGKVSMKTIFSKKKLKKDGSEGKTSIIAPVEELQRDERIPWICYSALDASSTLKLYESLKSHLSDMPWKFDGVPVYGKTMYDFYNEYWCPFGELLVMMESEGMLVDRAYLESIEKVAKAEQEVAVNRFRKWATRYCPDAQYMNVGSDSQLRQLLFGGIVNRKDSNQTLPTERIFKIPNVNNVIEEGKKAPKRFCDIKLTSLGYNLETEMYTATGWPSVSGDALKALAGSISADYDFFDEDCNLDLDDEDENPSQSQVAPVKIDKSAYGTAYAAFPTEEEGREACHAIAALCQVCSINSLISNFILPLQGHNISGKDLRVHCSLNINTETGRLSARRPNLQNQPALEKDRYKIRQAFIAAPRNSLIVADYGQLELRILAHLADCKSMLEAFEAGGDFHSRTAMNMYPHIREAVEKKEVLLEWHPQPGEDKPPVPLLKDAFASERRKAKMLNFSIAYGKTPVGLSKDWKVSVKEAKKTVDLWYNDRKEVLQWQEERKKEARVLHCVYTLLGRARRFPLMAQANTYQKGHIERAAINTPVQVLSSF

SEQ ID NO: 162522 - protein, 152 aa, Glycine max
  Coding DNA Sequence Number=SeqID_70837
MYPPLFSLNNLVDVPSTETDPQEMYPLLFLVTTTQVDVPSTCTTKDVPSNVLRQSSQAVSPLKLCEGGNKRILRREKGDTKEFRRLVLCSFGKGRRETQKEFRRLVLGEFFLAKGEEMKRMNSTSFQGLENQKTLESFLEQGRRRSSKRLRN

SEQ ID NO: 162523 - protein, 105 aa, Glycine max
  Coding DNA Sequence Number=SeqID_70838
MRGYRMVTRTFRQPGANEPIDAKRLTSSSAPFAIQGQRVRWQAEIPFGHLHLLSTEGNEFDGFTLVVQKHSSPTTREILLFWTGTIECNGIGKCRGCPTLSLPIH

SEQ ID NO: 162524 - protein, 503 aa, Glycine max
  Coding DNA Sequence Number=SeqID_70839
  Gene Ontology: Mol. function=protein kinase activity; Cellular component=plasma membrane; Biological process=protein amino acid phosphorylation
  Homolog annotation: Hit_ID=A7QLQ2; Match level="QueryCoverage=23%, HitCoverage=34%, E-value=6e-29, Identity=52%"; Hit description =Chromosome chr13 scaffold_120, whole genome shotgun sequence
  Pfam annotation: Domain name=Pkinase; Domain location=137-323; Score=- 92.3; E_value=0.0044; Accession=PF00069.16; Description=Protein kinase domain
  Pfam annotation: Domain name=Pkinase_Tyr; Domain location=137-323; Score=-118.1; E_value=3.5e-05; Accession=PF07714.8; Description =Protein tyrosine kinase
  Pfam module annotation: Pfam domain module=Pkinase::Pkinase_Tyr; Domain location=137-323::137-323
MKADPVKQEQEWIGRNQYEEERSLRLTVITNDIIGQRNADQLIQGGEDVQSSPHEEMSRVTVISNDVIDEKNSNQKIQEKLQIKGSCDEGLKNANEAKVILENSKSSVCSICRSRRPYSGLQKKYTYEELEAATEGFSIKYSLCEGEYGPAFRGQLENNQEIVIKQHTFTSLQEQKVFISEFQLLINARHENVIMLLGSCIRLSQLLIVYEKACNGSLDQYLSILVELIAGRMIADKILGQKCLVECLCIFRLQLFLLIGTASPNDRNVRSLLGRREYRQLVDPKVRSSYDEQELVSLFHITENCLKKNPKERFTMNMVVSALPCVANSNGLYVKEDFSPENSNVSDAKNSKGEEESLKENNLGTENTEEVRMNHREGEKEESLEEEDLDTENSEKVRRNHKEGEKEETLEEEEDLGTENREERVEQITCSRGNNEPEVSQECDTYTKCGEISKKTEEKEGSSTKLCQKWEGCLSYGGARKFYHQGAQEYTACKEFFGWCDSI

SEQ ID NO: 162525 - protein, 70 aa, Glycine max
  Coding DNA Sequence Number=SeqID_70840
MSISTDVKTSFSSSEEIEKYEKLIQRRPVRVTLFCENAPTMWDRHRLTGALKPDDPQGLHSEESVRASPS

SEQ ID NO: 162526 - protein, 94 aa, Glycine max
  Coding DNA Sequence Number=SeqID_70841
MEAMKDQMTTMMEAMMSIRKLIEVNAIAVVATSTAIEVDPTHPSSSNQVNRPILDMSQHPQFGHAQVPKPMGETHEVPQDHTLVDFEPHLEYAT

SEQ ID NO: 162527 - protein, 51 aa, Glycine max
  Coding DNA Sequence Number=SeqID_70842
MQYRLSRFIVTLTAKKRTQGMSNYMVGVCMSEHNMRLMTQKLYQPLEISSS

SEQ ID NO: 162528 - protein, 86 aa, Glycine max
  Coding DNA Sequence Number=SeqID_70843
MLDDHSCIFLRLFSGTCQVENDRSYMKCLLELDIKNGKRPMEIDDVEEDEPHQPRKCTKKLDSSHKVEMARISFQRQSIEAKDSVV

SEQ ID NO: 162529 - protein, 45 aa, Glycine max
  Coding DNA Sequence Number=SeqID_70844
MINKLYLAFWLPIYVTGIIEVGNAEITVLDSDVGSGETQKKRFSS

SEQ ID NO: 162530 - protein, 141 aa, Glycine max
  Coding DNA Sequence Number=SeqID_70845
  Homolog annotation: Hit_ID=A5C3T2; Match level="QueryCoverage=95%, HitCoverage=17%, E-value=3e-29, Identity=44%"; Hit description =Putative uncharacterized protein
  Pfam annotation: Domain name=zf-CCHC; Domain location=105-122; Score =17.4; E_value=0.0035; Accession=PF00098.14; Description=Zinc knuckle
MDIDYAISKDEPPVITDESNPADVALYERWERSNRLSVMFIKTKISAWIRGFVDQHEKEEERLVMEMGESALLTTAYGKNKATKPQANQKGNRKIPPQTDIKKVAKCFFCKKKRHMKKNCPRFQKWLEKKGYAKPKETSGK

SEQ ID NO: 162531 - protein, 113 aa, Glycine max
  Coding DNA Sequence Number=SeqID_70846
MMNHLFQVKRSFAIGAGVVTSFGYRKDRNGQWLKKDALSPQDERTPSPLSQREDSALLNEILTELRGLRSYVGERFDSLDTRFAGMDIRLTQLEEDVGYIRQSFDLPPPPPPS

SEQ ID NO: 162532 - protein, 96 aa, Glycine max
  Coding DNA Sequence Number=SeqID_70847
MAKRPSFGANIEKNPKEECVEAMTSKIILMMPKNQELSKFQRIRSQKASRINTKIFHKIFYQRVLLSGNRLPEGSNRLPIANIAFKIDLQSCNRLP

SEQ ID NO: 162533 - protein, 40 aa, Glycine max
  Coding DNA Sequence Number=SeqID_70848
MAPRFLVIVQQLSPILSRSSESDQFPLLNDPNKACIYVIK

SEQ ID NO: 162534 - protein, 54 aa, Glycine max
  Coding DNA Sequence Number=SeqID_70849
MEHFLEQVAWPEAQLPLVRPNEAASPEPTPVQVDPEPADPQSLVVNPPSSSELE

SEQ ID NO: 162535 - protein, 122 aa, Glycine max
  Coding DNA Sequence Number=SeqID_70850
MAIFWEILDPSSPRLASSLPRPWNTINLTSSPRRAITFKANHEGEGEKGLKSLERKKNKGRGRKKKKREAKALPNRNRGSFPTLFLLLALYPVQQPVPDLGTQSKLTVFCFLDHIMHLLIMS

SEQ ID NO: 162536 - protein, 91 aa, Glycine max
  Coding DNA Sequence Number=SeqID_70851
MPLHLALPPVYQVGIPLAPVKANDARLAQRLQYKPPRGYHNFHLLRPLRPHIVLLSAPGHPHDKRRLCWGCTIKGKETGKSSWGSPPPFGW

SEQ ID NO: 162537 - protein, 86 aa, Glycine max
  Coding DNA Sequence Number=SeqID_70852
  Subcellular localization annotation: CTP_CleavageSite=78; ConfidenceScore=5.05e-01
MHGNIKETTHSMFAPCPYFRNLMGGTKKARYLVIIPKVVASSFQRFLEISSPLISNIGVVGTSSNNISSKRKTLDEVSLSSSKSET

SEQ ID NO: 162538 - protein, 47 aa, Glycine max
  Coding DNA Sequence Number=SeqID_70853
MKMKTYAEPFLQAPSRLFIGNEGWRLHSSSPRQTGYFILKLSNGHEG

SEQ ID NO: 162539 - protein, 54 aa, Glycine max
  Coding DNA Sequence Number=SeqID_70854
MVFHLRLVMSFKAKKGEHMLKGAIKGINSSKKYQQESSQGYYASNQWGKTHRIK

SEQ ID NO: 162540 - protein, 70 aa, Glycine max
  Coding DNA Sequence Number=SeqID_70855
MESLNLSNTSIYALPASIWGSTNLSELCLQDKRYQGSIKECGVFPVYASESGAKLFGSSSKEVFESQSIT

SEQ ID NO: 162541 - protein, 165 aa, Glycine max
  Coding DNA Sequence Number=SeqID_70856
MAPKKLPSKRARKTATGEGSSTAPPVEIEFNGCRFRSLLRKELWISAPKCGANGFLMRKDNNANTLREEVNLQAPSGPRKVQLGTGIYSLNHRPLPVLRSNKTFIEKYCMPRQFRATIAWPGDRPNFQEEAGPANAQGAAQGDGGRAEDDEDMADLVDYLIGGGD

SEQ ID NO: 162542 - protein, 216 aa, Glycine max
  Coding DNA Sequence Number=SeqID_70857
MAQSKRKETNHKYLTKKKTVNWGGKDTMVVGEKTRSGVDKRKKPKYKVGGKEMFELILVYQNLEFEGLRQSGVLKGTKYIPNEGTLRFLERERDQTYGDHHQYLYLMKVLAWNCLCTGVKASIVIDQTCFHASYVVDLNGKAAGILWCSSCWKKSKEEELKCFGGKLMKNEEEKALKKSWKNWTTCSACNSRLAGKAKLDMKSHSVCNSRLACSLT

SEQ ID NO: 162543 - protein, 37 aa, Glycine max
  Coding DNA Sequence Number=SeqID_70858
MSVKNFVRRLGVHDKTDHTLVTEIWMTPLPKREDKSG

SEQ ID NO: 162544 - protein, 168 aa, Glycine max
  Coding DNA Sequence Number=SeqID_70859
  Homolog annotation: Hit_ID=A5AJL8; Match level="QueryCoverage=70%, HitCoverage=65%, E-value=1e-17, Identity=40%"; Hit description =Putative uncharacterized protein
MATTAKNVVVIQDASKTLNLRVFYWIINGLSLKPEDVVTLVAILHEVYHPMGYRITVDNKLLGVNQRIIEQELANKKQDYLMDEGLAQIVKHYASNKVAFKIKLFPGSSPKDVALEQATKLNATWVILDSIKRHLMARYDLSLLFMEDFQHIDETYTQTGRPQIKYFF

SEQ ID NO: 162545 - protein, 96 aa, Glycine max
  Coding DNA Sequence Number=SeqID_70860
MDEDQWAYDYAMSQEVHMDYDYDNEEECGVTEPHWARTVANENGFVAMIMRSDTDTGIKNSLEKTLGVGNVVVLQASWETSAWRGRLDGEVDLWYS

SEQ ID NO: 162546 - protein, 283 aa, Glycine max
  Coding DNA Sequence Number=SeqID_70861
MTHLNAPVKTARRQRHGLRSVAQQGDVGMERLRTLRTAMTRGLGAQQPHYAGTRPVTGVIEIQRKAGLADACRQLLQLIRRFRAGLTKKRQRQVQIRRRHRFTRVCGEAIGPPLHQLLLEGIRQFEGKKQLLRGMLSSGNRLPVVLPLSPGRVGVEVSEVTRVKQVDFCLALWRALAVAQVLLAGRAGAGKVHHMAAATAADIEAAGKSSGGGRAAGGGALTWHSGWRWTQLGNSQVETAGYRAGGEKTRRVAWRRGILTCICCTQISAACGGAGEPRYSPIP

SEQ ID NO: 162547 - protein, 388 aa, Glycine max
  Coding DNA Sequence Number=SeqID_70862
  Gene Ontology: Cellular component=mitochondrion
  Homolog annotation: Hit_ID=Q652R5; Match level="QueryCoverage=42%, HitCoverage=85%, E-value=6e-18, Identity=37%"; Hit description =Putative uncharacterized protein P0603C10.50
SFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGPGTTGLSPSLAPPSRGLWARSATEDASPDYNSDAEGDRFSWWAFPGSLAVTKGILRACTQRVVDGSRTDRLARDWSRAWLIHHFITAKSAMNPDFNQPTRRVLAGGRRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQG

SEQ ID NO: 162548 - protein, 412 aa, Glycine max
  Coding DNA Sequence Number=SeqID_70863
VDSRGSHGSFVLQMASRKRKSIGARPTAQYDTRRFHSLDAWNRYTNNILGMSILPERKVEIYYTEFDDFKTKLERCNLHKRLTNLADRTIDVALVKEFYANLYSFEDPSPKQAKVRGHLVKIDTTSLNTFLETPVVLEKGETLPSYSRYCRLPSDHREIEATLCIPGRDLNVDRARLIFGMVSQMDMNIGALISGQMTSIAQSNCCRLGFPALITALCRARGVVSNSLTFERLSPTINLAYIRKNCWNIDDLTVSFQGARRAKARPADIPSTSTAPAPTPVSTSAAPSVPAHVHAQHFEAMLQKQFLERVAWPGAQPSLNREGEGPIAQVRPETATTLERSPEGTSEPPTPVADLSSPQPAADPSTPTLEIPKDPMTPVLALNTSPLATPVLHLTDEEDAQNQDTQDLSQEF

SEQ ID NO: 162549 - protein, 105 aa, Glycine max
  Coding DNA Sequence Number=SeqID_70864
  Homolog annotation: Hit_ID=Q949K7; Match level="QueryCoverage=41%, HitCoverage=50%, E-value=6e-08, Identity=54%"; Hit description =Putative gag polyprotein
MGKLDHLEERLRVVEGGRDYAFTEVEELFLVPKRGHSQVQDEELLIHFFQESLIGVAVTWYTNLEPSRVHSWKDLMVAFVSPGGTPNDEKGDDNNDSRHINSVLL

SEQ ID NO: 162550 - protein, 412 aa, Glycine max
  Coding DNA Sequence Number=SeqID_70865
  Gene Ontology: Mol. function=3-isopropylmalate dehydratase activity; Cellular component=3-isopropylmalate dehydratase complex; Biological process=branched chain family amino acid biosynthetic process
  Homolog annotation: Hit_ID=Q8ZRJ0; Match level="QueryCoverage=100%, HitCoverage=87%, E-value=0.0, Identity=78%"; Hit description=3 -isopropylmalate dehydratase large subunit 2
  Pfam annotation: Domain name=Aconitase; Domain location=5-412; Score =467.1; E_value=2.3e-137; Accession=PF00330.11; Description=Aconitase family (aconitate hydratase
MAGKTLYEKLIEQHVVRHLDDEGHVLLYIDRSILNEYTSPQAFSGLRDRSRRVRHPATILLNVDHVNPTRPVRDAAMTDAGGQLQVDYFRKNAEHFGIELFDVLDPRQGIEHVVAHEQGLVMPGMVIAAGDSHTTTYGAFGALGFGIGTSEIEHLLATQTLIYRTLKTMRVEVTGELPFGCAAKDIVLALIEQIGASGATGYAIEFTGSAIDALSMEGRMTLCNMAVEAGARGAIIAPDDKVYAYIAGKPQMPVGELWQQALAEWRTLRSDDDAVFDRQLTIDCSDLEPKVTWGISPDQACAISGHVPNPADEPDLVKQQSMKNALHYMGLQAGTPLADIAITHAFIGSCTNGRIEDLRAAAAVIGTRKIAPHVRGIIVPGSTQVRQQAEPEGLAAIFIDAGFEWRQSGCSM

SEQ ID NO: 162551 - protein, 61 aa, Glycine max
  Coding DNA Sequence Number=SeqID_70866
ENDRSHPAQVVAAQIRTLLYKHEGCTSSEPSPGLKIDLYSVCRVDLYSLCGVDLYCSESNL

SEQ ID NO: 162552 - protein, 104 aa, Glycine max
  Coding DNA Sequence Number=SeqID_70867
  Homolog annotation: Hit_ID=Q2HVN2; Match level="QueryCoverage=66%, HitCoverage=20%, E-value=1e-10, Identity=46%"; Hit description =Putative uncharacterized protein
MILLDKAACQALWGHPEFDWEWHPAVNTAGGPSMDNVKAIKTILRSFEMVSGLRINFAKSQFGAIGQSEEWCRLAADYLNCGPLQFPLCYLGMPIGINPGRKVV

SEQ ID NO: 162553 - protein, 195 aa, Glycine max
  Coding DNA Sequence Number=SeqID_70868
MWPSRRLFVLFVVVGPLPASPASHFVQFCDGFGAAINHSRWCGWWVALTSTIWQNRNLLIFQGKTFDSSKVMEDAIFLAWKGILLFIPSDKYSKVYIRQKYPLFKARPLQIEENHPQLQEGDNDSAAQPVNQDKAKKQSNEEAERRLKSKIECSIEGLDALGLATMETAAARVPFSSFFYSPLMTKEDIINLRNF

SEQ ID NO: 162554 - protein, 67 aa, Glycine max
  Coding DNA Sequence Number=SeqID_70869
MVQLWFGIRVEKQIGGPFGPANKSYSETHELIVIHASSTNESGALRIDCLALFAYPPTSNLIRSPMN

SEQ ID NO: 162555 - protein, 92 aa, Glycine max
  Coding DNA Sequence Number=SeqID_70870
MCVCVCVCVCVCVCVCVCVCVCIHGVPSCIDFYRRTVGILKVITFGLPLSEKGALSTIPTEGNCAKRPKASLSPIPTERKCAEHPEGALSEP

SEQ ID NO: 162556 - protein, 81 aa, Glycine max
  Coding DNA Sequence Number=SeqID_70871
MGSNQKHSHLDPSEDYIMAKEPRRFTLEDYSSSNVPQFFTSIAQAEVQAQTITYPPSLIQLIQNNLFHGLPNEDPYAHVIP

SEQ ID NO: 162557 - protein, 20 aa, Glycine max
  Coding DNA Sequence Number=SeqID_70872
MAGTPQEKPKGGSTHLRVIV

SEQ ID NO: 162558 - protein, 40 aa, Glycine max
  Coding DNA Sequence Number=SeqID_70873
MKELEMELQRLNQHEENDKKKKGIALKASSSIQEESDLED

SEQ ID NO: 162559 - protein, 96 aa, Glycine max
  Coding DNA Sequence Number=SeqID_70874
MLSANQLGHMRFNCPVFKRRMENSDKMNFKEKKEKKGYITWEDNVINYSSDSEKKIISLGIMMKDYENGEEQSRYIDSKFSKHLACIKVYSYFSPR

SEQ ID NO: 162560 - protein, 150 aa, Glycine max
  Coding DNA Sequence Number=SeqID_70875
MAHQNPPYFAFCTPGQNETKNKIQGYQRETNKNIYIFLNEHQGMKGMVWPKNTSSSIANKTPHTYSQNNSKAPKFLKACNELQNKERETRLKRDIKGINSRKHQQESSQGYCASNQWGKTHQMIMMMDGSNSHKGKLITSKLSFQNYHDM

SEQ ID NO: 162561 - protein, 68 aa, Glycine max
  Coding DNA Sequence Number=SeqID_70876
MPTFEDDVPKGKPYKVPEFQQTLSTITNHVASHATRLLGHGNKRCGGRQKQGFCSYVSSISDEELKPT

SEQ ID NO: 162562 - protein, 74 aa, Glycine max
  Coding DNA Sequence Number=SeqID_70877
MEREAIRYCFKIESEYMATKNFYTAPCNRQHRKNAISRIAMSSSVFQRCMPSTLSSLFGCMRFRLSCKNPIPSL

SEQ ID NO: 162563 - protein, 204 aa, Glycine max
  Coding DNA Sequence Number=SeqID_70878
MGDQEEVQEQIKADMSTLKEQMASMMDAMLGMRQLMEKNAATAAAVSSAAEADPTLPAIVHHPIPDVVGQERSTLGHISNPHLEYNRVAYPYGLTPNYTPPVICDDAGRVPPPILEGEPPRQSDEVHEDRREHAQGDINSHSPFPAEEPALNALPQPNLMGKPRNPSAQPIFFSAYEPPPVAKERRKLDLIEKRLRVVEGFGDY

SEQ ID NO: 162564 - protein, 56 aa, Glycine max
  Coding DNA Sequence Number=SeqID_70879
MAAIGGVGLDDEEISSVLALFLDAIYKKGIQTTTKVKVVQLRKCRNELHLAYGSSA

SEQ ID NO: 162565 - protein, 125 aa, Glycine max
  Coding DNA Sequence Number=SeqID_70880
MYDYHEKERTPDLESILSDFMTYQASSKGYCYSMQQQGTQFEMDYSSADYQRESQWQTNYHNEAEGFLNLNDLLMQFRDTVESMQQAFRRIETQISKLVDNMTNAVAIKEEEHAEIEIHQESILQ

SEQ ID NO: 162566 - protein, 127 aa, Glycine max
  Coding DNA Sequence Number=SeqID_70881
MALRKLASKRSRKDKAAEGTSSAPEYDSHRFRSAEHQQRFEAIKGWSFLRERRIQLRDDEYTDFQEEIARRRWASLEGVRVMRSWVRGQWIPFDADAIGQLLGYPLVLEEGQECEYGPRRNRSDGFD

SEQ ID NO: 162567 - protein, 181 aa, Glycine max
  Coding DNA Sequence Number=SeqID_70882
MDMNLGSFISSQITLIAQHDSSRLGFPALITTLCKALGVHSDSLTHESLSPTINLAYIKKNYWNLDDPIITFRGPRKARGKRSEASSTLPPSSSIEIPMIPPAPTQIPLPAPLSTGGGASTTQEPVTEEPPAPAPSPAAAEEETIPAQTPQPSPPFALAPEETQQSALDLNEDQPQEEQDV

SEQ ID NO: 162568 - protein, 70 aa, Glycine max
  Coding DNA Sequence Number=SeqID_70883
MHLRSPCLLLQRHDHLVHHLHGVEAGVVEVVAVMAEVAKVDTVDVVNIDIRDGEGGSHRRIKPMWEEVRE

SEQ ID NO: 162569 - protein, 191 aa, Glycine max
  Coding DNA Sequence Number=SeqID_70884
  Gene Ontology: Mol. function=transferase activity, transferring glycosyl groups; Cellular component=chloroplast; Biological process =glucan biosynthetic process
  Homolog annotation: Hit_ID=Q9XGC1; Match level="QueryCoverage=87%, HitCoverage=19%, E-value=8e-85, Identity=91%"; Hit description =Starch synthase, isoform V
MQGGHGLHSTLSAHSKKFIGILNGIDTDAWNPATDAFLPVQYNATDLQGKAENKQALRRNLGLSSTDVRRPLVGCITRLVPQKGVHLIRHAIYLTLELGGQFVLLGSSPVPHIQNEFEGIANHFQNHDHIRLILKYDESLSHVIYAASDMFIIPSIFEPCGLTQMVYKRVKGRYKERARFRFGKQDLGFLR

SEQ ID NO: 162570 - protein, 181 aa, Glycine max
  Coding DNA Sequence Number=SeqID_70885
  Homolog annotation: Hit_ID=Q9M445; Match level="QueryCoverage=36%, HitCoverage=77%, E-value=3e-12, Identity=59%"; Hit description =Putative uncharacterized protein
NNSCRHQIAEISDMYLQPPSSNAKVLLLLLAVATRLVKIIGVALTAYGGSGNKKVNSSKQGRDHLSHKEGTTNIHNMHKGDQSLPNTSAVTTNTSDDQILRSAGTEKHSSSVNNGTEDAFINSGGGHQYFKEAEFNTGVQVAKGRHAPCSGNNGTKSSFRNSGSGKQDFGNAKFNTGANYN

SEQ ID NO: 162571 - protein, 182 aa, Glycine max
  Coding DNA Sequence Number=SeqID_70886
  Homolog annotation: Hit_ID=A5AL21; Match level="QueryCoverage=60%, HitCoverage=10%, E-value=2e-13, Identity=34%"; Hit description =Putative uncharacterized protein
MKVIFRFQDVIEVVQKEVQEPEKNPTDVQKVARCDLMKRDAKALFIIHQCVDAIISKKIRYVDTANKAWDTLEKSCARDNKLKKVKLQTLRNLGIIDKVLRTLIPRFDHIVVAIKQGQDLEEIKIEELHGILEAQEIKLNERNLQRSVEQPMQAQTTKGNNYDVGKNKKGKGKWKNNKWKGS

SEQ ID NO: 162572 - protein, 179 aa, Glycine max
  Coding DNA Sequence Number=SeqID_70887
MCTVKKVIWTFRLPVTKDETNIQRMREDMMQMRQSVTWGSCSLRAPILGTYMGGTKRPLVIIPKVVISLLMVSRGIIPFEKHIAAVGTTNNNMVSKRKTLDEGSLLSSKSETQHDHRFTSTPYVPMDSGIGPLFNSPCVQKRCWCCVHQMNTYLSHAYIKTCLKHRRSLFKNIKEKGNR

SEQ ID NO: 162573 - protein, 125 aa, Glycine max
  Coding DNA Sequence Number=SeqID_70888
MASKRERILKATWLKKETGKEERLFHLNIAAPRSVKLWEWNQKFRTAPPRLDYWVTYIMVGPALSPAWVLAWGCQMKRNVIVPSGDFVLVAALSVVSLVRSSGEVFEWLAKLVKDEAIVKVCLKR

SEQ ID NO: 162574 - protein, 179 aa, Glycine max
  Coding DNA Sequence Number=SeqID_70889
  Gene Ontology: Mol. function=catalytic activity; Cellular component =chloroplast thylakoid membrane; Biological process=cellular metabolic process
  Homolog annotation: Hit_ID=A7QQN6; Match level="QueryCoverage=60%, HitCoverage=42%, E-value=1e-40, Identity=78%"; Hit description =Chromosome undetermined scaffold_143, whole genome shotgun sequence
  Pfam annotation: Domain name=DapB_N; Domain location=56-134; Score= -37.8; E_value=0.071; Accession=PF01113.11; Description =Dihydrodipicolinate reductase, N-terminus
  Subcellular localization annotation: CTP_CleavageSite=44; ConfidenceScore=5.04e-01
MAATLTAVRIPTFHQRHLKQHFTAPSSSSLRLLNLAKMEGSEISEQVVGEDLGAKKKVFVAGATGSTGKRIVEQLLAKGFAVKAGVRDIDKAKTTLSSANPSLQIVKADVTEGSDKLAEAIGDDSEAVVCATGFRPGWDLLAPWKAKAICFIREWKTGLALRFVAPRLSQYMTGLAVGM

SEQ ID NO: 162575 - protein, 50 aa, Glycine max
  Coding DNA Sequence Number=SeqID_70890
MDNLVKLEKELEGLLCGGDPVLNARKLNKAEKYSSISRDKSWNQKPHLCK

SEQ ID NO: 162576 - protein, 490 aa, Glycine max
  Coding DNA Sequence Number=SeqID_70891
  Gene Ontology: Mol. function=structural molecule activity; Cellular component=protein complex; Biological process=microtubule-based movement
  Homolog annotation: Hit_ID=P29512; Match level="QueryCoverage=96%, HitCoverage=92%, E-value=0.0, Identity=80%"; Hit description=Tubulin beta-2/beta-3 chain
  Pfam annotation: Domain name=Tubulin; Domain location=37-292; Score =300.1; E_value=4.4e-87; Accession=PF00091.16; Description =TubulinFtsZ family, GTPase domain
  Pfam annotation: Domain name=Tubulin_C; Domain location=294-431; Score=272.6; E_value=7.9e-79; Accession=PF03953.8; Description =TubulinFtsZ family, C-terminal domain
  Pfam module annotation: Pfam domain module=Tubulin::Tubulin_C; Domain location=37-292::294-431
GGQCGNQIGAKFWEVICDEHGIDHTGKYSGDSELQLERINVYYNEASGGRYVPRAVLMDLEPGTMDSVRSGPFGQIFRPDNFVFGQSGAGNNWAKGHYTEGAELIDSVLDVVRKEAENCDCLQGLHNSIHFIFRDALTCIHYFHRITVLRGISNNFVFILYMIIVFNCDHLNFIVLAITGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRNLTVPELTQQMWDSKNMMCAADPRHGRYLTASAMFRGKMSTKEVDEQMINVQNKNSSYFVEWIPNNVKSSVCDIPPKGLKMSSTFIGNSTSIQEMFRRVSEQFTAMFRRKAFLHWYTGEGMDEMEFTEAESNMNDLVAEYQQYQDATADEEEYEDEEEEA

SEQ ID NO: 162577 - protein, 189 aa, Glycine max
  Coding DNA Sequence Number=SeqID_70892
  Homolog annotation: Hit_ID=A7P5Q0; Match level="QueryCoverage=96%, HitCoverage=46%, E-value=8e-21, Identity=31%"; Hit description =Chromosome chr4 scaffold_6, whole genome shotgun sequence
  Pfam annotation: Domain name=DUF247; Domain location=21-188; Score= -146.0; E_value=0.0013; Accession=PF03140.6; Description=Plant protein of unknown function
MNHDDDVVIDIEAILEGTEPHVTKECCIYKVPFHIRRLREDAYTPKVVSIGPFNHNRHVHLQNMEKHKLMYCKAFLKRTKTSSDSWMSYIEGVEPKFRRCYSETLEFRKKELVKIIFVDSGFILELFWRSCSEWSPEDTFLSTPWLSNNMRKNLFFVLEDLYNMSFTGSSNIPPFARLTFCYFGYYNGC

SEQ ID NO: 162578 - protein, 75 aa, Glycine max
  Coding DNA Sequence Number=SeqID_70893
MQCLVNEHSRRSVIAMAQHSSQWVCAEGVVLLERSAFICCNPAPALYLSTGFRVQANTLCGLYPVAQAAFHFLMT

SEQ ID NO: 162579 - protein, 299 aa, Glycine max
  Coding DNA Sequence Number=SeqID_70894
  Gene Ontology: Mol. function=catalytic activity; Cellular component =plasma membrane; Biological process=protein amino acid dephosphorylation
  Homolog annotation: Hit_ID=Q9ZPL8; Match level="QueryCoverage=61%, HitCoverage=79%, E-value=3e-30, Identity=40%"; Hit description =Protein phosphatase type 2C
  Pfam annotation: Domain name=PP2C; Domain location=99-294; Score= -19.7; E_value=8.7e-05; Accession=PF00481.12; Description=Protein phosphatase 2C
MWTLLKESNYNNGVAGVLSLLVRSESEYDIKQPEDNFTIEENYNENKDKNDVGDNTDAEKANDDDDDVVDDHQEEAKYLPEDDGPTATEEQHYKGPVTKDADEKNKPPTRHFIHGYHLIQGQMNQHRNLDGYDLGLYAIFEGHSVHAVKKACKAMDDEILESIADSRGGSTAVAAILINGVKLLVVNVGDSRAISCKNGRAKPHTVDHEPEKEKDLIESRGGFVSKKPVRECSQSGWPISNGMSIWRWKTEGAHYGRTIRKIDEDTEFIILASDGLWKVRGYCMYLMITDEDTLAEVEH

SEQ ID NO: 162580 - protein, 849 aa, Glycine max
  Coding DNA Sequence Number=SeqID_70895
  Gene Ontology: Mol. function=methyltransferase activity; Cellular component=intracellular; Biological process=metabolic process
  Homolog annotation: Hit_ID=A7Q4N6; Match level="QueryCoverage=95%, HitCoverage=92%, E-value=1e-144, Identity=54%"; Hit description =Chromosome chr10 scaffold_50, whole genome shotgun sequence
  Pfam annotation: Domain name=Methyltransf_11; Domain location=608 -710; Score=1.2; E_value=0.064; Accession=PF08241.3; Description =Methyltransferase domain
  Pfam annotation: Domain name=dsrm; Domain location=7-63; Score=28.6; E_value=2.3e-05; Accession=PF00035.16; Description=Double-stranded RNA binding motif
  Pfam module annotation: Pfam domain module=Methyltransf_11::dsrm; Domain location=608-710::7-63
ACYVVEEVKELPQTECPGLSIPQMGPCLYRCTLQLPELSVVSGTFKKKKDAEQSAAEIAIEKLGICTEAIDPTPQEAQESLVSRIAYIFSEKFVVCDHPLSGHIRATLLRKGDLCGSIPISVIAFYDAKLFSLCKCINPEVESNPFLVISYIMNATANLHQFLATSERHLWIRRLSPYPQDIIESLMKENGSQECIQVTAVHIPSSVEQSIEAVTLHISSREYYLDIIAYELGFEDASNVLISRNLGKASSETRLFFTASKSYLLDLSSKFPNGKETLYLKGSLNVRASYFAGQDITGDAILASIGYTRKSRDLFYEDVTVRLYYRQCSHLSCHQDSPQEQTGGVLFPGIYFVAESDENVIECVNGDCYKKQNDAIQNASLKVLSWLNMCFRSMILPFEQLYETADNFNIQIYFKNIIRDILAGQSTHNGQLNGIQCNNLVESIYMNSSCDMLGNIVHSLKIEGPYSGVCPSNGSLPCIRYSVSLAVEGENLKEVIEVCDEFEFEVGIGAVVSYVEDVVMQMSVGQCAYFSSNLLTTELIFASAGDSVKMLASLSSKDCCMEYEISLIRVAEPPEERMEQALFSPPLSKQRVEFAVQQILESHATTLIDFGCGSGSLLEALLNYPTSLKKMAGVDISQKGLSRAAKVLNSKLVTNSDAGGQLTSIKSVILYEGSITNFGSQLHGFDIGTCLEVIEHMDEDQACLFGDVALSSFRPRILIVSTPNFEYNVVLQKSNPPTQEQEESDEKTLLQSCKFRNHDHKFEWTREQFTQWACDLAARHNYNVEFSGVGGSADVEPGYASQIAVFKRDWKLEDDVIGLPVFLKADKQDRLWMLGEKRKRIYRFRQGTD

SEQ ID NO: 162581 - protein, 345 aa, Glycine max
  Coding DNA Sequence Number=SeqID_70896
  Gene Ontology: Mol. function=methyltransferase activity; Cellular component=Golgi apparatus; Biological process=metabolic process
  Homolog annotation: Hit_ID=A7QQK5; Match level="QueryCoverage=98%, HitCoverage=99%, E-value=2e-61, Identity=67%"; Hit description =Chromosome undetermined scaffold_143, whole genome shotgun sequence
  Subcellular localization annotation: CTP_CleavageSite=65; ConfidenceScore=5.00e-01
MGFTFSTMTLNLVLLMAMVATNILSLYHLSSTLQSPKSPKPPPPVPDQLLHQLHTIRATISHLTRLQNTHNPAQKSTIPSDLLLYSHLSPIASSCHNHPELLHKYMTYIPFSLCPSDSDLAESLILRGCHPLPRRRCFSKTPQKPPVSLPENPFPSSLPDNAVIWDHYSCKSFDCLNKQNPNLGFEPSRDISRFNSYKTDLDLPIQQLLQIAAAAKSALRLGLDAPQRDRGDHDHERGGAEQRGRRTAGARAAARAPAAAAAAVRRRRGSGAVRARREPVDSFDGDGVSAAGCGQGAEGRRVYAPLIGKLGYKKVKWATGNKTDASGVKNGEVYLTALLQKPVSR

SEQ ID NO: 162582 - protein, 105 aa, Glycine max
  Coding DNA Sequence Number=SeqID_70897
MGMGTYHLVGCAEETLAGALMLMQQEEEEVALAISGCLRTAIKPILALHELHKHSRWQEVDEAVAVDFEVVHDTAKLLRQDDRSKRRLDCAVELIGEDLAVVVGI

SEQ ID NO: 162583 - protein, 100 aa, Glycine max
  Coding DNA Sequence Number=SeqID_70898
MSSSHSGCLMSSSKSSRGADGTRACLIYGLVMKMDLDVGSFISQQISLIAQSNVEVPSYGTIAHHGEHAHAIPTPIDGPTAHHSKGLSSAGRLARRLVLH

SEQ ID NO: 162584 - protein, 60 aa, Glycine max
  Coding DNA Sequence Number=SeqID_70899
MIHEEGEALTDSSECRPWGSPDLSAPLSLCRSHMVGAFSQNTVTLTGLPMILPSESDLTC

SEQ ID NO: 162585 - protein, 82 aa, Glycine max
  Coding DNA Sequence Number=SeqID_70900
MAAEWRRKRDRRCHFKEKMSLEEAHHHRRPWIRAWRKKEMNEGIGREEHEILCSKRALNPLIQDHFQDSPLSVLRCHEACKA

SEQ ID NO: 162586 - protein, 188 aa, Glycine max
  Coding DNA Sequence Number=SeqID_70901
  Gene Ontology: Mol. function=prenyltransferase activity; Cellular component=integral to membrane; Biological process=regulation of transcription, DNA-dependent
  Homolog annotation: Hit_ID=A7QT41; Match level="QueryCoverage=63%, HitCoverage=47%, E-value=2e-33, Identity=47%"; Hit description =Chromosome undetermined scaffold_165, whole genome shotgun sequence
MLESYSGVINLQFSVLGQLLLQCPPFRLSYQGLGEPLCFAAFGPFATCAFYLLHGSSSHFHQVEGDREVGKMSPLVRLGTKKGAEVVKGAIFMLYALLVAFGLIKALPLTCIIFMAKYFCVRLHALFGVALALGLVLARKSVDDPGRPPGIVLSAATSFWLPVPPKRVFDFLRDENSRNEVCAKIPKS

SEQ ID NO: 162587 - protein, 76 aa, Glycine max
  Coding DNA Sequence Number=SeqID_70902
CMSGNRDVFVARLHACACQHPFHPGLFVGDAGGFQSPTREPLNVGGLVPPHCSLKSVVSDDACPGACFVQRDATTL

SEQ ID NO: 162588 - protein, 45 aa, Glycine max
  Coding DNA Sequence Number=SeqID_70903
MGRIVLSYLLGVETKHEQQKSIKVLRNGCKWGWSHDRLIVALSLR

SEQ ID NO: 162589 - protein, 151 aa, Glycine max
  Coding DNA Sequence Number=SeqID_70904
MKEGIGHILDLTPIGEKMKESLKRLTLNSHTSMGKDNVEANLDWEIRVEQQLKRKSTSKSYGSHSYPKKDQGQGILGTLASIATPLGLEFIPQVKKLLDEGLVRKSLNPCTLLVPKIGIIRHQVPKMGGMMNVLSGATLFCKITRTPNIFM

SEQ ID NO: 162590 - protein, 65 aa, Glycine max
  Coding DNA Sequence Number=SeqID_70905
ALGRRLQVDWARDPRDGPRVLLSLRLSSSFSSQGVSLAIRELLKEVFSKKLLKEVFSRKLLKEAT

SEQ ID NO: 162591 - protein, 107 aa, Glycine max
  Coding DNA Sequence Number=SeqID_70906
MLGFTSSSPQFSASPHQLDFPPYASRSYSAQWNVQELLHDMHMLHLSRILGKMEVEEPWQGLWLPLHYQVVFGHWECGKQACLMADLGMAFLDDWVMGNEKGSYGIL

SEQ ID NO: 162592 - protein, 141 aa, Glycine max
  Coding DNA Sequence Number=SeqID_70907
MNRKDQSRRKVKKPCKHSLIQRSIVIDGRKRKLNGRAINGGEIITVIRTTRKEGDPIPKTLLIERSSTKEVFNALTIKSLGTLLMSVTENPITKENLKAMMQNWLKKKMRTLNSLTAPQQNLTFCTLMLSFCSHEQGSRSL

SEQ ID NO: 162593 - protein, 68 aa, Glycine max
  Coding DNA Sequence Number=SeqID_70908
  Homolog annotation: Hit_ID=Q2HUM1; Match level="QueryCoverage=98%, HitCoverage=88%, E-value=3e-08, Identity=47%"; Hit description =Putative uncharacterized protein
EWQPKVTTIAESRDLANMSLATLFGKLQEHEMELMRLNQHEENDKKNKGIALKASSSIQEESDKENEI

SEQ ID NO: 162594 - protein, 179 aa, Glycine max
  Coding DNA Sequence Number=SeqID_70909
  Homolog annotation: Hit_ID=A5AIK9; Match level="QueryCoverage=60%, HitCoverage=6%, E-value=4e-13, Identity=39%"; Hit description =Putative uncharacterized protein
MTRGNPGDLQPFDPEIDRTFHRLFWHSVHPDHSVHFMHSEHSVHSVHSEHSVDGDSKYSNFEHSAANFHTENMAQPPPRERTLREMVAPDFTYESLCIQYPDEDVPYVLKTGLIHLLPKFHGLASEDPHKHLKEFHIVCSTMKPLDVQEDHIFLKAFPHSLEVVAKDWLYYLTPRSIAS

SEQ ID NO: 162595 - protein, 166 aa, Glycine max
  Coding DNA Sequence Number=SeqID_70910
  Pfam annotation: Domain name=zf-CCHC; Domain location=12-29; Score =17.3; E_value=0.0037; Accession=PF00098.14; Description=Zinc knuckle
MENPKQTIKSKIMCYNYGKQGHISKYCRLKKKLRNLNLEPTIEEQINNLLIETSEEETETSSSVLSDEDLNLIQQDDQLSSTDDDDRKINTLTREQDLLFEAINSIPDPQEKKVFLEKLKKTLEVKPRQKDFITNNKFDVSNILKSLRKVVILKVPTTVRKTNQKI

SEQ ID NO: 162596 - protein, 82 aa, Glycine max
  Coding DNA Sequence Number=SeqID_70911
MAEQAKQVFYVEDPCDERWKMATPPSFPPPPPIDSTSHSPSTMRRKRKETRLRSLATRPIGAERPLVHVDPAIGKVDGPHRS

SEQ ID NO: 162597 - protein, 127 aa, Glycine max
  Coding DNA Sequence Number=SeqID_70912
MTSLACFQQIPSQITTIRHKLGRTTHHISQKPNTHEIYVRRSLPKPEIEVPQRRGALHDSENGFLLQYGVEMVSKVWSFNGQQWWMRRGEEKQPLATCPILSGTKRGPPLPLDVTHTQPREEKNLTF

SEQ ID NO: 162598 - protein, 79 aa, Glycine max
  Coding DNA Sequence Number=SeqID_70913
MAKIQGLKEGKIYSNIYKEERTQPLSMGSKIYPGIHENPKAFFRSSSPILLESSIQYPCGVGLHQLIMVAQFFVGKVAQ

SEQ ID NO: 162599 - protein, 71 aa, Glycine max
  Coding DNA Sequence Number=SeqID_70914
MKDCKNTSGGLVRARALSARMDRLAHVSDFWLNALLSLSGWVEAVRLMTWSSALNEPDNSSSSGFFLALSH

SEQ ID NO: 162600 - protein, 135 aa, Glycine max
  Coding DNA Sequence Number=SeqID_70915
MSQHICYIVVNSPQSIQRSRQSQFESESYIKSWMQSSKCDVYLGAYLNSALKGLDDTPQPKSKAGARWIVVKCNRQNGSIECGYYVMHWMSRITLGTFRNNWEMYFNDVRPLKAERLKALRIQWAQFYLKVRNES

SEQ ID NO: 162601 - protein, 94 aa, Glycine max
  Coding DNA Sequence Number=SeqID_70916
MTILLNWLLLEEFMRGRQPSTTFLWNKQGAEGPTKPIDRSDPCVDPLYLMTLTILQLILKPLQVSWDATVFGVHNDNFPLCIKHVDLSELAKNG

SEQ ID NO: 162602 - protein, 105 aa, Glycine max
  Coding DNA Sequence Number=SeqID_70917
CSSCSDFEKAAVSPAKPPQKPDPEVDDPLYLMTLTIPQLFLRPYQVTWDATVFGVFNPDFPLYIKHEDLSKIPCGGQCLNILVLQSWILHLTETSMQAGNSDMYG

SEQ ID NO: 162603 - protein, 30 aa, Glycine max
  Coding DNA Sequence Number=SeqID_70918
AKESIDEEDPRPTGSNGAYISDGLHFSTTK

SEQ ID NO: 162604 - protein, 146 aa, Glycine max
  Coding DNA Sequence Number=SeqID_70919
MVALGRVYEGSTAVHNIPLLHGQVKVGVEEVKDADAPVLVPTNEVILVGQTLNTFLGWPTHIVKHLSEHAAVSPAKPADRSDYEIDDLLYLMTLTIPQLFLKPLQVMWDATVFRVFNENFTLYIKHEDLFEIAHGGQCLSISVIQL

SEQ ID NO: 162605 - protein, 55 aa, Glycine max
  Coding DNA Sequence Number=SeqID_70920
MEMQWKTKEKRITSLGTPLPLSLPTMPIYRKMGTWGNGSSPRRAVSFTLKSFEGP

SEQ ID NO: 162606 - protein, 103 aa, Glycine max
  Coding DNA Sequence Number=SeqID_70921
MPLQGEDKSRTSSPPQEAMDKSLKVGADEWREKERRRMSHEIISSFVLNIKLNFFSDRVHVMCEEESGEGCLQDDLLYLKSLSRLGGSQGRTTLKAHMRPINC

SEQ ID NO: 162607 - protein, 61 aa, Glycine max
  Coding DNA Sequence Number=SeqID_70922
MVSEMSNEDGTPRSLSSGTASWLDRVELEVLGSTEIVTEGMGSCSDGGGGGDAGGDPRLPP

SEQ ID NO: 162608 - protein, 204 aa, Glycine max
  Coding DNA Sequence Number=SeqID_70923
  Homolog annotation: Hit_ID=A5AYU6; Match level="QueryCoverage=47%, HitCoverage=17%, E-value=7e-11, Identity=35%"; Hit description =Putative uncharacterized protein
MISRLSQEQFKNQEKYPRESFIKKIQDSRFKNNQDQDSRLKDSRIKRRLNQDKFSKFKMKSHICGCVIDYTFMDTSFVVQVEGTSTWVVVTKNKRGYISCGSVLVEGTSTRLLKENKGGNRSNLKSSQDYDEDQANLCLITKSHENNKKESVRKKWYIDSGCSKHMTGDVSKFTTISPKKSGHVTYGDNNICKISKEVTSKPSL

SEQ ID NO: 162609 - protein, 143 aa, Glycine max
  Coding DNA Sequence Number=SeqID_70924
  Homolog annotation: Hit_ID=Q8H6Q8; Match level="QueryCoverage=96%, HitCoverage=4%, E-value=5e-08, Identity=25%"; Hit description=CTV.20
MTKANVSLPRTIKWDEVTLPEKWIMDKATSSVPRPTPTIEQIKQDNSGKVEITFNRRNSFSSRIEASRSEYESARRSFSVRTRSIPVGLTRSKSHNQFPTVNLQGLDTTSSIPRTTYNQEQEDDQKSIQSPTYSSMHEPYDVI

SEQ ID NO: 162610 - protein, 237 aa, Glycine max
  Coding DNA Sequence Number=SeqID_70925
  Gene Ontology: Cellular component=cytoskeleton; Biological process =phagocytosis
  Homolog annotation: Hit_ID=A2Q1V0; Match level="QueryCoverage=27%, HitCoverage=24%, E-value=2e-15, Identity=66%"; Hit description =Engulfment and cell motility, ELM
MYVCMSPRVASKGTLSRTLQRCLFFGTQLHSFASQHMVHHLHGIYSFAMVQMVRNQQNQLHSFASRHKFLEDHLRMQHEGWVSDVRRHKDQISQMNGMLTSEEKKRSLEAAKADFAMGLKHTEAAMLKWILGGGGECLVLVLVLGVRFLKVLLFYNVSIIAKYDPKSDLLDHEFMLKGKWFQQKDMEKSFQDLLRKQEGDRSVWEYPFVFAGVNITFMLIQMLDLEAVTTDHYLSDG

SEQ ID NO: 162611 - protein, 97 aa, Glycine max
  Coding DNA Sequence Number=SeqID_70926
  Homolog annotation: Hit_ID=Q45NJ7; Match level="QueryCoverage=75%, HitCoverage=36%, E-value=6e-22, Identity=71%"; Hit description =Putative uncharacterized protein
  Pfam annotation: Domain name=DUF300; Domain location=1-89; Score= -152.9; E_value=0.042; Accession=PF03619.7; Description=Domain of unknown function
MAVCCRPSCMFYFDDCITATRLYPNWLSWAFTIVLNISVSLALYSLVAFYHLFAKELAPHKPLAKFLCIKGIVFFYSCQQDNKLNVGNFNLKKQRGS

SEQ ID NO: 162612 - protein, 154 aa, Glycine max
  Coding DNA Sequence Number=SeqID_70927
MASRSLSMPNPPFGLGNGIEVYFWTDRWLSSPLVDLLDIPNISTPSLVLRLLTSSRMTSNLSKGKMAPSMSDFNIIKSFDIVGHAPKPYSTTQVIWHDPLLEWLKCNTDWASRGNPGRATGEEVFSGIPLAFSLVLLLISMGFHPPSWLSCLQQ

SEQ ID NO: 162613 - protein, 263 aa, Glycine max
  Coding DNA Sequence Number=SeqID_70928
  Gene Ontology: Mol. function=DNA polymerase processivity factor activity; Cellular component=PCNA complex; Biological process =regulation of DNA replication
  Homolog annotation: Hit_ID=Q00268; Match level="QueryCoverage=47%, HitCoverage=56%, E-value=3e-33, Identity=57%"; Hit description =Proliferating cell nuclear antigen
  Pfam annotation: Domain name=PCNA_C; Domain location=12-115; Score =86.0; E_value=1.2e-22; Accession=PF02747.6; Description =Proliferating cell nuclear antigen, C-terminal domain
MKLMDIDSEHLGIQEAYHVMPLLRCHPLSLLRFARISVVLVTLEGVKFSTKGDIGTTNIVCKQNNFVDKPEEAIVIEMNEPLSNTITISLSNEPPFVVEYKIAKMGYVRFYLALRIKEDEKDTKPQVVGIEGENEEWIGAGVGLGAPQHDRGDHDHERGDAEQQGRRTTGAHIAAPASIRRQNRETKGRRENAGSRKTKFDTPNQNCLQHMLLLKDVPESDDQCLLSSVNIDEKIRFVEIPSVKVESAVPTDLAYSSNRIPSI

SEQ ID NO: 162614 - protein, 149 aa, Glycine max
  Coding DNA Sequence Number=SeqID_70929
  Gene Ontology: Mol. function=RNA-directed DNA polymerase activity; Biological process=regulation of transcription, DNA-dependent
  Homolog annotation: Hit_ID=A5CBG1; Match level="QueryCoverage=95%, HitCoverage=9%, E-value=5e-28, Identity=40%"; Hit description =Putative uncharacterized protein
MDLNGKVITNDDIRRIPDAVIPSIFTIAQILLETRHFGKIDFRWYRDTFLTRVYIREDSQQPFWKEKFLAGLPRSLGDKVRDKIRSQSLNGDIPYESLSYGQLISYVQKVALKICQDDKIQRQLAKEKAQTKKDLGSFCEQFGLSACPK

SEQ ID NO: 162615 - protein, 66 aa, Glycine max
  Coding DNA Sequence Number=SeqID_70930
  Homolog annotation: Hit_ID=A9P8K6; Match level="QueryCoverage=57%, HitCoverage=23%, E-value=1e-07, Identity=68%"; Hit description =Putative uncharacterized protein
MSSKKTRKGKSPRRGGNRFWKSIVVRLKTPREAIEGDFFVFFSRCQVMDLSHLMLRDVFLKSNKLV

SEQ ID NO: 162616 - protein, 74 aa, Glycine max
  Coding DNA Sequence Number=SeqID_70931
KAGVAAHDVQRYVKESDWAAQCTRQDKMSNEELKLQDPRFLGLECFVSHLDVTLTSSVGPECVELISIVQRAIS

SEQ ID NO: 162617 - protein, 98 aa, Glycine max
  Coding DNA Sequence Number=SeqID_70932
MGHGITTTSVPRSLTKSYFETSAMKTLTNSLEGKADQVVPQWIEPKVCHYFFKSALKLVPCVTFIVVALANIFHIAIRAMFKPEAVRVDIMSCIGCGA

SEQ ID NO: 162618 - protein, 202 aa, Glycine max
  Coding DNA Sequence Number=SeqID_70933
  Gene Ontology: Mol. function=protein-tyrosine kinase activity; Cellular component=MHC class I protein complex; Biological process =protein amino acid phosphorylation
  Homolog annotation: Hit_ID=A7NTX9; Match level="QueryCoverage=69%, HitCoverage=89%, E-value=9e-51, Identity=68%"; Hit description =Chromosome chr18 scaffold_1, whole genome shotgun sequence
  Pfam annotation: Domain name=Hin1; Domain location=2-120; Score=10.3; E_value=0.00022; Accession=PF07320.4; Description=Harpin-induced protein 1 (Hin1)
  Subcellular localization annotation: CTP_CleavageSite=63; ConfidenceScore=5.56e-01
MSGVATSLVSMNSSVKMTFRNTATFFGVHVTSTPVDLNYYQLTVATGTMPKFYQSRKSQRSVRVMVIGSHIPLYGGGANLNSVNGKPVEPVPLTLSVMVRSRAYVLGKLVKPKFYKKIECSIVMDPKKMGKAISLVKKCTYQNNEVSGSAAFNSLFSIGSKDGSLKSLKCLIDTEFESLNQSLTCSGSALDASNCVHHLAKA

SEQ ID NO: 162619 - protein, 182 aa, Glycine max
  Coding DNA Sequence Number=SeqID_70934
MGMGVNLPLQTRTQETRYPRSPPCEARTTRYAGSPHSQKKKEYEGDCCCANRVEEPRWHMVQHKERRRGVRVQKREVSVTACASEGVIVAPTWQYGINNSLREKVQPEGTPPTLSTKTGSTDPRRREATCPELEPNIILPRPADGELTSEYEISEEEVENELKEEAMQGDMLMEVVLMLQVP

SEQ ID NO: 162620 - protein, 59 aa, Glycine max
  Coding DNA Sequence Number=SeqID_70935
MEVATTTLLQAPLELVGLGSSSSMDSFASWKINGSGMEKEEREEKPLQGEDESRRSSPP

SEQ ID NO: 162621 - protein, 115 aa, Glycine max
  Coding DNA Sequence Number=SeqID_70936
MHPNSTYGACVVPPTSPPPPVDTNLTIVDEGTISRYKRSFMLTPLSSWHNNYLHGYEQLMQHLKSTSDSHKILAFDQVYKLIKFEEAKCKEDCQSSGWLYECPTKVLLKRTRKGS

SEQ ID NO: 162622 - protein, 600 aa, Glycine max
  Coding DNA Sequence Number=SeqID_70937
  Gene Ontology: Mol. function=transferase activity, transferring glycosyl groups; Cellular component=cytosol; Biological process =pyridine nucleotide biosynthetic process
  Homolog annotation: Hit_ID=Q6XQM5; Match level="QueryCoverage=100%, HitCoverage=100%, E-value=0.0, Identity=80%"; Hit description =Nicotinate phosphoribosyltransferase-like protein
  Pfam annotation: Domain name=NAPRTase; Domain location=168-482; Score= 86.9; E_value=6.4e-23; Accession=PF04095.7; Description=Nicotinate phosphoribosyltransferase (NAPRTase) family
METKENGPSKKVSNGGIDGPTNPMVTPLLNDLYQFTMAYAYWKAGKHQERAVNPFGGEYTVFAGLEECIRFIANFTLAEEEIDFVRECLSSSCEDGFFDYLRGLDCSDVEVYAIPEGTVVFPKVPLMRVEGPVAVVQLLETPFVNLINYASLVSTNAARHRNVAGKSKTLLEFGLRRAQGPDGGVGASKYCYIGGFDATSNVAAGKLFGIPLRGTHSHAFVSSYMSLDEITDKSLRGKDGSSRCDDFVSLVIPETEMDILKAEAQCSKALHAYACVFNANFDLSNGVFGETNQSELAAFTSYALAFPDGFLALVDTYDGIYITGKMSEPLCAYKSVSRYGKVMRSGIPNFCAVALALSDLGYARKYKAVGIRLDSGDLAYLSCEVRNFFRSIEKEFGVPEFGKLQITASNDLNEETLDALNKQGHEVDAFGIGTYLVTCYAQAALGVVFKLVEINNQPRIKLSEDVSKVSIPCKKRCYRLYGKEGYPLVDIMTGENEPSPKVGERILCRHPFQESKRAYVVPQRVEELLRCYWPGSTDIKKDTLPALRDIRERCINQLEQMRPDHMRRLNPTPYKVSVSAKLYDFIHFLWLNEAPVGELQ

SEQ ID NO: 162623 - protein, 118 aa, Glycine max
  Coding DNA Sequence Number=SeqID_70938
MESRDVKNKSSGKRKLSSENTRSYFAWDLEMECVLVESHEEAKQFRFKVIPNWDDIVDLCTKDKATRLGVENALDTYDIMSKEATEDEVIHGVSIDIEGPSSTTRKTFTQVRVKRKKG

SEQ ID NO: 162624 - protein, 184 aa, Glycine max
  Coding DNA Sequence Number=SeqID_70939
  Gene Ontology: Mol. function=pyruvate kinase activity; Cellular component=membrane coat; Biological process=glycolysis
  Homolog annotation: Hit_ID=Q1SN32; Match level="QueryCoverage=89%, HitCoverage=51%, E-value=2e-42, Identity=87%"; Hit description =Pyruvate kinase
  Pfam annotation: Domain name=PK; Domain location=1-166; Score=-252.4; E_value=0.0038; Accession=PF00224.12; Description=Pyruvate kinase, barrel domain
MGKELRVCYLILTGYAGHVVQVSEVKGQDVVCIIKNIATLVGSLFTLHASQIHIDLPTLTEKDQEVISSWGVKNKIDFLSLSYTRHAEDVHHAREFLSKLGDLSQTQIFAKIENVEAEKVFNQDLYFKRTVKYVGEPMTHLESIASSTVRAAIKVKASIIICFTSSGRAARLIAKYRPTMNYLL

SEQ ID NO: 162625 - protein, 30 aa, Glycine max
  Coding DNA Sequence Number=SeqID_70940
MALGWWPQMTHPPHAEVPRMWDLCLPYEEK

SEQ ID NO: 162626 - protein, 37 aa, Glycine max
  Coding DNA Sequence Number=SeqID_70941
MNSLSEHVCAKQVHQYSLYLRAKSSFPGPSTIGCGIH

SEQ ID NO: 162627 - protein, 36 aa, Glycine max
  Coding DNA Sequence Number=SeqID_70942
MSVLELYIEKDIVGDDEVADMVQPVTIVQPREDIFN

SEQ ID NO: 162628 - protein, 76 aa, Glycine max
  Coding DNA Sequence Number=SeqID_70943
MSRNFTNCATMLPFEFRHVTELHKLPDDGCQITIDISEPYTEAMRGTVHKPQADLGAYQKFSPGRLKTRKGSLSKN

SEQ ID NO: 162629 - protein, 101 aa, Glycine max
  Coding DNA Sequence Number=SeqID_70944
MVSSNYLFLEGNSINRPPIFNGVEAIDLNIWDALEVGPYIPTMVVGNKTIEKPREEWSEEEKKLVQYNLKAKNIITSALGMDEYLGYQIVKVQKKRGIPYK

SEQ ID NO: 162630 - protein, 320 aa, Glycine max
  Coding DNA Sequence Number=SeqID_70945
ELKNFADGSIDVAIVKEFYGNLYDPEDKPKQVRVRGRLVKFDADTLNSFLKTLVILEEGENFPVYSRFCRSKPEPQEMAARLCIPRRGFELNADGLPLKILRKNLIMLAQTWSILSFSNLVPTSHTSNITLDRARLGFPALIIALCQARGVISDSLTLESLDPAINVAYVKKNCLNLDDLSVTFRGSCKANGKRSEAPPPSEVPPSSAPAPTPAIPSSSIQIPLPVPLSSLQDLGFPSIMSMDEFDAQEPVPEKPLPVTAEGEDELTPPEPFDFDAEPSLAPALIPDDATPVMEPEQPIQDSSTAPALDLNEDQPQEQDI

SEQ ID NO: 162631 - protein, 336 aa, Glycine max
  Coding DNA Sequence Number=SeqID_70946
MGEVSTEAIASLAQYYDQPLRCFTFGDFQLSPMVEEFEEILGCPLGGRKPYLFAGLMGPVHRYSRTVDLRMSPLSECGWVGGPKAIDSKGEPNWDQLLVKPRVGAVGQSTGAFPKLTMENLRPTMEKSPAVALARVASAIQSRSCYKKLGYPMRGAPLEEELAPVISRGFNKSNMETFQKGRKAWEVVREKDKELRGGNTGPIGGYRKWLRAHVQGLDWLPSLRTAKREEVEAPEEDEEVQALRTELEQAQTVKERFKSLPPKPCNKKPREPVGKSTDRTSSEGICGAITASLSSETNMLAIITKYQEELNLATAHEHRVEDEYAQVYAEKEARGR

SEQ ID NO: 162632 - protein, 132 aa, Glycine max
  Coding DNA Sequence Number=SeqID_70947
  Subcellular localization annotation: CTP_CleavageSite=24; ConfidenceScore=5.11e-01
MFAHSFKGCRPLGRACGVLIPSPCVNTTPEPFTKKFVDLVFFRFFRRFPQINVGGDSARIPFVEHASCESRVALPPKGRLRQGPMTRLVMSFKTKKGKHRLKGLSKGLIQGSINKNQAKAIVQAINGAKHTK

SEQ ID NO: 162633 - protein, 168 aa, Glycine max
  Coding DNA Sequence Number=SeqID_70948
  Pfam annotation: Domain name=Transposase_23; Domain location=48-118; Score=-6.8; E_value=0.0066; Accession=PF03017.5; Description =TNP1ENSPM transposase
  Subcellular localization annotation: CTP_CleavageSite=31; ConfidenceScore=5.17e-01
MASFSQIQSQFQSQMQSQGLALPLVGPSVPQVNTKESCVDPSGSDPETGDSDRCGLYIEANPAHLVALGRVYEGSTIVHKTPLLSGQVKVGVEEVKDLDASIPVPNDEVSLVGHAIDTFLTWPKHLVKPLSQQAIVSPAKPPQTPDPEVDDPLYLMTLTILELFLRPY

SEQ ID NO: 162634 - protein, 158 aa, Glycine max
  Coding DNA Sequence Number=SeqID_70949
  Homolog annotation: Hit_ID=A5B8K0; Match level="QueryCoverage=25%, HitCoverage=13%, E-value=6e-10, Identity=70%"; Hit description =Putative uncharacterized protein
MDVEKNVCDSVIGTLLNIQGKTKEGLNTRQDLADIGIRSQLHQRRNLISQRLLTVGRKGSYYRPWGRDGGRCAQEGTGHPEAEYCPPRFVSWGYDYLEQKILAEKTKKKLEEAAQSRSVDGFNDPPSPVRRHVKWKMARTKKAGEMTTEAVKEITEKI

SEQ ID NO: 162635 - protein, 246 aa, Glycine max
  Coding DNA Sequence Number=SeqID_70950
MEQEPLREKYPRLYNISYQQQKLIQDMGCQSANVWEWKLEWRRHLFEWRSQFLSITTSNRWEVTKTMGGSGALFGEGHCFDNKIDTACVFLNEVQDMAIQQHGPDVWEWAADPTGQYTANNAYKVIKGKHIMKKANKQIYDKEDRAEQQAKSIQCGPQLGQLTDLPYEPQTYLDHTPSTHKKPTGGNWQVYSRGSWSNRRHQRSGSFEGNHMPLSIIQQSSSRNSSGTATGNISIDLQQEASGGYT

SEQ ID NO: 162636 - protein, 40 aa, Glycine max
  Coding DNA Sequence Number=SeqID_70951
MAPSRPKAFPIFHCCWASSITAVLHSIMLFKPLPESFLHC

SEQ ID NO: 162637 - protein, 16 aa, Glycine max
  Coding DNA Sequence Number=SeqID_70952
MAAQGTRDGTSTPQSK

SEQ ID NO: 162638 - protein, 46 aa, Glycine max
  Coding DNA Sequence Number=SeqID_70953
MLNGLFVEDLSLDEPWRVKEEVFNLYKVLPKIMFSKLKKVLNSVVD

SEQ ID NO: 162639 - protein, 83 aa, Glycine max
  Coding DNA Sequence Number=SeqID_70954
MASPKEIATTIYHNGHIVDDPVHGSIGMMETILHNPQLNSVEFYAVTDLIPQSQPSSPQPSCPQLQLSPPQQLLYNNIDLNNP

SEQ ID NO: 162640 - protein, 60 aa, Glycine max
  Coding DNA Sequence Number=SeqID_70955
MTVRSFGFDGPNDIYPSHGKRPRGGHDILRMWQNIDIVRVRLTFMAFPYMGAAVAFHSEP

SEQ ID NO: 162641 - protein, 251 aa, Glycine max
  Coding DNA Sequence Number=SeqID_70956
  Homolog annotation: Hit_ID=Q2HW90; Match level="QueryCoverage=82%, HitCoverage=56%, E-value=1e-16, Identity=27%"; Hit description =Putative uncharacterized protein
MGSSQVPWLKKRFYQVKIKSLGVASLKELGQLMGQLQQQALRKAYGKIWDLTMAEVSTEAIASLAQYYDQPLRCFTFGDFQLTPTMEEKCLEAKARTLASQDEWAQFMDVLALLIFGVVLFPNVDGLVDLTTIDAFLAFHNCKESPVVAILADLYDTFDQRCEKNRARIVCCTPTLYVWLVSLLFRQEMRHVCPLEGHRSCIEKKEAKWDWLLASKEGAVSINYNLVLAIRQLGYPMRGAPLEEGLTPFIA

SEQ ID NO: 162642 - protein, 148 aa, Glycine max
  Coding DNA Sequence Number=SeqID_70957
MAEVDEVQEWMKADMEAMKEQMATMMEAMMSMKKIIEVNTATVATVSVVSRVDPTPPSGLNLINRPTSDTGDPHFVQVQNKHIFSSYGLPSNYTTPNENVNNSTPILIESQQPQTDHAHVSQPTGETHEISHRNLADFEPRLRYATEG

SEQ ID NO: 162643 - protein, 34 aa, Glycine max
  Coding DNA Sequence Number=SeqID_70958
DDLRPRVHPEAGGYATLPPLSCYSYLNMRPPSAQ

SEQ ID NO: 162644 - protein, 83 aa, Glycine max
  Coding DNA Sequence Number=SeqID_70959
MDQDDDNDAGNDLAMVVGSSSRKQKAVQENDEDLDFEENIDLESEEEEIMVNFEASDGEEGEGDAPLPYDNNEDDYVGIGEDD

SEQ ID NO: 162645 - protein, 191 aa, Glycine max
  Coding DNA Sequence Number=SeqID_70960
MVLAEGETLPAYSRYCRLPTDIREIEAALCIPGRRKNCWNPDDLTVTIREARRVRTRLVEAPSTSTAPPPACTLAAPSAPAYADFQRLEAVLQNIHQGQIILLQSLQMVAPPNSIPSVEQFNEWVAWPGTQSSLHREGEGPQPRYHNRWRMSHPRLPLQSPWSKGRRQIKHKKLQPLLRNLLRPLSSLQNQ

SEQ ID NO: 162646 - protein, 48 aa, Glycine max
  Coding DNA Sequence Number=SeqID_70961
MDIYSWREKKESHEDSTSGGFNLFSVFQTFGNSIGAVGGISEGISGNR

SEQ ID NO: 162647 - protein, 141 aa, Glycine max
  Coding DNA Sequence Number=SeqID_70962
MAEHGTRRTTTDRLEEAIAALSERHSDLANKVEAMCERLSHLSHPTRPSTQPSFSSRPPVKLDIYPRGYIESDNVQDDVPYQVEEMSHVNKVIEVESIFGLQDLKGGVEEVNLSNLLTNKEESTSLNGESNNIEQDNEGEL

SEQ ID NO: 162648 - protein, 178 aa, Glycine max
  Coding DNA Sequence Number=SeqID_70963
  Gene Ontology: Mol. function=structural constituent of ribosome; Cellular component=ribonucleoprotein complex; Biological process =translation
  Homolog annotation: Hit_ID=P29344; Match level="QueryCoverage=34%, HitCoverage=15%, E-value=6e-14, Identity=67%"; Hit description=30S ribosomal protein S1, chloroplast precursor
MECILTTFLTAKQNSTLNRGESAVTSSEGGEATKFNMTVGELMDAYEVCISNLQKAQSRRCISSLKKISPMNFITEAEEMAQTFRQRIAQVEAMARADMLRQSGLTIKDDEILGPFTSYFPEEGLDLSEVNYCYFEAGENKEALVKLVTYVHSNSTTKGIKIKSNYKKDNKNKIGEKR

SEQ ID NO: 162649 - protein, 369 aa, Glycine max
  Coding DNA Sequence Number=SeqID_70964
  Gene Ontology: Mol. function=serine O-acetyltransferase activity; Cellular component=cytoplasm; Biological process=cysteine biosynthetic process from serine
  Homolog annotation: Hit_ID=Q5MYA1; Match level="QueryCoverage=40%, HitCoverage=37%, E-value=9e-51, Identity=73%"; Hit description =Serine O-acetyltransferase 1
  Pfam annotation: Domain name=Hexapep; Domain location=252-269; Score =19.7; E_value=0.011; Accession=PF00132.15; Description=Bacterial transferase hexapeptide (three rep
  Pfam annotation: Domain name=Hexapep; Domain location=284-301; Score =16.5; E_value=0.1; Accession=PF00132.15; Description=Bacterial transferase hexapeptide (three rep
  Pfam annotation: Domain name=Hexapep; Domain location=309-326; Score =11.5; E_value=3.3; Accession=PF00132.15; Description=Bacterial transferase hexapeptide (three rep
  Pfam module annotation: Pfam domain module=Hexapep::Hexapep::Hexapep; Domain location=252-269::284-301::309-326
SHDMETCLMVEELLQRLMDCGQLEVSIGGREEPQICMQLEEKKVPLTPKALVICFTRKGTGSTPIYPRTAPKPTPFAYQSNKVVPWKYTPPAFSERVATEVDSLSAKVTNITGLSGVTHSGWVFASPHLAKLPSKGKAPMVQEPTNVATPSKEVDPLVTLPQSEGNLVLFKFEWLFGTPKVELVKHVTVQKVLESVHIAANKNTVLGDVSAMVPGGIRMARRVHSHFTVDRSQAVIRGKKGNKTSGLVVEETAFIGNNVSILHNVTLGGTGKARGDRHLKIGDGVLIGPGTCILGNIKIGEGVLIGPGNIKIGDGAKIGACSVVLKEVPPRTTAVGNPARVVGGKDNPIKLDKMPSFTMDHTSWFDYAI

SEQ ID NO: 162650 - protein, 158 aa, Glycine max
  Coding DNA Sequence Number=SeqID_70965
MGTNQNGKRFYQVKVKSLDVTSLKAFHAYHHSKESPVVAILADLFDTFDRRCEKNSARIVCCLPALCVWLVSHLFQQGTRHPCSLQSYRSCAEKGRVDWDQHLAGIGGNAINWFPRWKSKEEFFSRVGYPECNPLVIGCFLCEIVIRSQFHTTYEPEA

SEQ ID NO: 162651 - protein, 139 aa, Glycine max
  Coding DNA Sequence Number=SeqID_70966
MEEAIQSRSTDTVIDPPSPIRRHVKWKMACTKKTSQITFEAAKEIAEKIDSLEEQASQEHPGHVRATGVSVMIKQYFGPAPRTSRTSSSMAPEDLEQLTQQIRDQLEESITKKVSQQLIQPDAVPVLVVDAISGIRTVS

SEQ ID NO: 162652 - protein, 144 aa, Glycine max
  Coding DNA Sequence Number=SeqID_70967
  Subcellular localization annotation: CTP_CleavageSite=66; ConfidenceScore=5.40e-01
MEFQVGQKKHVLRGSSFERTATLRKGPASRANSDGANSLAPPWSTAPSRPNKTTPSSRPMPSTDPEVAKFREQDLKFLPEMEFLFKGTIVTGFASYAPSEDSRQNEGFNTRMKETNDNIDNNTKIDMTTQIMSSAKESGQRKRA

SEQ ID NO: 162653 - protein, 516 aa, Glycine max
  Coding DNA Sequence Number=SeqID_70968
  Gene Ontology: Mol. function=oxidoreductase activity; Cellular component=apical plasma membrane; Biological process=response to stress
  Homolog annotation: Hit_ID=A7PNT5; Match level="QueryCoverage=61%, HitCoverage=100%, E-value=1e-156, Identity=82%"; Hit description =Chromosome chr8 scaffold_23, whole genome shotgun sequence
  Pfam annotation: Domain name=Aldo_ket_red; Domain location=212-488; Score=408.9; E_value=7.6e-120; Accession=PF00248.12; Description =Aldoketo reductase family
  Pfam annotation: Domain name=MAM33; Domain location=1-172; Score =96.0; E_value=1.1e-25; Accession=PF02330.7; Description =Mitochondrial glycoprotein
  Pfam module annotation: Pfam domain module=Aldo_ket_red::MAM33; Domain location=212-488::1-172
MTALKPTFKVEVPVDFPFDIEDNPGERTIQLKGKFRDEIIKVQVDIPNVAPEEEHEDDENGNNEKNDSESSIPLVVSVFKENGVSLEFGVTAFPDEISIDSLSIKQSEESEDQLAYEGPEFIDLDENLQKAFHKYLEIRGIKPSTTNFLQEYMFAKDNKEYLMWLKNLKNFVEKNYLALSKHNHVNPRCQTVIWVREIMDKENTNGPLHFDLNTGAKIPSVGLGTWKAPPGVVGDAVIAAVKAGYRHIDCARIYDNEKEVGEALKTLFSTGVVQRSEMFITSKLWISDCAPEDVSKALTRTLEDLKLDYIDLYLMHWPFRTKPGSRGWDPEIMAPLCLPETWNAMEGLFASGQARAIGVSNFSTKKLQDLLGYAKIPPAVNQVECHPVWQQPALHNLCKSTGVHLTAYCPLGSPGSWVKGEILKEPLLIEIAEKLHKSPAQVALRWGLQSGHSVLPKSVNESRIKENLSLFDWCLPPELFSKLSQIHQQRLLRNESAVHETCSPYKSLEELWDGEI

SEQ ID NO: 162654 - protein, 89 aa, Glycine max
  Coding DNA Sequence Number=SeqID_70969
MDIENDRGYNCNGNNNSMEEEIQKEDESEVEVETNLVQIKQSRTYQGPRWEISSKLLFNHPKNLEGMYLRVSDEQDAQKPFQKSKMLTI

SEQ ID NO: 162655 - protein, 252 aa, Glycine max
  Coding DNA Sequence Number=SeqID_70970
  Gene Ontology: Mol. function=oxidoreductase activity; Cellular component=integral to membrane; Biological process=response to stress
  Homolog annotation: Hit_ID=Q0PGJ6; Match level="QueryCoverage=78%, HitCoverage=91%, E-value=6e-65, Identity=71%"; Hit description=Aldo -keto reductase
  Pfam annotation: Domain name=Aldo_ket_red; Domain location=10-198; Score=147.2; E_value=4.6e-41; Accession=PF00248.12; Description =Aldoketo reductase family
MSNEIRFFELNTGANIPSLGLGTWLADPGVVGDVIAHAVEAENIVPSDIPNTWKAMEALNKSGKARAIGVSNFSTKKLGELLEYARVTPAVNQSECHPAWRQDKLKAFCKSKGVHFSGYSPLGSPAWLEGDFLNHPVINMIAKKLGKTPAQVALRWGLQMGHSVLPKSSNPARIKENFDIFDWSIPEDMLDKFFEIQQEFPGSKKYLRSTKLRQERGLRAIGQFELVYGRVEVEAARVLDLATLGVRIAFDR

SEQ ID NO: 162656 - protein, 99 aa, Glycine max
  Coding DNA Sequence Number=SeqID_70971
MELMQISLQFQYHLLSEASARLASKRNLEGNLPCKHTLSALLAHPVSHLSLLALIALGSLSQSSLTRVKRENGAKRPFEDRKPFLKPEVENQEEGSVEL

SEQ ID NO: 162657 - protein, 385 aa, Glycine max
  Coding DNA Sequence Number=SeqID_70972
  Gene Ontology: Mol. function=molecular_function; Cellular component =membrane; Biological process=auxin mediated signaling pathway
  Homolog annotation: Hit_ID=A7Q2G4; Match level="QueryCoverage=87%, HitCoverage=97%, E-value=2e-74, Identity=44%"; Hit description =Chromosome chr1 scaffold_46, whole genome shotgun sequence
  Pfam annotation: Domain name=DUF6; Domain location=54-187; Score =33.8; E_value=6.1e-07; Accession=PF00892.11; Description=Integral membrane protein DUF6
  Pfam annotation: Domain name=TPT; Domain location=44-187; Score= -22.1; E_value=0.011; Accession=PF03151.7; Description=Triose -phosphate Transporter family
  Pfam module annotation: Pfam domain module=DUF6::TPT; Domain location= 54-187::44-187
MVCVVVLIVLVIALYPAEGSKAVAESGRATPEIPSSPNTMKDLGVVAILLSVEFFDVIVYTVSKAAMKKDMNDSVFVMYSNAFATCLLLPITFIFYRKRALPLLTYFIVGQLFINGFLSCSVQMLRFFGIGYCSPTLATAMSDLIPAFTFILAIVFRMEKLDWKTKSTRAKSIGTLVSIVGALIITLYKGQAVIKNHPSNKLFPKKHVSSEQFDWVLGAMLLAGHSFVLSLLFIVQTWIIRNYPTELVIVLTRGTLVAMLSIPPSLISVTDLKDLRLGFDVNLIAIAFQGPLYVAMFKPIGIIFAVIMGIAFLGDSIYLGRHTFLSCLNHKKNWSVLGAAIVVIGFYVVIWGKSQEQAKEECEVYDDSESYSPVVPLLKNKRMEE

SEQ ID NO: 162658 - protein, 68 aa, Glycine max
  Coding DNA Sequence Number=SeqID_70973
MLQPYGISIGLKEHSNSVTPKAYTPKSPSGPLPPDSDTAHELYNTHDLTLVFSNTFNTLRYNLTLVPK

SEQ ID NO: 162659 - protein, 183 aa, Glycine max
  Coding DNA Sequence Number=SeqID_70974
MHQLVFGSCSVGTFVGEKNRGPTNAEKAIGYEHGLVVPEVPILGYVLGTDDDGVGVGVNLKHVFCKVNGDDAGVAAHAAKVEAFSVTRESLYLLMIMEEREGVRLKRLQLMTRMPMSLGLTREKLGGERWCRRRRDGWRPKGEAQRREKLGRERGVVRGDERQKLGDSEETEKKSHIFLFDLV

SEQ ID NO: 162660 - protein, 186 aa, Glycine max
  Coding DNA Sequence Number=SeqID_70975
  Homolog annotation: Hit_ID=A7PNS4; Match level="QueryCoverage=55%, HitCoverage=21%, E-value=1e-39, Identity=72%"; Hit description =Chromosome chr8 scaffold_23, whole genome shotgun sequence
MVPSIFQKFRCLQTMQSARAVLISPTNAALLSIPCVLEPRVVVYQIGDFLAMNETEAVEDAREVVVVKEEERAEKMVYMWGYLPGASPEKSPILSPAPVTLSDPSLAVDSWKDVCGGGCGFAMVISEKGKLITWGSADDEGQSYLISGKHGEIPGLYQLPTEASVVKAAAGWAHCASVTGVKQEEF

SEQ ID NO: 162661 - protein, 282 aa, Glycine max
  Coding DNA Sequence Number=SeqID_70976
MGNLEKEHWQVKKFIFKYLKGTTNIGLVHHGDTSYALPSNSNSDYATDLDARRSTTRQLVVVSVIRSFVFWVQRELEHTLNYFVVNFVIRNKLNNFVIPKFQRFMFKVCKKLKALKAPLKNLFKQEFSNISNRVELAEAEYNSVLNSLKQNPQDPSLLALANRTRGQTIMLRKAESMKFSQLIKNKYLLQADKCSKFFHALIKRNRHSRFIVAIRLEDVHNTSSQDEIALAFVNHFWNLFSSHELTQAPSISICNRGPKVPPIALRPYFVLLLSKRFGTLFL

SEQ ID NO: 162662 - protein, 24 aa, Glycine max
  Coding DNA Sequence Number=SeqID_70977
MTVVACGMKEMCEDDKGYNFWGYQ

SEQ ID NO: 162663 - protein, 106 aa, Glycine max
  Coding DNA Sequence Number=SeqID_70978
MSRQNEFVGYLFTGKSPKNFDIPTGCTMDELKDLIKQVAPRGIPPYGVDETQMVIRTLIRKKKNKQGQFWHLIGLLGAPTIMMGAPSNTPKSGGLDTKWFGSFFST

SEQ ID NO: 162664 - protein, 159 aa, Glycine max
  Coding DNA Sequence Number=SeqID_70979
  Gene Ontology: Mol. function=oxidoreductase activity; Biological process=metabolic process
  Homolog annotation: Hit_ID=A4GXI2; Match level="QueryCoverage=65%, HitCoverage=58%, E-value=2e-34, Identity=68%"; Hit description =Oxidoreductase-like protein
MDYTVEDISTTMGTNFESSYHLCQVAHPLLKESGHGSVVFISSIAGLRAFPFFSAYAASKGAMNQFTKNLAFEWAKDNIRANAVAAGPVMIVLMEAVKSDTTTVLECGTFEGDLGVETILECNTFEDGLGVHTVFECNTFESRHQDHLGVKIIFECVTF

SEQ ID NO: 162665 - protein, 97 aa, Glycine max
  Coding DNA Sequence Number=SeqID_70980
  Subcellular localization annotation: CTP_CleavageSite=45; ConfidenceScore=5.03e-01
SWLLYPALPSPPPPSPPPPPPSRRIGFAVCHEAGTQSLITYLGIVARDKVDVTYENWKEVPTAQKDLIWEDIQAKFEILEASDSRTKRKLLQTVGER

SEQ ID NO: 162666 - protein, 276 aa, Glycine max
  Coding DNA Sequence Number=SeqID_70981
  Homolog annotation: Hit_ID=A4Q7P0; Match level="QueryCoverage=31%, HitCoverage=86%, E-value=1e-23, Identity=59%"; Hit description =Putative uncharacterized protein
  Pfam annotation: Domain name=DUF581; Domain location=59-114; Score =30.6; E_value=4.2e-06; Accession=PF04570.5; Description=Protein of unknown function (DUF581)
MLPKFIISPFRVESQEVKHVDKRRKHVRSFKSTNMDVGLRLLPQITSSNSTSNVLLKSAVRKANQQSIPQDLCFLKTYNLCNKQLCPDKDIYLYRDQGFCSVETKQMVAAYRQCSSEARSPTTTKADEQSQEEEKIKSRFHGEEKKLRLIIENNHFYSEKLGQIEEQMQRRPQGEEKSSGKLIINDCMMDQIVVNQLSLIPEPISGMIDQTKEDQLVQDKTQTQRRCHNDLLDGRQGEIILENSKSYACSICKSRRPNNASTKDFNYDELLEAIVL

SEQ ID NO: 162667 - protein, 132 aa, Glycine max
  Coding DNA Sequence Number=SeqID_70982
MMLKAYIHLGKFEEGLSLLEQQEEKMFAINKFCPCRSGSKVLDSLIPLAAIIREPLCHKVTVFLLMLIFLCRNILKGVKTALYYRIEFTKPPRDTKIGELTNGSTSCPEMFFFLAFHANNQFFIWKVPKYLM

SEQ ID NO: 162668 - protein, 66 aa, Glycine max
  Coding DNA Sequence Number=SeqID_70983
  Subcellular localization annotation: CTP_CleavageSite=46; ConfidenceScore=5.04e-01
MQTGRVIRSTAISLMSLSRYLPIGASVSVSGDTCPKQAPVDTPEKRASVSATPFCPTRYASRGGEL

SEQ ID NO: 162669 - protein, 96 aa, Glycine max
  Coding DNA Sequence Number=SeqID_70984
MTDNSIFQASEQIASAYLSMQGKITHRRAFNVIGKKNLLPNDATKHLCSYLQRHKNKYMRHQLGKQTGRCRNRASANRSIDFAKTLAVGSKKALPH

SEQ ID NO: 162670 - protein, 114 aa, Glycine max
  Coding DNA Sequence Number=SeqID_70985
MGLASSSTSIPESIHTKSLEVYFGNYTMIKMEETSEFLVLFGGENSNPPNDGSEDKILGLELIARLQNNGLKDRIFVRLELNARLQHRTIGLRPLTRIHTDGSLLVGLLWRLDL

SEQ ID NO: 162671 - protein, 66 aa, Glycine max
  Coding DNA Sequence Number=SeqID_70986
MITMMTTKDDEQKAQVNQRTSQENQEQVKSSSIKKNSRFKKKAYKQESRFKIQDLRIKIRFRLRFR

SEQ ID NO: 162672 - protein, 182 aa, Glycine max
  Coding DNA Sequence Number=SeqID_70987
MAPTRHPLDPDKSNRALGFPALITGLCQSFGVPVTPSKVIRPPITRAFIEKYCTQRQVQGDAPQAADAPPPHQAGPAGLFDTEQYLRHLVRQQAANHQAHVQTHDCLYQMSLSLQSQGFTSFLCPTPDQFRAEVAWPRDWPEAQAGEAPAGAPAKAPDEADEAHEDEEMTDLLDFLGGSGAT

SEQ ID NO: 162673 - protein, 68 aa, Glycine max
  Coding DNA Sequence Number=SeqID_70988
  Homolog annotation: Hit_ID=Q5MG92; Match level="QueryCoverage=63%, HitCoverage=3%, E-value=3e-08, Identity=55%"; Hit description =Putative retrotransposon polyprotein
MVFKPGDWVWIHLRKNRFTSKWKFKLQKRGDGTFDINSRVNSSQEGGNDRGLAKVEEFGLGGLNLSKE

SEQ ID NO: 162674 - protein, 184 aa, Glycine max
  Coding DNA Sequence Number=SeqID_70989
MDMKLGYIISSQISMIAQHDSSQLGFPALITTLCKARGVTSDSLSFESLSPAINLAYVKKNCWNLDDPTVTFWGPHKAKGKRSEALPSSAFHTSAPSTSNAAPSTPASSVPALALASELVPEEDELIPPEPFVYETDPASAQEEVASPELIPQSSPTPVLDDPQPYALASVPDQPIVQDPPVAL

SEQ ID NO: 162675 - protein, 198 aa, Glycine max
  Coding DNA Sequence Number=SeqID_70990
  Homolog annotation: Hit_ID=A6ZVW6; Match level="QueryCoverage=87%, HitCoverage=88%, E-value=1e-10, Identity=26%"; Hit description =Conserved protein
  Subcellular localization annotation: CTP_CleavageSite=62; ConfidenceScore=5.05e-01
TYQGNPCGVYLDLSSFTGSGVYPDLSSFIGSGVYPDLSSFTGSGVYPDLSSFTGSGVYPDLSSFTGSGVIQTFVACIKRSVPTQTYQGNPCGVYLDLSSFTGSGVYPDLSSFIGSGVYPDLSSFTGSGVYPDLSSFTGSGVYPDLSSFTGSGVIQTFVACIKRSVPTQVHINVDCQFFQSISEKNIFLPRWANVFVAE

SEQ ID NO: 162676 - protein, 106 aa, Glycine max
  Coding DNA Sequence Number=SeqID_70991
GTSTWLFKENKEGYIPCGSLLVKVFTRLKEISRTAERMKDNMEAMKEQMATMMEAIMSMNKIMKVNATAVAAISVVAEMDQTPPSGLNQINHPTSNMVGQGGKELG

SEQ ID NO: 162677 - protein, 149 aa, Glycine max
  Coding DNA Sequence Number=SeqID_70992
  Homolog annotation: Hit_ID=A5C8M8; Match level="QueryCoverage=43%, HitCoverage=14%, E-value=2e-09, Identity=47%"; Hit description =Putative uncharacterized protein
MALCSVFLNLHLLLFVCLTIEALGVAKPSVASYLSQEILAEQEADRVHGFPAQPQVQEYGGYITVNETQGTTLFYGFSRPLANQNKNPFSYGSMEAVAGLTQPNNAKPIVDSSFSKAKPEDSLDPQFKPPQASQLVSVFTILFLFGCSN

SEQ ID NO: 162678 - protein, 130 aa, Glycine max
  Coding DNA Sequence Number=SeqID_70993
MALEDKKSGTSWRSRSQKKRRSNNQFNRCSLNVQDKIDCNKINEIREERNANSIYTGSTPSHAYVQSLSKPLDVEASFMIMNQAILMMPKAQVIDSRLIQDFKIKHQESNPRFKIQEKKSRSNKLRLHIG

SEQ ID NO: 162679 - protein, 135 aa, Glycine max
  Coding DNA Sequence Number=SeqID_70994
MAAQLIRDRIVMECLEGVWETLEGNERCQFRGTVRLTATFLVHPEQPTRTLQQPMEWILPMPTPYRLVEPVQLIEVSSSEEDPEGDPEELSPEPAMDALTYQRMMRTHFLMLILQRILCQHLRQTLQRRVVLEGW

SEQ ID NO: 162680 - protein, 140 aa, Glycine max
  Coding DNA Sequence Number=SeqID_70995
MELIENMAASDHAILCDRVHVASCAICGGAHESGRCIPTEEHNYEVNYMGNQQRQGYNQGGYSGFQHGPNYNQQGQWRSHPGNQYNKDQGGPSNEPPQQGPSLYERTTKLEETLTQFIQFTMFNHKSTESAIKNLEVQVG

SEQ ID NO: 162681 - protein, 152 aa, Glycine max
  Coding DNA Sequence Number=SeqID_70996
MGAKYLKMVKRKLHATKQRQQKNVYTDNHSGISACQHDSSVSMIDLVSAEDDINLRQKNVYTDNHSGISARQRDSDVSMIDLVSAEDDQKNVYTDNHSGISAHQRDSNVSMTDLVSAEDDQKNVYTDNHSGISARQRDSNVSMTDLVSAEDD

SEQ ID NO: 162682 - protein, 121 aa, Glycine max
  Coding DNA Sequence Number=SeqID_70997
MSSKIYPKRIQGTSRLRILCPNTLEGTSFVAQVEGTSTWVVILRTREGTSLVDQFKWRIHPLSCSKRTREGTSLVDLWLVKDFTRLKEISRIVGCLGTGCRHGLWPNQYKSCVCLLLPYTL

SEQ ID NO: 162683 - protein, 187 aa, Glycine max
  Coding DNA Sequence Number=SeqID_70998
MAYTSWHLGMGKVGIMIGGQDVAEEQRHPYLGQGGHIGAHDSHSPPCSSPGKILPRPVPPLAILVFLALFQYHRISQELADSVGIERDPLTPNPGSHVTHALLCWPSIGIKLKDYFWIKLGHGSNQWCPPPAPYFLLEISILVVPELDASLPEKRPSLDGFEALLVYNAPKAVTVVLRGGTSSFGRL

SEQ ID NO: 162684 - protein, 109 aa, Glycine max
  Coding DNA Sequence Number=SeqID_70999
MQLFGYTQTIPALPVNSWVSYDDIHDRWMHYSDHMVAAGEPRVIPQVPETNIPHVPKPGAPSISARPAVDEPGHAVEVCYGIAERLERHLSLGVVMPGSSKFHSQLTQM

SEQ ID NO: 162685 - protein, 48 aa, Glycine max
  Coding DNA Sequence Number=SeqID_71000
MTKACQKGVRKCICLYVLGRSRNSGGQDMRVRLIKGEKSITGRLWVNS

SEQ ID NO: 162686 - protein, 145 aa, Glycine max
  Coding DNA Sequence Number=SeqID_71001
  Homolog annotation: Hit_ID=A5BSR3; Match level="QueryCoverage=51%, HitCoverage=23%, E-value=1e-10, Identity=50%"; Hit description =Putative uncharacterized protein
MEKKSKRQHEEHPFTENPTLNVDPPSPVVRHLKWKIARTKWYGQMTSEVAQEIADKIDSLQEQATQGSFVPHGRQDILNTALGRPEHPGRVRVIGTGVTISQYFGQASCASSTSSPSISQQQLAEIIGGIKDDIGKEVQDEIRKE

SEQ ID NO: 162687 - protein, 73 aa, Glycine max
  Coding DNA Sequence Number=SeqID_71002
  Homolog annotation: Hit_ID=A7Q8I3; Match level="QueryCoverage=100%, HitCoverage=12%, E-value=2e-12, Identity=46%"; Hit description =Chromosome chr5 scaffold_64, whole genome shotgun sequence
MASTDVRDILTAFNPSLDFFAITAGDGRVKVHTEFADITSTHSTATTLHHKSSINGHLALDYTCIEWLSFDKK

SEQ ID NO: 162688 - protein, 93 aa, Glycine max
  Coding DNA Sequence Number=SeqID_71003
MSSPSGNEHKAYWAVKTCNFSMDPSWRGKGSWQLSELDEFRPRSLRECQWRSKAPPQPRASRPRDIDLILPTPFLGDVGGEKTSLLPPTLPPP

SEQ ID NO: 162689 - protein, 111 aa, Glycine max
  Coding DNA Sequence Number=SeqID_71004
MLQPYGINIGLKEHLNPVTPKAYTPKSPSGPLPPDSVFPPTAPIEFPNVRETAKGLKPPFGLSSYDSFFSLHEHDFANPNGQSLRNGISNNISKFYDNPTVNETGIVVLPR

SEQ ID NO: 162690 - protein, 96 aa, Glycine max
  Coding DNA Sequence Number=SeqID_71005
MTAMSRLCLPSDHRTEKNNLIGAESSKLNSRIRKAGVAAHDVQRYVKESDWAAQCTRQDKMSNEELKLQDPRCRIRCPGHPARKYWTHKSVISLTD

SEQ ID NO: 162691 - protein, 65 aa, Glycine max
  Coding DNA Sequence Number=SeqID_71006
MEKINSHIISQRTYKGKGHLVQGKHAQVSWNSPRQASCLKLKVSARPSEWLLRTEKISWPKRPRC

SEQ ID NO: 162692 - protein, 109 aa, Glycine max
  Coding DNA Sequence Number=SeqID_71007
MPISTLEVRKATKKNDEEEKDDAQSHNESSPSKQQSQQEPIIEENVTPSTPRYMRPVRVTLFCENALTIWDEHRLKGALKSGVFNPKAYTPKSPSRPLPPDSGPIQKIF

SEQ ID NO: 162693 - protein, 176 aa, Glycine max
  Coding DNA Sequence Number=SeqID_71008
MSVHVAQVIADTIYLFAGMPPTRHPLDPDKSNKALGFSALIMGLCQSFGVPVTPSKVIRPPITRAFIEKYCTPRQAQGDAHQAADTPPPPRQADPARSLGMERYLQHLVRQQATNHRGLSQQGQGFAPFACPTPEQFGAEVTWPRDWPEAQAGEEPARSLGEAEEARMDEEMTDVA

SEQ ID NO: 162694 - protein, 406 aa, Glycine max
  Coding DNA Sequence Number=SeqID_71009
  Pfam annotation: Domain name=CaM_binding; Domain location=305-400; Score=-20.1; E_value=0.014; Accession=PF07839.2; Description=Plant calmodulin-binding domain
  Subcellular localization annotation: CTP_CleavageSite=39; ConfidenceScore=5.50e-01
MATKAKDSSIAGKKKAPSSNSHTTITERTIKPSVTTTTNSTYKPNSTSLEKKIPNYLKPTKTSFLESPTSKQPKSGSPSSKPFVAIRRRSLDKPLSSSNSTRSLTTPRRSSIGPINKSIVPSKPILARTTISASDGKTKPLVTKGTKKTVPTNTTTSTSTKKVFNKDHASFNSTKSTPKETTKTSKVETEQVKEVTSQEVEVIKVENEEQKVHEVEHVNDHVPPDVESEHEIEHVQGLENSDPPQYQVDDERVISTVSETEKETLEEKAKNKEHELEEDNKTNQDEGGNNNESDHQENHEAKVVVNDEDEGEGGEIIREDYKSENKNNGEEAIEEQKEAVEKVEENKVEATPSKQQSGERRHGKMEAQVSNDEIEKTAKLLEARKNKVRALAGAFQTVIDHQTTSK

SEQ ID NO: 162695 - protein, 192 aa, Glycine max
  Coding DNA Sequence Number=SeqID_71010
MDAPTQQHPPPTLIASKVPGIESDDDRPLVFKKRKVAPPSFETYVPQVKKEVMCPPSKNREPHVASITFEQDPPTGIEVPPPPTWKRLHPKVSKPSSPTIKHKIIYKIPSRACREKVSYDKDTIGWFHKIDAQQFDPSSDDFLPPFLCTKHVQLFTPMSKFVPLDYGHQALPFTKDDVYNVGMAMIQCGLTN

SEQ ID NO: 162696 - protein, 164 aa, Glycine max
  Coding DNA Sequence Number=SeqID_71011
MGSDCTGPYCWTYEHFPIVVSCVANEDYHEMKPRACRWKSGKELLTIPPHSAALSLSKEEIDDRWMQFSEYLAPVAFSLSPLSLCNTTRSNTEHCCSCIVAPTPLYYKKLHHSDFWLVVVFKLKKMINGGSLEACQWIAESLERLINIRIVTAGIEAYTIRSSA

SEQ ID NO: 162697 - protein, 115 aa, Glycine max
  Coding DNA Sequence Number=SeqID_71012
MAFSISCRADESQARLIANTSDVFFWSLVIRKDNLWVNALTHKYLSNNNSILNANCPPGASYTWCGIIKAKKGIFNGLGLDLGMVRVPCGLVIGTCMMPLEMWCLFSQSMILIFS

SEQ ID NO: 162698 - protein, 156 aa, Glycine max
  Coding DNA Sequence Number=SeqID_71013
  Gene Ontology: Mol. function=1-deoxy-D-xylulose-5-phosphate synthase activity; Cellular component=nucleus; Biological process=terpenoid biosynthetic process
  Homolog annotation: Hit_ID=A9ZN06; Match level="QueryCoverage=55%, HitCoverage=12%, E-value=3e-33, Identity=77%"; Hit description=1 -deoxy-D-xylulose 5-phosphate synthase
  Pfam annotation: Domain name=Transket_pyr; Domain location=4-141; Score=-22.1; E_value=9.1e-05; Accession=PF02779.15; Description =Transketolase, pyrimidine binding dom
MALVGQRYLMAIGGNDGKRPLADVWALDTAAKPYEWHKLEPEGEGPPPCIADFLEGFIFGTTSSAHQHLLVRFAVDRGGLVGPDGSTHYGAFDVTFTACLPNMVVMVASDDAEIFHTVATAAAISDQPCCFRYQKGNGVGVEIPPGNKGIPLEEKE

SEQ ID NO: 162699 - protein, 160 aa, Glycine max
  Coding DNA Sequence Number=SeqID_71014
MGALSAMVADVFMETRGIVTTIVNKADTVVEGVEDEELEVDEGEDLEDCNEGMGVVEVGLTVGPIKELDAREDVAVGGAKAKDEGSYYLTFVNHVLMEDAMTFWEIRKELEVEDVDWEGDDARKVYVAWSEHKLRMEDMKDLDLRWVENGGDKGERIWEK

SEQ ID NO: 162700 - protein, 106 aa, Glycine max
  Coding DNA Sequence Number=SeqID_71015
MLESFQQQDQMSVLELYIEKDVTGGSMFHSANSLTSCENNLSNNEAQPPRNVYKEFKIHFRMMLCIITISIGAILMRRTFVVWRCHRVLMLGKNYMLAWILIVKMR

SEQ ID NO: 162701 - protein, 206 aa, Glycine max
  Coding DNA Sequence Number=SeqID_71016
VPLGVGVQGQAMAAHGGHRWSWVVKNEHNPLCTRPGLAHPWALGATSSLVGIGLSAPLGAQRNFFSVGIGFSAPLGAQRNFLSVGIRLSAPLGTQRNFLSIRIGLSAPLGAQCHSLSVGIALSVPFMLSKRSKVYEACKVPKCGQSVVQAASIKLSRVEMLLVLQVRSSVRVWHRHSTLVYVSLMEWARTRFVVRGLEGLHCGVKF

SEQ ID NO: 162702 - protein, 116 aa, Glycine max
  Coding DNA Sequence Number=SeqID_71017
  Gene Ontology: Mol. function=zinc ion binding
  Homolog annotation: Hit_ID=O04238; Match level="QueryCoverage=65%, HitCoverage=9%, E-value=5e-22, Identity=67%"; Hit description =Transcription factor
MEKEYSIGLMFKCSIDPGAQVPTNVTGMLKFGTNLLQAVGQFNGHYVMLVAYMSVTPLQEDPVLQDYLQPVITSVDSDADDKYGQERVQIKPKLTMQSLVVNVVVECSHPLNLPLY

SEQ ID NO: 162703 - protein, 213 aa, Glycine max
  Coding DNA Sequence Number=SeqID_71018
  Subcellular localization annotation: CTP_CleavageSite=58; ConfidenceScore=5.67e-01
DLLPFMLARAFFLSPSKPHTVTQPPHRRVGGVAQSLRVRGQPVLSEAATRDSRQRVTRQRAVVHNGNRQPCSFGSRDMSGTGSGNGSNSSNANTGTSTGAASRSKNAPGNRTDIGWKHGTDVLGNGKKDSEPCASVLEEVKMLMMNIVAEVANASEKRRKLNIIHEEGTEGVEVESNSSQSGIQRKGMLAFKGRRKAKFVQASGGEGVQATLN

SEQ ID NO: 162704 - protein, 141 aa, Glycine max
  Coding DNA Sequence Number=SeqID_71019
MEEAKDSRKIMQPGEWWEMFSDGTPELRRFAIHVFELDLKSIALPFDEIESDNEWITEEGYNDEDEQPQAEGHGDNVELVGDVGGSSNDPVVDAFDLDNLIFLEPNGDDKQSEEDLDDDGDGDESDDIHGDDPIRGLDMLL

SEQ ID NO: 162705 - protein, 179 aa, Glycine max
  Coding DNA Sequence Number=SeqID_71020
  Homolog annotation: Hit_ID=A5C169; Match level="QueryCoverage=72%, HitCoverage=11%, E-value=1e-07, Identity=28%"; Hit description =Putative uncharacterized protein
MVCNDQADMIGRLLAGSLTFDCRIMHYIIVRIFLLRSFNLAQASEEDLILMWAFLTGRQIDWAHLVRYQIHKALRTNAPLPYPQLVTLFLCHFQIPLDDEPFVQVKRSFAIGASAVTSFGYRKDHDGQWLRKQDLPHERTPSPPPQRDASSVLINKVLSLNSVGFEHLLVNVLMPWIVA

SEQ ID NO: 162706 - protein, 151 aa, Glycine max
  Coding DNA Sequence Number=SeqID_71021
  Homolog annotation: Hit_ID=Q2QSY4; Match level="QueryCoverage=45%, HitCoverage=13%, E-value=1e-07, Identity=39%"; Hit description =Retrotransposon protein, putative, unclassified
MVFEKPIEEIRGYFKPLYIKAYINNKMLSRVIVNGRALLNVMPINTLEKIGTHALGVLVADITVGTKIKKMVEMIHANRFMFKVEVHIVEAIYYSPFMKLIQCLECMKRGRRMTRGMRVPRKEYAQSRHQRLFEENVGKTGKDAIYELLSE

SEQ ID NO: 162707 - protein, 316 aa, Glycine max
  Coding DNA Sequence Number=SeqID_71022
  Gene Ontology: Mol. function=sequence-specific DNA binding; Cellular component=nucleus; Biological process=regulation of transcription, DNA-dependent
  Homolog annotation: Hit_ID=A7LHI7; Match level="QueryCoverage=100%, HitCoverage=100%, E-value=8e-97, Identity=59%"; Hit description =WRKY50
  Pfam annotation: Domain name=WRKY; Domain location=237-297; Score =139.1; E_value=1.3e-38; Accession=PF03106.6; Description=WRKY DNA -binding domain
MALELMGFPKLDEQKAIQEAASEGLKGMEHLIRTLSHQPFHLNTELTDVTVSKFKKLISLLNRTGHARFRRAPVQYSSPPAPVHNANTSTSSIQLPPPPQNPNIPAPVQFPSPAPVAVHHAPVTLDFTKPHNALLSSNAKSVELEFSKETFSVSSNSSFMSSAITGDGSVSNGKIFLAPPATSARKPPAFKKRCHEHREHSGDVSGNSKCHCVKRRKNRVKNTVRVPAISSKIADIPPDEYSWRKYGQKPIKGSPYPRGYYKCSTVRGCPARKHVERAPDDPAMLIVTYEGEHRHAVQAAMQENAAGVVGLVFEST

SEQ ID NO: 162708 - protein, 182 aa, Glycine max
  Coding DNA Sequence Number=SeqID_71023
MIDEFGRFQTLLNGLLALGYEYTNAQFNMKILDSLPKDEFCVVLLDLDNEGDAIKISVAWGDSAQCYSDLNQGRGGACRFGSWLGGGSLVLVDLIRVVTSGMGEDGNDDGGGVFGEDCGVFGENGGGLWWFWFLWLKEIVVASVWGSRKLLKEVFSKKLLKEVFLRKLLKEVFLRKLLKEAT

SEQ ID NO: 162709 - protein, 32 aa, Glycine max
  Coding DNA Sequence Number=SeqID_71024
MQCVAMPPAVKQWSYQGVVEDKGEEVRGGAIH

SEQ ID NO: 162710 - protein, 95 aa, Glycine max
  Coding DNA Sequence Number=SeqID_71025
MVVQAKVGGQTKFELAKTSFEVKRENEVGDGGVWHGLVHYKGVTVKSGGAFGSKVVGHNVTMGWLNGVVWWMEVVNISSLLMTARRLGDVLGWLM

SEQ ID NO: 162711 - protein, 21 aa, Glycine max
  Coding DNA Sequence Number=SeqID_71026
MVSWRPVRVTLFCENAPSMWD

SEQ ID NO: 162712 - protein, 156 aa, Glycine max
  Coding DNA Sequence Number=SeqID_71027
  Gene Ontology: Mol. function=aspartic-type endopeptidase activity; Biological process=RNA-dependent DNA replication
  Homolog annotation: Hit_ID=Q69F85; Match level="QueryCoverage=87%, HitCoverage=9%, E-value=4e-24, Identity=37%"; Hit description=Gag -pol polyprotein
  Subcellular localization annotation: CTP_CleavageSite=62; ConfidenceScore=5.05e-01
MPLRGRIASQGHYKKSQPTRYGLPYSIVTNNSTSFKAQAYKEFLTMPSVKHIVTSVEHPQTNGQAKAANRVILNALRTRLNKDAIIPIKVGELSTRRLLFQEQHNKENMRVELETKDDVQEISKIKEEETKLRASRRYNTKVQLGAFQSGNLVSRV

SEQ ID NO: 162713 - protein, 33 aa, Glycine max
  Coding DNA Sequence Number=SeqID_71028
MATEPKAVTEDVKIDLFEDDDEFEEFEINEGSI

SEQ ID NO: 162714 - protein, 96 aa, Glycine max
  Coding DNA Sequence Number=SeqID_71029
  Pfam annotation: Domain name=DSS1_SEM1; Domain location=28-92; Score =45.1; E_value=2.4e-10; Accession=PF05160.4; Description=DSS1SEM1 family
MASSVSGVEEGMGASDSWSHAKIGAIIIKWHRCSEDFHVTKSPNPFPIKPNASQWDDKEEGKEVTQQWEDDWDDDDVSDDFSLQLKRELESNTNKN

SEQ ID NO: 162715 - protein, 81 aa, Glycine max
  Coding DNA Sequence Number=SeqID_71030
MRFFIVIHLFICSPEHKVQDHHRIQTQTANWEVTVFCENAPTIWDHIGLKENSNRVTPKAYTPKILSGPLPPYSGPTQKTF

SEQ ID NO: 162716 - protein, 233 aa, Glycine max
  Coding DNA Sequence Number=SeqID_71031
  Homolog annotation: Hit_ID=Q1RU93; Match level="QueryCoverage=82%, HitCoverage=16%, E-value=1e-07, Identity=25%"; Hit description=RNA -directed DNA polymerase (Reverse transcriptase); Ribonuclease H; Endonuclease/exonuclease/phosphatase
MASLSRGGDDVTVERGGWQRVRVVRERTIVRTNDPNIANEIENMFIPLFEEEDRPVWEGTFIGTLKLKEDYSFLNGPSHDISWAKMIWIGTAVCWLKPWCDLWYCSIGNADHLMLQCSFASKVRDWLEIKLQHKLDQNSMLNILGHQQVRWQPPIMGWVKCNTDEATKGSLGIAGCGEISAVITTIEIAHEKGWRNLWLECDSLMVVQDFKDVNLVPWSLRNTWRNAVIRLEI

SEQ ID NO: 162717 - protein, 82 aa, Glycine max
  Coding DNA Sequence Number=SeqID_71032
MCDRRHPVILLFQTSIDHLSWPTSTYQGNPCGVYPDLSSFTGSGVYPDLSSFTGSGVYPDLSSFTGSGVIQISVACIKRSAP

SEQ ID NO: 162718 - protein, 241 aa, Glycine max
  Coding DNA Sequence Number=SeqID_71033
MGRDNVEANLDWEIRVKQQLKKKSTSKSYGSHSYPKKDQGQGILGVTPYKPKDDKGKTIENKSEEAKGEESSEEIYPQEEGQPLMVKEECKEELLDEGLVCKSLNPCALLVPKIGIIRHQIPKIGGMMNVLSGATLFCKIPRAPKIFMICVHRDLLAPLIELVRNHVPSWEDAQEMGFQTLPYFNIPNTTNTCQILSKVEGMMQSYPTRALARRLQVDWARDPRKGPRVLMSLRVDFEPMG

SEQ ID NO: 162719 - protein, 135 aa, Glycine max
  Coding DNA Sequence Number=SeqID_71034
MERSMIYAASGGALSDMTPAEARNLIEKMASNSQQFSARNDAIVLRGVHEVATDSSSSTKNKKLEGKLDALVNLVTQLAMNQKSTPVARVCGLCSSADHHLNLCTSLQQSGINEQPKAYAANIYNRPPQQQNQQQ

SEQ ID NO: 162720 - protein, 32 aa, Glycine max
  Coding DNA Sequence Number=SeqID_71035
MTVSGQRWLEIYQGKNRLVAAPASSYSAILTQ

SEQ ID NO: 162721 - protein, 67 aa, Glycine max
  Coding DNA Sequence Number=SeqID_71036
  Subcellular localization annotation: CTP_CleavageSite=54; ConfidenceScore=5.33e-01
MKDCKNTSGEDVSFTSRISQSLTNSSQALKPAPASSSVLLVLKQKENNSLVLKRQQHAVTMYKGVCN

SEQ ID NO: 162722 - protein, 106 aa, Glycine max
  Coding DNA Sequence Number=SeqID_71037
MASRKRKSIGTRPTSQYDTRRFSSLDAWTRYTDNVLGRNILPERKVELYQTELDDFEAELERHNFHKHLTNLADGSIDLALGQPGKILRKDLTTLAQVWSVLSYSN

SEQ ID NO: 162723 - protein, 359 aa, Glycine max
  Coding DNA Sequence Number=SeqID_71038
  Homolog annotation: Hit_ID=Q6WAY6; Match level="QueryCoverage=75%, HitCoverage=45%, E-value=8e-25, Identity=30%"; Hit description =Putative uncharacterized protein
MGSSQAPSLRRGFYQVKDLAMAEVPTEAIASLVQYYDQPLRKPYLFAGFYPSLARISKIVQISAQELDHRKQVENGVVGVPRKCLEAKARILAGKGERAPFIDILALLIFGGVLFPNVDGLVDLAAIDAFLAFRDRKESLVVTILAYLYDTFDRRCEKSSTRIVCYTLALYIWLVLHLFRQEVRHACLLESHRSCTEKKEASWDRLLASKEGASVNWFPQWKEGRTGVLISCGGFPNIPLMGTRGCISYNPVLAIRQLGYPMRGAPLEEELAPIIARDFNNTNVEALQKVCKAWEMVQKKNKELRGSNNGPIGGYCRWLKAHMQGLDWLLSLRTTKGVEVEAPKEDEEVQALRVELEKA

SEQ ID NO: 162724 - protein, 86 aa, Glycine max
  Coding DNA Sequence Number=SeqID_71039
MPRRPPPIQLGKRNPVLQPAINLGRDRNTTVFGRRYSPQAYPYGLPPDFTPPYRSGRFEPSPYLRGVTPSLCRLSPCKKMMKEMPI

SEQ ID NO: 162725 - protein, 147 aa, Glycine max
  Coding DNA Sequence Number=SeqID_71040
AFFGSYSPSLLESSIKYPWGEVQEQVKADTEALKEKMATMMEAMMSIKEITEVNAVAIATTSTIAKPSFSVKNKHAFPPYGLPPNYMPPNVAYTPNENVNNSTPILIESQQPQSDHAHVSRPIGETHEMPHHNLADFDPCLGYATEG

SEQ ID NO: 162726 - protein, 241 aa, Glycine max
  Coding DNA Sequence Number=SeqID_71041
  Gene Ontology: Mol. function=protein binding; Cellular component=cell projection; Biological process=keratinization
  Homolog annotation: Hit_ID=Q86AI8; Match level="QueryCoverage=49%, HitCoverage=33%, E-value=2e-15, Identity=38%"; Hit description =Similar to Homo sapiens (Human). Mucin 2
MTDPLNESISCLLIRVDPWVLVPSPSKGYTLSPPEDYTSSHSEGYTPSPSEDYTSSPSVGHTPSPSEDYTSSPSEDYTSSPLESCTPSPSEDYTSSPLEGYTPSPSEDYTSSPLEGYTPSPLEDYIGLHALTFRGLHVLTFRGLHALTFRGLHTLTFRGLQVLTIRGLHALSIRGLHVLAIRGLHALTFRGLHVLAIRGLHALTLRGLHVLAIRGLHALAIRRMHALSLRGLHVLAFRGLH

SEQ ID NO: 162727 - protein, 136 aa, Glycine max
  Coding DNA Sequence Number=SeqID_71042
MKRWWATHLQSFADSVFASERIDVGLKRGKFSHPAWTNEKTGANEEGEDEGEARAVTAIPIQPSFPPTQQCHYSANNKPSPYPPPSYPQRQSLNQPQTITLAKVHQPSFSSRIRLERNVCLSRRSPRGVPLSIVGL

SEQ ID NO: 162728 - protein, 98 aa, Glycine max
  Coding DNA Sequence Number=SeqID_71043
MVGYAPSSFADLVFAGERIGAANIGPSHYPPPSHPQSLLAAHPMPSANQNTNQEMNFVAKKPIEFTPIPVSYADLLPYLLDNSVVAITPTKVPQPPFF

SEQ ID NO: 162729 - protein, 70 aa, Glycine max
  Coding DNA Sequence Number=SeqID_71044
MMIKKDDDKKLKDQSKNNSRVQDKNQEEFKTQEESLETRIKIKGSRSQKSRSRFKTQDSRMKRRLNQDKY

SEQ ID NO: 162730 - protein, 163 aa, Glycine max
  Coding DNA Sequence Number=SeqID_71045
MDNEEGVQEQMKADLSALKEQMVSITEAMLKLQKTIEDNATATTSNTAREVEPVLQPAINLGRDRNTTVFGRRYSPQAYPYGLPPDFTPCAAPKDLSQAPTFEGQLPPYADYPLQEEDEGDTHLGPLLHLKDPSPPRITPTKHSPPCPVFTRTRKRIRSLRGR

SEQ ID NO: 162731 - protein, 152 aa, Glycine max
  Coding DNA Sequence Number=SeqID_71046
FGYPMRGAPSEETIAPFIARELRGSSNGVIGGYHKRLKSRTQGITWLQKLKCLNGEEEKVHEESEEVQALKAKLEKTRVMKEKLRVAVTRVRKKCDELKDINMTAAEALQQETKKARKEEWSRNKLRGALLGNNNELKLRMAERDKSRMESM

SEQ ID NO: 162732 - protein, 137 aa, Glycine max
  Coding DNA Sequence Number=SeqID_71047
MNNLKLMLQNIYNRPTQPRQQNHPQQNNYDPSSNMYNPGWRNHPNPRWSSESEEKQHIPLPFPLRAISIKKMEEAEKEILETFRKVEKLKGSERISMGGNVSALIGKSVPQIPEKCKDPGPLQSTNVVIHLANRSVV

SEQ ID NO: 162733 - protein, 127 aa, Glycine max
  Coding DNA Sequence Number=SeqID_71048
MAYSLVDGASSHLFSFVFHCISMRSFLIGTSVIASFGYQKEHDGSWVKKGARHVGEEGHDGEDSSLLSKTLDRFDGLQTFVDERFDTLELQVDMHFNEMESRITKVEEDVSYIHSSFDLPPPPPPSS

SEQ ID NO: 162734 - protein, 110 aa, Glycine max
  Coding DNA Sequence Number=SeqID_71049
MKNSGKPSRNRPWKRLGSVTEAPRLGFSSLKQFFSLILSDSHIPGGLNILFCPPSPIYRGKEGGGCRPARLGELGCFHQKAPPSVGRSWKAQVGLIAIYTPLIYFIQGIL

SEQ ID NO: 162735 - protein, 291 aa, Glycine max
  Coding DNA Sequence Number=SeqID_71050
MDNVLGRHILPERKVEIYHTELDECKDELERRNFHRRLTNLVDNNIDLALVKDFYANLYIFEDPSPKKVRVRGHQVRIDADSLNTFLERPHVVEGETLPAYSRYCRLPTDYKEIEVALCIPGRGFVFNSEGHPGKILRKDLMTLAQVWSVLSYSNLAPTSHTSDLTVDRARLIFGLDSQMDINVGALISGQITSIAQSNSSRLGFPTLITACVRPEGKNCWNPNDLTVSIKGARRARMRLAEPPSTSTTPIPARPSAAPSAPASADFSILKPCVATYPSAGGRRVTRGSVF

SEQ ID NO: 162736 - protein, 93 aa, Glycine max
  Coding DNA Sequence Number=SeqID_71051
MEHETFLATWLAEIDFSPNGLVSKETSPHVMQDGGSSQHCIIIVILQRIILLGERAVYAMMLALEEDYKDGNEITNQGSLLKEYWILKRESID

SEQ ID NO: 162737 - protein, 343 aa, Glycine max
  Coding DNA Sequence Number=SeqID_71052
  Gene Ontology: Mol. function=nucleic acid binding; Cellular component= intracellular; Biological process=mRNA processing
  Homolog annotation: Hit_ID=A7PAZ3; Match level="QueryCoverage=100%, HitCoverage=39%, E-value=1e-149, Identity=75%"; Hit description =Chromosome chr16 scaffold_10, whole genome shotgun sequence
  Pfam annotation: Domain name=TFP11; Domain location=73-305; Score =400.5; E_value=2.5e-117; Accession=PF08697.2; Description=Tuftelin interacting protein 11
MPELQHNVALIVRLAEADIQEIDRDLRRERETALSLKNEKEKLETEAAFQKKQLDSMEEIMSVLDRVGEENTLGTLTLDSLAQYFRDLRKRSADNYKLCNLSCIACSYALPLLIRVFQGWDPLRNPSHGLELVSQWKALLEGEDYVDIWDVSSPYTQLVSEVVLPAVRISGINTWQARDPEPMLWFLESWEKLLPSSVLATILDNIVMPKLSSAVDTWEPHRETIPIHTWVHPWLPLLGHKLEGIYQVIRFKLSTVLGAWHPSDGSAYAILSPWKTVFDSASWEQLMLRFIVPKLQLVLQEFQVNPASQNLDQFYWVTNWASAIPIHLMVDMMEKFFFAKWLQ

SEQ ID NO: 162738 - protein, 156 aa, Glycine max
  Coding DNA Sequence Number=SeqID_71053
LKTPEEATELIENMSTSDHAILCNRDAPSVVRLMKKANAFPLKNTLKKPIRQGPNIFQRTTKLEEILTQFMQVTMSNNKSTELALRNLEDECKVVMTRSKRFMEAEDEDSVVPKKKARRKLLKRKETRNNHALRRSFTANATLLQVFEGYVDKEAQ

SEQ ID NO: 162739 - protein, 120 aa, Glycine max
  Coding DNA Sequence Number=SeqID_71054
MAFLNEMMSEISKDNVDEMWRHMKEILENVDEIYQEKISKALVPLVEHFAMVLGKKSNHSLGVDSAPITKKFSQKQIIQKQLENTQNQANNLELKVQKLTNITKKQEDVITQLHIEVQSQ

SEQ ID NO: 162740 - protein, 200 aa, Glycine max
  Coding DNA Sequence Number=SeqID_71055
  Homolog annotation: Hit_ID=A7R6F1; Match level="QueryCoverage=96%, HitCoverage=57%, E-value=3e-09, Identity=26%"; Hit description =Chromosome undetermined scaffold_1262, whole genome shotgun sequence
MFKKGLTTKGNALKALFSIQEESDKEDLNEIDEYDDFRLFVKRFNKFLRNKGNQRRSNINPKKKGEDSSLAPKFYECDQLGHLRFDCLIFKRRMEKSDKRNFKEKKACITWEDNDMDSSSDSENEIINLDLMAKDYESGEEVMSSNYDLSISFDELQDASNDLHKESVKIAKLFSYSKKTISSLEKEKFEIKCRIRKSEI

SEQ ID NO: 162741 - protein, 178 aa, Glycine max
  Coding DNA Sequence Number=SeqID_71056
  Subcellular localization annotation: CTP_CleavageSite=28; ConfidenceScore=5.04e-01
MAMNVTKGNKSRWTAAMLSGAGKGTGCCGMSVGRGDRVGMIMGAVSVGDGVGGRGGIRAAEVAVVMARRKEGSGGWFSELLWVVVEGGLAAMEVSHGSSVWRVVWVVVVEGGLEAMEGSHGSSVWRVVWVVVMEGGLAEVVVVEVGMGPAPPEEEEKKIALGIRGPSCLLKQGEGNKF

SEQ ID NO: 162742 - protein, 126 aa, Glycine max
  Coding DNA Sequence Number=SeqID_71057
MNYGREIHSKTKLKEVQHTASSRDAPISPLEKARPSHISPVQKARPSPTWTYLANGEGESSLISPVQKVRPSPTWTCLASGSGGTVHVTPYNANGNGGSTIIASTTGGFHGKQTPSVITFKRDPFR

SEQ ID NO: 162743 - protein, 225 aa, Glycine max
  Coding DNA Sequence Number=SeqID_71058
  Gene Ontology: Mol. function=helicase activity; Biological process =viral genome replication
  Homolog annotation: Hit_ID=Q8RV60; Match level="QueryCoverage=97%, HitCoverage=19%, E-value=9e-50, Identity=39%"; Hit description =Putative uncharacterized protein At2g05640
MARDRLADGQVDNIILKLITGREKDSRVYNIPNVPEVAALIVDGYRIDILYRSTSADKKRKRNRLTMRQWFAYRLQSRPNEAQTLLHSRKLFQQFIVEAYTMVESERLSYIKNNQKKLRVDKYCSLQSSLDTGTSNGLTKGKRVILPSTFVGSPHYMDQLYFDGMAICGHVGFPNLFITLTCNPNWPEIRRLLSPLNLKPTDRPDIVSQIFKLKYEQMLSNLIRH

SEQ ID NO: 162744 - protein, 128 aa, Glycine max
  Coding DNA Sequence Number=SeqID_71059
MAAEWRRKRERRRHFKEKMSLEEAHYHRRPRIRAWKKNEMNEGRGRDEHEILCSKRALKYETQPWPMGLEIYPEVHENPRAFLSSSCPILLEPLAHGSSDWSLPREIASGYDRVTAVTVYDGNDGVQK

SEQ ID NO: 162745 - protein, 112 aa, Glycine max
  Coding DNA Sequence Number=SeqID_71060
  Gene Ontology: Mol. function=phosphoprotein phosphatase activity; Cellular component=nucleus
  Homolog annotation: Hit_ID=A7QSS3; Match level="QueryCoverage=50%, HitCoverage=13%, E-value=2e-21, Identity=75%"; Hit description =Serine/threonine protein phosphatase
MTNECIDRKTILNLLGNSPKGMNPFFLQATQVRYNNKGAYVILEPPNFDNPIFHGFSAVTPRPKANPYYDYEEVIDSDEELDLASMKSAGSQSSACFQLVFLGTRLPFLVAI

SEQ ID NO: 162746 - protein, 206 aa, Glycine max
  Coding DNA Sequence Number=SeqID_71061
  Gene Ontology: Mol. function=nucleic acid binding; Biological process= regulation of transcription, DNA-dependent
  Homolog annotation: Hit_ID=A5B2J0; Match level="QueryCoverage=35%, HitCoverage=13%, E-value=3e-13, Identity=38%"; Hit description =Putative uncharacterized protein
MIEVVKGGLIKLLDASMTYPISNSPWVSLVQCVPKKGDTIVMENEHNELIAHARCFQLTSTIKPRKRLMSGAKIYFWDDSYLFKVCEDNLVRQCVTYKKFDGILAKYEVTHKVKTPYHPQTRGQVELSNKELKRILEKTSTKPFALLSFLNVIILEYENRLLQYYKHGQLTTTHAITIKNEYGCGQLTMAQAVTASDSNSRCPCPP

SEQ ID NO: 162747 - protein, 77 aa, Glycine max
  Coding DNA Sequence Number=SeqID_71062
MKFWDLFFVALMPVLETLLITLLGLLIATQRFNLLRSVEARNYLNNELIWKGSSKIMLCLPSIQEEGIFARNLFRSI

SEQ ID NO: 162748 - protein, 374 aa, Glycine max
  Coding DNA Sequence Number=SeqID_71063
MSERFDEDGNEMMRGGVAIEEEATRQDDCVGECNKGKKKENATIKVVTSVIFFKEIRPSKVGLVPIQRDVCGSNFGILDSKGDQLLHETSSLDLDNLDKGSDMACKEVYDSFGVQGWGAFIFKEKLKFLKKEVKLWSVSKLGGWSSSKLRGKGATTLGAQKWMGSRVNFKEINEEDNFLLIDSFSEFEIRKVIKVDIIKDIHEFHANGKLPKGLNASFLALIPKKGLRCLVREAEAKRLLFGVSIRSGNLKDSTLLVIVSPRKQFLGNSLERGVGKKYGLKELDKLVEGSLNKKGFQWWNDLVQICEIEGVHKFFKIKDMLVDGLMEHGHGICLRGSLGSFGSNNLYKKCGLLLVDKDLNLELKTDGNGDQILG

SEQ ID NO: 162749 - protein, 136 aa, Glycine max
  Coding DNA Sequence Number=SeqID_71064
EELRDYYEGRHMPHLRPHSHRREKERKSQEANINLPYFHGKDNVEANLDWEIRKDQGQGILGVTPSKPKDDKGKTIEKQPLKASMQEKTSSMSIQDEATTSPSSSESEEEKGEESSEEIYPQEEGQPLMVKEECKE

SEQ ID NO: 162750 - protein, 163 aa, Glycine max
  Coding DNA Sequence Number=SeqID_71065
  Gene Ontology: Mol. function=structural constituent of ribosome; Cellular component=ribonucleoprotein complex; Biological process =translation
  Homolog annotation: Hit_ID=A7QPE0; Match level="QueryCoverage=44%, HitCoverage=43%, E-value=1e-24, Identity=72%"; Hit description =Chromosome chr18 scaffold_137, whole genome shotgun sequence
  Pfam annotation: Domain name=Ribosomal_S15; Domain location=53-145; Score=46.7; E_value=8e-11; Accession=PF00312.13; Description =Ribosomal protein S15
MLQERPQNHLDMHHRLDSKGQHQGKLINYRVSKLRVVELLDGLCEKMQDYTLKINTNTYEWFKVDSWDNLTTRPEPKIPEDLYHLIKKAVSIRKHLERNKKDKDSKFRLILVDSRIYRLARYYNKTKKLLLVWVYSSYILAIHFKKFMYREGKRERKRKKKII

SEQ ID NO: 162751 - protein, 286 aa, Glycine max
  Coding DNA Sequence Number=SeqID_71066
MVATRWRQFKSSLTTKFVYADTEGRQKQDPSVKYGMDRQTWDEFAASRKTPTWQASCGSSSYSTSITQQQLADIIGSLKEEWRNEIIENLMEEVRNEIEEENKRSLEKLKQKLKDAIKIDGVVRVSVEKVLYGDAQVPFSTSKIQHVRQALQTFIAWPTNLVKIVSHDESYISPKKPPETVQRANNIFEDDLSRQLIKSLYDIYEKPVELMWDASKFGIPNVDVSFFLTYSDRCMSEPMKDMDRADGFGGQPMVGRIEDDALHDLFGAKRILANHVSAARSKERKM

SEQ ID NO: 162752 - protein, 51 aa, Glycine max
  Coding DNA Sequence Number=SeqID_71067
MGLTNWYGLIPELFPNVKYVQGIMTGSIVISKGTKYLPTYLITLMYVPFQD

SEQ ID NO: 162753 - protein, 221 aa, Glycine max
  Coding DNA Sequence Number=SeqID_71068
  Homolog annotation: Hit_ID=A5BEV8; Match level="QueryCoverage=38%, HitCoverage=11%, E-value=9e-10, Identity=33%"; Hit description =Putative uncharacterized protein
MIHYGELLGAPSIIAGAPSKQKKLLPEEEFVTSGSTHKLLPEERHPEVSGRTSSGSFRKNLLPEVSGRSFFRNFHWWSREVFGDSVVPCSVFEVLLVAVVPISSEALRPIPEEVFLENTSGRTSSGMGSVTSGRPSNLLCRFHIDKNVKAKCKSLIGEKNAWDYVMDSWGTLVDCPSEHEFHESHQKFQVACSPWPMFIDYVNDTWIIPHKEKFITAWTNK

SEQ ID NO: 162754 - protein, 167 aa, Glycine max
  Coding DNA Sequence Number=SeqID_71069
MGSTISYVGLAAIIHRMNEESDTRKRNSNAQAGNLDKFRRCGVVEPLSLDDNCLDSSQESRVKQVSRIKESFNQESRFKRRLKICESDFEGSIHQPLVEKEVIPIGNSSTKELPHEASDDGSSSFERLMDSSNIGEGSSQLCEQATKMKLGFGLKIGIGFDWVRNNA

SEQ ID NO: 162755 - protein, 41 aa, Glycine max
  Coding DNA Sequence Number=SeqID_71070
MGKWLTTESFGRPVRGSSGSSGRTFSGKFPEEVFFRKFYEK

SEQ ID NO: 162756 - protein, 78 aa, Glycine max
  Coding DNA Sequence Number=SeqID_71071
MRIGDKDVGIMDKLEYDYMMEEKVENERPWIFFINGVLCFLKFDGSGKEKEKYDWRRHFKEKTSLEEAHHHRKPWIRA

SEQ ID NO: 162757 - protein, 671 aa, Glycine max
  Coding DNA Sequence Number=SeqID_71072
  Gene Ontology: Mol. function=binding; Cellular component=nucleus; Biological process=activation of protein kinase C
  Homolog annotation: Hit_ID=A7P390; Match level="QueryCoverage=70%, HitCoverage=89%, E-value=0.0, Identity=57%"; Hit description =Chromosome chr1 scaffold_5, whole genome shotgun sequence
  Pfam annotation: Domain name=PPR; Domain location=272-306; Score =25.7; E_value=0.00017; Accession=PF01535.11; Description=PPR repeat
  Pfam annotation: Domain name=PPR; Domain location=334-368; Score =23.0; E_value=0.0011; Accession=PF01535.11; Description=PPR repeat
  Pfam annotation: Domain name=PPR; Domain location=380-414; Score=4.7; E_value=2.2; Accession=PF01535.11; Description=PPR repeat
  Pfam annotation: Domain name=PPR; Domain location=446-480; Score =45.1; E_value=2.4e-10; Accession=PF01535.11; Description=PPR repeat
  Pfam annotation: Domain name=PPR; Domain location=481-515; Score=3.7; E_value=2.9; Accession=PF01535.11; Description=PPR repeat
  Pfam annotation: Domain name=PPR; Domain location=517-551; Score =12.7; E_value=0.24; Accession=PF01535.11; Description=PPR repeat
  Pfam module annotation: Pfam domain module=PPR::PPR::PPR::PPR::PPR::PP R; Domain location=272-306::334-368::380-414::446-480::481-515::517 -551
MFKRCGAPRRKSKWKKVLVARNRYTIIASHTHGSGRVEPHQNPGATQAVDLYPLKIKIHGHKCNHANQNREASGEPNFETTAQSGGRQVHFPVTDMRNLRAAAPDPSPDSDPRTRGKRLRHPEFHHSMRAPRWNSPRAKSVRQNGATKRRHVERHVPRVRPSQLPPRRRRFVRANAPRWRVPQLLHVPHEGEEVHCVVAKRGFKSNTFVGCALIHMYSLRGGVFVADAYKVFAEMRDKNVFAWTAIVAAHVACRDMVSARRLFDLAPQRDVVLWNVVVSGYIELGDMVAARELFDRMPDRDVMSWNTVLSGYATNGEVESFVKLFEEMPVRNVYSWNGLIGGYVRNGLFKEALECFKRMLVLVEGEGKEGSDGVVVPNDYTVVAVLTACSRLGDLEMGKWVHVYAESIGYKGNLFVGNALIDMYAKCGVIEKALDVFDGLDVKDIITWNTIINGLAMHGHVADALSLFERMKRAGERPDGVTFVGILSACTHMGLVRNGLLHFQSMVDDYSIVPQIEHYGCMVDLLGRAGLIDKAVDIVRKMPMEPDAVIWAALLGACRMYKNVEMAELALQRLIELEPNNPGNFVMVSNIYKDLGRSQDVARLKVAMRDTGFRKVPGCSVIGCNDSMVEFYSLDERHPETDSIYRALQGLTILLRSHGYVPNLVDVAHAN

SEQ ID NO: 162758 - protein, 99 aa, Glycine max
  Coding DNA Sequence Number=SeqID_71073
MEGKKFVTLRGLGDKRVLIIAFEGDNLKALLDGVSLWLSKIFKYLVPWKPGEGHDNRLSLTQSYPTRALDRRLQVDWARDAREGPRVLTSFRVDFESMG

SEQ ID NO: 162759 - protein, 154 aa, Glycine max
  Coding DNA Sequence Number=SeqID_71074
  Homolog annotation: Hit_ID=A5B9Z4; Match level="QueryCoverage=74%, HitCoverage=19%, E-value=8e-08, Identity=25%"; Hit description =Putative uncharacterized protein
MEERRDANTNPLGGRDMGEFNMLSSQMEVHIPLVGLKKGLKLWNSKYFVDLDKQCKDLMVNINELDLKDENANLCEAELTRRRDLVNDFWKMFERNESLVHQKARSKRRTNIVREILVGDGWVEEPIQVNMGVKEFFYKRYEENTHAFYGNGHK

SEQ ID NO: 162760 - protein, 94 aa, Glycine max
  Coding DNA Sequence Number=SeqID_71075
  Gene Ontology: Mol. function=acyltransferase activity; Biological process=metabolic process
  Homolog annotation: Hit_ID=Q0QJH9; Match level="QueryCoverage=98%, HitCoverage=33%, E-value=4e-28, Identity=51%"; Hit description=Type 2 diacylglycerol acyltransferase
  Pfam annotation: Domain name=DAGAT; Domain location=1-92; Score= -178.3; E_value=0.003; Accession=PF03982.4; Description =Diacylglycerol acyltransferase
MGLPLVPVFCFGQTKAYKWWKPPGRLMQNLARSPIPFKNPLYIVVGRPIELEKNPEPTMEQVAKVHSQFVEALQDLFDRHKAHAGYTNLELKIF

SEQ ID NO: 162761 - protein, 139 aa, Glycine max
  Coding DNA Sequence Number=SeqID_71076
MVIDIVVWKEVAGLDMGGVRKFDETLDGYNEMQTYRGMLFDPTMNLRNRLEVGGLTTKDIILVYLITYILTSRFIDYFNADVSNEIVDFTKASSEITERHFKKLGMRFIDHEWIMVGESPAGNFDQMQEDVEAKSSTRA

SEQ ID NO: 162762 - protein, 94 aa, Glycine max
  Coding DNA Sequence Number=SeqID_71077
MDPNVDEVVECDNVDGEEGDKEIGRKDTHYESDGDVVYWKYNQLVPKPMTKIIVTLEYLVKLMVLTTLHKPRRWLIALLRESVKEDNDQGGGKA

SEQ ID NO: 162763 - protein, 124 aa, Glycine max
  Coding DNA Sequence Number=SeqID_71078
MECYKSRIQHRFFKHEYKVGLNLNQEGETLTNSSKSRSWGERCQQVLEIVNESKVFWGGLKSDNVTIATYPLAGERGEIQKVHLSRRKTRGVVTNVYSRKTLVKPKDEERIVKVLDLETISSDI

SEQ ID NO: 162764 - protein, 80 aa, Glycine max
  Coding DNA Sequence Number=SeqID_71079
MLVKNLVEGLRVHDKTDHTQVSQVTLTRKKEAPCKEHFSYHRHSFINPNGGVVRKCILNLLFKFIDDPTVNEYEIIVLQG

SEQ ID NO: 162765 - protein, 39 aa, Glycine max
  Coding DNA Sequence Number=SeqID_71080
MQEKQEAPKTPNLKIPEKATIFQSVAKGNKSSNSIAGSE

SEQ ID NO: 162766 - protein, 955 aa, Glycine max
  Coding DNA Sequence Number=SeqID_71081
  Gene Ontology: Cellular component=integral to membrane; Biological process=vesicle-mediated transport
  Homolog annotation: Hit_ID=A7QWN1; Match level="QueryCoverage=99%, HitCoverage=86%, E-value=0.0, Identity=59%"; Hit description =Chromosome chr4 scaffold_205, whole genome shotgun sequence
MAKEEITSFAVIHHSLYMYIGHSNGNISVLKLDQEPSWHLVQMKYTIPLSASYGNSEVSDDTVVTHILPQPAAESKRVLIIFRNGQMILWNIRESRSIFKTGENMLQPLHTETKKVTSACWVCPFGSKAIVGYNNGELFIWSIRSLNIGNGSASEHSYQNTPLLKLNLGYKSDKISIGSIKWVYAGGKASRLYIMGASDCATSNLLQVVLLNEHTEARTIKLGLHLSECCIDMEIISTSTEQSKNKQDSFILLGKSGHLYLYDDILIERYLLQCQSKSTPSLPKEVTVKLPLAESSITTAKFISNNPNVLTFEDEYYRQLITSYPLFVPVETNQKDEISLSSAKFTGFSKVQNLYITGHSNGAINFWDASCPIFTPILQLKQQSENDCSLSGIPLTALYFDSNSPLLVSGDQSGMVRFLNLVCVFRFKTEPYATNSFMSLTGGTKKGTDHIIQSVKHVKINGAILSLNIDPSLMHLAVGSDQGHLAIPCIQRNAFEVSVFNIDGPTLLYQKHIASEISAGIISLQFLTSSLHGFEKNILAVGTKDSSVLALDKEAGNTLGTGTIHPKKPSKALFMQVLDGQGAPVNGSITKDGLESSERNHIEDATTKQQYILLCSEKALYVYSLVHAIQGVKKVLYKKRFHSSTCCWASTFYSPSDVGLILIFTSGKVELRSLPELSLIVETSIRGYNYSPPKLKSFSGCQICCSSKGDLVLVNGNQEFFVVSLLVQRNIFRLLDSISCIYRKNMMLSPEVFVPGPVIYKEKKKGIFSSVIKDFAGSKEKHAPILETEDTTESIQELSAIFSNENFPCDADNNDNLTVDEDELELNIDDIDLDDHEEKHKDQSILGALNKKKLTGKFQALKGRLKEMKGNIQKTSSKEEQQDEQAGAVDQIKKKYGFSSSNETSFAKLAESKLQENMKKLQGINLRTTEMQDKAKSFSTLANQVLRTAEQERRN

SEQ ID NO: 162767 - protein, 61 aa, Glycine max
  Coding DNA Sequence Number=SeqID_71082
MSVKNLVERLGVHDKTNHTLGDQSGSRCFARMLQPYGINIGLKEHSNQVYLPPRPTPRRVC

SEQ ID NO: 162768 - protein, 79 aa, Glycine max
  Coding DNA Sequence Number=SeqID_71083
MEKNEETTMEENVKLKINRASTWEASLRSKEVVFLVGLGSSSSIDSFASWKMNGSGMEKEEREETPLQGEDESRRSSPP

SEQ ID NO: 162769 - protein, 133 aa, Glycine max
  Coding DNA Sequence Number=SeqID_71084
MITSYVKKKSLDKKELRRSDFLIAIEEYVEAKGNTLVDHKKSKNIKRIASFPVFPTFSSNKRWWRLRAYSFRGTRIPRVTRRPPAEGVPLGAGVQRHTTAARGGHRWSWVVEEEFESVGERKEEKWLFYAAKS

SEQ ID NO: 162770 - protein, 874 aa, Glycine max
  Coding DNA Sequence Number=SeqID_71085
  Gene Ontology: Mol. function=RNA-directed DNA polymerase activity; Cellular component=mitochondrion; Biological process=RNA splicing
  Homolog annotation: Hit_ID=Q9LZA5; Match level="QueryCoverage=82%, HitCoverage=95%, E-value=0.0, Identity=53%"; Hit description =Maturase-like protein
  Pfam annotation: Domain name=Intron_maturas2; Domain location=641 -800; Score=92.9; E_value=9.8e-25; Accession=PF01348.12; Description =Type II intron maturase
  Pfam annotation: Domain name=RVT_1; Domain location=217-473; Score= -4.6; E_value=0.00015; Accession=PF00078.18; Description=Reverse transcriptase (RNA-dependent
  Pfam module annotation: Pfam domain module=Intron_maturas2::RVT_1; Domain location=641-800::217-473
  Subcellular localization annotation: CTP_CleavageSite=59; ConfidenceScore=5.75e-01
MRGGPLSWTRCCRSFTLTDPRTSLSRSRSRSRSCRSSFVLTLELLSFFSAPAPNSCSILCQARIGSVSIFLFHVYEFRLVWKEEKRSKKLRLGFWRYLALIRHPRQQQYLSIHFFVVLPTHSSHGRVCLVGWGKGRMASYVSMVASLHLHIRRIVFGNAHPRLHSTLTKPQLKALVLDHYSHGKFSNLIQNIVASPPVLHTACQNLSPSFPPPDCFSIPATCRELLENRFDVASCCLTLTPSFVLPNLKLKVVIEAIRMVLEIVYDDRFVTFCYGGRVGMGRHTAIRYLKNSLENPTWWFTVRFKPHRFQHFHVEKLCSVIESKVKDSIFIDLIKRLFQCKALVIELGADWLGRGLPHECGLCSILINVYFDAFDKEIQEMRLRENRENRELDPKIIASGLYSDVFYKPVKVYAVRYLDEILLATSGSKMLALELRMGVVKTLELGLGLRVDKVNTAIHSAVSEKIEFLGMELQAVPPSILRPPMSEKAIRARKKYLRQKEVRALELRNARARNRRKLGLKIFSHVYKKIKQSDGFKFDFSIENQVREIFRSWADEVVQEFLGNIDECQEWHRSLSAGDFLQLRHIRNQLPPELVDAYDKFQEQVDKHLNPIEARKAIEEEERRVKEEEEQNYSKGTVEDLTKLCMKVEAPEILIRKAVKLVGFTNHMGRPRPIEFLVALEDADIIKWYAGIARRWLDYFCCCHNFKTVKTIVTYHLRFSCILTLAEKHESTKREVIKHFSKDLRVYDMNGNHEVYFPTEREVKMMGDRNLSDPKPVDGALSLAVVRLASDEPPCHCIAHFCDKTTTVFYRVHLLQNRLNVSPLDKEKWVQGMGVIHESLNRKCLPLCTDHVNDLYMGRITLQDIDCSYCVDVD

SEQ ID NO: 162771 - protein, 326 aa, Glycine max
  Coding DNA Sequence Number=SeqID_71086
  Homolog annotation: Hit_ID=UPI0000661253; Match level="QueryCoverage =42%, HitCoverage=100%, E-value=8e-10, Identity=33%"; Hit description= Homolog of Homo sapiens "Dentin sialophosphoprotein precursor
MHHVSRTCHSTSDKYARTRHHVFSTCYPTSDTYARACHHIFSTCHSTSDTYARARHHVSSRCHSMSDTYARACHNVSSTCHFKSDTYARTCPHISSTLHSASDTYARAHHHISSMCHSMSDTYAKARHHVSSTYRSRSDMYARAWHMHYTHQARQTQGSPLARQTQDSPLMSLTGSQNLRSILGKPQRNLTCLLKSKANTSLVQGSLNPRFTLAEPLFCQVSSPQELKEYKTQDTPLSCLLLNKHDDRNQRSSHTNSSNHQGKSSICKDDLSPECLCINSSSMSNLLSRYNRRRWRSRSNNNNNNRSKSLDDHWSRRHIMQNQTGS

SEQ ID NO: 162772 - protein, 42 aa, Glycine max
  Coding DNA Sequence Number=SeqID_71087
MAVMDPSLGDPLYRKSSWWCVQAACPADGARVQVYPSNLPNK

SEQ ID NO: 162773 - protein, 205 aa, Glycine max
  Coding DNA Sequence Number=SeqID_71088
  Gene Ontology: Mol. function=phosphoprotein phosphatase activity; Biological process=intracellular signaling cascade
  Homolog annotation: Hit_ID=Q2HTA0; Match level="QueryCoverage=58%, HitCoverage=18%, E-value=9e-19, Identity=43%"; Hit description=IMP dehydrogenase/GMP reductase, related
  Pfam annotation: Domain name=DUF1723; Domain location=164-205; Score =40.0; E_value=8.5e-09; Accession=PF08330.1; Description=Protein of unknown function (DUF1723)
MVRTRGLDRALGQVIDRGVGKGDRDDSDDAPQRRRPTTSARRQRVVVTADHVDEPVIPLPDVQDDPMEAPAAIEDIPADIPAGTGTEPAEDAHEGFPGDPSDPSVLTLYADHVACSVWTGDECPELKLSYHGRKVHSLGRPVPAIEGLVAGTGLSPLIACSVDTSDQGLLSTLVERWHQETSSFHLPVGELTITLDDVSSLLHLP

SEQ ID NO: 162774 - protein, 124 aa, Glycine max
  Coding DNA Sequence Number=SeqID_71089
MNTVNDEANNKMIRIEKGACYILFKNFRSPVILHEKDAGLKILRKVVQELQEQHGADSKSLNVVRCTSLNQDGIIKDECDFAFEEGRGGGGTLEFYQEEPNKLWWKNIKMMILVGLSFGKPTPG

SEQ ID NO: 162775 - protein, 55 aa, Glycine max
  Coding DNA Sequence Number=SeqID_71090
MEEQMRCLLYSFSTERTSHNRPDNYLKGIINSAIKGLDDAPQPKSKAPARWIVVK

SEQ ID NO: 162776 - protein, 64 aa, Glycine max
  Coding DNA Sequence Number=SeqID_71091
MNRESTLIWQDAKRMNTKCSIECEEDEEMCTIRRYICIEVFFMWDEKAVFGSSEDNLIAEQAAI

SEQ ID NO: 162777 - protein, 164 aa, Glycine max
  Coding DNA Sequence Number=SeqID_71092
  Gene Ontology: Mol. function=aspartic-type endopeptidase activity; Biological process=RNA-dependent DNA replication
  Homolog annotation: Hit_ID=Q69F85; Match level="QueryCoverage=100%, HitCoverage=10%, E-value=3e-14, Identity=26%"; Hit description=Gag -pol polyprotein
MVAWFVELSKFDIQYESCIPMKTQFVIDFLAEFAGNDIATLDWWIFYVDSATNVKGSRLTREVRAKRLRCYTGLLLFQGQVANIYQTKEIVLLKYYYIEKFFIDNFKSFEMYYILRESNTRVELPSKLARTKKVGHLKTIIQETLQTLNIDVEEVMAGEKEEPN

SEQ ID NO: 162778 - protein, 60 aa, Glycine max
  Coding DNA Sequence Number=SeqID_71093
MTMHDSVETSAHPANSTGYKRVEFKLSKYSGPTHQPADLPIGRVGQNAVGGGEGACLPTF

SEQ ID NO: 162779 - protein, 817 aa, Glycine max
  Coding DNA Sequence Number=SeqID_71094
MSSFLFDSAIGLSGSDSGVLIEQPIMDQEVISIGGSSSDDTLLRAFDNESSSSKRFVSVIMILPPFSSGSVRRGSGSGDVRVSPRVQCSLSVGSPSSTSIVASCEWVKDDVLKYKSCLTSGSNVTAFQCQVKLANPKDSCKLAVLGVILPLTSFQCALLEHLNVAPSKFHPNSWAMIGWVTLNSVSKKLFEFDSNIFPYFKNHFFKPQKVEGPVSLRAMRQVAGLMPTGGHLSIVQDVPPAPSTVEASAANLATPASSPPPQLLTSMVATGALAVLPSSSTSLVISPYAILAAVASSSLYSRHHVLRDQLYTSSDADSLWGATYKPKQKILVGFVSAFDKNLIRRTDCDTKRLCRRWHPWRWRATTRTLWRVERPKVANATVAFAEALRSNRQLSVKAEKMDLGGKVESMATEKDGLAKVIFLSKGPAEGVGVQAGGVHAVKQAGFFAKDLDLGLFDPFKDVKDGVLLNEEEIVAEEEAIDEGSCHPLMGLPFALWSFSPDDCEEFCLTCPWLKVLPNQCRDRSFDLLSSSSDGYEDSLGGTWTLDGHHHSCCIHHGDMFLHVCHSPWVTHTGVVIVSNQGDILLHMCHLSWVAHTGDLVVHSCIHVTRYGWHVLESYVRRRAYQGQTLGFKSLRDLSRKKSTTSGFECRSAKVKLQVGCNPERTFPVGAKLSRSRIFSGFTSNSSYEIARLKGSWLNLCIVSSSCSKFDSFFSNLRHFSDLFGGPEDDFLSCLFLSINLRMFDRDDNGVWEIVLAYKVFPGEFFHLAGPLAVVPGCSFPHCEEPRGAQTVKIVNRVAWHPAHTALVAKERPPVWRP

SEQ ID NO: 162780 - protein, 180 aa, Glycine max
  Coding DNA Sequence Number=SeqID_71095
  Homolog annotation: Hit_ID=A7PFU6; Match level="QueryCoverage=66%, HitCoverage=18%, E-value=4e-22, Identity=40%"; Hit description =Chromosome chr6 scaffold_15, whole genome shotgun sequence
MVGVFSQNNVTLIGLPMILPSESDLTYQCVVYLVISYDDLELCCKDLPHNGYLLAQKGGYGSIGILKNDLYNDLHRKKHPVIKDGDARVALSYLEGEAGNDPTFYSTIETTSDDGDGAMRVAIKLVFPYARHHLCAWHLHKNCYENVKNKYCSEDFEKTLYANFTQDEFEYFLEGYCCKT

SEQ ID NO: 162781 - protein, 19 aa, Glycine max
  Coding DNA Sequence Number=SeqID_71096
MKIHKPQISLRRLQVWPQQ

SEQ ID NO: 162782 - protein, 84 aa, Glycine max
  Coding DNA Sequence Number=SeqID_71097
  Gene Ontology: Mol. function=hydroxyisourate hydrolase activity; Cellular component=extrinsic to internal side of plasma membrane; Biological process=regulation of cell growth by extracellular stimulus
  Homolog annotation: Hit_ID=A7PVF7; Match level="QueryCoverage=59%, HitCoverage=15%, E-value=6e-10, Identity=67%"; Hit description =Transthyretin
MVALEQMKAHENVMRLTEDQKRRYTNRPIVEFEIAAQEQMKITELRLAKLFSSRENISSTTDKYSTARKAEVYHQPFRINHHEL

SEQ ID NO: 162783 - protein, 102 aa, Glycine max
  Coding DNA Sequence Number=SeqID_71098
MSKRLQEDLARAAEEGPRVLMNLRVDFWAHGPSGVSSLSFFSIPLPFIFQEAKESIDEEDPRPTSSNGAYIKFAPSNLLKPPKVVVRVEPTPLTSSGGSLKK

SEQ ID NO: 162784 - protein, 104 aa, Glycine max
  Coding DNA Sequence Number=SeqID_71099
MTHRLTIETHSSWRINCYDLEKVLPKKWAGTERKRQHTNKRERERENGLCNKKGRALQLESERPRGRKWLFKVFPWRRRFCTKRYVIKFHQTCAHNGTMSGKVG

SEQ ID NO: 162785 - protein, 184 aa, Glycine max
  Coding DNA Sequence Number=SeqID_71100
MEIKRVGKKETNTQEFLYWFDNNPCLHPVPKQPAVLEISFQPCKNPFTSKDPQGMYPPLFSLNNLVDVPSTRTDPQEMYPLLFSVNNPSRCTLYLYHKGCTLQCVKTKFSGESKEFSDCVILNSLTREKGDTKEFRREKGMKKMNSTVFKVWKTRKLWKAFGKKKKKKFKEIQKSIGKSLLSKE

SEQ ID NO: 162786 - protein, 223 aa, Glycine max
  Coding DNA Sequence Number=SeqID_71101
MKAVTWCTITAVKYGPEEQCQMQYTEISSYHAKENPPLHTTEEELWQHFKKADDVREIFISKKRNMNRRRYGFGHKDTFKVVTHTSIPGLKRGLFAEVVARRHPRTAIETPSTAVGNTSTSEAFLDIPRKGPKWLQDAWVGRLKKLAMLDNVEEDMLWDWGVNIVPKYIGDDMVLLLSLTEGKARQMMENNTSLFYSVERWNREVCAGSRLTWLHCWGVPLMA

SEQ ID NO: 162787 - protein, 74 aa, Glycine max
  Coding DNA Sequence Number=SeqID_71102
MKIEPGLEDEVCQSNVQPQCSPPLLSLFGTLIQPPITHQATAPGKNVQTPTTQHLIRLNVLCMLFVWLSEDTIL

SEQ ID NO: 162788 - protein, 48 aa, Glycine max
  Coding DNA Sequence Number=SeqID_71103
MEPNYGNVCLPLGGEVTMMDIPGGGNRVIKEFYVSLEGDDLESLIIHG

SEQ ID NO: 162789 - protein, 100 aa, Glycine max
  Coding DNA Sequence Number=SeqID_71104
MAKKKSCFSLVKRLFIWDTHSTQDKWPLPQQQLLKLMLLLLIASLGNARKTQKNLNMLKLGMVLHNPHTKCHREIKESAAAIQDEEFSALSLETMKGVST

SEQ ID NO: 162790 - protein, 484 aa, Glycine max
  Coding DNA Sequence Number=SeqID_71105
  Homolog annotation: Hit_ID=A2Q4W6; Match level="QueryCoverage=29%, HitCoverage=18%, E-value=2e-09, Identity=28%"; Hit description=RNA -binding region RNP-1
  Pfam annotation: Domain name=RRM_1; Domain location=83-153; Score =24.6; E_value=0.00036; Accession=PF00076.13; Description=RNA recognition motif. (a.k.a. RRM, RB
MREDSRVSNKERKREQEERKERERESRERNSGWERVRTRRERRESARLRMTEGSGLTIGGRTTGQHHSYMRANWRDHKDITSFYFTRFPEDATAEELWYHLKQTRDVREVFIPRKRNRQGRRYGFVRFKGVRDIQQIQKKLDSMVFGGMKMYVNVPKYERAKKEEPQTAEGGRAEARQPQEGKRYMYLSRNAETKVGVQRGSYAEMVTRNNQRAEQRRAPAKVSDIRHNSTSEVNLDIPLTGQQWLKEAWVGRLQNLASFDSLEDEIWWDSGQNISLKYIGEKWNPKLRPGFRLTWLQCWGIPLVAWDRHHIQQIVSGIGDVVDVEDCVEERRSLEVARILVKTPWKPLIQHTVTVNIQGEKFQVHVAEECGHSGDRWQQRRGSDFSSSEEINSEEGDDEVSNGGAFPSRWHKFQVLDSTAGRKTADEDVGVEVIGMEEDPTTGVKEQEDDARRGRDSDDPAKSETRARSARDMTGGTAADSDR

SEQ ID NO: 162791 - protein, 264 aa, Glycine max
  Coding DNA Sequence Number=SeqID_71106
MKIQNEKYTQRCNEASKRKKRGESYLRLAQLCQRPFAARILLLVHEPPLPQMLLWRRRRPSRGGEAAPAKENKQEEGKEEATLSAAVKVKFPASSFAVVGGGKRDEWMYEIMSERADMDYENAESCGAKNHMLIVRMRSRLLSQIVVNSTLGFIFPNGSIVHNDGGVSFQASTLVPIRVPNGIARTPDGILNLLETTMTPTHDALLYYNGRWNMSRQNEFVGYSFTGKNPKNFDISTGCTMDELKDLIKQVAPRGIPPYGVDET

SEQ ID NO: 162792 - protein, 113 aa, Glycine max
  Coding DNA Sequence Number=SeqID_71107
  Homolog annotation: Hit_ID=A7QK99; Match level="QueryCoverage=84%, HitCoverage=15%, E-value=3e-21, Identity=61%"; Hit description =Chromosome chr2 scaffold_112, whole genome shotgun sequence
MAKEEAEVVTVAAPIFRARPLNRKILNAPSLPLSKRSTPRLPEFQEFHLKTQERAMQHTSATSTSSLHCNDSDKIYMISDLRGTEVCWLQDLDKHRAISVQENRIRDLRRWKM

SEQ ID NO: 162793 - protein, 95 aa, Glycine max
  Coding DNA Sequence Number=SeqID_71108
MLHELRRYFLKKRIISVREESRVREWDFRNFSGGREDEESAKRLNDKKSRGNSNMNPPPDQFKFSQRGCNLVPFSKSMRDENKTMTPFPMYLNMS

SEQ ID NO: 162794 - protein, 90 aa, Glycine max
  Coding DNA Sequence Number=SeqID_71109
MNEEQWIYDSIMSEEVDMNVENEEDVGVKVEHVNCSDVFDISQARSVAYDKGFVAVIMRSDTNTRVRGRPSFLLIACERSGEYRPKKNDL

SEQ ID NO: 162795 - protein, 466 aa, Glycine max
  Coding DNA Sequence Number=SeqID_71110
  Subcellular localization annotation: CTP_CleavageSite=18; ConfidenceScore=5.12e-01
MPLSAPTQAVLASPSFAPAMSAPSTAPATTPPSIVAKEEKIQVADDLLNEADPLSKCHPLSEASNSLSGWETQEEKESEMCLSSGQPTHPPRILSLLALSTPSLVKPKFTYSRLASLWKLKGPRTFKTLNGSSSLALPISSLSVLPLAAPASSSHPSVSLDHVYTSCDMNSMWSMGYRPEQKTPIDFVSPFDQNLNRQLGSLAILEENRQRHQEALNKVGSLETEVAKWRVSRLDNDKVFGRCKNFLKEMNGLASSVECIAEEKKKLIAIVAESAKVIIDLLAQLKESESKMKEFELEAAKEKEVNKELEKKLLAFKKEAMEQHENGFYKAIKEQDADEEEDDGANVLGATLAFLTGLYEIENEITSDNLVFDFNLVEGALEIHRDSPRVNLGFDEPLRFVEAHQGSTLAHQRQTLGLKTLGDYSLRLTKGAPWEPWRFIEAHQGRTLGLTSLRESSRLTKGGPWV

SEQ ID NO: 162796 - protein, 162 aa, Glycine max
  Coding DNA Sequence Number=SeqID_71111
  Homolog annotation: Hit_ID=A5AK77; Match level="QueryCoverage=58%, HitCoverage=11%, E-value=1e-10, Identity=36%"; Hit description =Putative uncharacterized protein
MTRGNQGDLQPFDPEIDRTFHRLVRHSVHPGHFVHCEHSEHYVEGDSDFEHSTTNFYTENMAQPPPRERTLKDMAAPDFTYESLCIQYPDEGVPYVLKTGLIRLLPKFHGFAGEDPHKHLKEFHIVCYTMKPPDVQEDHIFLKAFPHSLEGMTKDWLYYLTP

SEQ ID NO: 162797 - protein, 63 aa, Glycine max
  Coding DNA Sequence Number=SeqID_71112
MNRQEEQEWSTCCQTVARPSPVERCVPTSFSTIFLKAVYLVICSPEHKVQDHHRIHTQTANRE

SEQ ID NO: 162798 - protein, 356 aa, Glycine max
  Coding DNA Sequence Number=SeqID_71113
  Gene Ontology: Mol. function=strictosidine synthase activity; Cellular component=endoplasmic reticulum; Biological process =biosynthetic process
  Homolog annotation: Hit_ID=A7R3C9; Match level="QueryCoverage=99%, HitCoverage=99%, E-value=3e-92, Identity=45%"; Hit description =Chromosome undetermined scaffold_503, whole genome shotgun sequence
  Pfam annotation: Domain name=SGL; Domain location=70-295; Score= -64.4; E_value=4.1e-06; Accession=PF08450.3; Description=SMP -30GluconolaconaseLRE-like region
  Pfam annotation: Domain name=Str_synth; Domain location=153-233; Score=70.3; E_value=6.5e-18; Accession=PF03088.7; Description =Strictosidine synthase
  Pfam module annotation: Pfam domain module=SGL::Str_synth; Domain location=70-295::153-233
  Subcellular localization annotation: CTP_CleavageSite=26; ConfidenceScore=5.12e-01
MSSSESTNARTRTASWFSTPFFVIVLPVAVAALLYRLEPFKPVLLPVQLGRSTVAVPARNGHMQDGSERVGEGHLEGPEDLAYDAAARVVYTGCEDGWIKRVTVNDSVVDSAVEDWVNTGGRPLGLVLKPNGELIVADAEKGLLRVSSEKEIELLVDEFEGLKFKLTDGVDIADDEGKPNGRFFSYNPATKKTTLLAQDLYFANGVAVSADQQFVVFCESVLMRCNKYFVLGPKTGTIEKFCDLPGMPDNIHYDGQGHYLIAMFTALSPELELAYRYPFIRKAFAMFTKYVGSLSISKNGGVLVVDLEGKPTAHYYDPKLALTSAIKIGNHIYAGSIFYPFVTRFDVEKYPALPTV

SEQ ID NO: 162799 - protein, 45 aa, Glycine max
  Coding DNA Sequence Number=SeqID_71114
MSLRQGTWQKLSHARERQGHEDEVETKKRKSYEDKAESKKRTRGK

SEQ ID NO: 162800 - protein, 208 aa, Glycine max
  Coding DNA Sequence Number=SeqID_71115
MTGRLLVGSLTFDCRIMHYIIVRILLPRSSNLAQASEEDLILMWAFLTGRQIDWTHLVRYRMHKELRANAPLPYPQLVTLFPCHFQIPLDDEPFVQVKRSFAIGAGAVTSFGYRKDRDGQWLKKDTLPPQDERTPSPPPQRDDSSALMNEELNRHHQKGGDCRSKDLDFDVLMMPYDHDVLIPCEHALLKLRSRQKLKRFKIHHKEDL

SEQ ID NO: 162801 - protein, 88 aa, Glycine max
  Coding DNA Sequence Number=SeqID_71116
MEEVSLYQLYERVGVRDVGRLNLQPCNTCEELRGRSLLRLQVASFFGVRGAKSSAAVLPRIHKNKHYCANYGGKDWRRNNKIKMKILK

SEQ ID NO: 162802 - protein, 267 aa, Glycine max
  Coding DNA Sequence Number=SeqID_71117
  Subcellular localization annotation: CTP_CleavageSite=34; ConfidenceScore=5.23e-01
MASFSQMQSQFQSQMHSQGLALPPEPEVGSSGARVSTKESCVAPSGNNPETGDSDKCGLYIEENPSRLVALGRLYEGSTTVYNIPLLHGQVKVGVEEVKDAEALVPVPIDEAAVSPAKPPESPDHEVDDPLYLMTLTIPQLFLKSLQVMWDATMFQHLTETSLRAGNSDVYGFLEPQSIQRSGQSQFESESYIKSWMQSSKRDVYLGAYLNGPDNYLKGIINSALKRLDDTPQPKSKAAARWIVVKYFNEVRPLEAERLKALRIQWA

SEQ ID NO: 162803 - protein, 73 aa, Glycine max
  Coding DNA Sequence Number=SeqID_71118
  Gene Ontology: Mol. function=glycine hydroxymethyltransferase activity; Cellular component=mitochondrion; Biological process=one -carbon compound metabolic process
  Homolog annotation: Hit_ID=Q9SZJ5; Match level="QueryCoverage=56%, HitCoverage=7%, E-value=4e-12, Identity=82%"; Hit description=Serine hydroxymethyltransferase, mitochondrial precursor
MASHSTFLVNGIPINEASNLGWQQPQGINGSRVQKVLESVHIAANKNTVPGDVSAMVHGGIRMGIRSRQPTEL

SEQ ID NO: 162804 - protein, 111 aa, Glycine max
  Coding DNA Sequence Number=SeqID_71119
MALRLFYSRSWFVELVVATRICFVIVLVTARAVWGGDFAVRSGSHSCSKGVILSEVNERRQLWVCRVCFWCCGVYVRVYRVHVWGCVSPQQSHTANSTSLCATSMLAVAAD

SEQ ID NO: 162805 - protein, 119 aa, Glycine max
  Coding DNA Sequence Number=SeqID_71120
MRTKDLYPLDMDVILKEKLSLGTWKYYKEINSSASQVDSLQAIITSPGNANAVAAAALENKDLPFLVAELGSDSHQSNINNNSDGDDRQFYPLLPFNHSTLKEKSWTIKKMNREMGAAV

SEQ ID NO: 162806 - protein, 272 aa, Glycine max
  Coding DNA Sequence Number=SeqID_71121
  Subcellular localization annotation: CTP_CleavageSite=28; ConfidenceScore=5.74e-01
MASPPSSPPPLPPSHPPPPPSNASVLPSAMKRTRKASHLRSLSTRPPGAERPVVHVDFAIGKADGPHRKKLRIYLGIMARDKVDVTYENWKERLLTVGRKGSYFRLSARDGGSLNQTSQGNRPLQPIRTVWTTICEKYSISKEKWAQFCQTRRDPSWEDVRKKAQAIQKQNTAPHVLSREGYEYLKQKLLVEKTKKKLEEAAQSGSIDGVIDPPSPVKRHMKWKMARTKKIGEMTTEATKEIVEKIDSFEEQATQGSFVPHGCLCNISFFVS

SEQ ID NO: 162807 - protein, 317 aa, Glycine max
  Coding DNA Sequence Number=SeqID_71122
  Gene Ontology: Mol. function=hydrolase activity, acting on glycosyl bonds; Cellular component=vacuole; Biological process=cell wall catabolic process
  Homolog annotation: Hit_ID=Q9SDY6; Match level="QueryCoverage=100%, HitCoverage=99%, E-value=1e-126, Identity=65%"; Hit description =Chitinase class I
  Pfam annotation: Domain name=Chitin_bind_1; Domain location=23-62; Score=72.8; E_value=1.1e-18; Accession=PF00187.10; Description =Chitin recognition protein
  Pfam annotation: Domain name=Glyco_hydro_19; Domain location=81-311; Score=569.7; E_value=3.1e-168; Accession=PF00182.10; Description =Chitinase class I
  Pfam module annotation: Pfam domain module=Chitin_bind_1::Glyco_hydro_ 19; Domain location=23-62::81-311
MGNMKLCPLMLCLLLAFLLGAAAQNCGTQVGGVICPNGLCCSQYGWCGNTEAHCGRGCQSQCTPGSTPTPTTPSGGDISNTISRSQFEEMLKHRNDAACPGRNFYTYDAFIAAARSFNGFGTTGDITTRRREIAAFFGQTSHETTGGWASAPDGPYAWGYCFINERNQADYCTSGTRWPCAPGKKYYGRGPIQLTHNYNYGLAGEQLNLNLLNDPDLVSRDPIVAFRTAIWFWMTAQGNKPSSHSVIIGTWNPSSADWQAGRVPGYGVITNIINGGLECGRGPDSRVQSRIGFYERYCQIFGVSPGNNLDCNNQRPF

SEQ ID NO: 162808 - protein, 113 aa, Glycine max
  Coding DNA Sequence Number=SeqID_71123
  Subcellular localization annotation: CTP_CleavageSite=45; ConfidenceScore=5.09e-01
MAMAVLTVLGWPTKTIVRFAQPCHPRQCMTLGRSPCQGCECVSALCAPGRTLREIKLHRCRNGEDGGKEKKGFRFQAKEEKVQAADDSLSEVDPLTRGILLVRHPARLADGKP

SEQ ID NO: 162809 - protein, 61 aa, Glycine max
  Coding DNA Sequence Number=SeqID_71124
MRTNEPYVLASQAQQPRDLYDVPEKATLEPCQENDDIGSIPFTSNVLDNDQGLSLDRNDLV

SEQ ID NO: 162810 - protein, 271 aa, Glycine max
  Coding DNA Sequence Number=SeqID_71125
  Gene Ontology: Mol. function=hydrolase activity, acting on glycosyl bonds; Cellular component=vacuole; Biological process=cell wall catabolic process
  Homolog annotation: Hit_ID=Q9SDY6; Match level="QueryCoverage=68%, HitCoverage=58%, E-value=9e-78, Identity=71%"; Hit description =Chitinase class I
  Pfam annotation: Domain name=Chitin_bind_1; Domain location=24-63; Score=69.6; E_value=1e-17; Accession=PF00187.10; Description=Chitin recognition protein
  Pfam annotation: Domain name=Glyco_hydro_19; Domain location=81-243; Score=136.5; E_value=7.8e-38; Accession=PF00182.10; Description =Chitinase class I
  Pfam module annotation: Pfam domain module=Chitin_bind_1::Glyco_hydro_ 19; Domain location=24-63::81-243
MGNMKLCSFMLCLFIAFFLLGATAQNCGSQVAGALCPNGLCCSKFGWCGESDTHCGAGCQSQCRNGSTPTPTPSGGNISNIITRSQFEEMLKHRNDPACPGHGFYTYDAFIAAASSFNGFGTTGDITTRKREIAAFLAQTSHETSGGWPTAPDGPYAWGYCFINERNQAYYCTSGTRWSCAPGKKVSNALQRSETPAKRSQITNVSLNLERFPARKEQMSIGKGNPCSKKQLCQETPNSRLDTSNVFIDFANKQLFIGAPRLNPLFGLFRT

SEQ ID NO: 162811 - protein, 382 aa, Glycine max
  Coding DNA Sequence Number=SeqID_71126
  Gene Ontology: Mol. function=hydrolase activity, acting on glycosyl bonds; Cellular component=extracellular region; Biological process =cell wall catabolic process
  Homolog annotation: Hit_ID=Q9SDY6; Match level="QueryCoverage=25%, HitCoverage=29%, E-value=6e-36, Identity=74%"; Hit description =Chitinase class I
  Pfam annotation: Domain name=Glyco_hydro_19; Domain location=1-124; Score=55.2; E_value=2.3e-13; Accession=PF00182.10; Description =Chitinase class I
MKYMDCDQVFIFNYNYGQAGTALGVDLLNNPDLVATNVEVSFKTALWFWMTPQGNKPSCHDVITGKWTPSDIDKSAGLVPGYGVITNIINGRIECRYKPDTRVEKSDRVLPKARPLAPTSEEDPASWCTKKVKTRDSEAVVIETLKVEEEMYVSPKASYKEKLLSMSGVKGTTPGLETTVPGKIDFQSVKTNSSNKQGLQGPEVSFRFLEAKLQRSWTKNNTIKILDMLDDYYGSPDNESADSDDVPKGNRVVNEEKSKETKVEPSVGYEPWMIIKRKPRKKVDRHETQKGITANNKKESDKRKDSPLIQKGNPRMDRVKNALGGKNPQLNGGKSSQEEEKSPSSGRKVNSKVLPNNKGVAPSGAGSPLKAKVANDFRPNKE

SEQ ID NO: 162812 - protein, 43 aa, Glycine max
  Coding DNA Sequence Number=SeqID_71127
MMERLFLSPPTCLRKFQRKKRGFGKRRRENKIERKRRGRKYRN

SEQ ID NO: 162813 - protein, 73 aa, Glycine max
  Coding DNA Sequence Number=SeqID_71128
MPLTMNGRIKEYLVLALPGQIVKGKNYFGNDVIFTAIEGNEARLDGGVDFVHELPALRWSLRMLTQCDFCPVL

SEQ ID NO: 162814 - protein, 46 aa, Glycine max
  Coding DNA Sequence Number=SeqID_71129
MATPNAPLAPQWNIPGAIPDMGFTVSGLGFEVYALGFRVYGLGYMV

SEQ ID NO: 162815 - protein, 253 aa, Glycine max
  Coding DNA Sequence Number=SeqID_71130
  Homolog annotation: Hit_ID=A7R9A8; Match level="QueryCoverage=33%, HitCoverage=38%, E-value=5e-08, Identity=36%"; Hit description =Chromosome undetermined scaffold_3580, whole genome shotgun sequence
MKKNAIKLITSLKQMDAKFGVSTLLDLDHHFAVVIRVLREVILINLSVFQFILSFLTMASSNSKSTKWLLVAKLTQKGGLLFVFHKPFSPECSWPVSLPLTASLALGGHSRKVAVTYETWKEVPVAQKDLIWEDIQAKFEIPEASGSRTKKKVLLTPTRMVWTTLSVKNTALARRNGSSFVRPAEIPRGRYDVRKKTQAIQKQNTAPHMLSCGGYDYLEQKLMDEKTKKKLEEVAQSGSTEGVINPPSPIRRH

SEQ ID NO: 162816 - protein, 64 aa, Glycine max
  Coding DNA Sequence Number=SeqID_71131
MASSKHQSQGLCFYSKPEESKEEDFKCFRAKLMQKLEEKALKKSWKNWTARSTCTSGLAYTKRA

SEQ ID NO: 162817 - protein, 344 aa, Glycine max
  Coding DNA Sequence Number=SeqID_71132
  Subcellular localization annotation: CTP_CleavageSite=64; ConfidenceScore=5.52e-01
MFLVRVGIVGARYAAPTLFRQLSLSLTLPFSSSSFSIEASSKASTFGHHFCPKSRKEGIFGVVKCVATSGTSKFQAVERVVQNEFWMFASRSQRSQCRLMYYRFPLGRIDGDPVLRETRIWATWEYVSSVGGGQQGMVEWYLEICRGGQETLGTSGGVLLPKTKLDQSRPNPGIVGQLENEVRKLREPLRDGSLVIDYQIVMAAQLIRDRVEMECLEGAWETLEGNTRCRFRGTIRFTATSLVHPDEPARTLQRTVEWILPMPTPYRLVETVQVIEVTSSEEDPEEDLEELPPEPAVDALDFLEGDEDPLLEVDSPEEVMSASEADSTEDSGPGEMAISGGSSS

SEQ ID NO: 162818 - protein, 149 aa, Glycine max
  Coding DNA Sequence Number=SeqID_71133
  Gene Ontology: Mol. function=protein serine/threonine kinase activity; Biological process=protein amino acid phosphorylation
  Homolog annotation: Hit_ID=Q6UY57; Match level="QueryCoverage=79%, HitCoverage=24%, E-value=1e-12, Identity=31%"; Hit description =Lectin-like receptor kinase 1;1
  Pfam annotation: Domain name=Lectin_legB; Domain location=28-144; Score=-89.6; E_value=0.00026; Accession=PF00139.10; Description =Legume lectin domain
MLATSEHFHYFKTCLLLPIIFMILPIVQPLSFNITNFSDPEIASRIQCTGIAKIENGNIVLNPLINNGVERAIYGQPLRLKNSSNGNVRFFYSFFIHNNIVAVEFDTYINEYDQPMHRVGINNNSVASLEYKKFRIESNIGKMGHALIT

SEQ ID NO: 162819 - protein, 261 aa, Glycine max
  Coding DNA Sequence Number=SeqID_71134
  Subcellular localization annotation: CTP_CleavageSite=57; ConfidenceScore=5.41e-01
MVETFRFSFHSIALTTSPSTLSLWFPSHHLSTALGKAVLLKVTTQRRQHIHSLQSVLHQSVVTYNTNLAFIFIFFKNLRFNTLVREKDYEVAVVVIKEHMACDKCKAMHNNTTTTNNNTNPMETEVPQFLVELPGGPAKGGSNDNGASVRALVSLSKEGNNTTSDAPLLNTSSLVGDLVETRYGKGKDTNTDKFESEDMPSHVPNDIKKERTLLRPPIVPNSKHSKGDFVENSSSKDRSGKKHLRTSDKEVDPSASRECHD

SEQ ID NO: 162820 - protein, 114 aa, Glycine max
  Coding DNA Sequence Number=SeqID_71135
MRPLDPTNHNVKNKLAIIMPKENFAYLVRQRLQLTLTQLKVERQTITEKRGIGEEISVGDGGNAGEDNKEVFKPKVWGRYWWHWQQHHRHSNVKIPPTETAATTLKCQDTANGD

SEQ ID NO: 162821 - protein, 196 aa, Glycine max
  Coding DNA Sequence Number=SeqID_71136
MNCNFCGGEHYNDNCHFYSMKNSWWGQELYPYNQYEEERTPNLESVFTEFMAYHASSKPNQNSMQNQEIHVGKSYSMENCQWEQELQPYNQYKEERMSNLDNLLMQFKESFESTQQAFKSLEIQVGKLAKEVAKYVATREENFLEVEAHEESLIEEHDSREKDKEKSEEKAQQWEKCLQVDIHKKVFSKSITFLIN

SEQ ID NO: 162822 - protein, 164 aa, Glycine max
  Coding DNA Sequence Number=SeqID_71137
  Subcellular localization annotation: CTP_CleavageSite=72; ConfidenceScore=5.56e-01
MSFFCLISPSDWATMIPGASNSESPSSKRVKTLRRTGGGTSRPRGGALPFAATGEPVLVTVILPPSIFRGVRRGTGNGDVRVPPHAQHTLSVGSPSSTPVVAGCEWGFKPRRKDTTCYNQRHEATGSKDRANIRAKTSSNVREGTKSNHRNKQRRDKKAKKGNY

SEQ ID NO: 162823 - protein, 141 aa, Glycine max
  Coding DNA Sequence Number=SeqID_71138
  Gene Ontology: Mol. function=binding; Cellular component=integral to membrane; Biological process=transport
  Homolog annotation: Hit_ID=A7QIX0; Match level="QueryCoverage=49%, HitCoverage=21%, E-value=2e-13, Identity=59%"; Hit description =Chromosome chr2 scaffold_105, whole genome shotgun sequence
MLVDVELDGFGIEIDCEHHMFVNMHQREIEKQISLNFSNCMIFWEVQGNCCIWHFGYLLVLVRSRFYHLGHWGSVLLWNVSHSNIKFYTYESLKQVMSSSILNFVPHYPEALRYAKVMCGGLVGSTSVLFTTPFDVIKTRL

SEQ ID NO: 162824 - protein, 231 aa, Glycine max
  Coding DNA Sequence Number=SeqID_71139
  Gene Ontology: Mol. function=hydrolase activity, acting on ester bonds; Cellular component=cellulose and pectin-containing cell wall; Biological process=lipid metabolic process
  Homolog annotation: Hit_ID=A7P8N7; Match level="QueryCoverage=98%, HitCoverage=63%, E-value=9e-48, Identity=42%"; Hit description =Chromosome chr3 scaffold_8, whole genome shotgun sequence
  Pfam annotation: Domain name=Lipase_GDSL; Domain location=1-212; Score=23.7; E_value=0.00012; Accession=PF00657.13; Description=GDSL -like LipaseAcylhydrolase
MADQIQQFATVHGNILQYLNDTAEATINKSLFLISAGSNDIFDFLLYNVSKNPNFNITREVQEFFNLLRTTYHTHLKNLHNLGARKFGILSVPPVGCVPIVTNGTGHCVNDINTLAALFHIEIGDVLENLSSEFPGMKYSLGNSYAITYDMINNPDPLHLSNVTSACCGNETVIDGVPCGSDTQVCENRSQFLFWDQYHPTEHASRIAAHKLYSGGKEYVAPMNFSLLVQE

SEQ ID NO: 162825 - protein, 304 aa, Glycine max
  Coding DNA Sequence Number=SeqID_71140
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=59%, HitCoverage=25%, E-value=1e-31, Identity=42%"; Hit description =Lipoxygenase
  Pfam annotation: Domain name=PLAT; Domain location=127-223; Score =24.0; E_value=4.3e-05; Accession=PF01477.14; Description=PLATLH2 domain
MAEILLCLQPTLQGLEKYFQVAYVAVMRNTTTENRTGLESLLSFYRSSIASSADPNVVIEVLNLLLSDAIPDQDIIYVLAGISNEGSETAWRWSRSENSSDFRDSSKTNEDLIKTTLTVHAKKPLQFKVRAVVTVRNKIKEDFKETMLKHLDAINDSIGTRNVVLELISIEIDPIPGAITVTNKHQREFFLESITIEGFVSGAVHFPCKSWVQGERILRKQEDTFIELSKLLEEATTRNQTEGNKDLNHNEKDYLLPKVVEFSEENRHGGKDTSKVELSANEGLNSNKAYRNKSLMTEKWNLGT

SEQ ID NO: 162826 - protein, 176 aa, Glycine max
  Coding DNA Sequence Number=SeqID_71141
MVFVIENIHWNELGLLFAVWIMILALEIGKVELHNNLLWSILGDQSTTGLLICRNLDKYFCDCFYEEQEVEVRWSESKLSKHQTQSHWPNSYLTNATKIRICLLNFSLFRGGGGNVTDDGVGGEGGAPPRHFEKGRDRGGGRLRQNGVVSSQHRRRSQRRHSPPPRPLQTQLRPPH

SEQ ID NO: 162827 - protein, 860 aa, Glycine max
  Coding DNA Sequence Number=SeqID_71142
  Gene Ontology: Mol. function=microtubule motor activity; Cellular component=microtubule associated complex; Biological process =microtubule-based movement
  Homolog annotation: Hit_ID=A7QSP8; Match level="QueryCoverage=99%, HitCoverage=70%, E-value=0.0, Identity=65%"; Hit description =Chromosome chr4 scaffold_162, whole genome shotgun sequence
  Pfam annotation: Domain name=FERM_M; Domain location=354-470; Score =76.3; E_value=9.8e-20; Accession=PF00373.9; Description=FERM central domain
  Pfam annotation: Domain name=FERM_N; Domain location=287-352; Score =15.8; E_value=0.00047; Accession=PF09379.1; Description=FERM N -terminal domain
  Pfam annotation: Domain name=MyTH4; Domain location=164-278; Score =172.0; E_value=1.5e-48; Accession=PF00784.8; Description=MyTH4 domain
  Pfam module annotation: Pfam domain module=FERM_M::FERM_N::MyTH4; Domain location=354-470::287-352::164-278
  Subcellular localization annotation: CTP_CleavageSite=58; ConfidenceScore=5.35e-01
MITDVPPSMTQNGRSSRYSFGSSNGNGDTPAQNGSAVINVDDYDSDSSNFAPSTPSTMSMAVPAELGGAVPLINRFQVDGFLKLMQKQIQSAGKHGFFSKRSVGPQVREKVTFEDMLSFQKDPIPTSLLKLNVDFVSRATKLFQIILKYMGIDPSDRVTPISLDERVELVGKLYKQSLKRPELRDELFVQISKQTRNNPERQYLIKAWELMYLCASSMSPSKDISSYLSEYIHNIANGVATDSEIQVLALNTLNALKHSVKAGPRHIIPGREEIEALLTGRKLTTIVFFLDETFEEITYDMSTTVANAVEEYIGLDANKYIGDLLAEFKAAKDRSKGEILHCKLIFKKKLFRESDEAVTEPMFVQLSYVQMQHDYILGNYPVGRDDAAQLSALQILAEIGFLSTPESCIDWNSLLERFLPRQISMTRAKREWEYDILSRYRSLENLTKDDARQQFLRILRALPYGNSVFFNVRKIDDPIGLLPGRIILGINKRGIHFFRPVPKEYLHSAELRDIMQFGSSNTAVFFKMRVAGVLHIFQFETKQGEEICVALQTHINDVMLRRYSKARSAAGGGSGSLNGDISNNSKTPNMELYEKRVQELSKHIEESKKNADQLLEELRVKQKQEEKMQEELDDLKESLKANKQNLDAVTSDRDSLVSLCNEKDKELQAAILDKRNMESRMAKLNNAVIENTAKKDLANAGNRQVTQKLEDELKVCKYELLSANETIESLKSEKLILEQKLSALEKRNAGEISSLKWKLEQERKVVKSEAYELERRLEGCRQELLTAKAIISVKDSEFDALQNNLKELEELREMKEDIDRKNEQTAAILKIQGAQLAEMESLYKEEQVLRKRYFNVIEGG

SEQ ID NO: 162828 - protein, 190 aa, Glycine max
  Coding DNA Sequence Number=SeqID_71143
GTSFVVQVEGTSTWVVVTENKRGYISCGSVQVEGTSTWLFKENKGGYIPCGSLLVKDFTRLKEISRTGGCLGTGCRHGLFPNQYKIPEALAVARQELHSLTLDSNCSMKRKTENTMLQNNEHVARGMFHHGIHHPLQSLMQFETLSEIGDSPMTINRTTGAIGEHDSDTACFLSLYLVGSSGLGIIKKGA

SEQ ID NO: 162829 - protein, 117 aa, Glycine max
  Coding DNA Sequence Number=SeqID_71144
MDELRERTKDYIQMEEMSRFRNKVRQKSDKQEGSTKYEPYKSDKRHKSNKCQLLLKRSRYGRYTPQMANHTTILKETFNLEVPIKLPLMKPPRSGLDAAKYYKYHCGIVITQKTVGP

SEQ ID NO: 162830 - protein, 449 aa, Glycine max
  Coding DNA Sequence Number=SeqID_71145
MVACYCIRVTHGVVACSSICVTHGVACSGDMGIVCPGFWRDSPRADLRYDELVELEKDDGSHKPRGGGLWLNLCVVSPCCSKFGSFFYDPDYFLDFVCCIELYPHVFFILLLLEQQSLGRWFPDLNGNHGVCVICESGPEDDFIGCLCLVVGLKMFDRGEKVFNAYPRQEVFIGMSFELGVIVDDNGLWQWSQYVHFPHGKRSRGAQTIEIVRRGGHPVWFLLLSNHNFFSVYGGSLECLLDDSLEVSDHFSGCQLEEHVCFGVALPRLLAPTSLASFRPAMSRCFPFSSKKAKLTASSATERYRSRGNLGLGRLWIGGRNLDRDASLQFHFWTSWTLVGAHVIFAELSKDFFQICHVLGYALRLHDHVVDIDLDVSSDMFLENLVDQSLSKRPGSSTPGTRTRHQLALKCWVEGGVSDFSNEVGIEEFVHFFFDSFSSFFSHLLFHLL

SEQ ID NO: 162831 - protein, 76 aa, Glycine max
  Coding DNA Sequence Number=SeqID_71146
MGDPSSVAEEDIRQEAKNKGMKCVTHELGTYSGITYESLSFIVNSELGGLCTVQPRNLTCTQLVALNCNLWTRHNT

SEQ ID NO: 162832 - protein, 79 aa, Glycine max
  Coding DNA Sequence Number=SeqID_71147
MAATLAVKRTSGHHETANRSQKTYLGKLQMNNQKASPHDLQRNGEQQASMENNLRMQRVHTQRRKKREQNRLRLIKFKL

SEQ ID NO: 162833 - protein, 150 aa, Glycine max
  Coding DNA Sequence Number=SeqID_71148
MVVPKSENDARISLNYQGKSLESRVPLGVGFQRRTTTVHGGYWWMWVMEKELGMLEMVLEEGRRNKLHFSKVTRKAKAETLKCFCSRKGSVPHMLDILSKITTGVTAKGCSRVALRVRFKVDGDIDATLGGGGGEGGRGGGETVGVAMVL

SEQ ID NO: 162834 - protein, 116 aa, Glycine max
  Coding DNA Sequence Number=SeqID_71149
MQMANRDRGGGHRTFNRGRRRGLILGAPITTNPSTSSIHISTLESMIHVIAPTPNTLPTARDQPNPTFVRESIPTTPIRDASPSAPDDSLTPEYPPDPNFEHIVDQRPFIRAYKGE

SEQ ID NO: 162835 - protein, 128 aa, Glycine max
  Coding DNA Sequence Number=SeqID_71150
MESEQHPPQQSPPIIINIHDEGLEPHAQSYEFTLQPHHHQEDYGYNPQFFIASKEDFMSNLMDIDLRTPESAYAYMQSMPILSFASFHHNIADSSSTNDFVWKSNMLFLINNLNHKNMASTSTTDNKQ

SEQ ID NO: 162836 - protein, 243 aa, Glycine max
  Coding DNA Sequence Number=SeqID_71151
MVVDMRDNIDVAECIIKLIPQWRSFGDRITLDGNKSVPRLPPDSMPVVDLVASDQEMELYPLGKVLGLGELHWNDEVVWGIWSLIMSGVITQLGYSFPITRADNIGSCSVEYPGDDDRICSQGWKENVEVLKPKPTNSYVVKEKSLTPTKKEALKRITDPSKEFEYYVPYKLILISSTERWNANLVVEANFMMMNQAILMMPKAQVIDSSLIQDFKIKHQESNPVFKIQEKKSRSNKSRLHIG

SEQ ID NO: 162837 - protein, 182 aa, Glycine max
  Coding DNA Sequence Number=SeqID_71152
MSVLELYIEKDVAGGSMFHSANSLTSCGNYLSNDETQSTRNMSNLHIDEDDDDADDDYLVSNSYVEESLDEDDSVDGISDTDDEVTNIPQPVRIVHPVEGAQRIENPFRNDALHYNIINWSYPDEEDNCGLEMPSTFNIGQELYVGMEFDNKDAVKNAVKQYVMKVHQSFKVVGSKSNKYMA

SEQ ID NO: 162838 - protein, 226 aa, Glycine max
  Coding DNA Sequence Number=SeqID_71153
  Homolog annotation: Hit_ID=A5BU47; Match level="QueryCoverage=46%, HitCoverage=5%, E-value=5e-12, Identity=37%"; Hit description =Putative uncharacterized protein
MRHVKHEGHAQTHGPEIYPRAHENPRAFSCIFGPIFLESSIQCPWGVGLHQTPPRSPSPHSDGQSKATSTRSRQSTRLRWLTLRTLDQPRPTVNVNPTMGRGSCQHKEKFHNYLRVIVQEKIPIVHNNWKDVPESLKDLVWDDILEKFDIPKALKAKKKVMSTVATRWRQFKSTLTTKFVYGNTEGQDKKDPSIKYGLDPETWDKFSTTRQTPNWQEKGTGNSKIQ

SEQ ID NO: 162839 - protein, 145 aa, Glycine max
  Coding DNA Sequence Number=SeqID_71154
  Subcellular localization annotation: CTP_CleavageSite=34; ConfidenceScore=5.25e-01
PSTSNVFYGSSQMFATTFNTPPSTYNLAPSSSCYCSSLPTQICDMSQEDEDEDEDNNNNNDDNDDGDGVDDDDNNGHHVPQQQRTITRQHPRTRGGRGRRLRGQQTCKWVLEGLPRLRRVESKGGSRQVGLLCYPKLKVKLLWTY

SEQ ID NO: 162840 - protein, 168 aa, Glycine max
  Coding DNA Sequence Number=SeqID_71155
MSGFSKQMPSMNEADEVDDGHANRIMDTRPTSPPQSDGQSEATSKRSRTTTQLRTLTLRTVDQPRPAFNVDPATGRASGPMRENFHSYLGVVAREKVPIIHNTWKDVPEMLKEIVWNDILAPKLFVNVLRESLIELDVILLVLCNFKDELKALLNQVLPDDLQAQLLH

SEQ ID NO: 162841 - protein, 113 aa, Glycine max
  Coding DNA Sequence Number=SeqID_71156
MAKSTDVLLVQGTLERWQCHSKRHDFDYVGVPVVGAASPLRLQVLGGEKQNVRVVAGRTSRQDEVVQAIAGELGFWRDGLPTSIVFDDFHQNYNGGVVDKRRCTTNAPLKKLI

SEQ ID NO: 162842 - protein, 83 aa, Glycine max
  Coding DNA Sequence Number=SeqID_71157
MTPYRGLEQLGASYGQSGRRWRSNYVPWFRSLSEEQPTYLQRDDDKDDDKKLKDQSKNNSSESRAIQEFKIRIKKNSRLMKKV

SEQ ID NO: 162843 - protein, 140 aa, Glycine max
  Coding DNA Sequence Number=SeqID_71158
  Homolog annotation: Hit_ID=Q6WAY3; Match level="QueryCoverage=30%, HitCoverage=1%, E-value=1e-07, Identity=54%"; Hit description =Gag/pol polyprotein
GPGSSSSSPMMKREMITMIVDTLPVFYYEKMVDYTPSSFADLVFTGERIEVGLRRGKFDYPALMNGKPRANGENEKKGETHVVIVVPTWPNFPPGYDLNATCAYHGGVPGHSVEHCITLKHNVQGLIDAGCLKFEEDNRL

SEQ ID NO: 162844 - protein, 72 aa, Glycine max
  Coding DNA Sequence Number=SeqID_71159
MTKLDITCGGNRVLVGLGSSSSMDSFASWKMSGIRMEKKEREEMPFQGEDESRRSSPPYEVMDKSLEEEGDE

SEQ ID NO: 162845 - protein, 187 aa, Glycine max
  Coding DNA Sequence Number=SeqID_71160
  Subcellular localization annotation: CTP_CleavageSite=36; ConfidenceScore=5.20e-01
MVEPFKKRKGSTSTTTVVGQHRHDTSGGPPAPPNPSFSSLWSLTLFSFDEQYQRDGVIFSKVDKIPIVVDQSLFYSLTKLSSQGVPFEGTLDDDWKHIYSTHHAHKMDVDGQWVRKQDLSPPIPNKRTPSPPPQWDSSSSLLNDVLTELRDLQEFVGDHFNVMDSRITHLEDDMSFIRRCFDPLMDS

SEQ ID NO: 162846 - protein, 448 aa, Glycine max
  Coding DNA Sequence Number=SeqID_71161
  Gene Ontology: Mol. function=GTP binding
  Homolog annotation: Hit_ID=A7PKU7; Match level="QueryCoverage=79%, HitCoverage=87%, E-value=4e-90, Identity=50%"; Hit description =Chromosome chr7 scaffold_20, whole genome shotgun sequence
MLSVGLTSVDVDDAFDSASQVNVHGWTINNKYYTADVSLWMAHLHDDFSAANVTLSRRMTALVMVFDMNEPSSLAALREWVSRTDIQNFEILLCIGNKVDLVPSHPAHAEYRRRLLKLEDSAADFYSEEYGISESEGTSLLGDEEPSWDIRRSCLDWCTDHNIEFIEACASNADFDKCLSIDGDLQGVERLYGALSAHMWPGMHADCCFCQHRISADFVLSFSSPPPALAPTPELSSEESDYEQEYEVLSAGSADWDESEQGWISASSLDSGGSAPQNNPGTVGQHEDGIKSDKESHPTTSSTAIQDESEKDMVHNTMDSEGDGKENEGKCLELEDLEHLMSEIGNMRAGLRLMPDFQRRDMAAKLAMKMASIFGGENSQHAPGRGGGGNAHGGARGGARRCRSIAECCSLAAAAPTATLNRAAMSIPVADGGRAAPLRRNSGRDGHD

SEQ ID NO: 162847 - protein, 115 aa, Glycine max
  Coding DNA Sequence Number=SeqID_71162
MAQCCHLCILSFFSISGAQCFPVLFVSVKVKVEVAAMFGVAVVGGGGIRGIMSEEVDMDDENEEECDVNEPHVDCSDAFNTSQVFDSREDVLRWARSVAYENGFAAVIVRSDTNT

SEQ ID NO: 162848 - protein, 136 aa, Glycine max
  Coding DNA Sequence Number=SeqID_71163
MEVFQDKFCIQKQDYQKERYSKAGKTDQHVLCVKVKIIKVVYDQMHDARDSFSQWVDSHSHALILCGGASSRSHFRSHSLRQCFLSLSLSAAALPLALALGLTLIVALTHNRLHGDNEVLFAGIKKVSECGLMRER

SEQ ID NO: 162849 - protein, 63 aa, Glycine max
  Coding DNA Sequence Number=SeqID_71164
MPKLRGIGVGGRDIVGRWAFILSNYQVKKAFLQEGDGGGVGGGVRLSSPDESEVVIGRWRLEA

SEQ ID NO: 162850 - protein, 228 aa, Glycine max
  Coding DNA Sequence Number=SeqID_71165
PSNLSQKNDDLGLIHRLIVMKFKNQVRNPVTSILTIGNLDIMLFTIQFRIPSPLGFVKKCLWMEKYASHEAVQNESFNPFSFSLTFGNSIRTIRGKIEESQKIAKDAAIAFRRHVSSLKAFSQNIVTLTGLPMILLSESDLTNPLCGVSCYVLLSAPGWFFTDMECDNSLPVCYLCLDPVMILNFVFGGADDQALDILRQWSLLHLEDQWKKNGEGRKMIGDATSRRR

SEQ ID NO: 162851 - protein, 253 aa, Glycine max
  Coding DNA Sequence Number=SeqID_71166
MGSGVTISQYYGRASHGSSSSSTSVSQQQLADIIGILKEDTKGSNAEIAINPAGEEDGAHVMPSMELYVQDDVVRVSVEKIYDDDAQVPFLMSEIQYVRQDSHISEKKLAEAAADDDPLRGLIKALYDIYEKPIELLWDRTKFGVPIVDASFFLIYTDVNEIIAAQAWVMVQFMDSLSLSPYTMQRINMLNVNITLKYGAHWQLVVLCPTKDIVVWFCSSRKKPDIHIKAAINNSGMKTLKTTLDGKIDQPAS

SEQ ID NO: 162852 - protein, 104 aa, Glycine max
  Coding DNA Sequence Number=SeqID_71167
MYNMGTVKKVDSVGNMDMFWKSHIIMVDSCIKRESQSEPFDVEMGDRLEDMIHDLGLEPFQQEYAPMYDTLQTDSNKPLYLGCNNSLTLLSAVLSLVNVKARYG

SEQ ID NO: 162853 - protein, 371 aa, Glycine max
  Coding DNA Sequence Number=SeqID_71168
  Homolog annotation: Hit_ID=A5AWV0; Match level="QueryCoverage=77%, HitCoverage=18%, E-value=5e-08, Identity=22%"; Hit description =Putative uncharacterized protein
  Pfam annotation: Domain name=Transposase_23; Domain location=288-358; Score=-4.9; E_value=0.004; Accession=PF03017.5; Description=TNP1ENSPM transposase
  Subcellular localization annotation: CTP_CleavageSite=27; ConfidenceScore=5.45e-01
MASPPASPPPPPSPPLSDALTSPSAVKQTRKASCGRHVRELEGGPYFSEGLDLGRYSDLARKWALATDQDGVDDTVCEKYDISKEKWTHFCKTRRDPSWEDVQKKAQAIQKQNTVPHVLSRGGYEYLEQKLLANKTKKKLEEVEQSGNIDPVIDPPSPIRRHVKWKMTRTKKTGEMMTEATKEITEKIHYGRVHAAGVGVTIKQYFGSAPRTSHSSSLLPPEELQQLTQQIRDQLEESITKKPNAISVSVLDVISGLALPPEHLVGPSGPRVSTKESCVDPLGNDPETGDSDRCNLYIEANPARPVALGRVYEGLTVVHNTLLLPGHVKVGVEEVKDPDAPVPIPSEEVSLVGQAIHTFLGWPTHLVKFLS

SEQ ID NO: 162854 - protein, 331 aa, Glycine max
  Coding DNA Sequence Number=SeqID_71169
  Gene Ontology: Mol. function=hydrolase activity, hydrolyzing O -glycosyl compounds; Cellular component=extracellular region; Biological process=carbohydrate metabolic process
  Homolog annotation: Hit_ID=Q6S9W0; Match level="QueryCoverage=99%, HitCoverage=95%, E-value=1e-124, Identity=68%"; Hit description=Endo- 1,3-beta-glucanase
  Pfam annotation: Domain name=Glyco_hydro_17; Domain location=29-331; Score=551.6; E_value=8.1e-163; Accession=PF00332.9; Description =Glycosyl hydrolases family 17
MFVSAILLLVGILSSIRVLEFTAAQTQVVGICYGVNGNNLPSKQEVVDLYKSKGIPRMRIYSPDEETLQALRGSNIELTMDVTGETLQSLTDPNVATDWVHRYVTSYSQDVNFKYIVVGNEVHPNYDVAPYILPAMTNIQNAISSANLQTKVSTAIDTTLVTDSYPPNNGVFTADASPYIGPIINFLVNNGAPLLANVYPYFAYVNNQQDISLPYALFTQQGTNDIGYQNLFDAMLDSIYAALEKIGAPNLEIVVSESGWPSAGGDGALVDNARIYYYNLLNHANGEIGTPKRPGRPIQTFLFAMFDENQKPGAETERHFGLFNPDKSSKY

SEQ ID NO: 162855 - protein, 149 aa, Glycine max
  Coding DNA Sequence Number=SeqID_71170
  Gene Ontology: Mol. function=protein serine/threonine kinase activity; Biological process=protein amino acid phosphorylation
  Homolog annotation: Hit_ID=A7PHF4; Match level="QueryCoverage=53%, HitCoverage=58%, E-value=3e-14, Identity=48%"; Hit description =Chromosome chr17 scaffold_16, whole genome shotgun sequence
  Pfam annotation: Domain name=efhand; Domain location=114-142; Score =16.7; E_value=0.089; Accession=PF00036.23; Description=EF hand
  Pfam annotation: Domain name=efhand; Domain location=78-106; Score =27.2; E_value=5.9e-05; Accession=PF00036.23; Description=EF hand
  Pfam module annotation: Pfam domain module=efhand::efhand; Domain location=114-142::78-106
MKTKGGSKNNVKNKDVEDGKFHDLVENDKEALSDIGRLEKRIKIAIWCIQEHLEMRPTMGKVKQMMDGMMGGELPMKEAKMAIAALDSDGDGLLSLEDFIALMEARGEEQKLNDLKVAFDMYDTESCGFITPKSLKRMLKKMALKNSEL

SEQ ID NO: 162856 - protein, 336 aa, Glycine max
  Coding DNA Sequence Number=SeqID_71171
  Gene Ontology: Mol. function=aspartic-type endopeptidase activity; Biological process=proteolysis
  Homolog annotation: Hit_ID=A5AK77; Match level="QueryCoverage=58%, HitCoverage=28%, E-value=3e-09, Identity=23%"; Hit description =Putative uncharacterized protein
MAEREGSRPPRRTLGDYSYQQGPKHYNSIVIPPFSNKVVELKSALLSLISSHPFAIMDHEDPYTHLSTFMELCSTIRASDEYVEAIYLRAFPFSLVDLSMQNPPSRLSPKDLTNLSVRHGKDSKLCCGGTMMSKSPEEAIVIIDSIVASDYQSHHDRAMTQRKCIMELDTQSAILAQNKLFAQKIEALTKRIGQLPQQYHRDVIVVVVTIRMATVMDNKKRRPIHNLQNQARPQQNFQASYHGYRGGSSSNQSYGWRPHNSGPANTSFVGPSNNSYGGLSNRGPQQQQAQPNRMSKMEDILTQFMQVSIANQKNTNASIKNIEVQVGQLAKQLFEH

SEQ ID NO: 162857 - protein, 227 aa, Glycine max
  Coding DNA Sequence Number=SeqID_71172
  Gene Ontology: Mol. function=hydrolase activity, hydrolyzing O -glycosyl compounds; Cellular component=vacuole; Biological process =carbohydrate metabolic process
  Homolog annotation: Hit_ID=O49012; Match level="QueryCoverage=81%, HitCoverage=78%, E-value=2e-69, Identity=71%"; Hit description=Beta -1,3-glucanase 3
  Pfam annotation: Domain name=Glyco_hydro_17; Domain location=31-227; Score=70.0; E_value=7.7e-18; Accession=PF00332.9; Description =Glycosyl hydrolases family 17
MAQGLLCLLSFNSSRSLRLAPKSQAAQTQVIGVCYGVNGNNLPSKQEVVDLYKSKGIPRMCILSQDEATLQALRGSNIELMMDVAGETLQSLTDPNVATDWVHRYVTSYSQDVNFKYIVVGNEVHPNYDVAPYILRAMTNMQNPISSVNLQTKVSTAIDATLVTDSYPPNHGVFTVDASPYIGTIIIFLVNNEVPLLPNVYPYFTYVNDQQGISIAYICPFYLARNQ

SEQ ID NO: 162858 - protein, 31 aa, Glycine max
  Coding DNA Sequence Number=SeqID_71173
AKESIDEEDPKPTSSNGAYINGANALATNNV

SEQ ID NO: 162859 - protein, 144 aa, Glycine max
  Coding DNA Sequence Number=SeqID_71174
  Homolog annotation: Hit_ID=B0HC01; Match level="QueryCoverage=22%, HitCoverage=70%, E-value=3e-11, Identity=100%"; Hit description =Putative uncharacterized protein
MRKRHASRREKGGQVSGKRQGRNRRAHEGASRGKRLGVGAYGKTPATRPFYGSWPFAGLLLTCSFLRYPLILWITVLPPLSELIPLAAAERPSAARNSYDHDYEFELGTHTFENRSCAHKYSHPLNPNPTTPPHTLSGSTSRGA

SEQ ID NO: 162860 - protein, 107 aa, Glycine max
  Coding DNA Sequence Number=SeqID_71175
MVVDVCQCFCGGWQSRHLPLTVELIETKTASTVWSSVSNDLPWTNFLTPLDSPQYTIRGVFMDDVRKGRGRSKLWVNKAVVALDVDVDPTAREAGTVELAEAKDNTL

SEQ ID NO: 162861 - protein, 44 aa, Glycine max
  Coding DNA Sequence Number=SeqID_71176
MGLSDFRKTLFRKILRPIPEEMVPEVSSGSTSSGMGLSNIRKKV

SEQ ID NO: 162862 - protein, 176 aa, Glycine max
  Coding DNA Sequence Number=SeqID_71177
  Gene Ontology: Mol. function=signal transducer activity; Biological process=G-protein coupled receptor protein signaling pathway
  Homolog annotation: Hit_ID=P93163; Match level="QueryCoverage=97%, HitCoverage=75%, E-value=1e-42, Identity=76%"; Hit description =Guanine nucleotide-binding protein alpha-2 subunit
  Pfam annotation: Domain name=G-alpha; Domain location=6-175; Score= -77.1; E_value=3.2e-14; Accession=PF00503.11; Description=G-protein alpha subunit
MGLLCSRNRRYNDADAEESAQEIGEKLSEIGGRLDYPYLTKELAQEIENLWKDPAIQETYARGSELQIPDCTDYFMENLQRLSDTNYVPTKVPLNVCEWFKDYQPVSTGKQEIEHAYEFVKKKFEESYFQSTAPDRVDRVFKIYRTTALDQKVVKKTFKLVDETLRRRNLFEAGLL

SEQ ID NO: 162863 - protein, 51 aa, Glycine max
  Coding DNA Sequence Number=SeqID_71178
MVKKIKKSFFRHDWMIHGVLSSVVQKVVSEWLGWVVDLGLNKLAYSVFGSV

SEQ ID NO: 162864 - protein, 101 aa, Glycine max
  Coding DNA Sequence Number=SeqID_71179
  Gene Ontology: Mol. function=glycine dehydrogenase (decarboxylating) activity; Cellular component=mitochondrion; Biological process =glycine metabolic process
  Homolog annotation: Hit_ID=P26969; Match level="QueryCoverage=85%, HitCoverage=10%, E-value=1e-18, Identity=51%"; Hit description =Glycine dehydrogenase [decarboxylating], mitochondrial precursor
MGPIGAKKHMAPFLPSHSVAGLDRFWDALISIRADIPEIEKGKADINNLTLGNMQPSQLHVCVSKFWPSTGPVDNVYGDSNLICALVPESQAVEEQAAVTA

SEQ ID NO: 162865 - protein, 98 aa, Glycine max
  Coding DNA Sequence Number=SeqID_71180
MSEEVNMNGDNGEKPGVFENIDCSDVLNTSQVFATHDDDVLHQARFVVYDIGFVEVIMRSNTDIGKRGRDSYDQRITLTLMYHGVRLENALYQDLHDP

SEQ ID NO: 162866 - protein, 248 aa, Glycine max
  Coding DNA Sequence Number=SeqID_71181
MKSGNWKASSVQSLCSVRFRKKSSSAPAPVDHDSHEVTNLLNIESTTPPTTTSLEHEQHPSTSEGPMLENTAQTTQTQNNDTLVKELPLPPALQQHPNVDPKIVKRATSERRLSFNLSMKMPRSFSVARNDQKGNFNDGGNKGKLLKTNESMWMKTKGKLKNEDSVWMKTIILGGKCVPDEEEDVVIYEGKGKKISAYHPRKSTSMSLSRQCSYINPGAFSVPQSHEERIKSINNTCEDNKMKLENSF

SEQ ID NO: 162867 - protein, 82 aa, Glycine max
  Coding DNA Sequence Number=SeqID_71182
MNMLYNRYSNNRFVREYFTKYGMTFSALVNKISIVTKRKGVRGKLGIMKVERNLQQGSLALRRTQIVFTVGISSSIMNVNQH

SEQ ID NO: 162868 - protein, 227 aa, Glycine max
  Coding DNA Sequence Number=SeqID_71183
  Homolog annotation: Hit_ID=A7Q685; Match level="QueryCoverage=40%, HitCoverage=27%, E-value=6e-10, Identity=35%"; Hit description =Chromosome undetermined scaffold_55, whole genome shotgun sequence
DYVDEEEHLKMFARAWILRFIGGVLLVDKSSKRVPMRYLQFLVAFEGCSTYAWGAAATDYNVQSIGSYILLIQLWAWERCPKLVPSIVPPQQQNNPLGYSKRLVNGIVAMKDGFKKRHHKVSNLDDLAPCLDKMTLLTEEEDKIIEAREEAPSLVPQFERQQFDMLGRSVETQGLGQRRESVDAEAHVIPAMPERQHGMYYTPDQFTQEPSQMSSLYPYPYQSGTSS

SEQ ID NO: 162869 - protein, 171 aa, Glycine max
  Coding DNA Sequence Number=SeqID_71184
  Gene Ontology: Mol. function=sequence-specific DNA binding; Cellular component=nucleus; Biological process=regulation of transcription, DNA-dependent
  Homolog annotation: Hit_ID=O82042; Match level="QueryCoverage=98%, HitCoverage=63%, E-value=4e-35, Identity=49%"; Hit description=Heat shock transcription factor
  Subcellular localization annotation: CTP_CleavageSite=58; ConfidenceScore=5.23e-01
METRLQATEKKQQQMMSFLAKALSNPSFTKQLVQKTPQSREVLGVEINRKRRLTASPSVENLQQDDQDLATLDYPSHDRDLATMETDMDTFFSPAYDNELSSETNEPASISVEDTILEDFLNKDLVTWNPEDEVIIGDSSQVDVPVEDLVANPDDWSEQLQDLVDHMDYLG

SEQ ID NO: 162870 - protein, 115 aa, Glycine max
  Coding DNA Sequence Number=SeqID_71185
MKTKAHNRITNNIVSEIEQEAPYQDDELVGLQEVLEVDPDFINESLTNVDGGGEETTYSDRGGGRRTFNRGRRHGVSLGAPITINPSTSSIHISTSELIIHVVAPAPNTLPTAQD

SEQ ID NO: 162871 - protein, 125 aa, Glycine max
  Coding DNA Sequence Number=SeqID_71186
  Subcellular localization annotation: CTP_CleavageSite=91; ConfidenceScore=5.15e-01
MRCEEGSMTCWWGPHPTSSNPPIPAKRGTPRGTFSLAWHPFIAAQKLGGSGTLRPKPAKTTYPNESKRFLGSCDTTTNLNAELVSIFHGLRVTGEVGHRRIICEPDFLKSRTNCATISSVCSAHC

SEQ ID NO: 162872 - protein, 1061 aa, Glycine max
  Coding DNA Sequence Number=SeqID_71187
  Gene Ontology: Mol. function=protein binding; Cellular component =cytoplasm; Biological process=ubiquitin cycle
  Homolog annotation: Hit_ID=Q9SMY8; Match level="QueryCoverage=90%, HitCoverage=87%, E-value=0.0, Identity=45%"; Hit description=F -box/LRR-repeat protein 15
  Pfam annotation: Domain name=F-box; Domain location=175-222; Score =31.5; E_value=3e-06; Accession=PF00646.24; Description=F-box domain
  Pfam annotation: Domain name=LRR_1; Domain location=1024-1047; Score =4.9; E_value=38; Accession=PF00560.24; Description=Leucine Rich Repeat
  Pfam annotation: Domain name=LRR_1; Domain location=265-287; Score =2.3; E_value=1.2e+02; Accession=PF00560.24; Description=Leucine Rich Repeat
  Pfam annotation: Domain name=LRR_1; Domain location=289-317; Score =2.6; E_value=1e+02; Accession=PF00560.24; Description=Leucine Rich Repeat
  Pfam annotation: Domain name=LRR_1; Domain location=353-377; Score =0.4; E_value=2.6e+02; Accession=PF00560.24; Description=Leucine Rich Repeat
  Pfam annotation: Domain name=LRR_1; Domain location=379-404; Score =4.5; E_value=45; Accession=PF00560.24; Description=Leucine Rich Repeat
  Pfam annotation: Domain name=LRR_1; Domain location=405-430; Score =6.5; E_value=19; Accession=PF00560.24; Description=Leucine Rich Repeat
  Pfam annotation: Domain name=LRR_1; Domain location=451-473; Score =9.5; E_value=5.3; Accession=PF00560.24; Description=Leucine Rich Repeat
  Pfam annotation: Domain name=LRR_1; Domain location=493-518; Score =1.6; E_value=1.5e+02; Accession=PF00560.24; Description=Leucine Rich Repeat
  Pfam annotation: Domain name=LRR_1; Domain location=535-555; Score =5.6; E_value=29; Accession=PF00560.24; Description=Leucine Rich Repeat
  Pfam annotation: Domain name=LRR_1; Domain location=584-606; Score =8.7; E_value=7.5; Accession=PF00560.24; Description=Leucine Rich Repeat
  Pfam annotation: Domain name=LRR_1; Domain location=626-648; Score =3.6; E_value=65; Accession=PF00560.24; Description=Leucine Rich Repeat
  Pfam annotation: Domain name=LRR_1; Domain location=668-692; Score =0.5; E_value=2.5e+02; Accession=PF00560.24; Description=Leucine Rich Repeat
  Pfam annotation: Domain name=LRR_1; Domain location=719-740; Score =10.7; E_value=3.2; Accession=PF00560.24; Description=Leucine Rich Repeat
  Pfam annotation: Domain name=LRR_1; Domain location=855-878; Score =3.5; E_value=69; Accession=PF00560.24; Description=Leucine Rich Repeat
  Pfam annotation: Domain name=LRR_1; Domain location=932-955; Score =0.9; E_value=2.1e+02; Accession=PF00560.24; Description=Leucine Rich Repeat
  Pfam annotation: Domain name=LRR_1; Domain location=978-995; Score =6.5; E_value=19; Accession=PF00560.24; Description=Leucine Rich Repeat
  Pfam annotation: Domain name=LRR_1; Domain location=999-1022; Score =4.8; E_value=40; Accession=PF00560.24; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=175-222::1024 -1047::265-287::...
  Pfam module annotation: Domain location=289-317::353-377::379 -404::405-430::451-473::493-518::535-555::584-606::626-648::668 -692::719-740::855-878::932-955::978-995::999-1022
MKLWCFPWLCFTEEEEEERNVPKPMKEDDIFGNDVVSDDDDDGNNTRGGDDEQFATARTDALGSWPGESSSTAAAACSETPAAGGESRDSSHKRAKFYADFEERNFSTHAGKCGASNEYGDYDHIKGTLRPNGETCYDAFALMGAVEESSSGFDSSIVKEGEGDDSDISKVEDVEVRMDLTDDLLHMVFSFLDHPNLCKAARICKQWRGASAHEDFWKSLNFEDRNISVEQFEDMCRRYPNATAVSISGSAIYLLVMKAICSLRNLEVLTLGRGQIADTFFHALADCSMLRRLNINDSTLGNGIQEITINHDRLCHLQLTKCRVMRIAVRCPQLETMSLKRSNMAQVVLNCPLLHELDIGSCHKLPDAAIRAAATSCPQLVSLDMSNCSCVSDETLREIALSCANLSFLDASYCSNISLESVRLPMLTVLKLHSCEGITSASMAAIAHSYMLEVLELDNCSLLTSVSLDLPRLQTIRLVHCRKFADLNLRTMMLSSILVSNCPALHRINITSNSLQKLALQKQDSLTTLALQCQSLQEVDLSECESLTNSICDVFSDGGGCPMLKSLVLDNCESLESVRFISTTLVSLSLGGCRAITALELTCPNLEKVILDGCDHLEKASFCPVGLRSLNLGICPKLNILSIEAMFMVSLELKGCGVLSEASLNCPLLTSLDASFCSQLTDECLSATTASCPLIESLILMSCPSIGLDGLCSLRRLPNLTLLDLSYTFLVNLQPVFESCSQLKSATTPPARSRIVLPILVRQIILIAPNEIVILICYDVASPGAAVKLCLGDLLVMGSNPETASLHIQGNVTSILLLYDMCNPPPLSQLLGVSQACKYLTDSSLEPLYKGALPALQELDLSYGTLCQSAIEELLSCCRHLTRVSLNGCANMHDLNWGCSRGHIAELPGVNVLSIATSHENVHKLSEQPTRLLQNLNCVGCPNIRKVFIPSTAHCSRLLFLNLSLSANLKEVDVACLNLSWLNLSNCSSLEVLKLECPRLTSLFLQSCNIDEEAVEAAISKCTMLETLDVRFCPKICSMSMGRLRAACSSLKRIFSSLSSS

SEQ ID NO: 162873 - protein, 130 aa, Glycine max
  Coding DNA Sequence Number=SeqID_71188
  Homolog annotation: Hit_ID=Q9LU39; Match level="QueryCoverage=60%, HitCoverage=24%, E-value=5e-28, Identity=70%"; Hit description =Genomic DNA, chromosome 3, P1 clone: MXL8
MALPCSASVPLTTLTSPLLFMFRKRFGEEVDQDFIYIIAVDRILQLEDIQEDGIWVTSSDYKNAQPDPLRDSAHNLVTEINTNNMEDITRFCNVYVDLDFLVCYYFLVCYYLLLTLSMPNVIKITLLNAN

SEQ ID NO: 162874 - protein, 77 aa, Glycine max
  Coding DNA Sequence Number=SeqID_71189
  Gene Ontology: Mol. function=nucleoside-triphosphatase activity; Cellular component=myosin complex; Biological process=signal transduction
  Homolog annotation: Hit_ID=A7P4U3; Match level="QueryCoverage=85%, HitCoverage=6%, E-value=9e-17, Identity=52%"; Hit description =Chromosome chr4 scaffold_6, whole genome shotgun sequence
  Pfam annotation: Domain name=DIL; Domain location=6-75; Score=0.4; E _value=0.0027; Accession=PF01843.10; Description=DIL domain
MDHLRKVLRDTGAYVNCLLRRECCTFSNGEYVKSGVAELEKWIVNATEEVIHQKRKKSLEEIRLDLCPAKHLTWELG

SEQ ID NO: 162875 - protein, 95 aa, Glycine max
  Coding DNA Sequence Number=SeqID_71190
MCKARLEWKPHTLMKGVFWRVYGWMMMPSSTLNISERSLELWRSNTIVEKVANEEERFDEKRKQVPRISATTKKVHPGGGRFSLFPQPCSGYHVK

SEQ ID NO: 162876 - protein, 371 aa, Glycine max
  Coding DNA Sequence Number=SeqID_71191
MDILIPLPLRWSYYLILSVNGHHMWSLDDLTLKAMGLQLLLHVDPSNGNLDVLIGEKGFLVCTGDGLNGCGVGVEVASLSDDLLSDLSLTPSNWSVDFFFFFFFLGFLLGMDFALLLSKDPLNLFGKSKGLQSFVFISNNPGQLILPPLLDIILIYWKNMHVSPYVNLHFLQVENTKALLSDNESSLADCEMLGVLVQSFEDMEYLVFLKEIVDKGNIVDVIYSSQDLHVVLNLLFPIYLFGILPIESFCNVALICLLPVFLVRVSFPDAPSDLCDGLHGQHDFFSKNLGHNGLSILKLSIPPEHPDELWIYLLWIIEAKTLQHVDVEEMFNVNNRSPSVWMVMVSVVMVMVVVAGAMFSLNFDMVTKEKD

SEQ ID NO: 162877 - protein, 42 aa, Glycine max
  Coding DNA Sequence Number=SeqID_71192
MYPPPSSQYNYPQVDVPLCLYHKGCTLQCVGTKNSQAELMKH

SEQ ID NO: 162878 - protein, 108 aa, Glycine max
  Coding DNA Sequence Number=SeqID_71193
MQSLQGLGLPSIKSMDEFDTQVAWPRAQTSPSGGGGASTAQEPEPEEPASATEEPAEGEDELTPPETFYYDTDVHMAQEETSTDQIPKPSHAPAPKETLLSSPVMEPE

SEQ ID NO: 162879 - protein, 58 aa, Glycine max
  Coding DNA Sequence Number=SeqID_71194
MTFGGLYGLQTYVGERFDALEQQVDMRFDAINSRITKVEEDVTIICDCLDLPLPPPSV

SEQ ID NO: 162880 - protein, 132 aa, Glycine max
  Coding DNA Sequence Number=SeqID_71195
MAAQLIHDRVVMVCLEGVWETLEGNERCRFRGTIRLTATSLVHLEEPTRTLQQPVEWILPTPTPYRLVEPFQVIEVSSSEEDPEEDPEELPPEPVVDALDFPKDDEDPLPEVDSPEDIMSASEADSTEESDP

SEQ ID NO: 162881 - protein, 94 aa, Glycine max
  Coding DNA Sequence Number=SeqID_71196
MYKDNWTQPWPMGSEIYPEVHENSRAFFSSFSPILLEPPANGSSDWSLPREDCITLSAARAKRKSRLIMRSAPWPSILVAMNNAWRHRVTLSQG

SEQ ID NO: 162882 - protein, 173 aa, Glycine max
  Coding DNA Sequence Number=SeqID_71197
  Subcellular localization annotation: CTP_CleavageSite=32; ConfidenceScore=5.04e-01
MVEPSKKRKGTSSRSQRHFQSQETPIPSSIPSGSLFSSEEQLIRYTNLFSSRSIIDPKFIDMDFFSNESFECIQAFENSNLIPFMSLKLHVYSDLVKAFYSNLEIQEGTLISEVYGIKMVIDQSLFYDLTQLPREGVPFEGTLIDDWKFDFSVHDARRLVCTNQADMTGRLFA

SEQ ID NO: 162883 - protein, 144 aa, Glycine max
  Coding DNA Sequence Number=SeqID_71198
MDRRPLPSFGQMESAAARKPRVRVSERRPIESLTYFFPKKKKSAGAWASNPCTRVVKRGEGEVFLHQKLPPPHSKARAHRFHEFATLRSPFFAFLIPFCTIIHLQQGVVRDGPRPMVHSEAMGHATLPPFPCYSCLNMRPPSAR

SEQ ID NO: 162884 - protein, 139 aa, Glycine max
  Coding DNA Sequence Number=SeqID_71199
MKLVRFRRRCCYWWRHFNLLARPQDSEWRLLSLAEIAYSGWSFASLTPLRKVEKGPQFLVVFVVVVAATELEEEHMACLDQQHSGKEGQTVVVVEDLPISDLDDSSNLDCICCLKDHNYSAVIDFAAEGVYCKCLQHRL

SEQ ID NO: 162885 - protein, 282 aa, Glycine max
  Coding DNA Sequence Number=SeqID_71200
  Gene Ontology: Mol. function=helicase activity; Biological process =viral genome replication
  Homolog annotation: Hit_ID=Q9C7W5; Match level="QueryCoverage=89%, HitCoverage=34%, E-value=1e-47, Identity=38%"; Hit description =Putative uncharacterized protein F15H21.18
MKLNQLMHDLKSGHVFGPILAFVYTIEWQKRGLPHAHILIFLHPSNKYPNPEDIDNIISAEIPNKDTDPELYQIVSNHMMHGPCGLANKRAPCMANGKCFRYVSAPEACWKIFAFPMHGRALAVEHLYFHLENQQPVYWKDSQEIGTVLAKSTIKESICWKPRKQGNTIGRLIWVPLSSGELFYMRMMLSSTKGSQCYEDIRIVENVVYHTFREACFAKGFLGSDQEFVGALREANTWGTPHYLRKLFVKLLFMNTMDRPEYVWKQTWQWMADDIVFNHQRQ

SEQ ID NO: 162886 - protein, 149 aa, Glycine max
  Coding DNA Sequence Number=SeqID_71201
  Homolog annotation: Hit_ID=A6X4J4; Match level="QueryCoverage=100%, HitCoverage=37%, E-value=9e-81, Identity=99%"; Hit description =Polysaccharide pyruvyl transferase
MPVVMLGIGIQNRPDIEGEDGLPAGTKKLLEVLKSREHYFLTRGENAAGYLRDQGFSYVRPVGCPSLYFRPDNMRKAISRLPDVKVGEGRTVFTGYMGAELETIGDMNALSSDDGRSAYVVQDELLHFDMQLESDANGRAYDSTTGELV

SEQ ID NO: 162887 - protein, 212 aa, Glycine max
  Coding DNA Sequence Number=SeqID_71202
MAPRKLASKRSRKDKAAEGTSSAPEYDSHRFRSTEHRQRFEAIKGWSFLRERRVQLRDDEYTDFREEIVHRRWTSLVTPMAKFDPDIVLEFYANAWPTEEGVRDMRSWVRGQWIPFDADAISQFLGYPLVLEEGQECEYGRRRNRSDGFDEEAIAQLLCIPGQDFARTAAGRRVRIMRTNMTTLTQIWMTLLLSNILPCDHNSDLPLPKCQL

SEQ ID NO: 162888 - protein, 131 aa, Glycine max
  Coding DNA Sequence Number=SeqID_71203
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=64%, HitCoverage=70%, E-value=3e-24, Identity=70%"; Hit description=LacZ protein
MKTAKGNNFSRSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRRGTATLASADVRRCFCRYAPPRQ

SEQ ID NO: 162889 - protein, 267 aa, Glycine max
  Coding DNA Sequence Number=SeqID_71204
MQRIRFQRRTVGRFGDAVERPHAEEIDADGNQQHRDHHRRGDDLMRLPEQAAAGLIDNPTGGAQQQQHLKQRRQVFHLAVAEVVIVIGGLIADAHRQPGDAGGDKIGERDNCQTTAISSILPENVSMRLAGAVDKGGDKRRRHHRRIDAEPFQQHRNDRRDNRTPHGDRHQRQADHQRHLHADAHDPGAHPGRQANGDGDQQRGRDLFADHRAKIAQADLAQRHGPHQRRGDLGAAVAAGADQQRDKERQRDRRFELLFKRLEHVAG

SEQ ID NO: 162890 - protein, 378 aa, Glycine max
  Coding DNA Sequence Number=SeqID_71205
  Gene Ontology: Mol. function=transcription factor activity; Cellular component=cytoplasm; Biological process=regulation of transcription, DNA-dependent
  Homolog annotation: Hit_ID=A8G8B1; Match level="QueryCoverage=58%, HitCoverage=70%, E-value=1e-111, Identity=86%"; Hit description =Transcriptional regulator, LysR family
  Pfam annotation: Domain name=LysR_substrate; Domain location=152-358; Score=168.1; E_value=2.4e-47; Accession=PF03466.11; Description=LysR substrate binding domain
MVQNGHVRFSRSYSLCDSRSNRFTFIQRAILPCAERVSWIKVKWPSRLTEMFSRPDVYTAIICGYCMCLKRNLFNLDVKDSHDRTQTPADAAGVTAHRLAGCRRRPASSDAIGVVSPVQRPGTAAGLPAGEILLQLAEQILPQIQQALQACHEPHQTTLRIAIECHSCIQWLTPALNNFRQSWPQVVMDFKSGVTFDPQPALQQGELDVVLTSDILPRSGLFYAPMFDFEVRLVLAPDHRLAQLAHITPEDLADEVLMIYPVQRQRLDVWRNFLQPAGVSPALKSVDNTLLLIQMVSAGMGIAALPHWVVESFEHQGLVVTRTLGDGLWSRLYAAMRDGEQRQPVLEAFVRFARQHACEHLPYVRDASRPGSLQPVSP

SEQ ID NO: 162891 - protein, 91 aa, Glycine max
  Coding DNA Sequence Number=SeqID_71206
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 162892 - protein, 188 aa, Glycine max
  Coding DNA Sequence Number=SeqID_71207
  Gene Ontology: Mol. function=nucleoside-triphosphatase activity
  Homolog annotation: Hit_ID=Q6A8Y5; Match level="QueryCoverage=36%, HitCoverage=5%, E-value=3e-10, Identity=58%"; Hit description=ATP -dependent helicase HrpA
APVASVSISCPPVQLLTGWCVTAKAPPDISAGKCSGHAARRVPFAIQAAQLLGRAIGAGLFAITPAGERGMCCKAIKLGNARVFPEFDLSRVVAARQALATVSDPAIHADIVAQIDDLVFEIKLIDTVDLEGGPVGKPVVPAALMNRPTRGERRFAYWALAECILAYYVGTDEGVSEVLHVAGEKRLH

SEQ ID NO: 162893 - protein, 81 aa, Glycine max
  Coding DNA Sequence Number=SeqID_71208
ITPTKVHQPPFLREYDSNAMCACHGEAPGHSIEHCRGLKRKVQDVSNDSSGFSTFTGIGCKPLVYLLKRPVTIQSEITRLA

SEQ ID NO: 162894 - protein, 158 aa, Glycine max
  Coding DNA Sequence Number=SeqID_71209
RVPFAIQAAQLLGRAIGAGLFAITPAGERGMCCKAIKLGNARVFPEFDHVRGSERDTERLAAYGWACCGGVKIPSAHTNSQPPLVVRVAAISSSEKPPKAAYSRLSLPHGQLLSRKQLFSLCCVRTGSSGLKQEVTELATTEASNLGCMGARISIVAL

SEQ ID NO: 162895 - protein, 69 aa, Glycine max
  Coding DNA Sequence Number=SeqID_71210
MMASRKRKAPSTPTQVRFDKSRFTSQEAWERYIDIIVPRKLLQERNVVVYYTEFDEFKEELKDATGTTS

SEQ ID NO: 162896 - protein, 202 aa, Glycine max
  Coding DNA Sequence Number=SeqID_71211
  Subcellular localization annotation: CTP_CleavageSite=70; ConfidenceScore=5.59e-01
MQLVVDMKGRPKIMGMSLSSSISTTTKSTRSERCFTFTKTSSITPNGLAMERLANWRVMHVGIISSSPSRQHMERGIKLILALQSMRAFLTATSPMEHSIMTTPGSLCLEAKLHGESKVIQRCFDDNNDDDKGDDKKLKDQSKNNSSESRTIQEFKNQEEFKTQEESLESRIKIQGSRSQESRSRFKTQDSRMKKRLNQDKY

SEQ ID NO: 162897 - protein, 96 aa, Glycine max
  Coding DNA Sequence Number=SeqID_71212
MRAKHEYRHPRLESSADLVRVRRPKSTPATIKRESSQGEKTHRVLDHSNTHPKSENSPLGNSFFSSIIFYSLFSSLLFHQFLNPFSSIRPLIIMRG

SEQ ID NO: 162898 - protein, 101 aa, Glycine max
  Coding DNA Sequence Number=SeqID_71213
  Gene Ontology: Mol. function=transporter activity; Cellular component= outer membrane-bounded periplasmic space; Biological process=transport
  Homolog annotation: Hit_ID=A0W8P3; Match level="QueryCoverage=97%, HitCoverage=37%, E-value=6e-48, Identity=98%"; Hit description=ABC -type amino acid transport/signal transduction systems periplasmic component/domain-like precursor
  Pfam annotation: Domain name=SBP_bac_3; Domain location=13-100; Score= -82.6; E_value=0.016; Accession=PF00497.11; Description=Bacterial extracellular solute-binding proteins, family 3
MPEIKLTGSKGVLKFGTSAVTEPFSFMDASHTVVGLDIEIARYVARKLDMTLEVVNMDFGAMIPALTAGKVDMIGACITITDERAKKVLFSEPYYVKGEFV

SEQ ID NO: 162899 - protein, 89 aa, Glycine max
  Coding DNA Sequence Number=SeqID_71214
MAKRMNNSGRRMSCIEALSESQLAKRIIFTFWLNECDCCGETKRELSLKRKPSCGALDEILRDCEVSRGGGDIPATCISSIFHLFFSLL

SEQ ID NO: 162900 - protein, 183 aa, Glycine max
  Coding DNA Sequence Number=SeqID_71215
MPPNSGGLAGLGWRRHGGRHSHGGRGGYGGVAENGVPPAPHTPTQPRQPHAHAAATTSGSDAPAQTAATSSGSDAPVTNGGLQREVLAEKTKLSRRRRRRSLYNKKRAGLPISLSKFKASSDLLKTKIWKLQKNSGNPKLFKLEKEQIVAEMHNQQSTEVTKKHAEKYSDREATEKFSPENEQ

SEQ ID NO: 162901 - protein, 29 aa, Glycine max
  Coding DNA Sequence Number=SeqID_71216
MPTELLVHPIINQTLLGIHDIISCIFLTN

SEQ ID NO: 162902 - protein, 349 aa, Glycine max
  Coding DNA Sequence Number=SeqID_71217
  Gene Ontology: Mol. function=serine carboxypeptidase activity; Cellular component=extracellular region; Biological process =proteolysis
  Homolog annotation: Hit_ID=Q8VWQ0; Match level="QueryCoverage=83%, HitCoverage=57%, E-value=1e-135, Identity=79%"; Hit description =Putative serine carboxypeptidase
  Pfam annotation: Domain name=Peptidase_S10; Domain location=75-349; Score=221.5; E_value=2e-63; Accession=PF00450.13; Description=Serine carboxypeptidase
MEHCNCYMFTLSLLLLLLLTPPSLSDDLGFDFPAKKLIRDLNLFPSEDVNIVPRHSNSHANKIVEKPLRFPNLVPSDSGISLDDLAHRAGYYLIPHSHAAKMFYFFFESRNSKKDPVVIWLTGGPGCSSELAVFYENGPFKIANNMSLVWNEYGWDKVSNLLYVDQPTGTGFSYSTDKRDIRHDEEGVSNDLYDFLQAFFAEHPEYVKNDFFITGESYAGHYIPAFAARVHRGNKAKEGIHINLKGFAIGNGLTDPGIQYKAYTDYALDMGIIQKADYERINKVMVPACEMAIKLCGTDGKIACTASYFVCNTIFNSIMSHAGDINVGNTIASSSLIYMLVLNVADLSE

SEQ ID NO: 162903 - protein, 216 aa, Glycine max
  Coding DNA Sequence Number=SeqID_71218
  Homolog annotation: Hit_ID=A7PHZ6; Match level="QueryCoverage=70%, HitCoverage=95%, E-value=5e-64, Identity=78%"; Hit description =Chromosome chr13 scaffold_17, whole genome shotgun sequence
  Subcellular localization annotation: CTP_CleavageSite=49; ConfidenceScore=5.63e-01
MLSAIAFGFSANWWLRCHGRTPPPLSFPVSVSYSSSFNSNSTKFNYIHRASSEGLPNELVEDSKFVPLNEEDPIYGPPALLLLGFEADEALKIRQLLKELDGEFLKVIYCTEDMIMRSLWEAMHTTQPNVEDVKIAKSLPRICFLSGLSGEEMMMFIDSFPETGLKPAAFAALVPNSANKPLEELIDEIMGDHEMLKKIFYDCRLENSYEEIGKEI

SEQ ID NO: 162904 - protein, 1787 aa, Glycine max
  Coding DNA Sequence Number=SeqID_71219
  Gene Ontology: Mol. function=binding; Cellular component=centrosome; Biological process=establishment and/or maintenance of microtubule cytoskeleton polarity
  Homolog annotation: Hit_ID=Q8S912; Match level="QueryCoverage=99%, HitCoverage=83%, E-value=0.0, Identity=68%"; Hit description =Microtubule bundling polypeptide TMBP200
  Pfam annotation: Domain name=HEAT; Domain location=1-29; Score=1.0; E_ value=19; Accession=PF02985.13; Description=HEAT repeat
  Pfam annotation: Domain name=HEAT; Domain location=1022-1056; Score =2.3; E_value=12; Accession=PF02985.13; Description=HEAT repeat
  Pfam annotation: Domain name=HEAT; Domain location=1057-1091; Score =7.5; E_value=2; Accession=PF02985.13; Description=HEAT repeat
  Pfam annotation: Domain name=HEAT; Domain location=152-188; Score =32.9; E_value=1.2e-06; Accession=PF02985.13; Description=HEAT repeat
  Pfam annotation: Domain name=HEAT; Domain location=35-70; Score=1.0; E_value=19; Accession=PF02985.13; Description=HEAT repeat
  Pfam annotation: Domain name=HEAT; Domain location=389-427; Score =2.6; E_value=11; Accession=PF02985.13; Description=HEAT repeat
  Pfam annotation: Domain name=HEAT; Domain location=467-504; Score =6.5; E_value=2.9; Accession=PF02985.13; Description=HEAT repeat
  Pfam annotation: Domain name=HEAT; Domain location=571-607; Score =24.2; E_value=0.00049; Accession=PF02985.13; Description=HEAT repeat
  Pfam annotation: Domain name=HEAT; Domain location=613-649; Score =5.0; E_value=4.9; Accession=PF02985.13; Description=HEAT repeat
  Pfam annotation: Domain name=HEAT; Domain location=654-690; Score =8.2; E_value=1.6; Accession=PF02985.13; Description=HEAT repeat
  Pfam annotation: Domain name=HEAT; Domain location=731-766; Score =14.1; E_value=0.21; Accession=PF02985.13; Description=HEAT repeat
  Pfam annotation: Domain name=VHS; Domain location=571-712; Score= -38.8; E_value=0.045; Accession=PF00790.10; Description=VHS domain
  Pfam module annotation: Pfam domain module=HEAT::HEAT::HEAT::HEAT::HEA T::HEAT::HEAT::HEAT::HEAT::HEAT::HEAT::VHS; Domain location=1 -29::1022-1056::1057-1091::152-188::35-70::389-427::467-504::571 -607::613-649::654-690::731-766::571-712
MKVNKLITDVNIAVAVEAVQAIGNLARGLRTHFSASSRFLLPVLLEKLKEKKPALAEALMQTLQAMHKAGCISLIDIVEGRLQVKGFNHWIYRILESTAYFFLIVPHYHGLALFGVFPDVKTATKNKVPLVRSLTLTWVTFCIETSNKVVITKVHKDYVPICMECLNDGTPEVRDAAFSALAGIAKSVGMRPLERSLEKLDDVRRKKLSEMISGSEDAVPGASSAASVQNTRVSASSAETSESVLVKRSAAGMLSGKRPVQSVPAVKKVGVVKLGTNKKTDGVPQVKALKSVEPPEDVEPTEMSLEEIESRIGSLIESDTITLLKSAVWKERLEAISSLKQQVEGLQDLDQSVEILIRLVCTLPGWGEKNVQVQQQVIEVITHISSTATKFPKKCVVLCLSGLSERVADIKTRAHAMKCLSTLSEAVGPGFIFERLYKIMKEHKNPKVLSEGILWMVSAVEDFGVSHIKLKDLIDFLKEIGLQSSNAATRNASIKFLGVLHRFVGPGSKVFLLADIKGFLTDVKPALLSALDTEYEKNPFEGASAVTKRTVRAKDSSSTVVAGGLDSLPREDISGKISPTLLKSLESPDWKVRMESVDAVNKILEEANKRIQATGTGELFGALRGRLLDSNKNIVMASLTAIGNVASAMGQAVEKASKGILSDILKCLGDNKKHMRECVLNTLDAWLAAVHLDKMVPYIAIALMDSKLGAEGRKDLFDWLSRQLSGLSSFAEAAQLLKPASSAMTDKSSDVRKASEACINEILRVSGHEMIEKMVKDIHGPALTLIVEKLKPYGAFQGTFFGSFFFANVGEFVWISSLNSSFFWSLESFESGRAVSVGAISKAKAGKSTANGVSKHGNRAVSSRVVATKGAKSESISVQDIAVQSQALLNIKDSNKEDRERMVVRRFKFEDPRIEQIQDLENDMMKYFREDLHRRLLSADFKKQVDGLEMLQKALPSIAKEVIEVLDILLRWFVLQFCKSNTTCLLKFSSFPFLPCHGDVLEFLPELLDTLKDEGYSLTESEGAVFLPCLVEKLGHNIEKVREKMRELTKQFVAIYSACKCFPYILEGLRSKNNRTRIECADLVGFIIDHHGAEISGQLKSLQIVASLTAERDGETRKAALNTLATGYKILGEDIWRYVGKLTDAQKSMLDDRFKWKVREMEKKKEGKPGEARAISRRSVRENGSDVAEQSGEMTRSLAGPILRKNYGQPDSNIDRQLMPRPMTVASGPTDWNEALDIISFGSPEQSVDGMKVICHELAQATSDPEGSAMDELVKDADRLVSCLANKVARTFDFSLTGGASSRSCKYVLNTLMQTFQNKRLAHAVKESTLDSLITELLLWLLDDRVPHMDDGSQLLKALNVLMLKILDNADRTSSFVVLINLLRPLDSSRWPSPASNESLASRNQKFSDLVVKCLIKLTKVLQSTIYDVDLDRILQSIHLYLQDLGMEEIRRRAGADDKPLRMVKTVLHELVKLRGAAIKGHLSMVPIDAKPQPIILAYIELNLETLAAARMLTASGPGGQNHWGDSATNNSASGTHSADAQLKQELAAIFKKIGEKQTCTIGLYELYRITQLYPKVDIFAQLQNASEAFRTYIRDGLAQMEKNAAAGRTPSSLPMPTPPPASLNISSPDFAPLSPVNANPLGDAKLNVKPEPTNFNLPPSSYNEENRAVNAITSRALNSDYTLGDQRNDRFMTGVTSGTLDAIRERMKSMQLAAAAGSTESGGRHLTSANDNFNQGLPPPSQIPHASEHVGTENTMHGGVLPMDEKALSGLQARMERLKSGSLEPL

SEQ ID NO: 162905 - protein, 698 aa, Glycine max
  Coding DNA Sequence Number=SeqID_71220
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=88%, HitCoverage=98%, E-value=0.0, Identity=75%"; Hit description =Chromosome chr13 scaffold_17, whole genome shotgun sequence
  Pfam annotation: Domain name=Arm; Domain location=376-416; Score =54.0; E_value=5e-13; Accession=PF00514.14; Description=Armadillobeta- catenin-like repeat
  Pfam annotation: Domain name=Arm; Domain location=417-457; Score =29.1; E_value=1.6e-05; Accession=PF00514.14; Description =Armadillobeta-catenin-like repeat
  Pfam annotation: Domain name=Arm; Domain location=458-498; Score =32.1; E_value=2.1e-06; Accession=PF00514.14; Description =Armadillobeta-catenin-like repeat
  Pfam annotation: Domain name=Arm; Domain location=499-539; Score =10.1; E_value=0.58; Accession=PF00514.14; Description=Armadillobeta -catenin-like repeat
  Pfam annotation: Domain name=Arm; Domain location=540-580; Score =21.1; E_value=0.004; Accession=PF00514.14; Description=Armadillobeta- catenin-like repeat
  Pfam annotation: Domain name=DUF634; Domain location=367-537; Score= -152.3; E_value=0.027; Accession=PF04826.4; Description=Protein of unknown function (DUF634)
  Pfam annotation: Domain name=U-box; Domain location=248-321; Score =91.5; E_value=2.7e-24; Accession=PF04564.6; Description=U-box domain
  Pfam module annotation: Pfam domain module=Arm::Arm::Arm::Arm::Arm::DU F634::U-box; Domain location=376-416::417-457::458-498::499-539::540 -580::367-537::248-321
MGGSESSKGVVMSRLVECIKEISGLPESQNLCKKVYGNLVRRVKLLSPLFEELKDNSDESLSDEQLQSFDSLFVALGSAKTLLKDVNQGSKLYQALRRNDTADKFQKVTEKIEAVLSEIPYNKLDISDEVREQIELVHAQFKRAKAQTEFADIQLDLDMAVAQKEKDPGPAVLKRLSEKLHLRTINDLRKESSELHELFITSGGELGDSFEMITSLLSKLRECVLTENPEVDSSECEKLSVKHRSPMIPDDFRCPISLELMKDPVIVSTGQTYERSCIQKWLDAGHKTCPKTQQTLVHTALTPNYVLKSLIALWCESNGIELPKKQGNCRTKKCGGSSLSDCDRTAISALLDKLTSNDIEQQRAAAGELRLLAKRNADNRVCIAEAGAIPPLVDLLSSSDPRTQEHAVTALLNLSINESNKGTIVNAGAIPDIVDVLKNGSMEARENAAATLFSLSVLDENKVQIGAAGAIPALIKLLCEGTPRGKKDAATAIFNLSIYQGNKARAVKAGIVAPLIQFLTDAGGGMVDEALAIMAILASHHEGRVAIGQAEPIHILVEVIRTGSPRNRENAAAVLWSLCTGDPLQLKLAKEHGAEAALQELSENGTDRAKRKAGSILELLQRMEGEHSHLYSLHHFFNNKLFGLLLACHLPMDKDVLVPVDVLVYRYQFLPLCYNEGPCMPQMGIQAVAVLALHHNTT

SEQ ID NO: 162906 - protein, 442 aa, Glycine max
  Coding DNA Sequence Number=SeqID_71221
  Gene Ontology: Mol. function=pseudouridylate synthase activity; Cellular component=chromatin; Biological process=pseudouridine synthesis
  Homolog annotation: Hit_ID=A7PI03; Match level="QueryCoverage=62%, HitCoverage=67%, E-value=2e-99, Identity=67%"; Hit description =Chromosome chr13 scaffold_17, whole genome shotgun sequence
  Pfam annotation: Domain name=PseudoU_synth_2; Domain location=211 -345; Score=14.0; E_value=3.6e-06; Accession=PF00849.13; Description =RNA pseudouridylate synthase
  Pfam annotation: Domain name=S4; Domain location=149-196; Score=49.5; E_value=1.2e-11; Accession=PF01479.16; Description=S4 domain
  Pfam module annotation: Pfam domain module=PseudoU_synth_2::S4; Domain location=211-345::149-196
  Subcellular localization annotation: CTP_CleavageSite=57; ConfidenceScore=5.63e-01
MGATTAIAALSLHCFSKSHTHFSPFRTLPRLTCSFSSSIKFNISFAPPKPKPKPEPDASNEPDGPLLIPWIVRGEDGNLRLQSEPPPSLLNAIATAQTGTKKDNKQTKTTAATATNTTKPQKARSTAPPQHSKAARRFYNQNIKESSAARLSKVLAASGVASRRSCEELIFEGKVTVNGTVCNTPQTKVDPAKDVIYVNGNRLPKRQPQKVYLALNKPKGYICSSGENESKSVISLFDDYLNSWGKKHPGVPTPRLFTVGRLDVATTGLIIVTNDGDFAQKLSHPSSNLSKEYIATIDGLVHKRHLIAISEGTTVEGVLCVPDVVELLPRQPEMQRTRIRIVFNSWVKEDRVLHCRPGDNFTQHFSLAASRASNRKWKIWWITATISIWNFRNDMIFKNQPFVISKLVDNAIFLTWSWLRGWEKDFAVPFQQWSSSMSLAFT

SEQ ID NO: 162907 - protein, 170 aa, Glycine max
  Coding DNA Sequence Number=SeqID_71222
MCAVKLRRAHTESQFRAYFSLSITASILTETPKTRFNYYDQKKQILIPGHAHTTVELFSNSLARNSHAVQHHRSIRNSEWKTMGGKKALVTIRNTHSELEDLEKIELEIEIIQCVRGESNVSRIQPGAGGVGRTNRKRRIQSVENDAQHTRWRQRVRNSRTETHASRLQE

SEQ ID NO: 162908 - protein, 100 aa, Glycine max
  Coding DNA Sequence Number=SeqID_71223
MASQFESVETTPITNVPLNDTTQPTPEANGHDKDNSKVDEEEEKCVITYKEIEPHYNYAPLPEDWDKVHKVKRVLDAAAEDEDLFMREMTIPIRAKFDKY

SEQ ID NO: 162909 - protein, 538 aa, Glycine max
  Coding DNA Sequence Number=SeqID_71224
  Gene Ontology: Mol. function=DNA binding; Cellular component=nucleus
  Homolog annotation: Hit_ID=A7P8X0; Match level="QueryCoverage=34%, HitCoverage=81%, E-value=4e-22, Identity=39%"; Hit description =Chromosome chr3 scaffold_8, whole genome shotgun sequence
  Pfam annotation: Domain name=Myb_DNA-binding; Domain location=369 -414; Score=29.0; E_value=1.7e-05; Accession=PF00249.22; Description =Myb-like DNA-binding domain
MDPFDDVLPVAPAARSKCFTLFEARPGAKFIPKAKSKQLSPKEIPVFHPANAMHSEDAVHNGTIGKSSGEAADIFSATDTGKPALHSLNEKGAEQNFVTPASSSINSFGNVILPKFKGVPTFHVIYYACQDSNKRKKDGSTSCSLRKNRRSSIAGEGEEDKGGKTSRQLRKQAARKPANSSFNEDVEDNNDLDPPYNSNGDELQENDETMKLIIHPRKKEYQQVHRRNLWLKVEKHLESFFFFIVDKALLEIPEDELDLRQIPIKDIILLEEHREWLAKNEVMTSNTSSTNQSGGDSLHKATAYYLLAVVTVSFESHVDYGGVSLYEAGAYNEGEFSGSEDAYDDQANEGIISTSHLFNHQCLMKKAPGAIWSEQDTQQFYEAVRMTGTIFSLFEPLFPGKTPHQIKLKFNNEDGKYCSRVDDAVYHFAKDHSRDLWIEPVKPVSTKAEEDPGGDASDFVMAEEVVDLTAGTHINADIFGFKAQMAKLLKYVAPREVATTKEDADVKAQEDSVAVHSPEQPDDSDDDFQKWSQYESAL

SEQ ID NO: 162910 - protein, 209 aa, Glycine max
  Coding DNA Sequence Number=SeqID_71225
  Homolog annotation: Hit_ID=Q39872; Match level="QueryCoverage=66%, HitCoverage=76%, E-value=1e-57, Identity=84%"; Hit description=PGmPM3
  Pfam annotation: Domain name=AWPM-19; Domain location=54-171; Score =203.2; E_value=6.3e-58; Accession=PF05512.2; Description=AWPM-19 -like family
MTNHDKCPTTCTRKHTCMTLLIDTCLQGTLKSLYIYGFTMPPSTSNEARRERDCEVEIGARNSPLYLKKFGFGGNGATMFFLTFSILAAVLGIVSKLLGGNHMRTWRSDSLASAGATSMVAWAVTALAFGLACKQIHLGGHRGWRLRVVEAFIIILTFTQLLYLILIHAGLYSSRYGPGYHDTDYGHGHGVGGTTGDPMHKPATAGTRV

SEQ ID NO: 162911 - protein, 147 aa, Glycine max
  Coding DNA Sequence Number=SeqID_71226
  Gene Ontology: Mol. function=isomerase activity; Cellular component =vacuole, cell cycle-correlated morphology; Biological process=cell redox homeostasis
  Homolog annotation: Hit_ID=Q2UKF5; Match level="QueryCoverage=100%, HitCoverage=31%, E-value=2e-73, Identity=90%"; Hit description =Thioredoxin/protein disulfide isomerase
  Pfam annotation: Domain name=Thioredoxin; Domain location=31-140; Score=94.3; E_value=3.9e-25; Accession=PF00085.11; Description =Thioredoxin
MWQPSSALLLVASLLTALPVNADGLYTKKSPVLQVDHKSYDRLIAKSNHASVRFYAPWCGHCQNLKPAYEKAAKNLDGLANVAAVNCDDDENKPLCGRLGIQGFPTLKIVTPSKKPGAPRVEDYQGQRTAKAIVDAVVDRIPNHVKR

SEQ ID NO: 162912 - protein, 88 aa, Glycine max
  Coding DNA Sequence Number=SeqID_71227
  Homolog annotation: Hit_ID=A6H037; Match level="QueryCoverage=100%, HitCoverage=60%, E-value=2e-12, Identity=34%"; Hit description =Putative translation factor
MAWEIIDLSEKPVTIVYENPRGLPEELLAEDGTNFSGDKSPLKFSDISPEIINMVDYAVEEDREKVSKYSGSSVIKIWSDNRIKVLRE

SEQ ID NO: 162913 - protein, 158 aa, Glycine max
  Coding DNA Sequence Number=SeqID_71228
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MFDRRHPEKISPPRKKKCDSPALIENNANRRRPGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 162914 - protein, 132 aa, Glycine max
  Coding DNA Sequence Number=SeqID_71229
  Homolog annotation: Hit_ID=A0ST23; Match level="QueryCoverage=20%, HitCoverage=55%, E-value=2e-08, Identity=100%"; Hit description =Putative reverse transcriptase
RLLFLSAVPPVQLLTGWCVTAKAPPDISAGKCSGHAARRVPFAIQAAQLLGRAIGAGLFAITPAGERGMCCKAIKLVVVVIKLIDTVDLEGGPVGKPVVPAALMNRPTRGERRFAYWALAECILSYYVGTDE

SEQ ID NO: 162915 - protein, 152 aa, Glycine max
  Coding DNA Sequence Number=SeqID_71230
MGNQQRQGYTQGRFSGFQQGPYNQQGQWGTHPDNQFNKDQGGSSNTLTHPNIFQRRTKLEETLTQFMQVTMSNHKITELALKNFEVQVGQLAKQIADKSSNSFGANTENNPKKECKAVMTRSKKFVKAEDEESVVYKEQMGEQIGADVEDHD

SEQ ID NO: 162916 - protein, 205 aa, Glycine max
  Coding DNA Sequence Number=SeqID_71231
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPEFDPFLMENYSVMYTVATDLFLKRPCCLALSREIWLRHRNGIGYPTQFQTALINQAYRYRRPRGGARYQLLFPLVRVNFELGVIMVIAVSFGKPVVPAALMNRPTRGERRFAYWALAECILAYYVGTDE

SEQ ID NO: 162917 - protein, 86 aa, Glycine max
  Coding DNA Sequence Number=SeqID_71232
  Homolog annotation: Hit_ID=A0ST23; Match level="QueryCoverage=31%, HitCoverage=55%, E-value=2e-08, Identity=100%"; Hit description =Putative reverse transcriptase
VHPFAPADQQQGYAELDKQIKLIDTVDLEGGPVGKPVVPAALMNRPTRGERRFAYWALAECILAYYVGTDEGVSEVLHVAGEKRLH

SEQ ID NO: 162918 - protein, 646 aa, Glycine max
  Coding DNA Sequence Number=SeqID_71233
  Gene Ontology: Mol. function=transporter activity; Cellular component= integral to membrane; Biological process=transport
  Homolog annotation: Hit_ID=A7MQ25; Match level="QueryCoverage=36%, HitCoverage=77%, E-value=1e-63, Identity=54%"; Hit description =Putative uncharacterized protein
  Pfam annotation: Domain name=BPD_transp_1; Domain location=21-210; Score=85.9; E_value=1.3e-22; Accession=PF00528.13; Description =Binding-protein-dependent transport s
ARGVSRHAGTVRAGVYAGAAGRDKAISALGAARLLNAGVLAGAAVYPAVFADAGLAAGFRPIRPALSGAEHYCALTHLILPVIVLAVAPTTEVIRLLRNSTSDVMDKNYVKAAATRGLSRFTVIRRHVLHNALPPVIPRLGLQFSTMLTLAMITEVVFNWPGLGRWLINAIRQQDYAAISAGVMVVGGLVILVSVLSDIIGAALNPLKHKEWSQAGVELSNHRLQIMDEADLRDFECYVSVRGDHTKQLENGIMARNIAPGYCVVERAGSLDYQAREIFRDIRSPAVNMFMQLNADTPWLRPGQILIVADPDTPAPLTMQALTTLKQAKSRTNNALIGVNVEEAGFMQKHYGMIAALTSAVDKIFGTAGDAGEKYFNAIEQTLKKIEASYQNQFRTQGTLIGQQFFVERNQLLNQLKELVNKPLLKNLARYSIKFQQYESMKRALNLSSRSIVHEWSTVGIGAIPGYSYYVGNAAKAARFMKMGGFIGIGFSFAGTTNDVVDACSKGREGECGKIAVKDYSKFAFTTGGGMLGGVWGSSAALAGCAAIGIVTAGAGGVACAVVGSVAGGECGKIAVRDYSKFIVGSAGGVVGGAYGGAAMAGVCAAVGIATVGVCGVACAVVGSVAGGYLGSTGAEAIVNKVTELL

SEQ ID NO: 162919 - protein, 215 aa, Glycine max
  Coding DNA Sequence Number=SeqID_71234
MAAGRHHDAQANLRTLNQLHYRGAFHNHPRQHAGFTQLSVEVTPEIARGLGQAQRLIRQRVQRQPLMLQQRREMIGMENRFDAAILKKADTAVHGVAVERFQQLIGAHGGNAIRHAALRHHAQPQRAVDAVFERLHFQLQSLIHRNNFARPRQHAFPFRREAVEVVAAIDQRQPQLALKVFKPHRERGLADEAGLRRAAKMAFALQIAKADCSGG

SEQ ID NO: 162920 - protein, 31 aa, Glycine max
  Coding DNA Sequence Number=SeqID_71235
MVYPGLEDFGDPNESLEKSSLSIPSTSRGGP

SEQ ID NO: 162921 - protein, 79 aa, Glycine max
  Coding DNA Sequence Number=SeqID_71236
MAEPSKKRKGSSSRSQRHSEAQDTPIPFSISSSSLFSSEEQRTRDGVPFEGALDDDWKFDFSVHDARQLVCTNQADMIG

SEQ ID NO: 162922 - protein, 179 aa, Glycine max
  Coding DNA Sequence Number=SeqID_71237
  Gene Ontology: Cellular component=integral to membrane; Biological process=protein insertion into membrane
  Homolog annotation: Hit_ID=Q6ABV5; Match level="QueryCoverage=100%, HitCoverage=54%, E-value=8e-49, Identity=56%"; Hit description =Preprotein translocase, YidC subunit
  Pfam annotation: Domain name=60KD_IMP; Domain location=2-179; Score =47.3; E_value=2.3e-14; Accession=PF02096.11; Description=60Kd inner membrane protein
MMEIAPELRKVQEKYKGKRDQLSREAMSRETMALYKKHGTTPMSSCLPLLVQMPVFFSLFSVLSDVTKHHAAGIGGVGLLNAELTEQFYDAKLFGVASLHETLGNAIDAGNTTAIIILVTLVVLMIGSQFFTQLQIISKNLSPEAKTGQAYQMQKIMLYVLPLGFIFSGIFFPLGVVVY

SEQ ID NO: 162923 - protein, 79 aa, Glycine max
  Coding DNA Sequence Number=SeqID_71238
MEAVHMRLRLSLSSSSDTQSESQQHNNSSVSSYYYLLPQNKNPIFIRKVVAVETMKPSWSMRCGALTTVWVFSQGGREL

SEQ ID NO: 162924 - protein, 183 aa, Glycine max
  Coding DNA Sequence Number=SeqID_71239
  Subcellular localization annotation: CTP_CleavageSite=36; ConfidenceScore=5.19e-01
MHLADRRNPERNLSRKHALSTSSARSTSHLSPSSLSASLALSENSLTRAKHENDAKHDVEELPCYGRLNPQLGILAEGFSIERCIVSLELDRAGLGYRMSGHGVCVCMRRSSPGELVPLDLEIVATFRRNNTERKIKLLHDKTVASILEEAHFFESSSSNSPTSWESQTTEFEVEVMAEEQPR

SEQ ID NO: 162925 - protein, 169 aa, Glycine max
  Coding DNA Sequence Number=SeqID_71240
  Gene Ontology: Mol. function=ammonium transmembrane transporter activity; Cellular component=membrane; Biological process=transport
  Homolog annotation: Hit_ID=B0KQ46; Match level="QueryCoverage=91%, HitCoverage=34%, E-value=4e-60, Identity=76%"; Hit description =Ammonium transporter precursor
  Pfam annotation: Domain name=Ammonium_transp; Domain location=1-168; Score=-112.5; E_value=1.6e-06; Accession=PF00909.12; Description =Ammonium Transporter Family
MAPHNLGYTLMGAAMLWVGWFGFNAGSAAAANGTAGMAMLVTQIATAAAALGWMFAEWIGHGKPSALGIASGVVAGLVAITPAAGTVGPMGALVIGLVSGVVCYFCATSLKRKLGYDDSLDAFGVHGIGGIVGAILTGVFAAPALGGFGAVTDIGHAGLDPGQGRDLHR

SEQ ID NO: 162926 - protein, 138 aa, Glycine max
  Coding DNA Sequence Number=SeqID_71241
  Gene Ontology: Mol. function=transcription factor activity; Cellular component=nucleus; Biological process=regulation of transcription, DNA-dependent
  Homolog annotation: Hit_ID=Q5BGV7; Match level="QueryCoverage=45%, HitCoverage=12%, E-value=2e-14, Identity=63%"; Hit description =Putative uncharacterized protein
  Pfam annotation: Domain name=Zn_clus; Domain location=5-37; Score =15.9; E_value=0.0018; Accession=PF00172.9; Description=Fungal Zn(2) -Cys(6) binuclear cluster domain
MRYNSRLKVRCSGEKTGCQRCANLGSECIFSISRIGKVPGKRSKANRAAAAAAAAAAVTAPPSSISLTSPSRLESANGTITAFQPFSNAIKDEGGSGVTPSARHVPSNFAVDPMITPLMVHDYSSSIPFYSGASYAPD

SEQ ID NO: 162927 - protein, 268 aa, Glycine max
  Coding DNA Sequence Number=SeqID_71242
  Homolog annotation: Hit_ID=A1FYG9; Match level="QueryCoverage=91%, HitCoverage=40%, E-value=1e-80, Identity=65%"; Hit description =Putative uncharacterized protein precursor
LSPGEIASLLERTAQVHWNYDGRYYFISNNCAVETAKLLQAGVPRLGEAGLAQLSPRGLKRRLVRLDVLDEGVLTDRNAAQAQGYYFASARDHYQQLFAVASSQLGLPVRDVRGWLTLPAPQRAPWLLQGDLRASAGLLLVEQAAQRRAQVRARDVLKRRLLAAPDSAETRGLRQLLEQGGQWLRPGTLLADGGYGLPLVDEQVVLAEAVATASAQAVPAWQALRVQLRQQLPAGQRNEMDAIDANLAALGARLRQQAAAPATGAAVR

SEQ ID NO: 162928 - protein, 91 aa, Glycine max
  Coding DNA Sequence Number=SeqID_71243
EFNIHLGSTFQPAIQSPKLKFTIDTIIRKPKSSRKGSYLAHGLKINPKAHENPRAFPWISGPIYLESSIQCPCGVGLHQILEKIVQPNKKD

SEQ ID NO: 162929 - protein, 74 aa, Glycine max
  Coding DNA Sequence Number=SeqID_71244
  Homolog annotation: Hit_ID=Q1DJ32; Match level="QueryCoverage=83%, HitCoverage=10%, E-value=8e-08, Identity=41%"; Hit description =Putative uncharacterized protein
MQPKQTLSATAISGQTFDYIVCGGGTSGCVIAAGLASIPDVSVLLIEAGRDSGLAPDVLVPGKYVKQLQDKDGL

SEQ ID NO: 162930 - protein, 79 aa, Glycine max
  Coding DNA Sequence Number=SeqID_71245
  Homolog annotation: Hit_ID=Q2UUF1; Match level="QueryCoverage=100%, HitCoverage=17%, E-value=1e-28, Identity=83%"; Hit description =Permease of the major facilitator superfamily
MANDAEERAIVTASMNAIGQAMSAWTQLLQYPAAEAPNFRGGFISNLATTVAQLAVVAIMVLLTRWDARKTRGSNVSAI

SEQ ID NO: 162931 - protein, 170 aa, Glycine max
  Coding DNA Sequence Number=SeqID_71246
  Homolog annotation: Hit_ID=O64438; Match level="QueryCoverage=24%, HitCoverage=17%, E-value=3e-13, Identity=80%"; Hit description=ARG10
MKAVAGLTQLNNAKPIADSSFSKTKPEDSLDSQFKPPEASQLLCHSLEGNAGALTNFEVLDFLRAKGASKDPTRVIAKVAQSEHITRCFYSTAVGGLRCYENPKNKITAVPAEEEQIWGAFFRNRESVISPNSNIRLMSVETALGTNGKCEVRDNRIGVHKKPTHTAKFH

SEQ ID NO: 162932 - protein, 235 aa, Glycine max
  Coding DNA Sequence Number=SeqID_71247
  Gene Ontology: Mol. function=sodium:dicarboxylate symporter activity; Cellular component=membrane; Biological process=dicarboxylic acid transport
  Homolog annotation: Hit_ID=P77529; Match level="QueryCoverage=100%, HitCoverage=52%, E-value=8e-98, Identity=79%"; Hit description =Uncharacterized symporter ydjN
  Pfam annotation: Domain name=SDF; Domain location=1-234; Score=-86.4; E_value=1.9e-06; Accession=PF00375.9; Description=Sodium:dicarboxylate symporter family
  Subcellular localization annotation: CTP_CleavageSite=59; ConfidenceScore=5.11e-01
MPLVFASILSAVARLHNATQLGKISFLTIGTLLFTTLIAALVGVLVTNLFGLTAEGLVQGSAETARLTAIQTNYVGKVADLTVPQMVLSFIPKNPFADLTGANPTSIISVVIFAAFLGVAALKLLKDDAPKGERVLTAIDTLQSWLTPYGVLALMTKVVAGSNLQDIIKLGSFVVASYLGLGIMFVVHGILLGVNGVSPLKYFRKVWPVLTFAFTSRSSAASIPLNVEAQTRRLG

SEQ ID NO: 162933 - protein, 152 aa, Glycine max
  Coding DNA Sequence Number=SeqID_71248
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=74%, E-value=4e-25, Identity=67%"; Hit description=LacZ protein
  Subcellular localization annotation: CTP_CleavageSite=14; ConfidenceScore=5.44e-01
MTMITPSSKLTLTKGNKSWNNHQTSILTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 162934 - protein, 293 aa, Glycine max
  Coding DNA Sequence Number=SeqID_71249
  Gene Ontology: Mol. function=nucleotide binding; Cellular component =intrinsic to membrane; Biological process=defense response
  Homolog annotation: Hit_ID=Q2HVE0; Match level="QueryCoverage=73%, HitCoverage=21%, E-value=2e-18, Identity=30%"; Hit description =Leucine-rich repeat; Leucine-rich
  Pfam annotation: Domain name=LRR_1; Domain location=157-178; Score =3.0; E_value=84; Accession=PF00560.24; Description=Leucine Rich Repeat
  Pfam annotation: Domain name=LRR_1; Domain location=44-65; Score=5.0; E_value=37; Accession=PF00560.24; Description=Leucine Rich Repeat
  Pfam annotation: Domain name=LRR_1; Domain location=67-89; Score =12.0; E_value=1.9; Accession=PF00560.24; Description=Leucine Rich Repeat
  Pfam module annotation: Pfam domain module=LRR_1::LRR_1::LRR_1; Domain location=157-178::44-65::67-89
MSKLQFLHFPHHGCVDNFPHRLQSFSVELSRVEKLWDGVQNLKNLKEVKVSGSKNLKELPNLSEATNLEVLDISACPQLASVIPSIFSLTKLKIMKLNYGSFTQMIIDNHTSSISFFTLQGSTKHKLISLRSENITVGPFRCICYKEKPSSFVCQSKLEMFRITESDMGCLPSSFMNLRRQRYLRVLDPRELRMIESGSVDVIDCKSLKHVLVLAEQFKYISSGVGFQNYQGLVEESVVVALDAISSTVETVFDHSELIDDKRYISIDERKLKPVKRIDEYLMKVLGPQQCFE

SEQ ID NO: 162935 - protein, 232 aa, Glycine max
  Coding DNA Sequence Number=SeqID_71250
MEIIISVPLITCDFCRREHYQDNCYMYSTNNSGWRQLTPYNQYEEQRVPDLDIVFAEFMAYHASSKANHNAIQKQEIQCAKVFFEDYQGEPESQFYYQNELERSFNLDILLMQFKDTIGSIQRAFKSAEIQVGKLVEEVTQAMSRREEEIVKVDTQEESPVNEHDLEEEDKEKAQQWKQCLPPHTQQEDNFQVNTCSHQLTIKEERHEDHEASIILGQPCLTFASCVFDMGK

SEQ ID NO: 162936 - protein, 78 aa, Glycine max
  Coding DNA Sequence Number=SeqID_71251
MNKLQKNVERRTRERFDEIQRSTQELSEIMEDIERRRHHRSPHSSQGSDDGYEEGRRHRHMRNMDGMDDMKIKIPKFL

SEQ ID NO: 162937 - protein, 293 aa, Glycine max
  Coding DNA Sequence Number=SeqID_71252
  Gene Ontology: Mol. function=transporter activity; Cellular component= integral to membrane; Biological process=transport
  Homolog annotation: Hit_ID=Q57IP6; Match level="QueryCoverage=18%, HitCoverage=12%, E-value=2e-11, Identity=61%"; Hit description =Putative MFS family transport protein
CAGGDIDMKLRGEMLQHRQLLFQQAADLRIGIAELAYRTGQHPDQQQHHNEDHRDHQRDRHAAPQTPAHQQGHQRIKHNRQEAGDEANPISTAGDTAISPPRIDGAHGEKRRIILSIVKFNFATYLTIGLPLAVLPGFVHDGLGYSAFWAGVPGERAVYFAVGADRGAGGAQPGAAVPRARAAGRRAEFLRHRHLAVGRGESRLAAYWSGDLLERHCHLWRNGDWRTAWSDDLSQRRPAAALQRDYRHQRAGDSAGAAPRAGERQQGQTAAVPCGARQGVRFWPAAGDGLGGL

SEQ ID NO: 162938 - protein, 170 aa, Glycine max
  Coding DNA Sequence Number=SeqID_71253
MACRDHHGHPHLFYYPETIKSDETNYGHLPLFKDDSVFSQCMLSKGDNDFHLHFEDDNVFSHCMLSKGDNDPHLHFKDDNVFSHCMLSKGDNDPHLHFEEDNVFSHCMLSKCDNDPYLHFEDDNVFSHYMLSKGDNDPHLHFKDDNVFSHCMLLKGNNDPHLHFKDDKCL

SEQ ID NO: 162939 - protein, 134 aa, Glycine max
  Coding DNA Sequence Number=SeqID_71254
  Gene Ontology: Mol. function=protein serine/threonine kinase activity; Biological process=protein amino acid phosphorylation
  Homolog annotation: Hit_ID=Q6ULS3; Match level="QueryCoverage=69%, HitCoverage=32%, E-value=6e-26, Identity=64%"; Hit description =Phosphoenolpyruvate-carboxylase kinase
MAFCTQTYCIELHRAAELKHTAWRRLLRHVVPVSPVVFFGRHQPDRVFFFFFQRKVSDIIFYQMLVGFVPFRGDSPMEIFEAVLRANLRFSTHVFCSISPTAKDLLRRMLCKELSRRFSIEQVLKMSCIFSGEG

SEQ ID NO: 162940 - protein, 43 aa, Glycine max
  Coding DNA Sequence Number=SeqID_71255
MESLDEDDSVDGISDTDDEVTDMIQPVTIVHPTEGVEGIQNSS

SEQ ID NO: 162941 - protein, 64 aa, Glycine max
  Coding DNA Sequence Number=SeqID_71256
MDKSLKVGKDGWRDRERRSTKFCASNEKEEMLFDASDGFRDWGANAFQEGGNDVDIKAQAHYNH

SEQ ID NO: 162942 - protein, 82 aa, Glycine max
  Coding DNA Sequence Number=SeqID_71257
MGSEIYPKVHENPRAFFSSSSPILLEPLAHGSSDWSLPREDCIIYKRNKKIKVAPPIQCMVVHYSIIETRGKNRFFPMRFKP

SEQ ID NO: 162943 - protein, 89 aa, Glycine max
  Coding DNA Sequence Number=SeqID_71258
MNAHPVSKPNPHDLLAFEENMFNSFFNLFTTRAYWINVGHLPLEVLSNWDNILTSSWVPFVQIGLKLDGSQVLQHIPLLRILPNELILI

SEQ ID NO: 162944 - protein, 119 aa, Glycine max
  Coding DNA Sequence Number=SeqID_71259
MSGGKGREGARNFMPQMSPLIQDQVQDSPLSVLRCHEASYGLEIYPKAHENPRAFSCISGPIFLESSIQCPWGGGGDYHQLDGSQHFLLDVMNTQMQRLLNRNNEDLYGQIEGLENQLN

SEQ ID NO: 162945 - protein, 321 aa, Glycine max
  Coding DNA Sequence Number=SeqID_71260
  Pfam annotation: Domain name=zf-CCHC; Domain location=79-96; Score =14.1; E_value=0.011; Accession=PF00098.14; Description=Zinc knuckle
LKRFVKFLNDKLLKNQEVKGQPQDVVKLHEEIRTLKTTLAKFVNGTNNLNKLLGYCRCSLDKFGNGYDGKVYVHDKDTIVCYFYGKTGHMTFKCKDRLKKDVLDNKKQTLIMVLGQWLLMTHDTRKVYVPMLDSLSWWNNHFRRKSKGKDNHSGGYNVSFNKDECAILCKDGSPLFNAKRKGNLYKIRLGDLTDQKNLPFDLPHTIYIKILRNLKGVGGLDDIYYAALINKMLWDQGVYHVFNKMDDDSKHTLIDKGLAIAKQKKFSQTNLKSRKVALEQSQKKAPQVDLDAINKRKQKRLAKAIADKDQGLKNFGISKKI

SEQ ID NO: 162946 - protein, 186 aa, Glycine max
  Coding DNA Sequence Number=SeqID_71261
  Subcellular localization annotation: CTP_CleavageSite=48; ConfidenceScore=5.10e-01
MTNCLNSFMSPFSLSKRIQKDTDTSFAVKVEGTSTWVVVTENKKGYISCGSVQVEGTSTRLFKENKGGYIPCGSLLVKVFTRLKAISRTAGCLGIGCRHGSPTGNLVPLDLEIEATLRRNWDESRRKLLQDRTVTSILEEETHFSDSLSPDSPSSRESATQFPEATIMADEQHQRITLEDYSSSSV

SEQ ID NO: 162947 - protein, 40 aa, Glycine max
  Coding DNA Sequence Number=SeqID_71262
MVVGILNKAQVEKDEGLKGGSVSGGDSPMELASWTRGGTW

SEQ ID NO: 162948 - protein, 149 aa, Glycine max
  Coding DNA Sequence Number=SeqID_71263
  Subcellular localization annotation: CTP_CleavageSite=74; ConfidenceScore=5.03e-01
MYPPLFSLNNLVDVPSTRTNPQEMYHLLFSVTTTQVDVSSTCTTKDGKRRIKRILRMCRFEFFDKGEGRHKRIQAKTLESFLQRKKKKKKKKKKKKKKKKRFKGCKRICGKVVCKGCKYCKFSSNANQGIAFIDSSSLVKKIIGRVITF

SEQ ID NO: 162949 - protein, 210 aa, Glycine max
  Coding DNA Sequence Number=SeqID_71264
  Subcellular localization annotation: CTP_CleavageSite=56; ConfidenceScore=5.11e-01
MGKGWGPGTTGAGYTGKSYHSAAPDPYGWPPSGQPNAACRAPSSACELRWTLEMVAAVEVAGGGVRLWPAVATGPTPAPVSALACNELYGSNQHPIELAETCDQGRKSQCSVGLFWVHWMPWRRDTYKLINTDLGQNSIDQLAFRQQEIRIMVAGKDVAKEKRHPDLCQGGHASTCDPHPPSITLRAKSCPREHNSLLMVSSSNAETFSR

SEQ ID NO: 162950 - protein, 61 aa, Glycine max
  Coding DNA Sequence Number=SeqID_71265
MGLGSERGRLGMRGVGEGKKGKREEVGRRRETKEGELKKTCTFVYRHFSPVHFDFMGKREK

SEQ ID NO: 162951 - protein, 71 aa, Glycine max
  Coding DNA Sequence Number=SeqID_71266
MEHTSIRKEDKISMIVNSVIASMEKPLPCQIEHYFLFPQHGIHLYQQEMNEATEVWMMPLPKREDKSGLTP

SEQ ID NO: 162952 - protein, 81 aa, Glycine max
  Coding DNA Sequence Number=SeqID_71267
MNGGHRTESSTPRQGSVYLDTCDTWKQVVPCQRSIDMHTQCPKRNTRSASSHAMHPTILFHSPGYYLFVWMQNLPASAPDC

SEQ ID NO: 162953 - protein, 129 aa, Glycine max
  Coding DNA Sequence Number=SeqID_71268
MRRPIASTRRQRQQERVVEDPPTIAKELNEEQPEAPIEEVVTDVEGFLGGPHDTSVLIDFENHIALRVWNREESPELKLSSHGRKMTKFGRPALEIEGLVAASGLSPLIACSLDTGDRRLMSAFCGMLA

SEQ ID NO: 162954 - protein, 109 aa, Glycine max
  Coding DNA Sequence Number=SeqID_71269
MESESVVAYCSGDITSSSEEMLFECPSGSKVVTISEDMSLDALRKTYMDAIGGCKILLDLFYHQSNYLRDGCVKYECMELKHDSSSFVSVCLSYPQVLMPHAAIAKLVE

SEQ ID NO: 162955 - protein, 102 aa, Glycine max
  Coding DNA Sequence Number=SeqID_71270
MIEHVADLDVHGPIRPYEHVARGAFHHGIHHLLRSPVRFETLSEIGDSPTTINRTTGAIGEHDSDTALSLSLSLSKETKIDARVWWIPLLRERFGMGLELEV

SEQ ID NO: 162956 - protein, 28 aa, Glycine max
  Coding DNA Sequence Number=SeqID_71271
MDVLAEMLNALDPSNKEGVEKCLWDKAK

SEQ ID NO: 162957 - protein, 77 aa, Glycine max
  Coding DNA Sequence Number=SeqID_71272
MWFEDELGRSKWVCNTPMNHAKKRQIQRLCRKRVRGQSTLKVSCWFVRIVIALKAVKEDCLGLEKDYLRRILTGRGF

SEQ ID NO: 162958 - protein, 165 aa, Glycine max
  Coding DNA Sequence Number=SeqID_71273
MSASDRVHQPTKKSLLELSSQDTVLAQNKLLSRKLEILTETLSCTICGGTYESGLCIPFEEQMQEGPYNQQGQWRSHPGNQFNKDQGGPSNRPSQQGPNIFQRTTKLEETLTQFMQVTMSNHKSTELALKNLEIQVGQLAKQLAEKSSNSFGRTRKRIPKRNALL

SEQ ID NO: 162959 - protein, 67 aa, Glycine max
  Coding DNA Sequence Number=SeqID_71274
MKKIKGLQAPHRSYIMWCQEHLRRGLRSSSSMDSFASWKMNDSGIEKEDREEMPLQGEDESRRSSPP

SEQ ID NO: 162960 - protein, 118 aa, Glycine max
  Coding DNA Sequence Number=SeqID_71275
MELGLRCNALNGSLSKVALGMTLREEPLSMSTLAPMLSKHLTDTCIVSPALDEYLFVSESEVIVGRDVIDYTLETLHGYVLCYVSRLIRQALKSVVFHLLAKPICWLSERPLSATLMG

SEQ ID NO: 162961 - protein, 106 aa, Glycine max
  Coding DNA Sequence Number=SeqID_71276
  Gene Ontology: Mol. function=phosphoprotein phosphatase activity
  Homolog annotation: Hit_ID=A7PHV0; Match level="QueryCoverage=91%, HitCoverage=31%, E-value=6e-15, Identity=41%"; Hit description =Chromosome chr13 scaffold_17, whole genome shotgun sequence
MTVTYNNCKERCTTLAPKRTPPVIENKPLGHRWLRRGNQHIGNDDLIVFRRKLDIMKQHEFLWEPYTTIVMSALPPICLVGSVAWCAVVPLICFHVVEWHQPDRVL

SEQ ID NO: 162962 - protein, 83 aa, Glycine max
  Coding DNA Sequence Number=SeqID_71277
  Homolog annotation: Hit_ID=A2QWD4; Match level="QueryCoverage=95%, HitCoverage=44%, E-value=4e-23, Identity=68%"; Hit description =Similarity to hypothetical protein EAA54961.1 - Magnaporthe grisea
  Subcellular localization annotation: CTP_CleavageSite=29; ConfidenceScore=5.46e-01
MAFPGLRSVATRRAVIPVRRSFSTSPSVRDAAGSTLPAKKPVGAFRGGIFGFLTGTIVAGASVYYYILGEYRVTNEMLTEDIY

SEQ ID NO: 162963 - protein, 210 aa, Glycine max
  Coding DNA Sequence Number=SeqID_71278
GELELHRGGGRSRTSGSPGERGADGRQRGDREIGGGQPEPARDLGLEEVDAHQCDGAEQQRRDQRVERTLLADLGAKPPGAFDDVSMSSHDETAHPHREFEAPGRKSRGDGSVGGGTRSGAADAWALATVAMVVTSTIATQSWWPMSVGAIVWVLARRPAVALALLALGSVAAVRVDHELARLVPDQSSLSIPSTSRGGPVPAFVPFSEG

SEQ ID NO: 162964 - protein, 362 aa, Glycine max
  Coding DNA Sequence Number=SeqID_71279
AIPAPQWRVDRRRQFPGRPGGHAVQADLATGNQPVGAGVLQANQHALGRRVGFERQPGRARLGDGRLHDEQFVAARQAQADDVARPHAGLDQVVRGQVGAAPEFVISEGLIQPVDGNGGGMPQDRGFQDIGQRFRLQQIRPTGALENHRYGDNPANGMRATQGFRVAGPGKFAAGRRPPAAIRIDPQPLLGQAGGGFLHQADHPVHFRNVGRMDVVDARADVVRIAEILERLEQFHVGARRLDRDHVRVHGGDRLDDVVELRIAHVRVDLGLVAHAGGRQAEAIHGPVQVRLPIGAAQRQALADGRLVDLDDADAGRFQVHHLVAQGQRQLAAGLFARLVVAHERPLQDGDRTRQHALDGLV

SEQ ID NO: 162965 - protein, 301 aa, Glycine max
  Coding DNA Sequence Number=SeqID_71280
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMTDINGCYRDSMYSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 162966 - protein, 102 aa, Glycine max
  Coding DNA Sequence Number=SeqID_71281
MKNGGESSRNRSRKCLGSVTEAPRLGFSSRKQFFSLISREKREVVAAQLAQASWVASTRRHRLLLEHPGRYFDDNKGDDKKLKGQSKNEFKMFKIESRTLQD

SEQ ID NO: 162967 - protein, 185 aa, Glycine max
  Coding DNA Sequence Number=SeqID_71282
MAGAQLGNNPANAQTGQRQRAADDKLLIHNPPADRLAEEKGAHGQVAGFPGVDQEKRHRQHPFAVAFHLRRIAPAVAAVGQLHLLLAIFGVGHFAGHAGETGVAADVEAVGLPANRRMRRPRLRVVEVKDIVVIEDAVAHRRPQRYLEEVLVGKALAAVILRDKVAHLLLHIVKHAVTAAPHAGQ

SEQ ID NO: 162968 - protein, 111 aa, Glycine max
  Coding DNA Sequence Number=SeqID_71283
MLHSMLQSLHRGQSIIKQSLQGLGSPSIMSIDEFDLQVAWPGAQPFPSRRGGASAAQEPAPEEPGAAAEGEDELTPPEPFYFDADVHMAQEEGTSTNQIPEPSPAHVPKET

SEQ ID NO: 162969 - protein, 383 aa, Glycine max
  Coding DNA Sequence Number=SeqID_71284
  Gene Ontology: Mol. function=mannitol-1-phosphate 5-dehydrogenase activity; Biological process=metabolic process
  Homolog annotation: Hit_ID=A7ZTE9; Match level="QueryCoverage=53%, HitCoverage=53%, E-value=1e-102, Identity=92%"; Hit description =Mannitol-1-phosphate 5-dehydrogenase
  Pfam annotation: Domain name=Mannitol_dh_C; Domain location=1-200; Score=296.3; E_value=6e-86; Accession=PF08125.4; Description =Mannitol dehydrogenase C-terminal domai
  Pfam annotation: Domain name=MtlR; Domain location=197-371; Score =307.9; E_value=1.9e-89; Accession=PF05068.3; Description=Mannitol repressor
  Pfam module annotation: Pfam domain module=Mannitol_dh_C::MtlR; Domain location=1-200::197-371
TVETFSEWIVDKTQFKGELPNIPGMELTDNLMAFVERKLFTLNTGHAITAYLGKLAGHQTIRDAILDEHIRAVVKGAMEESGAVLIKRYSFDAQKHAAYIQKILGRFENPYLKDDVERVGRQPLRKLSAGDRLIKPLLGTLEYGLPHRNLVKGIAAAMHFRSEDDPQAQELAALIAEKGPQAALAQISGLDAASAVVAEAVNDYNAAIMEETQAFENRVLERLNAGKTVRSFLIAAVELLTEAVNILVLQVFRKDDYAVKYAVEPLLDGSGPLGDLSVRLKLIYGLGVISRAEYEDAELLMALREELNHDGNEYAFTDDEILGPLGELHCVAALPPTPLFDESDKELLAMQKLRYQQMLKKSLPEINALTPLLAGRTSAGTAA

SEQ ID NO: 162970 - protein, 187 aa, Glycine max
  Coding DNA Sequence Number=SeqID_71285
MGEAEEVQEKMKADMEAMKEQMATMMEAMMSMKKIMEANAVIVAATSAVAKVNPMPPSGLNQMNHPTSNMHAFPSYGLPPNYTPPNVAYTLNENLNNSTPILIESQQPQTDHAHVSRPMEETHEIPHHDLADFEPWLEYATEGQAVGGIPLAKHFGGPSVSPTAFKNPHDYGRNGKVGSSRGKAQGH

SEQ ID NO: 162971 - protein, 443 aa, Glycine max
  Coding DNA Sequence Number=SeqID_71286
  Gene Ontology: Mol. function=protein dimerization activity; Cellular component=endoplasmic reticulum lumen; Biological process=proteolysis
  Homolog annotation: Hit_ID=Q7CS44; Match level="QueryCoverage=85%, HitCoverage=98%, E-value=0.0, Identity=82%"; Hit description =Cellulose synthesis protein
  Pfam annotation: Domain name=M20_dimer; Domain location=235-342; Score=22.8; E_value=0.0013; Accession=PF07687.5; Description =Peptidase dimerisation domain
  Pfam annotation: Domain name=Peptidase_M20; Domain location=129-438; Score=144.0; E_value=4.2e-40; Accession=PF01546.19; Description =Peptidase family M20M25M40
  Pfam module annotation: Pfam domain module=M20_dimer::Peptidase_M20; Domain location=235-342::129-438
MEGAEILERLQHYHSDEAQHLEYAEKARAALARLELTKTKIPLPADVIPLTVKPKTAGKRWHPPKDMLDLIELRHDLHRHPEISGEEKETARRVRAFLEQAPPDRLLAGLGGHGVAAVYDSGRSGPSVLIRSEIDALPIREKGEVEYRSSVDGKGHLCGHDGHSTILTALALGLARQRPETGRVILLFQPAEETGAGAAAVIADPRFAEIKPDYSFSLHNLPGLPFGHVSVVEGPVNCASRGIKITLAGKTAHASSPEHGISPMRAIARLMPSLSDLGSGFPPAPDFSMVTITHAIMGEAAFGISPADAEIWATLRTLTDDRMENLCNAAETLAKRVADEEGLTLDITYDDIFLHCENAPDAVDHIRQALDDEKISHGSEGLPMRASEDFGRFRGVSSSAMFFLGAGRDYPNLHNPDYDFPDALIGIGARIFMRLIRNLTDGK

SEQ ID NO: 162972 - protein, 192 aa, Glycine max
  Coding DNA Sequence Number=SeqID_71287
  Gene Ontology: Mol. function=cyclopropane-fatty-acyl-phospholipid synthase activity; Biological process=lipid biosynthetic process
  Homolog annotation: Hit_ID=Q7WTR5; Match level="QueryCoverage=19%, HitCoverage=16%, E-value=4e-10, Identity=75%"; Hit description =Cyclopropane fatty acid synthase
TRQGRRPRGSINTFSPTAVYRRYGRLPMPANLTSSWKTGITSARDYDTTLMARHERFQAAWPQLAEKYGERFKRMFSYYLNACAAAAPKAVCAWRVDFRAMLKGAYRAFFIRDYSASGSHTFDGVDNRLGMRIDFDIDPMPQLLRAQRGALQRFRDQMHAELTFGDITDCQADTIDADESFMQNIFDLLSVL

SEQ ID NO: 162973 - protein, 394 aa, Glycine max
  Coding DNA Sequence Number=SeqID_71288
  Gene Ontology: Mol. function=transcription repressor activity; Cellular component=intracellular; Biological process=negative regulation of transcription, DNA-dependent
  Homolog annotation: Hit_ID=Q7CIS2; Match level="QueryCoverage=86%, HitCoverage=100%, E-value=1e-165, Identity=83%"; Hit description=HTH- type transcriptional repressor purR
  Pfam annotation: Domain name=LacI; Domain location=55-80; Score=51.7; E_value=2.6e-12; Accession=PF00356.12; Description=Bacterial regulatory proteins, lacI fa
  Pfam annotation: Domain name=Peripla_BP_1; Domain location=112-382; Score=101.4; E_value=2.8e-27; Accession=PF00532.12; Description =Periplasmic binding proteins and sugar
  Pfam module annotation: Pfam domain module=LacI::Peripla_BP_1; Domain location=55-80::112-382
  Subcellular localization annotation: CTP_CleavageSite=44; ConfidenceScore=5.37e-01
MQNGGKAKGNNHQQSSGGGGQCQFQIGRKTISRRKRLTIYLSVSCDKPRSTIFMATIKDVAKRAGVSTTTVSHVINKTRFVAEETRNAVWEAIKALHYSPSAVARSLKVNHTKTLGLLATSSEAPYFAEIIEAVENHCFERGYTLILGNAHNDLQKQRAYLSMMAQKRVDGLLVMCSEYPDDLLQMLEENRNIPMVVMDWGESRGDFTDTVQDNAFHGGYLAGRYLIERGHRDIGAIPGQMERNTGGGRHAGFLQAMQEAGISVRPEWIVQGDFEPESGYQAMQQILNQKQRPTAVFCGGDIMAMGAICAADEMGLRVPQDISVIGYDNVRNARYFTPALTTVHQPKAQLGEKALEMLLDRITSKREEPQTIEVQPTLIERRSVADGPFRDYRR

SEQ ID NO: 162974 - protein, 110 aa, Glycine max
  Coding DNA Sequence Number=SeqID_71289
  Gene Ontology: Mol. function=protein disulfide oxidoreductase activity; Cellular component=cytoplasm; Biological process=cell redox homeostasis
  Homolog annotation: Hit_ID=P0AC71; Match level="QueryCoverage=99%, HitCoverage=94%, E-value=4e-53, Identity=89%"; Hit description =Glutaredoxin-4
  Pfam annotation: Domain name=Glutaredoxin; Domain location=16-80; Score=100.0; E_value=7.4e-27; Accession=PF00462.15; Description =Glutaredoxin
MSTVEKIQRQIAENPILLYMKGSPKLPSCGFSAQAVQALSACGERFAYVDILQNPDIRAELPKYANWPTFPQLWVDGELVGGCDIIVEMFQRGELQPLIKETAEKHKEAE

SEQ ID NO: 162975 - protein, 203 aa, Glycine max
  Coding DNA Sequence Number=SeqID_71290
MTGRLLASSLALESHILHYLIVRILLPRSSNLAQVSEEDVIVIWAFHTRGQIDWAHLVRYRMHKALRLNAPLPYPHLVTLFLQHFDIPFDSEPYIPIKRSFLIGAVVVASFGYRKECDGSWVKKGAQPNDDEGHLPVEGDSYLLQSILDRFDGLQTYVGERFDALERQVDMRFDEMDSWITKVEEDVTIIRDYLDLPPPPPSF

SEQ ID NO: 162976 - protein, 135 aa, Glycine max
  Coding DNA Sequence Number=SeqID_71291
  Homolog annotation: Hit_ID=A0PAV3; Match level="QueryCoverage=48%, HitCoverage=31%, E-value=3e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSMGRYAKRII

SEQ ID NO: 162977 - protein, 62 aa, Glycine max
  Coding DNA Sequence Number=SeqID_71292
MAPPKESAAIIYHNGHIVDDPVQGSIGAMETILQNSTEFYDFIPQPQPLSPQPSCPQLQPPQ

SEQ ID NO: 162978 - protein, 282 aa, Glycine max
  Coding DNA Sequence Number=SeqID_71293
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDKETAADDVVTNVEDIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 162979 - protein, 297 aa, Glycine max
  Coding DNA Sequence Number=SeqID_71294
  Gene Ontology: Mol. function=motor activity; Cellular component=cell projection
  Homolog annotation: Hit_ID=UPI00016621D1; Match level="QueryCoverage =75%, HitCoverage=40%, E-value=4e-19, Identity=33%"; Hit description =UPI00016621D1 related cluster
VHALAFRGLHVLTIRGLHVRTIRGLQVLAFRGLHVLAFRGLHALTFRGLQVLAFRGVHVLAFSGLHVLTFKGLHVLPFRGLHALTFRGLHVLAFRGLHALTFRGLDGYTPSPSEDYTSSPRGLHVLTFRGLHALAIRGLHALAFRGLHVLTFRGLHALAFGGLQVLAFRGLHVLAFRGLHALTFRRLHVLTFRGLRALIFRGLHILAFRGLHALAFRGLHVLNFRGLHAKAVASGGSNLARLGELGGKLLPYFAINRGRSEEEKPRRFRNVSVRNYAKILDRSSRFIVRSSFSSVFN

SEQ ID NO: 162980 - protein, 60 aa, Glycine max
  Coding DNA Sequence Number=SeqID_71295
  Homolog annotation: Hit_ID=A0PAV3; Match level="QueryCoverage=63%, HitCoverage=17%, E-value=5e-07, Identity=76%"; Hit description =Restriction endonuclease
MVKVGTSYVPINVSFSPKVGPGLPGINRDTRIYLFCEVIFRHRCSQWLLFLSSCPSCSSY

SEQ ID NO: 162981 - protein, 150 aa, Glycine max
  Coding DNA Sequence Number=SeqID_71296
  Pfam annotation: Domain name=Transposase_23; Domain location=5-75; Score=5.2; E_value=0.00032; Accession=PF03017.5; Description =TNP1ENSPM transposase
TDPDTGDSNKCELYIEENPPHLVALGRVYEGSTIIHNIPLLHDQVKVCVEEVKDVDALIPVPTDEVILVGQTLNTFLAWLTHLVKCLSEHGVVGPIKPADRSDLEVEDPLHLMTLTIPQLFLKPLQFMWDVSLFELFNSDFPLFMKFCLK

SEQ ID NO: 162982 - protein, 25 aa, Glycine max
  Coding DNA Sequence Number=SeqID_71297
MALSEGLNRSARPMARLADHNYALS

SEQ ID NO: 162983 - protein, 234 aa, Glycine max
  Coding DNA Sequence Number=SeqID_71298
  Subcellular localization annotation: CTP_CleavageSite=48; ConfidenceScore=5.00e-01
MDRARLVYGLVTCMNMNIGALISGQISTIAQSNSSRLGFPSLITALCRARGVTSDSLTNESLSPAINLAYIKKNCWNMDDLTVNFRGARKSLHVVAPPGSILSAEQFIEKVSWPRTLPFAVREGEVPSAQVPQQVQGASSEATIPGAFDFSGAGVEMRPNEDVLSEPIVAAPPTPVHERQADPPTPIMEMLEDPTTPVLRLSSTPSATPVLHLTDEEDMQDQDTQGTQDQSQEF

SEQ ID NO: 162984 - protein, 247 aa, Glycine max
  Coding DNA Sequence Number=SeqID_71299
  Gene Ontology: Mol. function=oxidoreductase activity, acting on NADH or NADPH; Biological process=electron transport
  Homolog annotation: Hit_ID=Q6UUU1; Match level="QueryCoverage=24%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNSMMPLTHPSQSTDGDPGRKYEVTWLDLGHLHPSRPGLVTITIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 162985 - protein, 132 aa, Glycine max
  Coding DNA Sequence Number=SeqID_71300
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=48%, HitCoverage=52%, E-value=2e-25, Identity=87%"; Hit description =Putative uncharacterized protein
MGSPAKPGQTFALFDEANDEWLDWAPKIPLGKANESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 162986 - protein, 155 aa, Glycine max
  Coding DNA Sequence Number=SeqID_71301
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MKHFTDTLISANILRANDNHRIRLAIQPTWRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 162987 - protein, 203 aa, Glycine max
  Coding DNA Sequence Number=SeqID_71302
  Gene Ontology: Biological process=transposition, DNA-mediated
  Homolog annotation: Hit_ID=Q1J7G7; Match level="QueryCoverage=22%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLEVTVTHLAAPIVYSSTTENCFSLVLLLASKANQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 162988 - protein, 33 aa, Glycine max
  Coding DNA Sequence Number=SeqID_71303
TTEPQPEAEWHSLELHLPGLFRNGRVKCLDNSR

SEQ ID NO: 162989 - protein, 247 aa, Glycine max
  Coding DNA Sequence Number=SeqID_71304
MTSRKRKATASGPWEPYDTSRFISEGAWERYAQNIHSRNILPERNVILYISEYDEFHQELKRWNWHKALTRQPDGHIDVALVKEFYANLYDPEDKSPRQVKVRGKLIKFNVESPQHLPGDPGGLGAWGTLHHNCWNPDYPTITFPGTCKTRARGPDTSAPSSSTPPAPAPPPTPTLATPVPSGTSAQSVEILVPMLQSLHHGLCLVMQSIHDLAQHRPIMSMKAFMAQVAWPGVQHSPLGGGKAPTA

SEQ ID NO: 162990 - protein, 234 aa, Glycine max
  Coding DNA Sequence Number=SeqID_71305
MDPLPGIAKVFSYAVQQERQINSNDMIGNNSLINAASTSSSNSGLSCTYCGKDNHTVDKCFKKNGFPQNYGSKGGKSNHSGFGKGNSSGKGRKLCTYCGFINHTVDEFYKKHGYPPKHKYNKSQSSNINNMNLLKKEDMQNLKRIGTVDMVEGLYRLKMLPFNPLKEYAPSSIIAYVLVASASVSAFSWEKGRTEKEKGWVRLGQKGKEKFGLDEDKKKDTRDEEFEMEERMTS

SEQ ID NO: 162991 - protein, 163 aa, Glycine max
  Coding DNA Sequence Number=SeqID_71306
  Homolog annotation: Hit_ID=A5BM28; Match level="QueryCoverage=68%, HitCoverage=60%, E-value=2e-25, Identity=47%"; Hit description =Putative uncharacterized protein
MIVASSLLPDSGCRSMIAIVTETTKMVSSQFRGGNESSGSNGIRRGKGVKPNDMKKEEWNLLDRLAFGVIKLTLVKNAAFNIVNEKTTTNLMKALSDMYEKPSATDKVYLLESVHIKFEDEVNALILLSSLPDNVRKRDSGESSSHVSNSALNTEGRGKTTQK

SEQ ID NO: 162992 - protein, 82 aa, Glycine max
  Coding DNA Sequence Number=SeqID_71307
MRITRMRKIKFGHSTCGGITLDSIPFAIVGDVVVYPRMNSGLYIRLYLLFCDSIIAKVTMRHGIKLQRSCLPYLKDFMRMES

SEQ ID NO: 162993 - protein, 160 aa, Glycine max
  Coding DNA Sequence Number=SeqID_71308
  Subcellular localization annotation: CTP_CleavageSite=43; ConfidenceScore=5.79e-01
MASPPASPPPPPSSPSNASASPSAVKWTRKASRLRSLSTRPPSAERPVVHVDPTTGKADSPHRKKLKTYLGIVACDKVDVTYENWKEAEFEILEAFDSRTKRKLLQTVGERWRQFKSDLTRKWVLAAYQDGGEDTVCEKYGISKEKWAQFCQTHRDPSWE

SEQ ID NO: 162994 - protein, 255 aa, Glycine max
  Coding DNA Sequence Number=SeqID_71309
MKIDREGMTKYLHYQVITKLVAFEVSSAIWPDKACRLIWVGDRSSIGSGGSGFRVAREGSREASSSFETNKNNLEEHLWPGVNFSSQLKHNPFSHRIASSSGERRLKGMEGEGCLVGVESKGAEEMGGGGRGPSEPVGSRGVILKIHPVGSEPSKHETSSFKRCGDFEGVKVEGLAVDEANRDRARSVSGTRGTFHLRYNLVGIVAVVFEVKLNYFVVVEVGLSIGVLVEAVSLYQVQSLKLQADRDFRSLYNLT

SEQ ID NO: 162995 - protein, 65 aa, Glycine max
  Coding DNA Sequence Number=SeqID_71310
MILLPTLQRWNSSLNKWSLDGFAVAVGDSYPGVSPHGDAPDLRPGPKSSVGAPEPSDVSPVKIYG

SEQ ID NO: 162996 - protein, 48 aa, Glycine max
  Coding DNA Sequence Number=SeqID_71311
MAFLIDEDSNGPIDQEELKECTSNDVLMANSCVYGFSTVFIHLEHHLG

SEQ ID NO: 162997 - protein, 129 aa, Glycine max
  Coding DNA Sequence Number=SeqID_71312
MKTISKRFEELDVCGKFTLKTKLWEIAYPDQNSMCPPPAKVNTKGAPKKPMNRNPRFEELRMSLHVDGLTQATMDKWMDTTDMGYVIASRYNIYLKDHCPLPPVALLWSSNCHPQDTIRLDYVTGHCKT

SEQ ID NO: 162998 - protein, 76 aa, Glycine max
  Coding DNA Sequence Number=SeqID_71313
MEDIEDEAVLIHVEVEGGHEIVHVRLGVGPCRNLPFGGRATRGSRVRLPREEGAQSRHQRLFEENVKKTKCVVYKL

SEQ ID NO: 162999 - protein, 219 aa, Glycine max
  Coding DNA Sequence Number=SeqID_71314
  Homolog annotation: Hit_ID=A5C1W3; Match level="QueryCoverage=69%, HitCoverage=66%, E-value=5e-10, Identity=32%"; Hit description =Putative uncharacterized protein
  Pfam annotation: Domain name=DUF674; Domain location=1-193; Score= -264.9; E_value=2.2e-05; Accession=PF05056.3; Description=Protein of unknown function (DUF674)
MADVKTEVTLKLVVIIGRNEVLFVEAGKDFVDALFSFLKLPLRTVARLVLKEPNVQPIEVASLSSLYQRKEDFADFISSLLTIPLGGMLHLTEGCSSLGSVEGLYKSVVDFEEVIGLQRNYTNLSHAHYIRAVITISETANSKGYVKGPIMYMATDDLVVTLMSSISVISLLSSVCIHVNDLEEKVVNIGINVGVLILQASLTSTSVLSVGLGHLLTPR

SEQ ID NO: 163000 - protein, 238 aa, Glycine max
  Coding DNA Sequence Number=SeqID_71315
MKMKTKSLRVILMIFVSIEVMHCEGCWKEQTDALLGLDLRFESDTDCCQWERIKCDSSTGRVARLNLYHLLLDGFEESQLGIAGCAYNEGDKGGCSADFEDTNLQQKEEKDRASKNNTGVPRLIPMNLQFHKVPVRKEFHAEKSWSGLTRTQWVCGFLILCDEGMNPRGLAMAAMELLLALVAAGRAAKGARLRWEEEPKGLTVELPAVGFTVAVDAEEGATSAAPGASRGWRPGPQS

SEQ ID NO: 163001 - protein, 140 aa, Glycine max
  Coding DNA Sequence Number=SeqID_71316
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q42779; Match level="QueryCoverage=79%, HitCoverage=17%, E-value=3e-31, Identity=61%"; Hit description=Alpha- carboxyltransferase aCT-1 precursor
MAASSASLAGASASDFLRSSTSSFNEEDFTVAAKLRKVKKHEYLWPANPDPNVKGEVLSHLSQFKPLKEKPKPVTLDFEKPLVDLQKKIIDVVLNANGLIGMVFMDGNRKLDYLNEQTDDDKSSHEKIAIMLLSDCHLQD

SEQ ID NO: 163002 - protein, 41 aa, Glycine max
  Coding DNA Sequence Number=SeqID_71317
MVAVVILMVTMVANNDDKYVNDGDNNKNNGDMNGGGGDNCD

SEQ ID NO: 163003 - protein, 971 aa, Glycine max
  Coding DNA Sequence Number=SeqID_71318
  Gene Ontology: Mol. function=kinase activity; Cellular component =membrane; Biological process=activation of JNKK activity
  Homolog annotation: Hit_ID=A7PP08; Match level="QueryCoverage=65%, HitCoverage=65%, E-value=1e-177, Identity=51%"; Hit description =Chromosome chr8 scaffold_23, whole genome shotgun sequence
  Pfam annotation: Domain name=WD40; Domain location=156-193; Score =7.8; E_value=3.5; Accession=PF00400.23; Description=WD domain, G -beta repeat
  Pfam annotation: Domain name=WD40; Domain location=197-246; Score =21.5; E_value=0.0031; Accession=PF00400.23; Description=WD domain, G- beta repeat
  Pfam annotation: Domain name=WD40; Domain location=251-289; Score =25.6; E_value=0.00019; Accession=PF00400.23; Description=WD domain, G-beta repeat
  Pfam annotation: Domain name=WD40; Domain location=300-338; Score =9.0; E_value=2.5; Accession=PF00400.23; Description=WD domain, G -beta repeat
  Pfam annotation: Domain name=WD40; Domain location=342-382; Score =1.9; E_value=19; Accession=PF00400.23; Description=WD domain, G-beta repeat
  Pfam annotation: Domain name=WD40; Domain location=386-424; Score =23.1; E_value=0.0011; Accession=PF00400.23; Description=WD domain, G- beta repeat
  Pfam annotation: Domain name=WD40; Domain location=69-124; Score =20.1; E_value=0.0082; Accession=PF00400.23; Description=WD domain, G- beta repeat
  Pfam module annotation: Pfam domain module=WD40::WD40::WD40::WD40::WD4 0::WD40::WD40; Domain location=156-193::197-246::251-289::300 -338::342-382::386-424::69-124
MGSIVYSKTKKFQEESNSVSHTIVPEQDFEQLPALPDAVACQFSALEKIVVIYGDHSLYIYDIHDVNRVTKCFVLVSHSSCIWDIKNLCCENMHDPSLACTARGCLGGISFATCSADGTVRIWDIALQSDFLKDAEELKTELLSSSCLVTAGTFERDAVKADLTNQEFRSLAVSSDGNYLAAGDCKGNLHIYNLHTSDYTCFQGAHDAEILTLSFTLSTQDISKEIAKDNYFLASGGRDCMIHLYDVKRNFDLIDSIDDHSGAVTSIKISSNGCRILSCSSDSFLVLRDVVIADSGYKFLQQHRQRALQRGTVYDMAVDRTCETVVTVGQDKKIKTFDMAAQKLIRSYNHDKNFGEPIKVIMDPSCTYVVCSFSNKSICMYDFITGEMVAKATGHAEIVTGVIFLPDCKHIVSVDGNGCVFVWKLPAPLSARILERIMEKNNPLSPRSSVQRPAYNYLSFCKEECRHSKINPEDVWSLRNNSQSGDGMLYPESSHSEASSFKFSVSRLPKWAQAKVTSSINVNKNLNCNSLEFQNVQELSRFLVICRRENLVTVKLCLEYAPSSPEVQIPSDHASPLPDTLNSQDSSRFGGTYSSLLIKSLNFSNIPLDNHWHSIYTVCMEALSSPEMQNLCETKFPEIPLSLRQHKAVICEDQNSFGPNNLSKNEKRGVAPEHVGCNNNDVSWCSEEVSESKAEQLYLSESGSVSETTTEGNLGSLPSEEDSDMFKQHFGSLSNTHKVKSRNSLVRRFSARYTVQWDYPGDCKKLFSSPVGNKSGRKSSEDKGATHTVSEDRSLQVKETEEVTNSSEQDIKNSEPCSADSTCELTKFPVKENSVDKGSELGETIAVCKEAFGSLDAAAESVLQLFLKLENVHGKEVATGAGAQFLDEATELLPLVVNKVNAVARLVQCRKNSKCETSRPSVQEIDQFGRFAAGRGTRERIGGGNENGCCGEEEDREKKRVSEGRRGRWGH

SEQ ID NO: 163004 - protein, 180 aa, Glycine max
  Coding DNA Sequence Number=SeqID_71319
MRDDEKGSSKKSSSRWRAWSIWGLIHRRGSKEEEGGGNGNGNGVERSYSESWQEYRGGGGGEKNGDVRGGGFNPKLMRSNSSVSWRNGQSMIGGGGGGFGNVSMRKSDVQGNELGLGLGGRKGRDEFVGLERNRSARYSSPNSIDNNGLLRLYLGGRRNGSGKGRSNQAHSIARNVLRLY

SEQ ID NO: 163005 - protein, 84 aa, Glycine max
  Coding DNA Sequence Number=SeqID_71320
  Gene Ontology: Mol. function=protein serine/threonine kinase activity; Biological process=protein amino acid phosphorylation
  Homolog annotation: Hit_ID=A5AG35; Match level="QueryCoverage=50%, HitCoverage=5%, E-value=1e-09, Identity=76%"; Hit description =Putative uncharacterized protein
MGSHFVMYLAKVKDLSLCSKVLSPSLMLLVLANYLRFLNSNSFSGLIPASIGNLSKLNWLDIGDNQLQGPIHILSGSTPLMLPT

SEQ ID NO: 163006 - protein, 441 aa, Glycine max
  Coding DNA Sequence Number=SeqID_71321
PTMQYVGTSNSGSIIDIDVDKLSFFEAIRILEEDFGYDDQPMRLWWKGGDGEYKEITMDNRALELSDYAIANNYELELFVECAGGNKGVVDDNFYGDSEDSSDESVKDVQLDESEEERAIGLDNGAREEGDSCDDAYANQEENLNLPSEVQSDAHFRVVDKAAGCKKATCGGKKVASRGKKASSGGKKPAGRGKKVEHNYVNLSDEEVYERFNNELLYMEFKWKFGLEFALLKELKEAILKYNVLMGEKSGLISMIRDEQEQGVSIVPTIWYMLVRKGPGKPKKLGKRELDEDLNMTRLRRDPTPYKCNQCGVACHNTRRCTLPPQVVPEETEQLNVVEGGTEGVAEGGNEGAPIGVHTRQVNNVEGYTKGASEGGIEGGGGGVQIGQLNVVEGGTEGAVEGETKGGGGGVQTGPIQHQKNDITQIKCTNKNNKLMGKGVQ

SEQ ID NO: 163007 - protein, 96 aa, Glycine max
  Coding DNA Sequence Number=SeqID_71322
KLGEKLATQLAQASKVASSRSNSLLEGPSGPAFEEVTETHGLRKNTSFRLPPHYGISRIAQACFLLISETSRDFIYCATNVAKYLKAANQRLHFIK

SEQ ID NO: 163008 - protein, 64 aa, Glycine max
  Coding DNA Sequence Number=SeqID_71323
MISDVVFFDCSNTLCFFIEDHVNLEYTGWWLYMVSINVVLVTVVEAVVVVVDMRIMETMVVVEE

SEQ ID NO: 163009 - protein, 152 aa, Glycine max
  Coding DNA Sequence Number=SeqID_71324
MQRRSSAGVLIPIDLEFNATCRKRNAKRNRKFLQDIEATTIQEEPLSSEASSSFPKQGESHTVLFEANIIVDEPRRVTLGDYSSSSMSQFFTSIARPEVQAQNITHPHSLIELIQNNLFNGLFNEDPYAHLATYIEIYNMSDWLVCLRMLLD

SEQ ID NO: 163010 - protein, 101 aa, Glycine max
  Coding DNA Sequence Number=SeqID_71325
  Subcellular localization annotation: CTP_CleavageSite=48; ConfidenceScore=5.64e-01
MATPPTSPPPAPPADASTSPSTLKRTRMVTRLRSLATRPPGADRPVVNVDPATGKANGPYKKKLRTYLGIVAYDKVDVTYETWKEVPAAQKDLIWEDIQVF

SEQ ID NO: 163011 - protein, 255 aa, Glycine max
  Coding DNA Sequence Number=SeqID_71326
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGQDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163012 - protein, 77 aa, Glycine max
  Coding DNA Sequence Number=SeqID_71327
  Homolog annotation: Hit_ID=UPI0000ECBAF8; Match level="QueryCoverage =55%, HitCoverage=50%, E-value=1e-17, Identity=100%"; Hit description= UPI0000ECBAF8 related cluster
MAVVFGILGQSGRHRGGAPIRPIVSRITIHWPSFYNVVTGKTLALPNLIALQHIPLSPAGVIAKRPAPIALPNSCAA

SEQ ID NO: 163013 - protein, 150 aa, Glycine max
  Coding DNA Sequence Number=SeqID_71328
MDFLNVSNAGFDDAEKNSLDNDCHHQKGGDYECCFQDHFNKHSKVKHCFKIKTRLHQQISIASRFIQDQFLPQNTLFPTYQGSDISKICFYRLTVGILKIINFGLSLSEYGALSATPTKGNYAERPKAALSPTPTEGNCTEWPKGALSEP

SEQ ID NO: 163014 - protein, 397 aa, Glycine max
  Coding DNA Sequence Number=SeqID_71329
  Gene Ontology: Mol. function=transmembrane receptor activity; Cellular component=integral to membrane; Biological process=signal transduction
  Homolog annotation: Hit_ID=A8GG43; Match level="QueryCoverage=99%, HitCoverage=94%, E-value=1e-117, Identity=70%"; Hit description =Methyl-accepting chemotaxis sensory transducer precursor
  Pfam annotation: Domain name=HAMP; Domain location=278-347; Score =58.3; E_value=2.6e-14; Accession=PF00672.16; Description=HAMP domain
  Pfam annotation: Domain name=MCPsignal; Domain location=2-89; Score= -87.3; E_value=0.011; Accession=PF00015.12; Description=Methyl -accepting chemotaxis protein (MCP) signaling domain
  Pfam annotation: Domain name=TarH; Domain location=130-263; Score =117.6; E_value=3.6e-32; Accession=PF02203.6; Description=Tar ligand binding domain homologue
  Pfam module annotation: Pfam domain module=HAMP::MCPsignal::TarH; Domain location=278-347::2-89::130-263
MGSVLVESAGETMGDIVNAVTRVTDIMGEIASASSEQSRGIEQVGQAVAEMDRVTQQNASLVEESASAAAALEEQASMLTQSVAVFRLRAEGQEEFKAPVTSKATVTPLASSGLSYSAFRSDNHNLDIITLGSQQRDSLSLSWVSLLQARNTLNRAGTRAALKLPQEQVNELMSSARSSLQKADLYFNQFMAVERSSEQQSQQTATTKASYERLRGALRELIGFLEKGELQAFMDQPTQKTQDLFEADFVQYLQLVNGDISEARDANQFSFKLAGLMLAGAVLMLIVVTGSAMWWLRTMLVQPLNQIRSHFERIAAGDLATPIQVYGRNEISMLFASLQRTQQSLIGTVGAVRDGAESILIGLQEIAEGNNDLSSRTEQQAASLEQTAASMEQLTAT

SEQ ID NO: 163015 - protein, 54 aa, Glycine max
  Coding DNA Sequence Number=SeqID_71330
MSGQTETGNKITYSVLKLTPASFSIRYSLSLEEILLSFSSGERMRILFMGQGSK

SEQ ID NO: 163016 - protein, 32 aa, Glycine max
  Coding DNA Sequence Number=SeqID_71331
MWDTLQEHEMELMRLNQHEENDKKKKGIALKD

SEQ ID NO: 163017 - protein, 315 aa, Glycine max
  Coding DNA Sequence Number=SeqID_71332
  Homolog annotation: Hit_ID=UPI00006A2D9E; Match level="QueryCoverage =48%, HitCoverage=71%, E-value=1e-08, Identity=15%"; Hit description =UPI00006A2D9E related cluster
MPSPSEDYTSSPLEDCRSSPSEDYKSSTSEEYTPSPSEDYTSSPLEDYKSSASEGCTSSSLEGYMPSPSEGYMLSPSEDYTSSPSEGNTPSPTEDYVSSPLEGYMPSPLEDYTSSPSKGSTPSPSVDYSLHALAFRGLLVLAFRGLHALAFRGLHVLAFSGLHALALRGLHVLPFRWLHTVAFRGLHVLAIRGLHALALRGLLVLAFRGLHALALRGLHVLAFRGLHALAFRGLHVLTFRGLHALSFWGLHVLTFRGLHAHAFRGLHVLAYRGLHGLAFRGLLVLAFRGLHALAFRGLHLLTFRGLHVLAIRGLH

SEQ ID NO: 163018 - protein, 468 aa, Glycine max
  Coding DNA Sequence Number=SeqID_71333
  Gene Ontology: Mol. function=DNA-directed DNA polymerase activity; Cellular component=cytoplasm; Biological process=DNA replication
  Homolog annotation: Hit_ID=Q6CYR5; Match level="QueryCoverage=54%, HitCoverage=69%, E-value=1e-127, Identity=88%"; Hit description=DNA polymerase III, beta chain
  Pfam annotation: Domain name=DNA_pol3_beta_2; Domain location=16-130; Score=226.8; E_value=4.9e-65; Accession=PF02767.7; Description=DNA polymerase III beta subunit, central domain
  Pfam annotation: Domain name=DNA_pol3_beta_3; Domain location=132 -252; Score=209.2; E_value=9.9e-60; Accession=PF02768.6; Description =DNA polymerase III beta subunit, C-terminal domain
  Pfam annotation: Domain name=SMC_N; Domain location=271-422; Score= -19.0; E_value=2.8e-10; Accession=PF02463.10; Description=RecFRecNSMC N terminal domain
  Pfam module annotation: Pfam domain module=DNA_pol3_beta_2::DNA_pol3 _beta_3::SMC_N; Domain location=16-130::132-252::271-422
SDFPNLDDWQSEVEFTLPQATLKRLIEATQFSMAHQDVRYYLNGMLFETEGEELRTVATDGHRLAVCSMPVGQALPNHSVIVPRKGVIELVRLLDGGETPLQVQIGSSNIRAHVGDFIFTSKLVDGRFPDYRRVLPKNPDKALEAGCDLLKQAFARAAILSNEKFRGVRIYITENQLRITANNPEQEEAEEMLDVSYSGTELEIGFNVSYVLDVLNALKCENVRLLLTDSVSSVQIEDVASPAAAYVVMPMRLACALAVARLPAPPTAWIVNADLTLAPGFNFLVGANGSGKTSVLEAIYTLGHGRAFRSLQAGRVIRHDQDAFVLHGRIEGSERELAVGLSKNRAGDSKVRIDGSDGHKVAELAQLLPMQLITPEGFTLLNGGPKYRRAYIDWGCFHAYPGFFLAWSNLRRLLKQRNAALRQVVRYSQIRPWDQELVPLAEQISAWRAEYSAAIASEITATCSQFLP

SEQ ID NO: 163019 - protein, 269 aa, Glycine max
  Coding DNA Sequence Number=SeqID_71334
  Gene Ontology: Mol. function=hydrolase activity; Cellular component =membrane; Biological process=metabolic process
  Homolog annotation: Hit_ID=A8G7Q6; Match level="QueryCoverage=100%, HitCoverage=99%, E-value=1e-100, Identity=66%"; Hit description=Cof -like hydrolase
  Pfam annotation: Domain name=Hydrolase; Domain location=3-241; Score =48.3; E_value=2.7e-11; Accession=PF00702.17; Description=haloacid dehalogenase-like hydrolase
  Pfam annotation: Domain name=Hydrolase_3; Domain location=6-264; Score=292.0; E_value=1.2e-84; Accession=PF08282.3; Description =haloacid dehalogenase-like hydrolase
  Pfam annotation: Domain name=S6PP; Domain location=2-269; Score= -78.9; E_value=3.9e-05; Accession=PF05116.4; Description=Sucrose-6F -phosphate phosphohydrolase
  Pfam module annotation: Pfam domain module=Hydrolase::Hydrolase _3::S6PP; Domain location=3-241::6-264::2-269
MAIKLIAIDMDGTLLNPQHEITAGVKAAICRARDKGVSIVLATGRPFVGVERYLMELDLRQPGQYCISNNGALAHSADSGEVVAEKTLGFDDYLYLEQLARDLGVHFQAFDKSFLYTPNKDISEYTIHEASLTGIPVRYRAVEEMDPATRFPKLMMIDKPELLDKAIAALPARARDSYTILKSAPYYLEILNPLVNKGYGVKMLAEKLGLQPSEVMAIGDQENDLAMIEYAGTGVAMGNAIDSVKQIAQFVTKTNMEDGVAHAIEELVL

SEQ ID NO: 163020 - protein, 39 aa, Glycine max
  Coding DNA Sequence Number=SeqID_71335
MAPIARAEHMGGTHFKQRARWMGHAASANVPDASDWLLL

SEQ ID NO: 163021 - protein, 430 aa, Glycine max
  Coding DNA Sequence Number=SeqID_71336
  Gene Ontology: Mol. function=transporter activity; Cellular component= integral to membrane; Biological process=transport
  Homolog annotation: Hit_ID=A8G7R5; Match level="QueryCoverage=100%, HitCoverage=100%, E-value=0.0, Identity=83%"; Hit description=D -galactonate transporter
  Pfam annotation: Domain name=LacY_symp; Domain location=8-406; Score=- 319.5; E_value=0.056; Accession=PF01306.10; Description=LacY protonsugar symporter
  Pfam annotation: Domain name=MFS_1; Domain location=21-389; Score =218.5; E_value=1.5e-62; Accession=PF07690.7; Description=Major Facilitator Superfamily
  Pfam annotation: Domain name=Sugar_tr; Domain location=17-430; Score=- 109.3; E_value=0.0001; Accession=PF00083.15; Description=Sugar (and other) transporter
  Pfam module annotation: Pfam domain module=LacY_symp::MFS_1::Sugar _tr; Domain location=8-406::21-389::17-430
MDLSAVQAKPTRRRYITLLMIFITVVICYVDRANLAVASAHIQQEFGISKAEMGYVFSAFAWLYTLCQIPGGWFLDRVGSRLTYFIAILGWSVATLLQGFASGLLSLIGLRAITGIFEAPAFPTNNRLVTSWFPEQERASAVGFYTSGQFVGLAFLTPLLIWIQELLSWHWVFIITGGIGIIWSLVWMKVYQAPSQSKGINQAELDYIRAGGAMVDGDAPGEKKARVKLTAADWKLVFHRKLCGVYLGQFAVTSTLWFFLTWFPNYLTQEKHIAALTAGFMTTVPFLAAFVGVILSGMVADRLVRSGRSLGFARKTPIICGLLISTCIMGANYTNDPLWIMVLMALAFFGNGFASITWSLVSSLAPVRLIGLTGGMFNFIGGLGGITVPLVVGYLAQDYGFAPALVYISAVALIGALSYILLVGDVQRVG

SEQ ID NO: 163022 - protein, 224 aa, Glycine max
  Coding DNA Sequence Number=SeqID_71337
  Homolog annotation: Hit_ID=UPI00016621D1; Match level="QueryCoverage =80%, HitCoverage=40%, E-value=6e-14, Identity=31%"; Hit description =UPI00016621D1 related cluster
MHAVAVRRLHVLVFRGLLALPFKGLHILAIRGLHALTLRGLHVVAIRGSRTLTFRGLHVLAFRGLHVLAFRGLHRTTCLTIRGLHDFTFRGLHVLAIRGLHALTLRGLHVLTFRRLHVLTIRGLYILAFRGLHVLIFRGLHVLHFRGLHVLSFRGLHVLTFRGLHVLAFRGPHAVAFRGLHVLTFRGLHTSPLEDSTSSPSESYPSYLSEGYTLSSSEDYTSSP

SEQ ID NO: 163023 - protein, 295 aa, Glycine max
  Coding DNA Sequence Number=SeqID_71338
  Gene Ontology: Biological process=transposition, DNA-mediated
  Homolog annotation: Hit_ID=Q6UUU1; Match level="QueryCoverage=38%, HitCoverage=95%, E-value=1e-36, Identity=61%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCYGRVCLIPPPDTQFR

SEQ ID NO: 163024 - protein, 60 aa, Glycine max
  Coding DNA Sequence Number=SeqID_71339
MVESSNKEYMVKIIKILMPPKVSSSSGRGGRSRSKGKEVLLALPKQIIKKTTSSSSGSPT

SEQ ID NO: 163025 - protein, 76 aa, Glycine max
  Coding DNA Sequence Number=SeqID_71340
MEYSRLMMGGKALDIFIIGGGGTQAEQEEKPKVVRRTTSSPAGSDIIGVFCRRVVVDIIKMAMVVGGFIIKNSLIV

SEQ ID NO: 163026 - protein, 230 aa, Glycine max
  Coding DNA Sequence Number=SeqID_71341
MELLKKLRLNKGGTVESSSVQQHIPQSQGVIICWESYTYQCMPKMIGVFFKRVVQSQEEKALIQVFLAKLSRKQESPISKKAYSSDHHQDFDQQHLHHRQQLQQEMARNAPRAASSQNQSAGKSPQEKSSFTFPLAQKSKAGNARNAIESQKAPRAVSPSRFPKNGTGHNMKPENCQRPMDDRSFEVIAWLKLGQEMTMEAPRKNDSLFDRCSSEIGKLTTCYDDFTILK

SEQ ID NO: 163027 - protein, 44 aa, Glycine max
  Coding DNA Sequence Number=SeqID_71342
MGANDSSFMNRGPVTRGMSKRLEEDWARAAEESPRILMNLRVDF

SEQ ID NO: 163028 - protein, 120 aa, Glycine max
  Coding DNA Sequence Number=SeqID_71343
  Subcellular localization annotation: CTP_CleavageSite=51; ConfidenceScore=5.26e-01
MHHQKKKTLNEASLLSSKSETQHDYRSTSTPYGSHRPRQQGCCPSSFVSSSAMRNSDPNFVWELSFADILILANRKVLFNTGFCTRREIVQRFGQACEKYPRRGAKGLFQEIFWTLARLG

SEQ ID NO: 163029 - protein, 76 aa, Glycine max
  Coding DNA Sequence Number=SeqID_71344
  Homolog annotation: Hit_ID=Q6WAY3; Match level="QueryCoverage=85%, HitCoverage=2%, E-value=7e-07, Identity=43%"; Hit description =Gag/pol polyprotein
MPYVDLLPCLFDNAIAVISPTKISQPLFPKGYNPNVTCAYHGGVLGHSIEHCMSLKHKVQSLIDAGWPRFEEENRS

SEQ ID NO: 163030 - protein, 232 aa, Glycine max
  Coding DNA Sequence Number=SeqID_71345
  Homolog annotation: Hit_ID=A2Q6E1; Match level="QueryCoverage=42%, HitCoverage=50%, E-value=2e-07, Identity=33%"; Hit description =Putative uncharacterized protein
VESTHWALKRLLQNSLRDLHSIWEAMNNMITYALNQIVVEFECVHYAGKNSSHCGCIMRTTHGLPCACLSELEVSITEEIETISKQFEELDKLMSKHQRSTKRDSSYWEYVDALHSMQNHNSLVKRAATLSEQPKPRRNFPVLDQFHSCIHDFIENIIDVKPDDNFEYRAIAALLGIDEHPWYLVHIHMLKELEKWSDEYINLLGGIDRFKELKRSLLVDGLSMEYKFLVTF

SEQ ID NO: 163031 - protein, 168 aa, Glycine max
  Coding DNA Sequence Number=SeqID_71346
MATIRLSPLIPCSLDTSERGFIFAFAERKGHYTLDDVASLLHLPIIGAFHTFDALDVDKVVDLIVKLLEVQYWIYKHFHTIASCVANEDYHERKPHACRWKEFKLISLFSGQIKWGSCIVIDQPERVVRQFGYVQTIPPHLATPSVSIEEIDNRWMQFSEYLALVDHI

SEQ ID NO: 163032 - protein, 546 aa, Glycine max
  Coding DNA Sequence Number=SeqID_71347
  Homolog annotation: Hit_ID=Q2HW90; Match level="QueryCoverage=48%, HitCoverage=51%, E-value=4e-20, Identity=28%"; Hit description =Putative uncharacterized protein
MGSNPAPLVKKKFYQVKIKNLGDLTMVEVSMKAIASLTQYYDQPLRCFTFGDFQLTPTVEEFDEILGCPLGGRKPYLFSRFYPSLARISKIVKISAQELDQGKQVKNGVVGVPRKCLEAKARALASQDEWALFIDVLALLIFRVVLFPNIDGLVDLAAIDAFLAFHDLKESSVVAILADLYDTFDRRCEKDSARIVCCTPALYVCLVAHLFCLERRHVCSLEGRRSCTEKREANWDRLLANKEGVSINWFPRWKEGRVGILFSCGGFPNVPLMGMRALAGVLQGVRKAWEMVQKKDKELRGSSNGAVGGYHRLKAAKEEEVEAPEESKEVQALKMELEKAQAVKEKFKSTAVRIRKENAELRDVNIATAKALEQETKRARKEEYGRNKFRGALWGSNSELKLRREERDQSQVEGMILKDELKTCLRSKRSLSQRLSETETNMLAIISKYKEELDLATAHEHKVVDEYAQVYTEKEARGRVIDSLHREAMMWMDRFALTLNGSQDLLRLLVKAKAMADAYSTPEEIHGLLSYCQHMIDLTAHIIRNH

SEQ ID NO: 163033 - protein, 166 aa, Glycine max
  Coding DNA Sequence Number=SeqID_71348
MKSSIVSYKQSLQNQGGVNYMQIDIFVVVAPNLQVVVIIKKGENVNHEDFDDVKKIKPWIMVVIIKKGENVNHAGFDDVKKNLLDKGGECEIVNHAYLDDVEKKSLDYHHQKGGEFASKDKHGFKINTRLLQQTNPCFKINSRSSLALKQSAFKTCKALVIDYQAV

SEQ ID NO: 163034 - protein, 90 aa, Glycine max
  Coding DNA Sequence Number=SeqID_71349
  Subcellular localization annotation: CTP_CleavageSite=32; ConfidenceScore=5.21e-01
MAFLSDGEKFWVKKLTLPPLFKLIHAGGCSPRRANPVHFFFAKFFAKKLRVPFGSALAYLKSLGRTWDDDLRTTSLASARTRPQASESRK

SEQ ID NO: 163035 - protein, 94 aa, Glycine max
  Coding DNA Sequence Number=SeqID_71350
  Subcellular localization annotation: CTP_CleavageSite=13; ConfidenceScore=5.15e-01
MATPPSYLPPNSPASLESTSRRTRQCTRLIRLTIRHLDQLRLVVHVNPSVRKALGPLKENFHTNLGTIAQYKSQFEIPKVSNSRKKVISLVGTR

SEQ ID NO: 163036 - protein, 62 aa, Glycine max
  Coding DNA Sequence Number=SeqID_71351
MQSQGLALPTEPEVGLFTTRVRTKESCIDPSGNDLDTGVVGLGKPADRSDPYVDDPLYLMTL

SEQ ID NO: 163037 - protein, 248 aa, Glycine max
  Coding DNA Sequence Number=SeqID_71352
  Homolog annotation: Hit_ID=A5BJP5; Match level="QueryCoverage=64%, HitCoverage=14%, E-value=6e-08, Identity=29%"; Hit description =Putative uncharacterized protein
MERGRKERPKEVESYFSPLSRKSKCTGEKFLWRKTQVFLWRKLLKSRKISKIDFRILISFTLLIFKIKSRIVSKHEREFVGDFTSQSPTDTVAFSSINDNINVTSSHKSFSNNHKVPSNSGKGPKDNKFGTHCGKTNHTVETCFFKYGFPTGYRNRGIGGSSNFKSFASLAEVDYDITSQTIALEDGLTRDQFRLSKDQYNAIIALLQQTKDSSTSILITFNILWLISQTSNFKMIGVAKQHHGFFHL

SEQ ID NO: 163038 - protein, 202 aa, Glycine max
  Coding DNA Sequence Number=SeqID_71353
MTGRLLAGSLAFESRILHYLIVRILLPRSSNLAQVSEEDLIVMWAFHKGLQIDWAHLVRYRMHKALRLNAPLPYPHLVTLFLQHFNIPLDSEPYVPIKRSFLIGASVIASFGYVKEHDGSWIKKGARNVGEEGHEGEDSSLLSKILERFDGLQTFVGERFDTLELQVDMRFNEMESRMTKVEEDVSYIWSSFDLPPPSSPSS

SEQ ID NO: 163039 - protein, 93 aa, Glycine max
  Coding DNA Sequence Number=SeqID_71354
MNAMPPVEELGLAVRSEMLLMKKLLSREVIRGDENQKSNRIRERVKEVQQNALNALSEGGSSYATPSHCSQKVIGTKLCYFEAKEIVVSAVTL

SEQ ID NO: 163040 - protein, 193 aa, Glycine max
  Coding DNA Sequence Number=SeqID_71355
MKDKSIGKDIYHSVVLPKVFEINGVIRKFLYETLIDVQDKIYLDKADVNKRREMDRGGKLDNGHRMRVSPIRDTQARMYSLESFESPERVLKKKEWTQVKPLLKLSKEPRKGWTRLCPRPTPKKLTQNPSSTIEHLKAISEPKSDAKRPIVFKKKKVAPSSDETYMPQAKKVKPTQEAPPPPPPPLTQPRTSK

SEQ ID NO: 163041 - protein, 105 aa, Glycine max
  Coding DNA Sequence Number=SeqID_71356
MRTAEIQPRKEFHTGLKLEESSGEPIQQGAKKRENVEKEKRIEEDVRDEEEEKKEEEEKDKSKESGDDLNHQNQDHEPVNSGGQKRDTTSLIKGDTVPFDAIKKG

SEQ ID NO: 163042 - protein, 129 aa, Glycine max
  Coding DNA Sequence Number=SeqID_71357
  Subcellular localization annotation: CTP_CleavageSite=63; ConfidenceScore=5.16e-01
MVLLIRPALDSFSWGGPFNATPKVEVCGRGAVNYSLGRRRHSCEFSFFYTLCGGRRGVLRNVLSSLRSGEQCLCGFFPGTTTLIWGHIDGSLSNVGKWIRARNGYGPEQQWCSKFGGVHTEPQKVWTGI

SEQ ID NO: 163043 - protein, 75 aa, Glycine max
  Coding DNA Sequence Number=SeqID_71358
MDLFMAIQLAAFLASSKSKESLAQNLKEVLQLLQQEEEEESSKKDVGSSKDIDDQDDDPFYQNEDDCFGISLEDD

SEQ ID NO: 163044 - protein, 235 aa, Glycine max
  Coding DNA Sequence Number=SeqID_71359
  Pfam annotation: Domain name=Transposase_23; Domain location=33-103; Score=-9.5; E_value=0.013; Accession=PF03017.5; Description =TNP1ENSPM transposase
MKKIQGLQASHGATSGSNVETTPADPSCGKYVSLKPTMGLYLQRQRTTVLVAIGKICEGGSSIHNVTYADDVVRVSVDEFIEGDAEVPFPTSEIQYVKQALQTFIAWPKNLVKKVSHEESHTSPKKLPKTDERGMNDIEHDPLRQLIKSLYYMYDTPIELKWDGSKFGLPNVDALFFLTFSDVNEIVAGYKCLNISILQLWMLFLDEWSSTLGHASVYGFLEPQSIHHAKDRRTE

SEQ ID NO: 163045 - protein, 171 aa, Glycine max
  Coding DNA Sequence Number=SeqID_71360
MEGSGSSGKRIEVSLRRGKFDYVASTSSGNRRPRAGGAKKKEGDAHTVTATPTWPSSQQTPHIPMYHYPTHQYNYSANIGSPPCPTPLRPRMPNQPQRPPQHHPQNPFPTLPRPSANPNPNTNTNPKRNFPERKPVEFTPIPMSYANLLPSLLYNQMAIVSLGKVYHPLFP

SEQ ID NO: 163046 - protein, 203 aa, Glycine max
  Coding DNA Sequence Number=SeqID_71361
  Gene Ontology: Mol. function=phosphoric ester hydrolase activity; Cellular component=cytoplasm; Biological process=carbohydrate metabolic process
  Homolog annotation: Hit_ID=Q6D074; Match level="QueryCoverage=100%, HitCoverage=60%, E-value=1e-103, Identity=93%"; Hit description =Fructose-1,6-bisphosphatase
  Pfam annotation: Domain name=FBPase; Domain location=2-203; Score =219.8; E_value=6.5e-63; Accession=PF00316.11; Description=Fructose-1- 6-bisphosphatase
MKTLGEFIVEKQHDFSHATGELTALLSAIKLGAKIIHRDINKAGLVDILGTSGVSNVQGEVQMKLDLYANEKLKAALKARGEVAGIASEEEDEIVIFDGERAENAKYVVLMDPLDGSSNIDVNVSVGTIFSIYRRITPVGTPVTEEDFLQPGSAQVAAGYVVYGSSTMLVYTTGYGVHAFTYDPSLGVFCLSHEKVRFPASGN

SEQ ID NO: 163047 - protein, 186 aa, Glycine max
  Coding DNA Sequence Number=SeqID_71362
MGKVEEAQEQMKVDMEATKEQMDTMMEAMMSMKKIMEANAVAVAATSAVAKVNPMPPFGLNQMNHPTSARVGKDLESTGDPHYAQIQNKHAFPPYGLPPNYTQPNVAYIPNEDVNNSAPILIESRQPHHAHGPQYHPQLHFLHSTTSKNPRAMAEMGKLDHLEERLRAIKGGEDYAFANIEELGIL

SEQ ID NO: 163048 - protein, 71 aa, Glycine max
  Coding DNA Sequence Number=SeqID_71363
MENWTKHVVTTHSSKLEGGGHMNEKAIHGAPKKGEIGELHYAITTHGSKLEGGHMNENALLGAATILRMEN

SEQ ID NO: 163049 - protein, 840 aa, Glycine max
  Coding DNA Sequence Number=SeqID_71364
  Gene Ontology: Mol. function=subtilase activity; Cellular component =outer membrane; Biological process=proteolysis
  Homolog annotation: Hit_ID=Q54483; Match level="QueryCoverage=52%, HitCoverage=41%, E-value=0.0, Identity=86%"; Hit description=SSP-h1
  Pfam annotation: Domain name=BetR; Domain location=672-816; Score =112.2; E_value=1.6e-30; Accession=PF08667.1; Description=BetR domain
  Pfam annotation: Domain name=Peptidase_S8; Domain location=1-179; Score=-58.0; E_value=0.0012; Accession=PF00082.13; Description =Subtilase family
  Pfam module annotation: Pfam domain module=BetR::Peptidase_S8; Domain location=672-816::1-179
EGCAGTIRSGQTVARQPGRRRLSGRHRRRAQNILVLFAAGNDGNYNQPDVISGLAYFVPDIAPNWLSVASVAQDAASTNSVPYTISSFSSRCGYTASFCVSSPGTRVYSSVIEGTSVENLTTGYAKYSGTSMAAPHVAGSVAVLMERFPYLNGAQVAEVLKTTATDMGAPGIDALYGWGMINLGKAINGPGMLATVEDIPEEFRIPDPTGVAYGPTQFVVDLPGVGAVLDKGKPTERVCSDVLCGLDFWSNDISGHGGLTKEGMGTLVLTGNNTYSGPTLVNQGRLAVNGSVTSAVSVQSGGIVGGSGTVGSLTARQGGTVAPGNSIGTLNVAGNVSFEPGSRYAVEVGPNGQSDRIQSSGSATIGGGEVAVTLENSPNLLTQSEVRSLLGQQYTILSAQQGVSGQFDAVAPNYLFLGTGLSYQPTGVTLSVGRNGTSFASVAQTPNERAVAAAADALAAGNPVYESLLGRRHRKRAKRGGIARRQAAHGRDGVDAGPACGHRMAGERGHDGGAAQRAGVATPVRRAGAWHRAAVQRRQRAVRGGQRAGLARRHGAEGGGGSGGERERHAVAGLRRAAVAEPSGQQRQRRFYLALLTFSDHRNDHGAGMPAPFLFAAAGLALKAQAPFDLRSPSDVLIVSVAATEQIFPGVTMVIIKKRAGVIFYSVLLYVSFDTMFDDATWELFLHYGIGKRQHARELSRILDLSFSHAHRKLKGQSPWTLEQINSVAAALGETPAAIADLSAEHETTEPNMARDAIFFVAGVAMPCVGHIGDELPAGRPAEFVALRVEGQWRIYRADEAPAGPRYGVDLIEIRPGFGDDERLSIAVLDDSHKAADELA

SEQ ID NO: 163050 - protein, 164 aa, Glycine max
  Coding DNA Sequence Number=SeqID_71365
  Gene Ontology: Mol. function=protein binding; Cellular component =periplasmic space
  Homolog annotation: Hit_ID=A8GL44; Match level="QueryCoverage=69%, HitCoverage=68%, E-value=9e-51, Identity=86%"; Hit description =Putative uncharacterized protein precursor
  Pfam annotation: Domain name=LTXXQ; Domain location=120-142; Score =23.4; E_value=0.00081; Accession=PF07813.3; Description=LTXXQ motif
  Pfam annotation: Domain name=LTXXQ; Domain location=47-69; Score =24.6; E_value=0.00036; Accession=PF07813.3; Description=LTXXQ motif
  Pfam module annotation: Pfam domain module=LTXXQ::LTXXQ; Domain location=120-142::47-69
MIMRKLTALFIASTLALGSASAAFAADTTAPAADAAPMKMMHHKGEGKGGPFAGLNLTEQQRQQMRDIMKEWHQKRGPGMKEERQALHNLVASDSFDEAKAKAQIDAIGKAQSERMLERAKAENKMYNLLTPEQKKQYNENYQKREQKMMDHMNKMKAQMSSDQ

SEQ ID NO: 163051 - protein, 45 aa, Glycine max
  Coding DNA Sequence Number=SeqID_71366
MVNKSERRECYWGRDEDKGYVGVRELNVKVGNWGWCAYAWLVEVG

SEQ ID NO: 163052 - protein, 132 aa, Glycine max
  Coding DNA Sequence Number=SeqID_71367
MAIPKEEPPKKWVFLCRQSLTLPKIYLAKVQSSLRLCLNGVFYRGSPILISGAQQIRVSRYRSRVELPYHFHKARCRNMPFCGRAKARLTGALSKGGRMRGVATNVYLWKTSEKLKEIGQNENSKFESCIYA

SEQ ID NO: 163053 - protein, 119 aa, Glycine max
  Coding DNA Sequence Number=SeqID_71368
MDGQWLKKDAQPPQDECTPSPPPQRDDSSALMHEVLSKLRGLRTYVGERFDSLDGRIDAIDAHFEGMDTRITQLEEDEIKIVIIKNWGDCTSKDFDVLMMPKDHVLLNFNSRGSRASQV

SEQ ID NO: 163054 - protein, 125 aa, Glycine max
  Coding DNA Sequence Number=SeqID_71369
MVPRMSSGPPPLDDKRYRMTIICLCVPSDLIVSGWRKGVRMTIICLRLSSGSPPLDDKRCRMTIICLCVPSDSIVSGWQKGKDYGELGLWLKACGTAGHDICQGLASGSGIKGMSHIISMIHMQQ

SEQ ID NO: 163055 - protein, 78 aa, Glycine max
  Coding DNA Sequence Number=SeqID_71370
MAEKTKKRLEEVAQSRSTEGVIDPPSPIRRHVKWKLAHTKKIGQMMPMTAKEIAEKIRILWTSRRHRDRSSPMDVRMS

SEQ ID NO: 163056 - protein, 232 aa, Glycine max
  Coding DNA Sequence Number=SeqID_71371
  Subcellular localization annotation: CTP_CleavageSite=30; ConfidenceScore=5.18e-01
MYPLLFSVTTTQVDVPSTCTTKDVPSNVLRQSSQAVSLLNLYEGETKDISGACFYMLVLLWLLRCLALHLPGDEVFLDEGPINRQLDDLAGGDGFSVELVEARDHSVKPRALLDFSESTGIMLSSNVIHICVRVVMLVRMIRTPSPCGIQAKLMQSDPPRVLDRRIQEDWARATKEGPRVLMNLGWISEPMGQALASHLKEVNLAISELLKEVFSKKLLKEVFSRKLLKEAT

SEQ ID NO: 163057 - protein, 82 aa, Glycine max
  Coding DNA Sequence Number=SeqID_71372
MIEVASITEDRMKPGNTQVHLLSFFRNMTFVRNTQCPIHHNKMVYQKGVNRTLLDMGSSKAVPKTPFELWTNRTPSIRHLHV

SEQ ID NO: 163058 - protein, 108 aa, Glycine max
  Coding DNA Sequence Number=SeqID_71373
MSASDHAILLQVVPFIVRLMSQVIVFPLKNTLRKFITWEINRDKDTIKEDFQDSSKLVEKSSNSFGVNIEKNLKEECKVVMTRSMKLVAAEDEDVVALKDTLLKRGMG

SEQ ID NO: 163059 - protein, 372 aa, Glycine max
  Coding DNA Sequence Number=SeqID_71374
  Gene Ontology: Mol. function=oxidoreductase activity, acting on the CH-OH group of donors, quinone or similar compound as acceptor; Cellular component=outer membrane-bounded periplasmic space; Biological process=...
  Gene Ontology: Biological process=carbohydrate metabolic process
  Homolog annotation: Hit_ID=A4W8H9; Match level="QueryCoverage=99%, HitCoverage=99%, E-value=0.0, Identity=87%"; Hit description=Glucose sorbosone dehydrogenase precursor
  Pfam annotation: Domain name=GSDH; Domain location=228-335; Score =247.9; E_value=2.2e-71; Accession=PF07995.2; Description=Glucose Sorbosone dehydrogenase
MPRSSLIFLPALFIPFSLLAAPEAVRVEMLQNRLDHPWSLAFLPDNNGLLVTLKGGQLKHWQAGKGLSDPIVGVPKVWANGQGGLLDVVLAPDFKQSRRIWLSYAEAGKDGKAGTAVGYGRLSDDLTRIEAFQVVFRQTPKLSTGNHFGGRLVFDGKGYLFIGLGENNQRPTAQDLDKLQGKVVRLTEDGNVPPDNPFVRTPGARPEIWSYGIRNPQGMAMNPWSDTLWLNEHGPRGGDEINIPEKGKNYGWPLATHGINYSGLKIPEAKGEHVEGTEKPLFVWKVSPAVSGMAFYNSDVFPQWKNKLFIGALKEKDVIVLSVKDNKVTEDGRILGDRDQRIRDVRVGPDGYLYVLTDETDGQLLKVSPSGA

SEQ ID NO: 163060 - protein, 270 aa, Glycine max
  Coding DNA Sequence Number=SeqID_71375
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFQRSYAEVQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163061 - protein, 45 aa, Glycine max
  Coding DNA Sequence Number=SeqID_71376
MSASSSRDCEKVSFAICRNLPFGKRATRDSQVLAPHTSIARDDSL

SEQ ID NO: 163062 - protein, 61 aa, Glycine max
  Coding DNA Sequence Number=SeqID_71377
MVEDMHEPHLAINCWHSGLDGGGCMNGNQFMGLRIIFDDGGSTNSARESIRRASDTLVEDT

SEQ ID NO: 163063 - protein, 74 aa, Glycine max
  Coding DNA Sequence Number=SeqID_71378
  Subcellular localization annotation: CTP_CleavageSite=32; ConfidenceScore=5.05e-01
MARTYSPLKVIGTSTQGSTFMRKQRSTHREGRSSTDWTRDVEIYAVSMILGMPLCSLEVPCTIAPHLPPSVKAL

SEQ ID NO: 163064 - protein, 45 aa, Glycine max
  Coding DNA Sequence Number=SeqID_71379
MSLIDAILTRKAPVTRAMSKRLQEDWARAAEEGPRVLMNLRGSIL

SEQ ID NO: 163065 - protein, 93 aa, Glycine max
  Coding DNA Sequence Number=SeqID_71380
  Homolog annotation: Hit_ID=UPI0000ECBAF8; Match level="QueryCoverage =44%, HitCoverage=48%, E-value=1e-16, Identity=100%"; Hit description= UPI0000ECBAF8 related cluster
MEEQEKGLSGVSETTVTHEEKVRVETLEGSVDCRGVVLMEGMQAWHWPSFYNVVTGKTLALPNLIALQHIPLSPAGVIAKRPAPIALPNSCAA

SEQ ID NO: 163066 - protein, 185 aa, Glycine max
  Coding DNA Sequence Number=SeqID_71381
MDRARLVYGLIMKMDMDVGSIISGQISQMAQPNSSRLGFPALITALCIARGVVSDSLTFESLSPTINLAYIRKNCWNPDDPTITFPGSRKAKARAPSYASTSVPTSTPAPPTPVSAPAGLSMQSTNAFVSMLQSLHPGLFLVAWPRVQPSFLGGGETPAAQEPQAQDMPKAGEAEETDRGRTRIK

SEQ ID NO: 163067 - protein, 165 aa, Glycine max
  Coding DNA Sequence Number=SeqID_71382
MELIENMTASDHAILCDRTHIPTKRSLLELSSQDALLAQNNLLAKQLESLTETLSKLPTQLQVAQQSHSAVIHVGGCNICGGAHESGCCIAQDEATKELAKQIAGSSSKGFGANTEQNPKEEYKVVITRSKGGLVVENESGTNEGELGVEEEKEKEGNQMGEREK

SEQ ID NO: 163068 - protein, 69 aa, Glycine max
  Coding DNA Sequence Number=SeqID_71383
KIEENDGTSETPASTPMEVTAEEGAAKACIDEDYIADVTTTQGTWDPWPTSAQDDPTPPQDDPAPAKDH

SEQ ID NO: 163069 - protein, 27 aa, Glycine max
  Coding DNA Sequence Number=SeqID_71384
MRVQELFTHEEGVDKGIALAFTYSQVR

SEQ ID NO: 163070 - protein, 134 aa, Glycine max
  Coding DNA Sequence Number=SeqID_71385
MESKEPMVLFHLQEGEIALRKWMMDRVTLGIMGEELEDQCILYSYMAITPNCHPCNCIRPLRPRRLGGKGWALLRDKCASYALRISKPVGIAEVIKDRGDHSNMTSEKIGKYKELLCQLEPLFEEYDYLPKDMS

SEQ ID NO: 163071 - protein, 84 aa, Glycine max
  Coding DNA Sequence Number=SeqID_71386
MSHVWRRLSMSGFTSDSPQISASPHQLDLAPYASGSYNAQWNTPGFLHDKHMLHSSCILEKMEVEEPWLGLWLPLNYGVDMGAS

SEQ ID NO: 163072 - protein, 105 aa, Glycine max
  Coding DNA Sequence Number=SeqID_71387
MVQLWFGIRVKEPGGPFGGPFVRPPPSSPEPYELIVIHASSTILSGAPRIDCLALFVRPPPSSPEPHELIVIHVSSTIESGAPRIDCLALFMSPPPSNHIRSPMN

SEQ ID NO: 163073 - protein, 133 aa, Glycine max
  Coding DNA Sequence Number=SeqID_71388
MDPEKSNMALGFPVLITDLCQFYEVLVSPTKLIWPLINRSFIEKYYMPRQAQQLGQDQQQLAMHAYMQDLADQQAANHRGQVQLNNNFYQYTLHQQHQDPNPYPWPTPKQFGAIIAWPGDRPNFQGVSDYNFV

SEQ ID NO: 163074 - protein, 78 aa, Glycine max
  Coding DNA Sequence Number=SeqID_71389
MAARSGEPRLTPEVTGSPKRAGSFRLKSFEGPCESEASLGDLGSKKLRKKTLLPLLFGIFHIPDQNVERSPVLCGNWC

SEQ ID NO: 163075 - protein, 325 aa, Glycine max
  Coding DNA Sequence Number=SeqID_71390
  Subcellular localization annotation: CTP_CleavageSite=16; ConfidenceScore=5.58e-01
MAPTPRTHIEILGPIPGSIFSSSLFREPFFFSFLPRASSFLSSAGSPFFLLPHCFASPFASPTRGGCSSSMQAAASPSFECASSSVLSRGAALLFFIEVRMSRSRASSSCWTSVNEELEHIVAHMPKLTIEEQGQWKELAYKLQHVAAPPEGFFQTIFGEVGKVYAAKWKDILGSIWHLVDKDGNYHNVMYNQDVDQPAIVAGWTTLRDFYQRTGDHLISLHHYGKSTFFLTICKTPLLPRAFPRWHSLYHQVPGFVIFKVYLTEQNVFCSSLGVPSSMYYFLKDKGWTHLHFGDVAECQLVFNHWRKLLKIGAGLKVTGESGSG

SEQ ID NO: 163076 - protein, 128 aa, Glycine max
  Coding DNA Sequence Number=SeqID_71391
  Pfam annotation: Domain name=G-patch; Domain location=1-38; Score =25.6; E_value=0.00015; Accession=PF01585.14; Description=G-patch domain
  Subcellular localization annotation: CTP_CleavageSite=78; ConfidenceScore=5.19e-01
MMLRYGYEPGMSLGKNNSGRTSLVSTRGNRGKFGLGYKPTQTDIRKSISQRKNRGQGSRLGQQAEGVPPCHISRSFISAGLRHKGQVAAICKDDSPRRSDLVWPCPPGFRLGNWRVEERPDIYATSIM

SEQ ID NO: 163077 - protein, 194 aa, Glycine max
  Coding DNA Sequence Number=SeqID_71392
MDPLSGSHPLHAPPKVEVCGGGTFGHSIRGGGCPGKLSFLYAICGSRGGVIGNGFPIFEVVSIASVDSLPRRPRLSDAAMMVARVMLGHNYEPEMGLGKNNGGKTSLADIRKNISERKNKGQGPRSGQRAKEALLCHISRSFVSAGLRREGQVAAICDDDSPRRSDLIQPCPPGFQLGNWRVEERPDVYMTSIM

SEQ ID NO: 163078 - protein, 444 aa, Glycine max
  Coding DNA Sequence Number=SeqID_71393
MPSGGKETIFYPLARISKIVKISTQELERGKQVENGVVGVPRKCLEEKARVLASQGEWAPFMDILTLLILGVVLFPNVDGLVDWAAIDAFLAFYNHKESSVVAILADLYDTFDRRCEKNNARIVCWDYNPVLAIRQLGYPMRGAPLEEGLMPFITRGFNSTNAGVLQRIHKAWEMSQRKDKELRGSSNGPIGGYRRWLKAYAQDLDWLLSLRTTKGVEVETLEEDEEVQVLRTELEKAQTVKEKFKSAAVRIRTENAELRDVNLATTKDLEQETKRAHREEHGRNKFRGALWGSNSELKLRREERDQSRVDGLILKDELRVCLRSKRSLSQRLCETKTNMLAIISKYQEELDLATAHEHKVADEYARVYAEKEARGRVINSLHQEETMWMDRFALTLNESQELPRLLAKAKAMVDTYSAPEGIHGLLRYCQHMIDLMAHIIRSC

SEQ ID NO: 163079 - protein, 185 aa, Glycine max
  Coding DNA Sequence Number=SeqID_71394
MAHKVTMDKSTVRSAKNVAMKPLCVTTGLLWLRLATLDPHTLSLDHPSLRLVCTVFSFNTVLHHPTLVLHNFLATCSNHTLLMALLPLPGCHTYLVHTFRTQRLLLVINPLSHPMMAPPSSSNKFHLLLTFPRLSFQIQDSHKVFLQGALGEDGLYKLYPSLARTTSHNNNTHSSANVHNSLLSP

SEQ ID NO: 163080 - protein, 181 aa, Glycine max
  Coding DNA Sequence Number=SeqID_71395
MFSPFGILDSLETSEENCFSEKNPSRGTSIMLPRRFRERFREDSSPFFIVLRSFFVVLWSSTVSLNELTNNQSETKAKINSQIKLCPQKSLKTVLRLSSLVTDAWGANTFPVRKYISRTFHTSSSYTTPFRFFRRFPQINVGGDSAHLPFLEDAPVSLASPSRRRVGCDSWQLHWGLFLES

SEQ ID NO: 163081 - protein, 43 aa, Glycine max
  Coding DNA Sequence Number=SeqID_71396
MAKIMLKVTIASEAILNTINAKDQLYVELVGIESSSSMESFAS

SEQ ID NO: 163082 - protein, 48 aa, Glycine max
  Coding DNA Sequence Number=SeqID_71397
MPKILSFVNIEDPSFSMRGCGSTNDNPLRVYILSLFHPEFIYPLGLSL

SEQ ID NO: 163083 - protein, 72 aa, Glycine max
  Coding DNA Sequence Number=SeqID_71398
MGAKHLVRTKEKSHVIKQRSPDEIRTHLLLEVASPLSLPFSIPLPFIFLEAKESIDEEDPRPTSSNGAYITY

SEQ ID NO: 163084 - protein, 252 aa, Glycine max
  Coding DNA Sequence Number=SeqID_71399
MMIGCGITWMLWKLERIDGDLALRGTRIRATWEYVSSVGGGQQGMVEWYLEICRGGQETLGMSGGVLLPTTKLDQSRPNPGIVSQLKKGTGRLWRPLRNGSLVIDYQIVMAAQLIHDRVEMECLEGAWETLEGNTRCRFRGTIRFTATSLVHPDEPAHTLQRTVEWILPTPTPYRLVEPVHVIEVTSSEEDPEEDPEELPPEPAVDALDFLEGDEDPLPEVDSPEDVMSASEADSTEDSGPGEMAISGGSSS

SEQ ID NO: 163085 - protein, 146 aa, Glycine max
  Coding DNA Sequence Number=SeqID_71400
MGSNQTPSLKKRFYQVKVKSLGITNLSELGQLMGQLQRQAFRKAYGKIWDLAMVDVSTEAIASLAQYYDQPLRKCLEAKARILAGRGKWAPFIDILALLIFGGVLFPNVDGLVDLAAIDAFLAYHDRKESPVVSILVDLYDTFDRR

SEQ ID NO: 163086 - protein, 137 aa, Glycine max
  Coding DNA Sequence Number=SeqID_71401
MFVLTLLNPEIKNIFQKLNGEASRAKKQLFEEGSSTSSSTEATEIDNEGMMKVEQTMTKLATGQGTDVSQPIRLPNIRGNQINFPSWVHDNLNHNQLMGASIEDPYAHLIRFLQSCVSGGGGGGVQLIGSTRTHIIH

SEQ ID NO: 163087 - protein, 332 aa, Glycine max
  Coding DNA Sequence Number=SeqID_71402
  Homolog annotation: Hit_ID=A5BC53; Match level="QueryCoverage=68%, HitCoverage=25%, E-value=2e-07, Identity=22%"; Hit description =Putative uncharacterized protein
  Subcellular localization annotation: CTP_CleavageSite=41; ConfidenceScore=5.28e-01
MAESLKKRKGTSSTTAATGHRRHGPSEAPRAPIHPSLSSPRSSTLFSSDDQRLQYNSQFSSRIILDPKYLDTDLFNDETFDCYQVFQNSGLVDFMSLKLSYYPELVKFFYINLKIQDGIISSEVHGISMIIDQSLFFSLTKLPSQGAPFEGTIVDDWKFNYSSHDARCMVFHDRILLPRSSNLAQASEEYLILMWAFLTGRQIDWAHLVRYRMHKALRANAPLPYPQLVTLFLRHFQIPLDDEPFVQVKRSFAIGVGVVTSFGYRKDRNGQWLKKDALPPQDKRTPSPPPQRDDSSALLNEVLLELRGLRTYVGERFNSLDVRFEGMNTRIT

SEQ ID NO: 163088 - protein, 71 aa, Glycine max
  Coding DNA Sequence Number=SeqID_71403
MDKSLKVGEDEWRERKRRSTKFYASNETDASSIGACRPRIFFINGFLCFLEDKWQRNGEGRERGDATSRRR

SEQ ID NO: 163089 - protein, 151 aa, Glycine max
  Coding DNA Sequence Number=SeqID_71404
MCQQQNLRSLLKFASGKSNLGKTDIDYVPNQPIHFNFKSLQKSKECMNGINGGSDYRKGEYQPNNQMQLSASKALFGSLISVRESEVLIPPHLHFKLASEQVSSAVVRRRRRRRRRPPFPSLTSPESVPALSFQFRYLECYSPILSTFLLP

SEQ ID NO: 163090 - protein, 113 aa, Glycine max
  Coding DNA Sequence Number=SeqID_71405
MVRTRGLGRALGAGRGLLPQHARRQRVRLREDVTERHEDVPQLHEDVPHVFDATPEMTGVADAVQTEGVATDGSLGSPAADEGFPDGPRDPSILTDFAEHVEHSIWSRQVHSF

SEQ ID NO: 163091 - protein, 252 aa, Glycine max
  Coding DNA Sequence Number=SeqID_71406
  Subcellular localization annotation: CTP_CleavageSite=38; ConfidenceScore=5.45e-01
MASNPTRVQKKSKSQKKEARRTFSSSSQQGFNFLNMLEAQGLSKFVQMKGTFYPKLVKVFYTCAKADMESNLYFTINGVEMVIDVAIWKAIAGIDMGGVYKFKEFTDDYSKMATYRGMLLDPTRLLRNRLGIGVLTSRFIDYFTIDISNEIVDFTKASNEITERHLKKLGMTYVDHEWIMEGEQPPPANVDQMEKEAQQKLAHQWSPFESLMIQKMDVILHLHQEHQAKDKAKDHVSNPISRLSKCTQCRIH

SEQ ID NO: 163092 - protein, 40 aa, Glycine max
  Coding DNA Sequence Number=SeqID_71407
MPLDLWVTIAKGGVVDKSGAFAPIYPQFVMRSSDLRSSCK

SEQ ID NO: 163093 - protein, 144 aa, Glycine max
  Coding DNA Sequence Number=SeqID_71408
NLRIDDISDLWCWRLKTKVLPREEPSSARRKGLLGTPAEKSGTFFRWITRNILQKLFPQESTEEPSTLLLREFPEAPFLRAEEGSSRGRTFVFNLQHHSHLCHLRHSNSYEEVRRLTLMAEDTNNNFNGGCQLQWRTRGRGGRK

SEQ ID NO: 163094 - protein, 29 aa, Glycine max
  Coding DNA Sequence Number=SeqID_71409
MVILGGVGVIEEGFRVAGVNARVMEVLMS

SEQ ID NO: 163095 - protein, 85 aa, Glycine max
  Coding DNA Sequence Number=SeqID_71410
  Subcellular localization annotation: CTP_CleavageSite=36; ConfidenceScore=5.14e-01
MTGITHGLKLSLTHTFSIKFSTCLWLSFVSSGLLLYANLFGMETPTMRSIWHCIPLKGVSLGKMFPNFFNKSSTPRGKELAIEDK

SEQ ID NO: 163096 - protein, 118 aa, Glycine max
  Coding DNA Sequence Number=SeqID_71411
MNHFFRKVPGRGFPGVFRKTFGYFQKNTSSGNFPENVLPELPEEPLTGLLEDTAVILFHHFFRRTLIFSPLVFYPKVTTLSKSNGELGRLTSKAVRREDGEEEEAWLVVSGRRRKLGS

SEQ ID NO: 163097 - protein, 116 aa, Glycine max
  Coding DNA Sequence Number=SeqID_71412
MELGLKCDALKGNLSNVLLGMTFNDESLSIRTLATMWSKHLMDTCEVIVGGNIVDDAPEALHGYFLVDDRCPDQAFLKEMHQQFLIPRVCPHFLAIHLQVIFGASGDAILPRKGIG

SEQ ID NO: 163098 - protein, 86 aa, Glycine max
  Coding DNA Sequence Number=SeqID_71413
MMRIMKLAKYRLKAQVEKTKAQVEKDKAPEWRRMKAQTYQGNPCGVYPDLSSFTGSGVYPDLSSFTGSGVYPDLSSFTGSGVIQPL

SEQ ID NO: 163099 - protein, 66 aa, Glycine max
  Coding DNA Sequence Number=SeqID_71414
MNILYSYLSKPTFERGVKKAIIDGPKRLSPGEKTSGVATNVYLRETLENQKRSANFENEGSGVVYT

SEQ ID NO: 163100 - protein, 104 aa, Glycine max
  Coding DNA Sequence Number=SeqID_71415
  Homolog annotation: Hit_ID=UPI0000ECBAF8; Match level="QueryCoverage =39%, HitCoverage=48%, E-value=1e-16, Identity=100%"; Hit description= UPI0000ECBAF8 related cluster
MTKGADNHKVPSHVIGLAVSGLQKGVEDDVSLCVSADLLAPVTSWNFYPEFCMQAWHWPSFYNVVTGKTLALPNLIALQHIPLSPAGVIAKRPAPIALPNSCAA

SEQ ID NO: 163101 - protein, 307 aa, Glycine max
  Coding DNA Sequence Number=SeqID_71416
  Homolog annotation: Hit_ID=Q6WAY6; Match level="QueryCoverage=89%, HitCoverage=45%, E-value=3e-27, Identity=30%"; Hit description =Putative uncharacterized protein
MVEEFEEILGCPLGGRKPYLFSGFYPSLARISKIVQISAQELDSGKQVENGVVGIPRKSLEAKARILAGRGEWAPFIDILALLIFEGVLFPNVDGLVDLAAIDAFLAYHDRKESSVVAILADLYDTFDRRCEKSSTRIVCCTLALYVWLVLHLFRQVRHACSLESHRSCTEKGGANWDRLLANKEGASVNWFPRWKEGRTGVLILCGGFPNVPLMGTRGCISYNPVLAIRQLGYPMRGAPLKEELAPIIARGFNKTNVEALQKVRKAWETVQKKEKELRGSNSELRLRREERDQSRVDSLILKDELK

SEQ ID NO: 163102 - protein, 71 aa, Glycine max
  Coding DNA Sequence Number=SeqID_71417
MWTTTGILRKHYGCPGIPFFNKTGGVVATLLAQAHSARPSELGCFNLKQEIAQKPLEGPRFENYYLHHPFY

SEQ ID NO: 163103 - protein, 263 aa, Glycine max
  Coding DNA Sequence Number=SeqID_71418
YNSNAREKAPEAPINHVITGFGPHLGYTIEGHAFFGVPMLNTPRASQYRPLSQPLHFVRGEGSLVVFEKEKIKHIEERLHTIEGRGSYGFADMSELFGTRCDYSPKEFKVTDFDKYKETTCPKNHLRMYCKRMGAYAKDEKDLMDTFIRQYQYNFDMAPERMQLQNLSKKDNDNNPCLHPVPKRPAVLEISFQPCKNPFTSKDPQGMYPPLFSLNNLVDVPSTRIDPQEMYPLLFLVNSPSRCTLYLYHKGCTLQCVKTKFSG

SEQ ID NO: 163104 - protein, 163 aa, Glycine max
  Coding DNA Sequence Number=SeqID_71419
MPFRGLKSARKQAVFFAFSGKRDELAKQACCAKQIHQYSLYMSSRKRKSIGTRPTSQYDTRRFSSLDAWTRYTDNVLRRNILPERKVELNHTELDDFKAELERRNFHKSLTNLVDGSIDQALVKEFYANLYSSEDRPPKHSRVRGRLVKIDADSLNTILETPS

SEQ ID NO: 163105 - protein, 76 aa, Glycine max
  Coding DNA Sequence Number=SeqID_71420
MAAEWRRKRERRRHFKEKMSLEEAHHHRRPWIRAWRKKEMNEGRGREDHEILCSHIPLIQDQFQDSPLSVLRCHEA

SEQ ID NO: 163106 - protein, 113 aa, Glycine max
  Coding DNA Sequence Number=SeqID_71421
VSYLNFIWGLLFVDLLILASRLKVLNTSYSLKQGTIQCFDQEGKRYQERRAKGSFPWFSWTLETSLGHQITSRHTKGAEKVFQGSEVKGIERRDKDEEERRKKRKRGRCATES

SEQ ID NO: 163107 - protein, 141 aa, Glycine max
  Coding DNA Sequence Number=SeqID_71422
MTLLLSNILPSDRNANLPLQKYQLVCVVPTWVRIAPTKTPSGPEEVQQGPEVSSSGYGPLSALQGARSPQQGSCPQNTVDPEKSNGVLGLPALITGLCRFYGVPVAPSKVIRPPINQAFIKKYCAPRQAQGETPQQHWDGR

SEQ ID NO: 163108 - protein, 101 aa, Glycine max
  Coding DNA Sequence Number=SeqID_71423
MKGACCVGIVPSRKGRLIDLLGAHHNHLLVEVVREMDFMGETFVVEWTIFVGWAPDWEEFRCWLNNCTNAGNMGKWGCEGFVGILAMWELKLWHGRLPPSS

SEQ ID NO: 163109 - protein, 38 aa, Glycine max
  Coding DNA Sequence Number=SeqID_71424
MGTWGRTQIEARVTTDKSSSLPSSGQAENATARQPSIL

SEQ ID NO: 163110 - protein, 114 aa, Glycine max
  Coding DNA Sequence Number=SeqID_71425
  Subcellular localization annotation: CTP_CleavageSite=43; ConfidenceScore=5.69e-01
MTPTPINPSPDHGFSTCLPSSSSSSSCSFGRIGFAVYREADMQASRLRSLSTRPPGADPPVVHVDPATGKANGPHRKKLRIYLGIVVRDKVDVTYENRKEVPTAQKDLIWEDIK

SEQ ID NO: 163111 - protein, 42 aa, Glycine max
  Coding DNA Sequence Number=SeqID_71426
MNNGRVFGMPGKSRNISEIKTSIVAQFVKICNIPEVKKRIVT

SEQ ID NO: 163112 - protein, 267 aa, Glycine max
  Coding DNA Sequence Number=SeqID_71427
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIRSCDRHGGRYVDVDAGLDRRAELLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163113 - protein, 218 aa, Glycine max
  Coding DNA Sequence Number=SeqID_71428
VERDMQGIMLKAKHPVKDSFLDQAHLTYTIVDTQHRPEKGPTEDKEEALPLEANIPYEVQVTDKDKDTATQLPSELVAEELGQLIGPTSSVNKPHAEFLPPLQDKSDLITGSKDDFLTHISKDSFHMQSALLKEMGLSCGDQDSKAIWGDSIAQWDYVPSVQAAGGVKSRSFLMLEGRCILNDQRLVIVNVYAPCDLDGKKALWDDLRQLKVSNPGGL

SEQ ID NO: 163114 - protein, 65 aa, Glycine max
  Coding DNA Sequence Number=SeqID_71429
MESPTIATYPSAGGQREGSWVRLPWEEDVWSRHQRLFEENVGKTGKGCFPCSYVFLNCDKEIRPT

SEQ ID NO: 163115 - protein, 252 aa, Glycine max
  Coding DNA Sequence Number=SeqID_71430
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSITKGLVSILSSRKTRRSQLGGILTKTPSLLVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163116 - protein, 310 aa, Glycine max
  Coding DNA Sequence Number=SeqID_71431
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTLYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLIKMTKKDENAAIVLKKLISQGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFR

SEQ ID NO: 163117 - protein, 240 aa, Glycine max
  Coding DNA Sequence Number=SeqID_71432
  Homolog annotation: Hit_ID=A0TCD9; Match level="QueryCoverage=57%, HitCoverage=11%, E-value=2e-07, Identity=37%"; Hit description =Putative uncharacterized protein precursor
HSQPGFAAGRLQRPVPAGADRPLYQLANDRRGLRAVYRLPVRRAVGARHGVHRGGAGVAQYRQHRRTGSLAAARDLHGRGRRRQYAGHVCAGGGGCCAGRQPAADQRQPDGLPEPVLRARKRPHHRVPGQLARRCPAVRSAGDQHLFAGLGRYGRGQPAKSPAVVEDGHHVRQLQLGHRLQRPGGHPFAARQLRPAFASRSVSAGEPAMLPVRQPGEARLQGTADARSLRGVRQLPERTA

SEQ ID NO: 163118 - protein, 678 aa, Glycine max
  Coding DNA Sequence Number=SeqID_71433
  Gene Ontology: Mol. function=transporter activity; Cellular component= integral to membrane; Biological process=transport
  Homolog annotation: Hit_ID=A8G809; Match level="QueryCoverage=24%, HitCoverage=49%, E-value=1e-82, Identity=90%"; Hit description =Alkaline phosphatase
  Pfam annotation: Domain name=BPD_transp_1; Domain location=238-677; Score=18.1; E_value=0.00095; Accession=PF00528.13; Description =Binding-protein-dependent transport s
IGVKAKIVTYEWGEYLKRAKAGEHQTVMMGWTGDNGDPDNFFATLFSCAAAKDGSNYSRWCYKPFEDLIQPARAESNHDKRIELYKQAQVVMHDQAPALIVAHSTVYEPVRKEVKGYVVDPLGAQQVCAPADQSPAYGRRIVQRHFILRRLGLVIPTFIGITLLTFAFVHMIPGDPVTIMAGERGISAERHAQLMAEMGLDKPLYQQYFSYVSNVLQGDLGTSLKSRISVWSEFVPRFQATLELGICAMIFAVLVGIPVGVLAAVKRGSVFDHTAVGISLTGYSMPIFWWGMMLIMLVSVQLNLTPPAADRLHADRHPDLGRAGRLRRRGDAHDPAGHRAGHHPAGGDRAHDPFLDAGGVGRRLHPHRARQGREPHAGDRRSRAAQRAAAGGDGDRAAGRHHAGRRHSDRNHLLLAGAGPLADRRAAAPRLPGGAGRGVAGRLGRGRPGVYRSDAGDRARRRRAGAACAGGPVPRRAAQAAGVARGRQLAIYPRHRRRGPRRAVAPDVRCAPVAAGRLPGGGAVADHGRDIRPAGRLLRRRGGRDYHARRRHHAGPAEPAAGAGAGGGIRAVDRQRLAGADLRRPAALCASDARSGAGGGEPRLLTASRVAGAGALRLMFVNILPNCLAPLIVQASLGFSNAFWTWPLSVSGHGRAAAYAGVVHHALQRAAVRAKRLV

SEQ ID NO: 163119 - protein, 416 aa, Glycine max
  Coding DNA Sequence Number=SeqID_71434
FGRFQRRRLRAQERQQEQRRQAGGDGNHHEEAVPVPDLHHPRDRVAGQRRAQVGEQADETGRRARRILVRALRRRHADQHLRAEDEETDGEEAAGLQQVGHARHQPQCRHRQEDTDGEDQVHRAAVAAEQLVGTPTGHQRTDKAAHFKQRNGRVGGHQRIALFLRQVEVAPIVDRGAHDVHQHVRDRQQPDVLVGQHVAFDDLAVAQPLAFRFLHQLHGVVAPFADARQPQGGWLVAQAPAHQQAKHHTDDTGDDHAVTPAEVQRDKAHQQRDQRASDVVRGVPDSPPATALGARIPAGEDFGTRRPAPALEEGVEDPQRAQHQQRRTEAEEDIQHPGHDQAQPHKVTRVGAIADHAGNEFRAAVGDVEQRAEDADVGHRQAQIAQHRRHDEVETFAREVKRGVADVHGGHQLDAP

SEQ ID NO: 163120 - protein, 147 aa, Glycine max
  Coding DNA Sequence Number=SeqID_71435
  Gene Ontology: Biological process=transposition, DNA-mediated
  Homolog annotation: Hit_ID=Q1J7G7; Match level="QueryCoverage=27%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDWIADEVNVDEEWNENPKADEEQQMN

SEQ ID NO: 163121 - protein, 87 aa, Glycine max
  Coding DNA Sequence Number=SeqID_71436
MARDKLADDEADNIKLQLIAARGKDGRAQKEILLLKLKMENCKESMNCTLAICHYSTLYSFLMEKMDIELTYFTILLHPAKKESEAV

SEQ ID NO: 163122 - protein, 151 aa, Glycine max
  Coding DNA Sequence Number=SeqID_71437
MDMNVGHIISSQISVIAQHDCSRLGFPTLITALCKARGVTSDSLTFESFTVAINVAYVKKNYWNLDDATVTFRGPHKAKGKRSEALPSSEIPLSVALSSFDIPPISASAPTPLPAPPTGPSSFTSETLFVMLQNLHRGQIIIIQRLQSSGQ

SEQ ID NO: 163123 - protein, 124 aa, Glycine max
  Coding DNA Sequence Number=SeqID_71438
  Homolog annotation: Hit_ID=A7P3Y3; Match level="QueryCoverage=92%, HitCoverage=19%, E-value=5e-44, Identity=73%"; Hit description =Chromosome chr1 scaffold_5, whole genome shotgun sequence
  Pfam annotation: Domain name=DUF747; Domain location=1-114; Score= -112.8; E_value=2.8e-06; Accession=PF05346.2; Description=Eukaryotic membrane protein (cytomegalovirus gH-receptor) family
MGIDIIKHSFIAKFNNIAPIAYSEFLEVLCKQTLHMQTEGAKKKLTFVPLAPACVVIRVLAPVYAANLPYNPLRWRLFWILLFSAITYIMLTSLKVLIGMVLQKHARCTKEAHTLMLTREFFEA

SEQ ID NO: 163124 - protein, 124 aa, Glycine max
  Coding DNA Sequence Number=SeqID_71439
  Gene Ontology: Cellular component=integral to membrane; Biological process=protein transport
  Homolog annotation: Hit_ID=A7R1U0; Match level="QueryCoverage=85%, HitCoverage=45%, E-value=1e-27, Identity=59%"; Hit description =Chromosome undetermined scaffold_377, whole genome shotgun sequence
MAGRYDSNPFDEEEVNPFSDPSVRGKASSQSNFSGGAFYTTNPGSVPAATNSRLPPLKPEPVDYNYGFGATVDIPLDSSMDLKKKEKELQAKETELRKREQSYNLKSLGDSISSLGTFYWMSGY

SEQ ID NO: 163125 - protein, 149 aa, Glycine max
  Coding DNA Sequence Number=SeqID_71440
  Homolog annotation: Hit_ID=A5C9F7; Match level="QueryCoverage=38%, HitCoverage=15%, E-value=5e-07, Identity=45%"; Hit description =Putative uncharacterized protein
MKTYENDDLKVTVVTSEINPEDESYPSERKEAAVIPQSVVSDKRQGVPISNKKSFKKVAKQRSRPRPSSKRDKKKGKKRGKNNLAIPRSENSCLHIAGFGRVSFSWLPTWFLLSMTGFSSSGLFLSSHFGDPRVKKETPNFSPFLLVNR

SEQ ID NO: 163126 - protein, 388 aa, Glycine max
  Coding DNA Sequence Number=SeqID_71441
  Gene Ontology: Mol. function=inositol or phosphatidylinositol phosphatase activity; Cellular component=ribosome; Biological process=sulfur metabolic process
  Homolog annotation: Hit_ID=A7R1U1; Match level="QueryCoverage=96%, HitCoverage=96%, E-value=1e-142, Identity=66%"; Hit description =Chromosome undetermined scaffold_377, whole genome shotgun sequence
  Pfam annotation: Domain name=Inositol_P; Domain location=53-384; Score=82.0; E_value=1.9e-21; Accession=PF00459.16; Description =Inositol monophosphatase family
MEEEDHKMFGLVSEPEEYCKELGVAVRAVQMACFLCQKLQDTLISKSRSNNNLNSPLTVAGWSVKAIVSWILFECLGNENVSIVTEKEVRTLSSTNASELLEAVVKTVNECLAEAPRFGVEEPKSTLGTSEVLEIISRCNSVGDPSGRFWALSPLDGGSSCGDQHVVALSLIEEGEVVLGVLGCPNYPMRKDWFSYHHSYLRMISKLAPPTSQTWNKGCVIYAKRGSGKAWIQPLLHVNDKFVWPNHAKQVSVSSIDNLEMATFCQPVEKANLSHSFAEGLAHSVGFSNQPLRVYNTMKYTAIACGDAEVFIKFARAGYKEKIWDHAAGAIIIQETGGMVTDAKGHPLDFSKGLYFERLDRGIVACAGATLHEKIIDAVDASWASSCL

SEQ ID NO: 163127 - protein, 566 aa, Glycine max
  Coding DNA Sequence Number=SeqID_71442
  Gene Ontology: Mol. function=oxidoreductase activity; Cellular component=intrinsic to mitochondrial inner membrane; Biological process=electron transport
  Homolog annotation: Hit_ID=Q8H5X6; Match level="QueryCoverage=88%, HitCoverage=86%, E-value=0.0, Identity=72%"; Hit description =Putative NADH dehydrogenase
  Pfam annotation: Domain name=Pyr_redox; Domain location=282-398; Score=21.0; E_value=5.7e-05; Accession=PF00070.18; Description =Pyridine nucleotide-disulphide oxidor
  Pfam annotation: Domain name=Pyr_redox_2; Domain location=114-442; Score=81.6; E_value=2.6e-21; Accession=PF07992.5; Description =Pyridine nucleotide-disulphide oxidore
  Pfam module annotation: Pfam domain module=Pyr_redox::Pyr_redox_2; Domain location=282-398::114-442
MALARIARANLRRSGGAFGSYAHEKDTFNVGGYTSRCNIPSHANFESDGKFSYAPRIKEQNYMNFSMRGISGTPHHQFPSASTQTVIEESEYEFENDRQRYAGLEATKPGEKPRVVVLGTGWAACRFLKGIDTKIYDVVCISPRNHMVFTPLLASTCVGTLEFRTVTEPVSRIQDALARDPNSYFFLASCTGIDTGKHEIYCEAVNNGGLPQEPYQFKVAYDKLVIATGSEPLTFGIKGVKENAFFLREVNHAQEIRKRLLLNLMLSENPGISEEEKKCLLHCVVIGGGPTGVEFSGELSDFIMRDVHERYTHVKDYIHVTLIEVPRTWLNSLPYRKAYCANEILSSFDVSLRQYATKHLTKSGVRLMRGVVKEVHPKKIILSDGTEVPYGLLVWSTGVGASQFVKTLDLPKSQGGRIGVDDWLRVPSVEDVFALGDCAGFLEHTGRPVLPALAQVAERQGKFLVELFNEIGNQNGGKAYSAKGMPFGEPFVYRHLGSMASVGGYKALVDLRQSKDSKGLSLAGFVSWMIWRSAYLTRVLSWRNRFYVAVNWATTLVFGRDNSRIG

SEQ ID NO: 163128 - protein, 162 aa, Glycine max
  Coding DNA Sequence Number=SeqID_71443
  Gene Ontology: Mol. function=oxidoreductase activity; Cellular component=anchored to membrane; Biological process=response to oxidative stress
  Homolog annotation: Hit_ID=Q2HTY9; Match level="QueryCoverage=97%, HitCoverage=72%, E-value=3e-22, Identity=50%"; Hit description=FAD linked oxidase, N-terminal
MFSLHEVDLDIESGMAWVEAGATLGELNYQIANKSNVHAFPAGVCSSLGTGGHFSGGGYGNLMRKYGLSVDDIIDAKLVNANALLPTPQEPPSIYFKSKSDFVETPIPKEALKSIWDLMIKYNNIWMQWSPYGGRMAEISPQATTFPHRAGNLFLIQYSVLD

SEQ ID NO: 163129 - protein, 129 aa, Glycine max
  Coding DNA Sequence Number=SeqID_71444
MQAKTHNKKFEGNIYTRKVELVGGIELETTSCWEKRSRDGGNGIGGVGSGTLEGEIIRVVVVVVVVMVMMKMVKVSGRRRRIGGGGMAERKLEEVPDLRFGVRLGISYGHALLFGKNSDNRAREGKGRT

SEQ ID NO: 163130 - protein, 85 aa, Glycine max
  Coding DNA Sequence Number=SeqID_71445
  Subcellular localization annotation: CTP_CleavageSite=62; ConfidenceScore=5.18e-01
MLRARSGLYATHGSIFLLLTQYPFKNTSVNMFYSKLQLLQTENGGFFGALLLGSLRTGGTTLSSAVWCLTEISSCMIYCSKVGPG

SEQ ID NO: 163131 - protein, 67 aa, Glycine max
  Coding DNA Sequence Number=SeqID_71446
MAPDENAKTPCTNLNFGIFFCRDDPRCEEEEEEEEEEEEEEEEEEEEEEEEEEEEEEEEEEEEEGSV

SEQ ID NO: 163132 - protein, 53 aa, Glycine max
  Coding DNA Sequence Number=SeqID_71447
MNGSEGGDGFHFRAGWMFDKMKDDARVVKWGLRVTNISGLPSQWTRDSSEKIV

SEQ ID NO: 163133 - protein, 139 aa, Glycine max
  Coding DNA Sequence Number=SeqID_71448
  Homolog annotation: Hit_ID=A7QKD3; Match level="QueryCoverage=100%, HitCoverage=18%, E-value=2e-30, Identity=55%"; Hit description =Chromosome chr2 scaffold_112, whole genome shotgun sequence
MFKGELYLLATDQGYINQPDLVWEKLNEMSSIKPLENLKVNGDTLFLTSNLKEFKVENHESSTWDENNALTSTAVYNFTFKDYLASIDSATHASLDINSDLQLAIALQQQEFEQQPPRQDNLQQKSSISGSSRLVTGPQ

SEQ ID NO: 163134 - protein, 273 aa, Glycine max
  Coding DNA Sequence Number=SeqID_71449
  Homolog annotation: Hit_ID=A6FJQ2; Match level="QueryCoverage=13%, HitCoverage=84%, E-value=9e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPLKLQKTIEDNATAAASNTAREVEPVLQPAINLGRDRNTTVFGRRYSPIAYPYGLPPDFTPHTAPDDLSQAPTFEKQLPPYADYPLQEDDEGEAHLGPLLPLKDPAPHELPQPNIVAMSRLHPHLLKNSFGRETCRASCINESANARGEAVCVLGALPLPRSLTRCARSFGCGERYQLTQR

SEQ ID NO: 163135 - protein, 66 aa, Glycine max
  Coding DNA Sequence Number=SeqID_71450
  Subcellular localization annotation: CTP_CleavageSite=28; ConfidenceScore=5.56e-01
MVMMMTKVMTKSSKINQRTTQVNQEQFKSSRKKNSRLKRKVKSQESRFKVQDLKTQDSRFKNQEKA

SEQ ID NO: 163136 - protein, 110 aa, Glycine max
  Coding DNA Sequence Number=SeqID_71451
MALKKFSTKRSRRDATGEGSSVAPEFDSHRFQSAEHQQHFEAIKGWSFHKERRDQLREDEYMDFQEEIARRHWTPLVTHMAKFDPEIVLEFYANAWPTEEGVRDMRSWVR

SEQ ID NO: 163137 - protein, 72 aa, Glycine max
  Coding DNA Sequence Number=SeqID_71452
MCYASHPGKSNSISTSKVCGTFDINSRVNSSQEGGYDRGLSKEEEFYLMGSTWMDQSLEQGVREFKKSLARD

SEQ ID NO: 163138 - protein, 59 aa, Glycine max
  Coding DNA Sequence Number=SeqID_71453
MKERERKIFRPDKFSARSFSTSDIPPDMNKEEKTETPSVLSKNTTLEKILLIRDRTCDL

SEQ ID NO: 163139 - protein, 39 aa, Glycine max
  Coding DNA Sequence Number=SeqID_71454
MRGYPMVTCTIRQPGPNESVDARRLTSSSAPFVVLTREI

SEQ ID NO: 163140 - protein, 395 aa, Glycine max
  Coding DNA Sequence Number=SeqID_71455
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=41%, E-value=0.0, Identity=63%"; Hit description=NBS-LRR type disease resistance protein Rps1-k-1
  Pfam annotation: Domain name=LRR_1; Domain location=102-124; Score =6.0; E_value=24; Accession=PF00560.24; Description=Leucine Rich Repeat
  Pfam annotation: Domain name=LRR_1; Domain location=160-180; Score =10.7; E_value=3.3; Accession=PF00560.24; Description=Leucine Rich Repeat
  Pfam annotation: Domain name=LRR_1; Domain location=182-207; Score =6.0; E_value=24; Accession=PF00560.24; Description=Leucine Rich Repeat
  Pfam annotation: Domain name=LRR_1; Domain location=305-327; Score =4.2; E_value=51; Accession=PF00560.24; Description=Leucine Rich Repeat
  Pfam annotation: Domain name=LRR_1; Domain location=330-353; Score =4.6; E_value=43; Accession=PF00560.24; Description=Leucine Rich Repeat
  Pfam annotation: Domain name=LRR_1; Domain location=79-100; Score =6.0; E_value=24; Accession=PF00560.24; Description=Leucine Rich Repeat
  Pfam module annotation: Pfam domain module=LRR_1::LRR_1::LRR_1::LRR _1::LRR_1::LRR_1; Domain location=102-124::160-180::182-207::305 -327::330-353::79-100
NLENVSQSDEALEARIMDKKHINSLRLEWSGCNNNSTNFQLEIDVLCKLQPHFNIELLHIKGYKGTRFPDWMGNSSYCNMTHLALSDCDNCSMLPSLGQLPSLKFLEISRLNRLKTIDAGFYKNEDCRSGTPFPSLESLSIDNMPCWEVWSSFDSEAFPVLENLYIRDCPKLEGSLPNHLPALETLDISNCELLVSSLPTAPAIQRLEISKSNKVALHAFPLLVEIIIVEGSPMVESMMEAITNIQPTCLRSLTLRDSSSAVSFPGGRLPESLKTLRIKDLKKLEFPTQHKHELLESLEGLPAPNLIAFSISGSDKLKSLPDEMSSLLPKLEDLGIFNCPEIESFPKRGMPPNLRTVWIENCEKLLSGLAWPSMGMLTHLTVGGRCDGIKSFPKE

SEQ ID NO: 163141 - protein, 91 aa, Glycine max
  Coding DNA Sequence Number=SeqID_71456
  Subcellular localization annotation: CTP_CleavageSite=53; ConfidenceScore=5.27e-01
MTMQNMQFQQEARASIQSLTNQMGQLATQLNQQQSLNSDRLPSQSVQNPKNVSAITLRSGKQCQEPQPANEPAQPHSTPENGGDSKDVKSK

SEQ ID NO: 163142 - protein, 88 aa, Glycine max
  Coding DNA Sequence Number=SeqID_71457
MKGMRYHAQDCNNDAQLPMVLASGSVALHISLYSVASQVEPQLYRLTRSRSAKTVSSIGACRPWIFFINGVLCFLRFDCSGMEKEQDE

SEQ ID NO: 163143 - protein, 300 aa, Glycine max
  Coding DNA Sequence Number=SeqID_71458
  Homolog annotation: Hit_ID=A5AHQ6; Match level="QueryCoverage=61%, HitCoverage=18%, E-value=4e-07, Identity=22%"; Hit description =Putative uncharacterized protein
MAESSKKQKGMSSTTTTIGHRRHRPSKAPTAPIHPSLIILDPKYLDIDFFNDETFDCYQVFRNTGLVDFMSLKLPYYPELVRVFYSNLKIQDGIIRSEVHGISMIIDQSLLFSLTKLPNQGAPFEVTIVDDWKFDYSSHDARRMTFLTGRQIDWAHLVRYRMHKAYRANAPLPYPQLVTLFLCHFQIPLDDEPFVQVKRSFAIGASALTSFDYRKDRDRQWLKKDALPPQDEHTPSPPTQRDDSSTLMNEVLSELWGLHTYVGERFDSLDGRFDGLDTRITQLEEDVGYLHRCFDLPPPS

SEQ ID NO: 163144 - protein, 70 aa, Glycine max
  Coding DNA Sequence Number=SeqID_71459
  Homolog annotation: Hit_ID=UPI0000ECBAF8; Match level="QueryCoverage =58%, HitCoverage=48%, E-value=1e-16, Identity=100%"; Hit description= UPI0000ECBAF8 related cluster
MYSNAGGMIDYAESRPAGMQAWHWPSFYNVVTGKTLALPNLIALQHIPLSPAGVIAKRPAPIALPNSCAA

SEQ ID NO: 163145 - protein, 161 aa, Glycine max
  Coding DNA Sequence Number=SeqID_71460
MGCSSSMAGADGMINGSGGIGSSSASGTGSWAAEASPPPEGEGWTPGKATYARNSSTLIAGYWPELCNLCMMMIWPLCRLCSMENNVSEVTEDGPIGGTGAGKGVGAEAGNCGRCGVKVDGAEGFGKVDEEEEEVSSATEVGGASDLLPLAFLGPLNVTVG

SEQ ID NO: 163146 - protein, 80 aa, Glycine max
  Coding DNA Sequence Number=SeqID_71461
MGLNQDHAFKKRKEHALRCPYRTRARARVMGEVEKVQEQMKADMEAMKEQMATIMEAMMSMKKIMEANAVAVAAISAVAK

SEQ ID NO: 163147 - protein, 146 aa, Glycine max
  Coding DNA Sequence Number=SeqID_71462
  Homolog annotation: Hit_ID=A5BEV8; Match level="QueryCoverage=84%, HitCoverage=18%, E-value=2e-14, Identity=31%"; Hit description =Putative uncharacterized protein
MGEDSWSLVRNHLLKELGKFLDDYIKLFGGTNRFEEFRMSLLVDELTKVTMNKWMDIIDMGYVIASRSQTSTDTSVHRIICIGHVYGNYFVQVYLKDRCPLPPVALLWSNNYHPQAKQWPTPYISRMQHYKSFMMFKRDYVDINDD

SEQ ID NO: 163148 - protein, 96 aa, Glycine max
  Coding DNA Sequence Number=SeqID_71463
MWKRIRRVELVLWMRWWLRNDELLKPKRRRMNPYISIDEIKRKMKKKKISSYGSRFDEEMSKIGSFGGLGMEERRKGEEAAQEFLKNVIFIDQDAL

SEQ ID NO: 163149 - protein, 356 aa, Glycine max
  Coding DNA Sequence Number=SeqID_71464
  Gene Ontology: Mol. function=hydrolase activity, acting on carbon -nitrogen (but not peptide) bonds, in cyclic amides; Cellular component=mitochondrion; Biological process=pyrimidine nucleotide biosynthetic process
  Homolog annotation: Hit_ID=Q12NL3; Match level="QueryCoverage=32%, HitCoverage=33%, E-value=2e-41, Identity=72%"; Hit description =Dihydroorotase
  Pfam annotation: Domain name=BON; Domain location=299-356; Score =15.2; E_value=0.04; Accession=PF04972.8; Description=Transport -associated domain
  Pfam annotation: Domain name=efhand; Domain location=250-275; Score =11.2; E_value=1.2; Accession=PF00036.23; Description=EF hand
  Pfam annotation: Domain name=efhand; Domain location=276-304; Score =24.9; E_value=0.0003; Accession=PF00036.23; Description=EF hand
  Pfam module annotation: Pfam domain module=BON::efhand::efhand; Domain location=299-356::250-275::276-304
ATLPEGRKADRYPVSDRVGTGERTRELPGGNACLWKNASNAAFVRFLAFCWPFAHMFFPALSPDSVDNRITAFEKRKSAQYANRLSPRVGRFINAAGTTGFPTGKRAVSATQLMQALVKAGISDSGKFFLGTDSAPHPKSAKEASCGCAGMYTAHAAIELYAEAFEEAGALDKLENFASVYGSDFYGLPRNTDKITLRKESWLVPDSIPFADDVLVPLRAGQTIAWRLVMMLSAHGFAVTIDEMRGEQAPYEQAFKALDTDGNGKLSKKEVSKDKDFKHAFAKADKNHNGSLDQDEFASYKSKVDGAENKQAAADSAITAKINGFVDTAEQKARAEKIAKSVDGVKSVNNALVVKP

SEQ ID NO: 163150 - protein, 84 aa, Glycine max
  Coding DNA Sequence Number=SeqID_71465
MASMMEAMLGMKRLMESAYPYGLPPNYTPPAMHEDAGHVTPLILEGEPPRHPDGVHKDPRERAQGDVDSYSLFPTEGPAPNALP

SEQ ID NO: 163151 - protein, 76 aa, Glycine max
  Coding DNA Sequence Number=SeqID_71466
IVIIKKGEIVEVMSSKVILMMPKNQELRKVSSKDSRIKFQDSRFKNQVSSFKIQESRSRFKTQDSRIKRRLNQDKY

SEQ ID NO: 163152 - protein, 105 aa, Glycine max
  Coding DNA Sequence Number=SeqID_71467
  Subcellular localization annotation: CTP_CleavageSite=61; ConfidenceScore=5.31e-01
MKLCFYKAKRSCALSLFCRKKYFMCLQAKLHLATLSARMASRKRKAPSTPTQARFDRSRFTSQEAWERYTDIVVPLKLLLEKNVVVYYTKFDEFKEELKRRHWDE

SEQ ID NO: 163153 - protein, 72 aa, Glycine max
  Coding DNA Sequence Number=SeqID_71468
MIYLSWLRQNFQQLLIDVDDVAIAQHARAHIMMLISGYLMPDTSAILASLFRALDRVVKPDQTKIGECLLLL

SEQ ID NO: 163154 - protein, 126 aa, Glycine max
  Coding DNA Sequence Number=SeqID_71469
MGNNQSDLIPIDLEINATCRRRNQERIINFLQDLEGAVIPEEEPQSSEASSSFPIAKHSHLDLSEDYIMAEEPRRVTLEDYSSSNVPQFFTSIGQPEVQAQTITYPPSLIQLIQNNFFHGLPNEDP

SEQ ID NO: 163155 - protein, 292 aa, Glycine max
  Coding DNA Sequence Number=SeqID_71470
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSSAAGLLEFARGSLQTLFAWVSPVEAAEQQILHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163156 - protein, 132 aa, Glycine max
  Coding DNA Sequence Number=SeqID_71471
  Subcellular localization annotation: CTP_CleavageSite=46; ConfidenceScore=5.10e-01
MPPTRHPLDPDKSNRALGFPALITSLCQSFRVTVTPSKVIRPPITRAFIEKYCTPRQVQGDAPQAADAPPPPHQADPAGSFGMEWGHVQTHECLYQLSLSLQSQGFAHFLCPTLDQFRAEVAWPRDWPEDQT

SEQ ID NO: 163157 - protein, 196 aa, Glycine max
  Coding DNA Sequence Number=SeqID_71472
MTTQCTCRLDFTSTKTGSTRMRTMLWMSLCNLKMKICHKWGLNKYQTRLLADNVQALICVRSEYLFTPSFKLVLLVFIWEWSYRQAHWVAKSGDVSSTSRNLTITQKLTNLPKRRKLGPLLYSTLSLKFTLFRPLSSEQFSWLPLILCKSGLNGLPDLDVVLSAILALSSRNEDEDVEMKKDQDTSKMKSFVVGDV

SEQ ID NO: 163158 - protein, 168 aa, Glycine max
  Coding DNA Sequence Number=SeqID_71473
MAEPSAMTSSIFRYAIRHIFMANFWLSAMNRRPPLTTLLGDREKERERDRDKKDQSKDKEREKEREVEKDSDRVREKERERRREKALEMGTRIRGKIKLERRRERRIEIKKRARDRVSRKTYEEDYELDNVDDKVDYHDKRDEEIGKQAKDSKLDNDNQDGQTSTHLS

SEQ ID NO: 163159 - protein, 112 aa, Glycine max
  Coding DNA Sequence Number=SeqID_71474
MVIWFGPSKGVTCCIFWEILVTWLYALESGYQLLDEVLGSMGKMDKVSKDRVNWDSVWGNWIGNWFGNLVERAWRSSLHHFYTSNDDVNLTRSGSFDTGYEVLDDATSSEGR

SEQ ID NO: 163160 - protein, 59 aa, Glycine max
  Coding DNA Sequence Number=SeqID_71475
MAGAGDNGGVYHQLDGSQRLLLDVMTTQMQRLLNRNNEELYIRIAKSSLFILKPLSPRE

SEQ ID NO: 163161 - protein, 168 aa, Glycine max
  Coding DNA Sequence Number=SeqID_71476
  Homolog annotation: Hit_ID=A5BK17; Match level="QueryCoverage=64%, HitCoverage=9%, E-value=3e-08, Identity=31%"; Hit description =Putative uncharacterized protein
MLPQCVMLQSLATEAGSFRSVFWSGNQGCLFPALCLNILDHCPTFEFLWLHFVVNIQQTSPFEGPDLIFIGNGQGLNISASGHSNFVYPFGPNVKLFLKNMLHVPQITKNLIGDSNKILLQGGGIGFDGLYQFPNLQFCSAVSSPACINIVSSVGCNNTVPNSIYLAP

SEQ ID NO: 163162 - protein, 155 aa, Glycine max
  Coding DNA Sequence Number=SeqID_71477
  Homolog annotation: Hit_ID=A7QV24; Match level="QueryCoverage=28%, HitCoverage=6%, E-value=4e-11, Identity=75%"; Hit description =Chromosome undetermined scaffold_184, whole genome shotgun sequence
MKQEKRMKQYHEELKMKQIKSLDTPSLSVERMREVQARLQTSWINIGIKEHSNRVSPKAYTSKSPSGPLPPDSVYLVAKGLNINSLPLKDLSINSLPLKGLIVDPVATYPSAGGRRVTRGMRVPRKEYARSRHQRLFEENVGKTGKDAIYELLSE

SEQ ID NO: 163163 - protein, 355 aa, Glycine max
  Coding DNA Sequence Number=SeqID_71478
  Homolog annotation: Hit_ID=A7QV24; Match level="QueryCoverage=99%, HitCoverage=56%, E-value=1e-117, Identity=62%"; Hit description =Chromosome undetermined scaffold_184, whole genome shotgun sequence
MEGGTVVLTIKDQPILANGDVNEDVDMLENIEIGEQKRRDEAYKAAKKKKTGIYDDKFNDDLSTEKKMLPQYDDPVAEEGLTLDEKGRFSGEAEKKIEELRRRLTGVSTNTFEDLTASGKVSSDYYTHEEMLKFKKPKKKKSLRKKYKLDINALEVETVSSGLSVSDLGSRKDVRRQAIKDEQERLEAEMRSNAYQSAYAKADEASKLLRLEQTLNVKTEEDETPVFVDDDEDLRKSLEKARRLALKKEGEGASCPQAIALLATSNHNNETDDQNPTAGESRENKVVFTEMEEFVWSLHIDEEARKPESEDVFMHDDEEANVPDEEKSNEAGGWTGVQETNEDEQRNTENKEEIK

SEQ ID NO: 163164 - protein, 185 aa, Glycine max
  Coding DNA Sequence Number=SeqID_71479
MIMRGQDIYSSQDEATTSPSSSESEKTKGEESSEEIYPQEEGQPLVVKEKCKEVSVSSKRLAKKETHFTIKTNIKETFPLRQPPHFLFCKKTLVSIVTPLGLEFIPQVKRLLDEGLVRKSLNLYVLLVPKIGIPMDPKRIKVIPEWPTPPSVEGRSPEYEEPQDLRSNPFQGGGNDAILPRKDIG

SEQ ID NO: 163165 - protein, 22 aa, Glycine max
  Coding DNA Sequence Number=SeqID_71480
MPPNRRPSPKPKVARYLGYACI

SEQ ID NO: 163166 - protein, 86 aa, Glycine max
  Coding DNA Sequence Number=SeqID_71481
MKTSPKSHTVVNASTYQCYSCGFWNSDIYGFLEPQSIQRSGQSQFESESYIKTWMQSSKRDVYLGAYLNGGHWQMVVIVPKEHLVV

SEQ ID NO: 163167 - protein, 92 aa, Glycine max
  Coding DNA Sequence Number=SeqID_71482
GCSNSDFDIESGNWNQRGCSKSDFAFESGNWNQRGCSNSDFAFESGNWNHRGVSKYNESKDIQSSEHKEDEEMAQKEDLMIFQGGEDLTIGQ

SEQ ID NO: 163168 - protein, 284 aa, Glycine max
  Coding DNA Sequence Number=SeqID_71483
MARGWGVYASLTRTGMNNSILKHHVDLRFNFLFLEMRIPVRMNIDRGDVGKKGLKLVNDGEYGGVGSGFKPRDLTRRAYTKLCVLPPSTRITTCGSGGFWVSEELFGIPGKVGSGATVAPRELLIAIKTQSSLPLACDFLRAQVFDGGYGEGNWGRRLRARVGTLPETFAVFQEFLLLETGQAGGMHQRERLESLDFTPNVQFEARDEATQESLVGSLYGDCAKRASIACRKSDHVGSLVYLHDGVGVGVEEEEENGRHGDEKEEEGGFDYARIEMGNSRIFYF

SEQ ID NO: 163169 - protein, 75 aa, Glycine max
  Coding DNA Sequence Number=SeqID_71484
MVCENKYANVLVPPTSITEQQYGYNIPKNQVTALCVQIYDKLALSYQVLRIKPFPNEDNPNYTCVCVIKTKTCEN

SEQ ID NO: 163170 - protein, 84 aa, Glycine max
  Coding DNA Sequence Number=SeqID_71485
MDYLSLYFIHFCLKIQKQNYLLMAPFGMSNMAIKWSFKLVNEYVLLSKAPARSMRHKNPKENLPCKHALSALSLAKRVIRHLPD

SEQ ID NO: 163171 - protein, 39 aa, Glycine max
  Coding DNA Sequence Number=SeqID_71486
MEVSMYTMDDAIPADISDVTEEADPSLVHVTTPQLRGFI

SEQ ID NO: 163172 - protein, 381 aa, Glycine max
  Coding DNA Sequence Number=SeqID_71487
  Gene Ontology: Mol. function=ATP-dependent helicase activity; Cellular component=intracellular
  Homolog annotation: Hit_ID=A7QXE2; Match level="QueryCoverage=9%, HitCoverage=3%, E-value=2e-10, Identity=86%"; Hit description =Chromosome undetermined scaffold_221, whole genome shotgun sequence
MTSFNQIDDYGQEKLWKTQKQLAPRKRKNQIAALVEHCNLQCLPSTIHRVSAQPTWMDARAVGHDGMLSNCKIWDLNPTHNGNMSFCCKMSGVLAMLALQCSLKRASAQPASVGAVAVEHCGISGSYLQSMRLGSHIGSLFMVTNQNSTSATPFHPISQKLDNSNFLLQRQQVEPGIKARTLQRFVASPQISMRFLKEADCEVDALGSCGDPVLPVNTMISVIESNDSDCSGGYSHGDNNFGHVEVVVAAALAIVPNVSFTLMEPMFQSNSSNTFDPNSTTWIPDSGASFHLTGESQNIQQLGPFEGEPMKSYFKVHWVLMTSTYFHILHSKTALATCLLSNSSVDSAVTSVSSCSNTQISDSIVNPVSDVKTTPSTKACV

SEQ ID NO: 163173 - protein, 408 aa, Glycine max
  Coding DNA Sequence Number=SeqID_71488
  Gene Ontology: Mol. function=ATP-dependent helicase activity; Cellular component=intracellular; Biological process=dosage compensation complex assembly during dosage compensation by hyperactivation of X chromosome
  Homolog annotation: Hit_ID=A7QXE2; Match level="QueryCoverage=80%, HitCoverage=32%, E-value=1e-153, Identity=75%"; Hit description =Chromosome undetermined scaffold_221, whole genome shotgun sequence
  Pfam annotation: Domain name=DUF1605; Domain location=99-210; Score =101.3; E_value=3e-27; Accession=PF07717.7; Description=Domain of unknown function (DUF1605)
  Pfam annotation: Domain name=dsrm; Domain location=309-371; Score =44.1; E_value=4.8e-10; Accession=PF00035.16; Description=Double -stranded RNA binding motif
  Pfam module annotation: Pfam domain module=DUF1605::dsrm; Domain location=99-210::309-371
MSDSHTAESSRTLLPPFQFILKLYSILSNNLLPAPHLPRVQDLTMQFPRMITNHIPFIVDKSLQSSLPFPFFLFHILVITGTAKSRFSAKDYSDHMALKQFSFILKEACLVDAEASVINKLSHNQSLVRAVICSGLFPGIASVVHRETSMSFKTMDDGQVLLYANSVNARYQTIPYPWLVFGEKVKVNAVFIRDSTGVSDSILILFGGALSNGIQAGHLKMLDGYVDFFMDHNLADSYVKLKEELNKLIQKKLEDPSIDIHKEGKYLMLAVQELVSGDQCEGRFVFGRESRKPKASNDENKFTKDGTNPKSLLQTLLMRAGHSPPKYKTKHLKTNEFRALVEFKGMQFVGKPKRNKQLAERDAAIEALAWLTHTSDNNQHEDDKSPPDITDNMLKLLGKRRKSKQGHG

SEQ ID NO: 163174 - protein, 259 aa, Glycine max
  Coding DNA Sequence Number=SeqID_71489
MKAKFLGEKNNSRYSSPKTVNLSGPNDVKTTDDSSLQQQPFMSNYIRGVKAKDMPCSFKPTIDMNLTFEETQVCAYVFNPNVDPSGNEILYGVGNNLGTRQNFQSLCPNKPIREELDVIDGTQVETLIKHYGKDWMPSFSNLKLIYIPIVENKDHWVMSCSVFSKLCFKHKICFLDLMEWIVEILWKPEEFLIMDPALWVLEWIQMEESFVSLLYGVLHEKAIRMKVTMTLLLGTHNQYKGDLIRNVERTSHDYIHGKH

SEQ ID NO: 163175 - protein, 75 aa, Glycine max
  Coding DNA Sequence Number=SeqID_71490
VKEFDEKVLKERTKIDPGEQRTMRQANDRNPCAKRHFLHALSELLFMLSALTPDIWLDGPAKQVLSAKPRNLSGF

SEQ ID NO: 163176 - protein, 91 aa, Glycine max
  Coding DNA Sequence Number=SeqID_71491
GTSTRLFKENKGGYIPYGSLLVKDFYKVEKKSQGPQVAWGLDAFVNPNAILLRKEPIARAMAKRLQEDKARNVGEGLMVLMSLMVDFESMG

SEQ ID NO: 163177 - protein, 189 aa, Glycine max
  Coding DNA Sequence Number=SeqID_71492
MEDMKVGAVKYKAMDYQKNMRGKIDAKTGRKSLEEKLESPLSAQDMPGVYSRSTCNTRLVRKRPTKKPKGVLSAKVRAKPEVSVKVKLPSAYIKRRKQKKKTRSLTTHALGLSLRENPLFSHPSSSSIHLNPLNLPAKYIFGVVLVKKDLKHHEIGNNNRDDHRVIPVDGINAFEIFVNEHYGREAPWC

SEQ ID NO: 163178 - protein, 71 aa, Glycine max
  Coding DNA Sequence Number=SeqID_71493
MKKTRQVSTTKRKGEKRKDPRSWNHEKKCVEEVGNVKRKVRVVRIESETVAVFFSAWWDVEKGGMMRKAWW

SEQ ID NO: 163179 - protein, 73 aa, Glycine max
  Coding DNA Sequence Number=SeqID_71494
MEEGDTTEVIVLVHLLRWCLSGTKWKFRRQSNSKVSRDIKHVGSVYVSGKDWKHEYKLWMVGPGLQGLRKHFH

SEQ ID NO: 163180 - protein, 32 aa, Glycine max
  Coding DNA Sequence Number=SeqID_71495
MTIFHHGDAAEDKEEEVASLRSFLENFLEKLL

SEQ ID NO: 163181 - protein, 120 aa, Glycine max
  Coding DNA Sequence Number=SeqID_71496
QAKCALCAKPECYSIEAELSAPCCTKLQLSSMASKKRKAPSTPTQAKFERSRSTSQEAWERYTNIVVPRKLLPKRNVVVYYTEFDEFKEELERRHWDEKLTDFSDSSIYIAIVKEFYANL

SEQ ID NO: 163182 - protein, 47 aa, Glycine max
  Coding DNA Sequence Number=SeqID_71497
MVLQHHPRESIQTLTHIPAHQQRELFNCREGATIPLEGLEGCKRNTE

SEQ ID NO: 163183 - protein, 151 aa, Glycine max
  Coding DNA Sequence Number=SeqID_71498
  Pfam annotation: Domain name=Chromo; Domain location=47-96; Score =20.8; E_value=0.0014; Accession=PF00385.15; Description='chromo' (CHRromatin Organisation MOdi
MWRIQSPFLFLHSTVIDLQEANDSIDEEYLRPTSSTWSYIMCSGTLITPLAIIDTCWDIIKFGQRLVVLVQWKGLHLDDTSWEDWKTLKDTYYLENKVLFKGLVDDRPKDTDLEDTRSRTIRRTNPVSERLCLKQVANSVKGIMCWPARIG

SEQ ID NO: 163184 - protein, 158 aa, Glycine max
  Coding DNA Sequence Number=SeqID_71499
DKRGYISCGSVQVEGTSTWFFKENKGGYIPGGSLACKGFYKTAVDASVGGKIKLKTPNKAMDLIEYMAASDIAILRDRANIPTKKSLLELTSHDALLAQNKFLSKQLEALTETLRCTICGGAHESGHCIPIEEKPTHEVNYMGNQPRNNFNAGGFSGF

SEQ ID NO: 163185 - protein, 170 aa, Glycine max
  Coding DNA Sequence Number=SeqID_71500
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
  Subcellular localization annotation: CTP_CleavageSite=33; ConfidenceScore=5.34e-01
MKHFTDTLISAQHSKPVYTPLAPNTQTASPRALADSLMQLARQVSRLESGHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163186 - protein, 258 aa, Glycine max
  Coding DNA Sequence Number=SeqID_71501
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGMMRKRTQMKGREKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163187 - protein, 48 aa, Glycine max
  Coding DNA Sequence Number=SeqID_71502
MENWRTALRNNFAGLQTRRRMENWRTALRNNILGLQTRGGGYMNSARQ

SEQ ID NO: 163188 - protein, 115 aa, Glycine max
  Coding DNA Sequence Number=SeqID_71503
  Homolog annotation: Hit_ID=Q2HW90; Match level="QueryCoverage=68%, HitCoverage=16%, E-value=9e-09, Identity=39%"; Hit description =Putative uncharacterized protein
MGPLQMQAFHKAYGKILHLTISEIFTEAVVSLTQYYDQPLRCFTFGDFQLVPTVEEFEEILGCPLGGRKPYLFSGFLPSLSKIAIVEAEQSTGFLDGRKEMREFSSHVGTTQTSC

SEQ ID NO: 163189 - protein, 28 aa, Glycine max
  Coding DNA Sequence Number=SeqID_71504
MTFMGLRIKVGGWRIALEGPNGPPGFST

SEQ ID NO: 163190 - protein, 190 aa, Glycine max
  Coding DNA Sequence Number=SeqID_71505
  Gene Ontology: Mol. function=structural constituent of ribosome; Cellular component=ribonucleoprotein complex; Biological process =translation
  Homolog annotation: Hit_ID=Q2PMT2; Match level="QueryCoverage=100%, HitCoverage=100%, E-value=7e-99, Identity=80%"; Hit description =Chloroplast 30S ribosomal protein S2
  Pfam annotation: Domain name=Ribosomal_S2; Domain location=13-183; Score=302.9; E_value=6.3e-88; Accession=PF00318.11; Description =Ribosomal protein S2
MTKRYWNIILEEMMEAGVHFGHGTRKWNPKMSPYISAKRKGIHITNLIRTARFLSEACDLVFDAAKTRLQKFRDLRMQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAICEGRSSYIRNS

SEQ ID NO: 163191 - protein, 496 aa, Glycine max
  Coding DNA Sequence Number=SeqID_71506
  Gene Ontology: Mol. function=glycerol-3-phosphate O-acyltransferase activity; Cellular component=plasma membrane; Biological process =phospholipid biosynthetic process
  Homolog annotation: Hit_ID=Q0SXQ8; Match level="QueryCoverage=100%, HitCoverage=59%, E-value=0.0, Identity=93%"; Hit description =Glycerol-3-phosphate acyltransferase
  Pfam annotation: Domain name=Acyltransferase; Domain location=160 -304; Score=157.1; E_value=4.6e-44; Accession=PF01553.12; Description= Acyltransferase
MVPVSVMFGRAPGREKGEENPPLRMLNGIQKFFAVSWLGRDSFVRFSPSVSLRRMADEHGTDKIIAQKLARVARMHFARQRLAAVGPRLPARQDLFNKLLASKAIARAVEDEARSKKISHEKAQQNAIALMEEIAANFSYEMIRLTDRILGFTWNRLYQGINVHNAERVRQLAHDGHEIVYVPCHRSHMDYLLLSYVLYHQGLVPPHIAAGINLNFWPAGPIFRRLGAFFIRRTFKGNKLYSTVFREYLGELFSRGYSVEYFVEGGRSRTGRLLDPKTGTLSMTIQAMLRGGSRPITLVPIYIGYEHVMEVGTYAKELRGATKEKESLPQMMRGLSKLRNLGQGYVNFGEPLPLMTYLNQHVPEWREAIDPIEAVRPSWLTPTVNNIAADLMVRINNAGAANAMNLCCTALLASRQRSLTREQLTQQLDCYLDLLRNVPYSTDSTAPTASASELIDHALQMNKFEVEKDTIGDIIILPREQAVLMTYYRNNIAHML

SEQ ID NO: 163192 - protein, 288 aa, Glycine max
  Coding DNA Sequence Number=SeqID_71507
  Homolog annotation: Hit_ID=Q7REV3; Match level="QueryCoverage=70%, HitCoverage=8%, E-value=4e-07, Identity=26%"; Hit description =Drosophila melanogaster CG8797 gene product-related
RPADRLFGDVGGGGDVTDGFQRGDHKDQHQRQQQVPVEAQAVIERRGDGDCRRGGRRCVGGQHVHRPGQQIADRHGDHQRSHAQVRVALAVQQDDYRQHRAGQQQVFRRAEAMIVHRGVAAADRGQADLNQRQADDHHYDAGNQRGDDAARQMQHARQQNFGAGGDHQGAEQRGHHGRHVGAAVFQRQAAHDQRRNEVEAGALNRQQPGTHRPPGFDLQNGSQTGGEQRHADDVLGILCRQTQRLADQQGRGDHRDEHRQQMLAGGKQRLRQRRAIFQAINQFTGAGF

SEQ ID NO: 163193 - protein, 113 aa, Glycine max
  Coding DNA Sequence Number=SeqID_71508
MQSSKRDVYLEAYLNGLDNYLKGIINSALKELDDTPQPKSKAGARWIVVKCNRQKGSTECGYYVMHWMSMIILGTFRNNWETYFNDIRPLEAERLKALRIQWAQFYLKVRNQT

SEQ ID NO: 163194 - protein, 120 aa, Glycine max
  Coding DNA Sequence Number=SeqID_71509
  Homolog annotation: Hit_ID=A0PAV3; Match level="QueryCoverage=54%, HitCoverage=31%, E-value=3e-07, Identity=52%"; Hit description =Restriction endonuclease
  Subcellular localization annotation: CTP_CleavageSite=84; ConfidenceScore=5.13e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWVTPGFSQSRRCKTTAK

SEQ ID NO: 163195 - protein, 81 aa, Glycine max
  Coding DNA Sequence Number=SeqID_71510
  Subcellular localization annotation: CTP_CleavageSite=84; ConfidenceScore=5.81e-01
MKVFRRSSPLFIRSSFVLRSSTGLISSSQMRIRRSKSPAFVVHPKRSLMVQRLNVSLLSKTKRSLMIQCLNVSLLSKSRDR

SEQ ID NO: 163196 - protein, 61 aa, Glycine max
  Coding DNA Sequence Number=SeqID_71511
MASRKRKSTASRPQEPYETTRFISEGAWERYAQNVHSRNILLERNVILYVTEYDEFYWELE

SEQ ID NO: 163197 - protein, 80 aa, Glycine max
  Coding DNA Sequence Number=SeqID_71512
MVAIIPARVPQPPFFRGYDSNATCAYRGGVPGHSIEHCMTLKHKVQAIGLFAQATCAPKFFDFQDRSIRDYSSCTLVGVS

SEQ ID NO: 163198 - protein, 95 aa, Glycine max
  Coding DNA Sequence Number=SeqID_71513
  Pfam annotation: Domain name=zf-CCHC; Domain location=23-40; Score =31.2; E_value=3.8e-06; Accession=PF00098.14; Description=Zinc knuckle
KRRIERCQNFNNGRKSQEDSQVLRCYKCNQLGHIKANCPSNEECPEKSDKKRYDERRTKKAYIAWDDNDSSDGSEKEINLLTRDYESDENSSQEG

SEQ ID NO: 163199 - protein, 254 aa, Glycine max
  Coding DNA Sequence Number=SeqID_71514
FGTVLFPNVDGLVDLVAIDAFLAYHHSKESPIIAVLADTCDIFDLRFCLLQGHLMCSEEGKENWEELLVGMTGVSISWFPRWKEGEPGVLCSCYPMRGESSEKIITPFIERGFNEANAKILHKICKAWNRVGRKDKELRGGSNGVISDYHKWLKSRMQGIAWLPKLRSLSRKEAEILVESEEVQALKAELERTRLVKENLKTVVTRVRKECDELKDINMTTVEALDNELKRRRAERDKSRMESMVLEDKLKACQ

SEQ ID NO: 163200 - protein, 132 aa, Glycine max
  Coding DNA Sequence Number=SeqID_71515
MEFADHLLPAGQPCLVPGQVSADYIEWFFRISHPFMTPTQAADQQRDAPATDPEDYIRPSPQVPVAFDPPPYVDDYEGYEAIAQRLERVLNLRIVTAGTELYDIMQDCLTIARGGPSTDGTVRARQRRRTDH

SEQ ID NO: 163201 - protein, 53 aa, Glycine max
  Coding DNA Sequence Number=SeqID_71516
FGREDHMESITQHQGSVCPDGYDTLTREMPCQRSINMHAVSTRHNPWKLGRNQ

SEQ ID NO: 163202 - protein, 36 aa, Glycine max
  Coding DNA Sequence Number=SeqID_71517
MGSTMDSTVYDHLEAQKQHENKEGNEQQFEGCTFRN

SEQ ID NO: 163203 - protein, 115 aa, Glycine max
  Coding DNA Sequence Number=SeqID_71518
  Homolog annotation: Hit_ID=A2Q6B4; Match level="QueryCoverage=63%, HitCoverage=30%, E-value=1e-07, Identity=36%"; Hit description =Ribosomal protein L33; Nucleic acid-binding, OB-fold
MDLKENCTYVMHNFKVRKNNDQYKVCDHQFKLVFIGVTVVRQCVLDDLPFRKYRFVGFADVVAGQFEPGLLVDEVVFRHVSGKGRRVVFKLKDLRLAELGIEARSVFKSLGQGSS

SEQ ID NO: 163204 - protein, 162 aa, Glycine max
  Coding DNA Sequence Number=SeqID_71519
  Subcellular localization annotation: CTP_CleavageSite=49; ConfidenceScore=5.69e-01
MASPPASPPPPPPSPSHPPPSDASASPSTVKRTRKASLVHVDSITSKVVGPYRKKLKTYLGIVARDKVDVTYENWKEVPTAQKDLIWEDIQNLKSQRLLTVGCKRSYFRLSVRDGGSLNQTLRGNGPLQPIRTVWTTLSMRNTTKARKNGSSFARLAETLFG

SEQ ID NO: 163205 - protein, 347 aa, Glycine max
  Coding DNA Sequence Number=SeqID_71520
  Gene Ontology: Mol. function=ATP binding; Cellular component =chromosome; Biological process=DNA metabolic process
  Homolog annotation: Hit_ID=A9QP00; Match level="QueryCoverage=100%, HitCoverage=95%, E-value=0.0, Identity=97%"; Hit description=RecF
  Pfam annotation: Domain name=ABC_tran; Domain location=6-332; Score= -51.2; E_value=0.012; Accession=PF00005.18; Description=ABC transporter
  Pfam annotation: Domain name=SMC_N; Domain location=2-343; Score= -131.3; E_value=0.055; Accession=PF02463.10; Description=RecFRecNSMC N terminal domain
  Pfam module annotation: Pfam domain module=ABC_tran::SMC_N; Domain location=6-332::2-343
MSLELEQLNIVFGPNGTGKSNIYKAIHLMHSAAQGQFSQALANEGGILKVFWAGKTRSDQLRRMNLAVETETYEYELQVGFVEKLPYPSQFQLDPVIKEESLWLSGQHRRPSSQLMKRRNQAVFLNNVHHEKVTHSGTLYENESVFGQLGEPHLYPEVSQMRESLRNWRFYHEFSVSSGSAMRAPQVGFRSPVLASNGANLAAAFQTIVEIGDELLLMRILDQAFPGCVFYSDNTGGRFRMMMQREGLSRPLEPAEFSDGTLRFLCLAVALLSPRPPAFIALNEPENSLHPQMLPALASLIAEASRYSQIWLTSHSPELAHLIEKHRSFSLYQLSMVEGETRVERLG

SEQ ID NO: 163206 - protein, 148 aa, Glycine max
  Coding DNA Sequence Number=SeqID_71521
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=73%, E-value=2e-24, Identity=70%"; Hit description=LacZ protein
MKHFTDTLISANICINPYKFFQIISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163207 - protein, 140 aa, Glycine max
  Coding DNA Sequence Number=SeqID_71522
  Subcellular localization annotation: CTP_CleavageSite=54; ConfidenceScore=5.25e-01
MVLMLKMMIHSLIIMQMATPPNSLLPPPTDLASHSPSTLKWTRKTTRLRSLATRSVGAEKSLNWKQVPVAQKDLIWEDIQALTINKDDVDDIVCEKYDISKEKWTQFCQSRRDPLWEDVRKKAHAIQKQNITLTFCLVGL

SEQ ID NO: 163208 - protein, 91 aa, Glycine max
  Coding DNA Sequence Number=SeqID_71523
  Gene Ontology: Mol. function=protein dimerization activity
  Homolog annotation: Hit_ID=Q2HTZ2; Match level="QueryCoverage=90%, HitCoverage=85%, E-value=2e-16, Identity=41%"; Hit description=HAT dimerisation
  Pfam annotation: Domain name=hATC; Domain location=17-68; Score=-0.8; E_value=0.04; Accession=PF05699.5; Description=hAT family dimerisation domain
MEFEKDMNMSQSMNKNEVDLHLMETSEKATPSFDILNWWKHWGRVLNTYRSFLTPKTVEASICAQNWFRSTPLTTDIEDLVGELEKIELGT

SEQ ID NO: 163209 - protein, 378 aa, Glycine max
  Coding DNA Sequence Number=SeqID_71524
  Homolog annotation: Hit_ID=A7NZM9; Match level="QueryCoverage=49%, HitCoverage=61%, E-value=1e-26, Identity=46%"; Hit description =Chromosome chr6 scaffold_3, whole genome shotgun sequence
  Pfam annotation: Domain name=DUF547; Domain location=323-378; Score= -5.5; E_value=9.1e-06; Accession=PF04784.5; Description=Protein of unknown function, DUF547
MGVGGKVGSFGGKGWWVIVLLKFVGPKEKKLCARELRREVKIMYLVVKRETEKRKRTSEVRREKNEKQLKSFEKWDAPEENGREGRRGRLEFFSEKENQETQQPHPGEGNTPEKNPHCVTVVLPEKDAGGVNFFCRCGVVRKEARRGRATQSGEDHEVDIRQEKTKQNFEMAQESIRQMRELLGELVMVEGEIARLKSQISQLQDGLKREQEVTMESKPKTMAFETKALHFISKAIKGDYNLNDFSYNDKAGFFKTSVEQKEIAGAQSRDLLGSPNQITLDPLLSEENDLKWQPNKLSESIMNSMDPKFISSPSSIPLLRKLRILMSNLQTVDLKSLTNQQKLAFWINVYNACIMHGFIQYGVPSTPEKLLALMNKVH

SEQ ID NO: 163210 - protein, 92 aa, Glycine max
  Coding DNA Sequence Number=SeqID_71525
  Gene Ontology: Mol. function=protein binding; Cellular component =cytoskeleton
  Homolog annotation: Hit_ID=A7QFI1; Match level="QueryCoverage=93%, HitCoverage=24%, E-value=1e-28, Identity=65%"; Hit description =Chromosome chr8 scaffold_88, whole genome shotgun sequence
MATTARCHGLMAHVKQLEIEVPSLEKAFFSQTHHSSFYTNGAIDWHPNLRFEQNLVTCADLPRFTMDSYEECHGPPRLYLLDKYELIHETYD

SEQ ID NO: 163211 - protein, 513 aa, Glycine max
  Coding DNA Sequence Number=SeqID_71526
  Gene Ontology: Mol. function=serine-type peptidase activity; Cellular component=lysosome; Biological process=proteolysis
  Homolog annotation: Hit_ID=Q9FLH1; Match level="QueryCoverage=96%, HitCoverage=96%, E-value=0.0, Identity=64%"; Hit description =Lysosomal Pro-X carboxypeptidase
  Pfam annotation: Domain name=Abhydrolase_1; Domain location=130-380; Score=-15.0; E_value=0.085; Accession=PF00561.11; Description =alphabeta hydrolase fold
  Pfam annotation: Domain name=Peptidase_S28; Domain location=68-492; Score=294.5; E_value=2.1e-85; Accession=PF05577.3; Description =Serine carboxypeptidase S28
  Pfam module annotation: Pfam domain module=Abhydrolase_1::Peptidase _S28; Domain location=130-380::68-492
MEEHRLSLRMSTLVFTLSIIIIVLSYPAQPLALNHSPKFLGKFAATARTHSNSEPPPQFHYEKRYFQQRLDHFSFSELPTFPQRYLISTEHWVGPHRLGPIFFYCGNEGDIEWFAQNTGFVWEIAPRFGAMVVFPEHRYYGESVPYGSAEEAYKNATTLSYLTAEQALADFSVLITYLKHNYSAKDCPVVLFGGSYGGMLAAWMRLKYPHIAVGALASSAPILQFEDIVPPETFYDLVSNAFKRESFTCFNYIKQSWNEIASTGQTNNGLELLTKTFNLCQKLKRTKDLYDWAEAAYSYLAMVNYPYPAEFMMTLPEHPIREVCRRIDGGPAGTSILERIYEGVNVYYNYTGEAKCFELDDDPHGMSGWEWQACTEMVMPMSSSQESSMFPPYEYNYTSIQAECLKKFGVKPRPRWITTEFGGHDIHATLKKFGSNIIFSNGLLDPWSGGGVLQNISESVVSLVTEEGAHHIDLRSSTKNDPDWLVEQRETEIKLIEGWISDYHQKNEAMFDM

SEQ ID NO: 163212 - protein, 91 aa, Glycine max
  Coding DNA Sequence Number=SeqID_71527
MEEKSTSCNVCDTWCSFSLYVHIEQVAATAVWELMTLLIKPIRESEPSCEDIELLLNVREAQSRGRSDFQIYLRNIKNKKSMVKRLMHQHI

SEQ ID NO: 163213 - protein, 148 aa, Glycine max
  Coding DNA Sequence Number=SeqID_71528
MNVVAGEINWHVCWDFGFLAISEYGHNNRVEELQHSTLDLASTTRRQASFLFSPNPLLHLLLIILLTSKGQSPFILTFTYLSVNKIQKGKAGQEKKQKTTNVFQNNRKFGEKELFFFEIAMSQRVNTVSRLGNEEDFGIKHRRKIPNY

SEQ ID NO: 163214 - protein, 115 aa, Glycine max
  Coding DNA Sequence Number=SeqID_71529
MILIEVCCIALSLPVGYFDPFSYSCICSPQCQGSCKLEEFIFTAYYSIIEFVIMLACLFSHQSGIRALWLRGYFSTCLNDEGTYEDDIIEWSKLSLLEGQDEGLSICEEYASSSL

SEQ ID NO: 163215 - protein, 490 aa, Glycine max
  Coding DNA Sequence Number=SeqID_71530
  Gene Ontology: Mol. function=transferase activity; Cellular component= integral to membrane; Biological process=glycolysis
  Homolog annotation: Hit_ID=A7QZG5; Match level="QueryCoverage=93%, HitCoverage=96%, E-value=1e-160, Identity=62%"; Hit description =Chromosome chr7 scaffold_275, whole genome shotgun sequence
  Pfam annotation: Domain name=Hexokinase_1; Domain location=31-240; Score=-28.8; E_value=7.2e-09; Accession=PF00349.12; Description =Hexokinase
  Pfam annotation: Domain name=Hexokinase_2; Domain location=242-485; Score=153.9; E_value=4.4e-43; Accession=PF03727.7; Description =Hexokinase
  Pfam module annotation: Pfam domain module=Hexokinase_1::Hexokinase _2; Domain location=31-240::242-485
MRKNVVVAVSTTTLALVVVGVLIRRWKRWKEQQLWKTKQIIRKFARECATPVTKLWQVADDFVSNMKVSLGSSDENSTLNMVISNVTSLPLGDEEGFFYGVNLQGKHLLMLCARLGGKSMPISALQREEISIPDAVLAGASEEITDYVATEIAKFVSLHPEIQDGAPAKKKKLGFTLSYPVDEVLPFAATTFQRKSANNPVRKGMVKDLNKALTNHGMKMHVSSLVDETIGGLAGGRYYNRESVAAITLGMNTNAAYVESAEEVANDLTQSPNSSELVISMEWGKFNSPHLPLTSFDASVDAESSNPGREIFEKLISGMYLGEVVRQVLLKLARETALFGSNVPPKLMTPYLLRSPDMAAMHQDMSEDREIVSEKLSEIFDIDSCSLMAREMVAEVCDIVTERGARLAGAGIVGIIKKLGRVENRKSVVTVEGGLYEHYRIFRNYLHSSIWEMLGKDLSDNVIVEHSHGGSGTGALFLAAAQTYAHRADS

SEQ ID NO: 163216 - protein, 282 aa, Glycine max
  Coding DNA Sequence Number=SeqID_71531
  Homolog annotation: Hit_ID=A7QFG7; Match level="QueryCoverage=34%, HitCoverage=18%, E-value=8e-45, Identity=83%"; Hit description =Chromosome chr8 scaffold_88, whole genome shotgun sequence
MPQSPYISYFFPSSGGFDGGEVEKIPGFDFVDWLKNTVSENDFVVMKMDVEGTEFDLIPRLFETRAICLVDEIFLECHYNRWQRCCPGQRSPKYEKTYDQCLQLFTSLRQSGVLVHQWTQTARTSGEFGVLEQIASTNGDTCMQRRNRQSKWRYGLRFGNRQSNWRVPWPEAAGLRPCHGSVVQMQVQAKPLLPLAVCLAQGLPRKRYYHWRKKLRDCTALPSFASIALLFFFLISSYLVVVAFFLFGCCLLFLGCALFQSWYVISLLFILREFSVLGLVGM

SEQ ID NO: 163217 - protein, 194 aa, Glycine max
  Coding DNA Sequence Number=SeqID_71532
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=8e-24, Identity=100%"; Hit description=LacZ protein
MTMITPSSKLTLTKGNKSWIKQPTETKRKRKKQRKEKAIDDDVVEDLVLSSDEDVPPSHSPSARKNDDTESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163218 - protein, 297 aa, Glycine max
  Coding DNA Sequence Number=SeqID_71533
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSKKSAAKSTEKKGKTVQVLKEEKLDPLAEKLRQQRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 163219 - protein, 115 aa, Glycine max
  Coding DNA Sequence Number=SeqID_71534
  Gene Ontology: Mol. function=protein dimerization activity
MIFDPRMKLEALRFYYSKLDASTCDEKINNIKEKMYKLFDEYVIVKSSSSTASSSQQPTVEEDFSIEENQEMDDPYNEYINYVSQNVNVNGKSELDLYLAETPLEPKFFFLNWIF

SEQ ID NO: 163220 - protein, 291 aa, Glycine max
  Coding DNA Sequence Number=SeqID_71535
MPANFADLVFTGERIESGLRKGKFEYASNVAPNNNRRAPVVGTRKKEGDTHAVTTAPTWMKAPQNVQYSYQHNPPNLSIRAGSSLPTQVKGPPATKRTPAQHTAPAMPRPANNTTPGASYNNARRTPPRDDFSPIPMAYSELWPSLLENYLVVAIPGKPFKYKVQHLLNAGWLSFQEKGPNVKTNPLSSHGGASVNAIEKDGPSGAKRLEDVATSRRFTYESLQAACMVSRGGDERDERDECLFHLRESHDMETCPAVEELLQRLMDWGQLEVSKGGREEPQICMQSEEKK

SEQ ID NO: 163221 - protein, 111 aa, Glycine max
  Coding DNA Sequence Number=SeqID_71536
  Subcellular localization annotation: CTP_CleavageSite=33; ConfidenceScore=5.73e-01
VLQWLLFLSAVPPCSATDGVVRNRQKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 163222 - protein, 78 aa, Glycine max
  Coding DNA Sequence Number=SeqID_71537
KIQAEALSRRFRGRFREGFPPFFIVLRSFFGLQPTRGVLNVGGDSARFPSLEDAPVSLASPSRRRVESTVGDSTGDNC

SEQ ID NO: 163223 - protein, 216 aa, Glycine max
  Coding DNA Sequence Number=SeqID_71538
  Homolog annotation: Hit_ID=UPI000065F7CF; Match level="QueryCoverage =68%, HitCoverage=20%, E-value=3e-08, Identity=29%"; Hit description =Homolog of Homo sapiens "Leucine-rich repeats and IQ motif containing 1
GLHVLAFRGLHALAFRGLHVLAFRGLHALGLQRTTRPHLQRATCPQLHRATRPYFQRARRPPLQRTTRPRHQRATHPHLYRTTHPRLQRSTCPRLQRTARPHLQRTIHLEDYTSSLTEDYTSSPLEGYTPSPSEDNTSSPSEGYIGLHVLPFRGLHVLAIRGLHVLTFRGLHALTFRGLHGLTFRGIHVLAFKGLHTLTFRGLHVLASRGLHAGIL

SEQ ID NO: 163224 - protein, 77 aa, Glycine max
  Coding DNA Sequence Number=SeqID_71539
MFVLRFEAIKGWSFHRERRVQLRDDEYTNFQEDIARQGWTSLVTPMAKFEPEIVLEFYANAWPTKKSVRDMRSWVRG

SEQ ID NO: 163225 - protein, 260 aa, Glycine max
  Coding DNA Sequence Number=SeqID_71540
  Homolog annotation: Hit_ID=Q5XM22; Match level="QueryCoverage=24%, HitCoverage=36%, E-value=2e-16, Identity=62%"; Hit description =Resistance-like protein HAAS-2
IMDRTRGLDWTLGKVIGRTLGREVSGDADESPRRRRPTTSAHRQREVASFVEDVEHVDHVVDEVHKQLEKATAEDVDADAQDFPDRPHDTSILMDYIHHVAVTVWNREERPELKLSSHGRKEEKFGRPVSDIEGLVAATGLSPLIACSLDTSNRGLISAFAESFKALHVDEVVDLLVDLLEFSLEEARDETLQCHEAHVRLSWLRDIYRSKCDAALWTVAAQAYLLHLIGCTLFANKSATHVHMVFLDAFGDLSQTGSYA

SEQ ID NO: 163226 - protein, 55 aa, Glycine max
  Coding DNA Sequence Number=SeqID_71541
MASYGVVSPIIFLLHSATMIFKKQRTPLMKKIQGLQAPHGSSTMDTKAITFDSNV

SEQ ID NO: 163227 - protein, 132 aa, Glycine max
  Coding DNA Sequence Number=SeqID_71542
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=97%, HitCoverage=4%, E-value=7e-22, Identity=40%"; Hit description=CTV.20
MTGTFQKSLRILLETSLGQGPVYFNCYPNKTVSLMDRNILDSLFLNIHFHGLDMKEGSILAALIYRIQYKVMNTCSSRILLKPQRGETTLFITDMTKANVSLPRTIKLDEVTLPEKWVMDKATPFVPRPALP

SEQ ID NO: 163228 - protein, 60 aa, Glycine max
  Coding DNA Sequence Number=SeqID_71543
PFTKRKPRAKRIFGHALSRGSLALSAQPLHLKLTWSAKLAKAKLNPFQFGLNWAKRWPSC

SEQ ID NO: 163229 - protein, 255 aa, Glycine max
  Coding DNA Sequence Number=SeqID_71544
MGSMRSPSPNCYVYRGRILPGLLQGGECESCAPNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANTEHIARASLPFSCPTPDQFRAEVAWPGDWPEAQAGEAPPEAPGDGEEAHEDEEMADLLDFLGGSGDT

SEQ ID NO: 163230 - protein, 268 aa, Glycine max
  Coding DNA Sequence Number=SeqID_71545
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRWLTPVILALWEAEVGGSRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163231 - protein, 78 aa, Glycine max
  Coding DNA Sequence Number=SeqID_71546
  Homolog annotation: Hit_ID=Q6ZTD3; Match level="QueryCoverage=38%, HitCoverage=22%, E-value=1e-08, Identity=86%"; Hit description=cDNA FLJ44770 fis, clone BRACE3032980
  Subcellular localization annotation: CTP_CleavageSite=66; ConfidenceScore=5.03e-01
MTMITPSSKLTLTKGNKSCRDRVSSCWPGWSLTPDLVIRPPQPPKVLGLQVSAIEFLQPGGSTSSRAAATAVELQFAL

SEQ ID NO: 163232 - protein, 275 aa, Glycine max
  Coding DNA Sequence Number=SeqID_71547
  Gene Ontology: Cellular component=ribosome
  Homolog annotation: Hit_ID=A2Q6B4; Match level="QueryCoverage=74%, HitCoverage=86%, E-value=2e-20, Identity=29%"; Hit description =Ribosomal protein L33; Nucleic acid-binding, OB-fold
  Pfam annotation: Domain name=DUF223; Domain location=40-135; Score= -0.7; E_value=0.0035; Accession=PF02721.5; Description=Domain of unknown function DUF223
MARIPDKIKSIDGSRETLKLAVRITDLWFVGTPNKFEQAEMVIVDSEGDQIHAVCKADHLKSWKADLKENSTYVMHNFKVVKNDGQFRVCEHEYKLAFIGVTIVREVDLHELPFKEFRFVEFGNVVAGNFVVGLLVDIIGVVDQVLFQHVSSKNTRVVFRMKDLSGEVLSCTLWENYCMQFLAYLNERGNDGPIVIILTHARIKDAQGSYLASVSNSFKASKLLINEPILEIQEFRERLLDLGVKVSPVLPPGDQGSSQLSRGSQLSSKDAFLSK

SEQ ID NO: 163233 - protein, 78 aa, Glycine max
  Coding DNA Sequence Number=SeqID_71548
FNGQNEVESVPKPLGGHEVYDRVKDIDTIFEYINIAKLVGVPESRHDCNIEEVIPYIDAHKNHVTATHPKMNKMTLLQ

SEQ ID NO: 163234 - protein, 113 aa, Glycine max
  Coding DNA Sequence Number=SeqID_71549
MALEWWPQMTHPLHAMVPGLWDLHLPCEEKVGTRLGYPIQKLLNGRNGSWRRHHLSCRCGRKISWPHPRPPSPSDRNYQIIRIPTVLPDVGLVNGWAQALKSKAIRDNPSGST

SEQ ID NO: 163235 - protein, 97 aa, Glycine max
  Coding DNA Sequence Number=SeqID_71550
MTRARARKAKEALQQVLSILFEYKPKFQGEKSKGPIGNLGISLLGDQMVADLLAVGVIQEHPGCIKGLSQPLCVALAGKSDSFLPFIFTLVLSNHKF

SEQ ID NO: 163236 - protein, 170 aa, Glycine max
  Coding DNA Sequence Number=SeqID_71551
MKTNMEALKDQMTSMMEAMLSMNRMIESNMAAIAATSAAAEVDSTHPPAINQANQPIPNVLGQGGEVLGSTSDPHVGHNRNAYPYGLPPNYTPPTMHMPNENANHAVPVTFEGQQPQPIRGAREEPQEHAQGDFYPYLTFTTEGPAFNAICLDPIPRELLNPALYNRCIS

SEQ ID NO: 163237 - protein, 158 aa, Glycine max
  Coding DNA Sequence Number=SeqID_71552
  Homolog annotation: Hit_ID=A2Q1D6; Match level="QueryCoverage=51%, HitCoverage=13%, E-value=9e-07, Identity=37%"; Hit description =Ovarian tumour, otubain, related
MEIRVETVGRRHGRDERILFADLSFCFGTNKKGWRRDGEEQQLNVEIGAMKVKVCCGGRRQQTRYAEGGSIVADVFECREDVLRWARSVAHENRFVVIILRSDTNICSRGRTTFVLIGYERSGEYRCRKKEFIRRDTRTRKCGCPFKLRRKLVIGGEG

SEQ ID NO: 163238 - protein, 506 aa, Glycine max
  Coding DNA Sequence Number=SeqID_71553
  Gene Ontology: Mol. function=DNA-directed RNA polymerase activity; Cellular component=intrinsic to membrane; Biological process=innate immune response
  Homolog annotation: Hit_ID=Q19PJ3; Match level="QueryCoverage=30%, HitCoverage=9%, E-value=3e-40, Identity=54%"; Hit description=TIR -NBS-LRR type disease resistance protein
  Pfam annotation: Domain name=TIR; Domain location=36-171; Score =167.7; E_value=3.1e-47; Accession=PF01582.11; Description=TIR domain
MSSAYSFDSDLHDEEMEMEMDFLRERYQEDNRNYDVFLSFRGEDTRASFTSHLYTALHNAGVFVFKDDETLSRGNKISPSLQLAIEESRVSVVVFSRNYAESRWCLKELEKIMECHRTTGQVVVPVFYDVDPSEVRHQTGHFGKAFRNLENRLLKVEEEELQRWWKTLAEAAGISGLSVVRNCKEIGDKICLLAQHWREALREAAGILGDSVSEFGETLCEALCEAVGFSDGADLYYRTACGELEYGTWRGCRGKFANEISLLMKHWREALCEHNGIPLVFLLNFSVEEEIIRDFKDLMMSWKEALREAAGISRVVVLNYRAPFWNSAVHSLRKMPSCNNLNANNPSSTLNPVQDPMSLFYVNPNENPAASIVSSPLTGGTCEKDSDSRKAWLTLNFPLMLGGIFEKKILTSRSATSCNRTLIGAQYSSTRMRARVENSTLKHRSLQDSDRHGTYMTSIAANRHVSQCTRSNIITTVNDIDADPLTWWFHSSSPSMLSRLQSFKHG

SEQ ID NO: 163239 - protein, 283 aa, Glycine max
  Coding DNA Sequence Number=SeqID_71554
  Homolog annotation: Hit_ID=A2Q4S5; Match level="QueryCoverage=37%, HitCoverage=15%, E-value=3e-09, Identity=36%"; Hit description=IMP dehydrogenase/GMP reductase, putative
HFPSIAESTIDQDYDEDSPRACRWNATKKTVKSIRTPAYRERLDRLRILDVYWISYGEHRPIRDFHLISCYSGLLRWGPVVVYYRPKRVVREFGYTQTIPAPPIDSWVSYDDIHDRWMHYLDHMVPTGEVCVVSSQCASDYMDWFFCISHPFMTPCHALDPLPDGHALQPRVVPQALQIDIPHVLEPRTPSTSARPAVEEPRHAVDVCHGIAERLERHLSLGVVMPGSLTHEVIEECLMMARSVTQDQLCRDSLNAKGIWIEIHGKELVRDLFHARSLKSHKV

SEQ ID NO: 163240 - protein, 105 aa, Glycine max
  Coding DNA Sequence Number=SeqID_71555
MAETWLRCLPRRWTMITLPRRWTVTLLFTETSSMHLATSSQQAPLHGNNGLWLKKKNKWSRRRMKRSEVRNGDANEMFNNVEWNNRAQVIYEDVQLGGIYRKTWE

SEQ ID NO: 163241 - protein, 48 aa, Glycine max
  Coding DNA Sequence Number=SeqID_71556
MDGKVDDEDIQEVLRETTLTPDLNRQQWVKAIKWLSDDPKQLVIVNKE

SEQ ID NO: 163242 - protein, 232 aa, Glycine max
  Coding DNA Sequence Number=SeqID_71557
  Subcellular localization annotation: CTP_CleavageSite=33; ConfidenceScore=5.29e-01
MPTPSHQLGGSSPESYSLHPATVILFPRTRPPGCARSSPPPIGDQPGSPKVFPTRKINMQQGQADILIARFPDPSFGVKTGSSQCWVATENNDDLWWIMVVVGDGESAWDVRNDFGRKKEEMVFFLSYTKAKAENAQVRNGLGHGNIAHTPEIFSKIPKGSSQCAVATENNDGLWWLMVVVGDGESAWDIRNGFGRKKEEEMLPQEASLRGFLKKLPRGFFEKLSQEASLRS

SEQ ID NO: 163243 - protein, 79 aa, Glycine max
  Coding DNA Sequence Number=SeqID_71558
  Homolog annotation: Hit_ID=A2Q2U3; Match level="QueryCoverage=97%, HitCoverage=15%, E-value=7e-35, Identity=89%"; Hit description=CENP -B protein; Homeodomain-like
  Pfam annotation: Domain name=CenpB-DNA-bind; Domain location=1-56; Score=62.8; E_value=1.1e-15; Accession=PF09091.2; Description =Centromere binding protein B, DNA bind
MEKVVYEWFLQHQERVNITGELILQKARDTMKLVYPHDDSNFSFSIGWLGKFKHRHGIKSFRRFGESGSVDVPDIGQKL

SEQ ID NO: 163244 - protein, 79 aa, Glycine max
  Coding DNA Sequence Number=SeqID_71559
MGRRSHMVDGSSYFGIQTALVLFKEGDEAHTNHEIDTEEEQAQMRVKTQPCVLDETANAGADAVGVEIAYAEIGATMHC

SEQ ID NO: 163245 - protein, 163 aa, Glycine max
  Coding DNA Sequence Number=SeqID_71560
  Gene Ontology: Mol. function=intramolecular transferase activity, phosphotransferases
  Homolog annotation: Hit_ID=A7PHN3; Match level="QueryCoverage=54%, HitCoverage=18%, E-value=8e-25, Identity=67%"; Hit description =Chromosome chr17 scaffold_16, whole genome shotgun sequence
MGWQWFIKRLQSSERNSSAQKHKFWAVCHFSEEWKPSVWSLIFIFFPTFLFSASIFRFGRRICEGLCSCNGLIWYAAEDRCGVVVKGANRSGNIAGTCPLKDNDILLTARALDDSNEVRNTIAVVNELSKEMRQILLSHPANPKCALGGKNIASVVLLGDSGI

SEQ ID NO: 163246 - protein, 121 aa, Glycine max
  Coding DNA Sequence Number=SeqID_71561
  Gene Ontology: Mol. function=binding; Cellular component=nuclear pore; Biological process=protein import into nucleus, docking
  Homolog annotation: Hit_ID=A7PD87; Match level="QueryCoverage=83%, HitCoverage=8%, E-value=4e-21, Identity=51%"; Hit description =Chromosome chr17 scaffold_12, whole genome shotgun sequence
MAWVHMKNVQLLLLWHLEGLFHIYNKTVNGENSFKVPTEDSLHLVEAFRQFSSFKYLHLGLFAIVYILNCSMVVTELPQDDAKRALEALCIPVITHLQEGMHEGPKSLSKRPSRQLTIHID

SEQ ID NO: 163247 - protein, 93 aa, Glycine max
  Coding DNA Sequence Number=SeqID_71562
  Gene Ontology: Mol. function=binding
  Homolog annotation: Hit_ID=Q9FJI6; Match level="QueryCoverage=56%, HitCoverage=9%, E-value=3e-09, Identity=50%"; Hit description =Similarity to transportin-SR
MCTQALLTSGDVEHEATVSDNPFTTTDLVVTDIKILCLTIGSYSKWLDYASEAMFVLPLVLDILMNGMGTYEECAVATALAFRRSIPHLQQDR

SEQ ID NO: 163248 - protein, 59 aa, Glycine max
  Coding DNA Sequence Number=SeqID_71563
MKILMTNTLTPYHRGGTMNASGHSLPWCPMHAIKKAMRTFRLPVTKITKQMQCMSDDTV

SEQ ID NO: 163249 - protein, 221 aa, Glycine max
  Coding DNA Sequence Number=SeqID_71564
  Homolog annotation: Hit_ID=A5AF73; Match level="QueryCoverage=50%, HitCoverage=9%, E-value=3e-07, Identity=32%"; Hit description =Putative uncharacterized protein
MLWASKVLLAPHSIKMIRNLMLQRSELVTELFKGKCLRHPSFCLLSTLSNDTTPYALKKSYLRENVSDIQGSACSQLYQMIRHLMLQRSDMIGSGSPGNDALIGEVAKEARDRAADMGVYNEELVYSRKCVSLEYRPSIVDEDLESIPLPIPSLPISSRECRRSDTTPYASKKRRRVPDALWWALCCVVILLFVYILSKGNNIESRSALSKICPVRCSSGF

SEQ ID NO: 163250 - protein, 63 aa, Glycine max
  Coding DNA Sequence Number=SeqID_71565
MERIDAVKGQRNQDSGCSHEEWHRWLHARGMVMVGGVGGSRGDDKRVKNEVRTLRKEESSGVE

SEQ ID NO: 163251 - protein, 224 aa, Glycine max
  Coding DNA Sequence Number=SeqID_71566
  Gene Ontology: Mol. function=ammonium transmembrane transporter activity; Cellular component=integral to membrane; Biological process=transport
  Homolog annotation: Hit_ID=Q8H251; Match level="QueryCoverage=21%, HitCoverage=9%, E-value=3e-16, Identity=81%"; Hit description=Amt2 -like protein
AHKNPRAFSCISSPIYLEFSIQCPCGVGLHHAGLLWMAWSGFNSGAPYAVNIASSIVVLDTNICAATSFLLWTSLDMVFAKTRHCIRNGITWLARACYFLLLWCALSLLCSKFRLNYSYFGALARYIDHRLRQTPSSTLRLVQFAATADKGKAAFRPLVAGGGLHRLKAASYISGVYVGLVDEADLWPASERPLETTSCHPSSVVSSYARLSLSLSIVWSKLVH

SEQ ID NO: 163252 - protein, 122 aa, Glycine max
  Coding DNA Sequence Number=SeqID_71567
MALTLRVNISERLIGILGTGLNFGRARGDCEDRFYSPAKARRALHTMENDKLRRVHSDVTASRSVRDKSGHHALRLYLPKFTSLFVSCNESIQWEEASRRGLRACEAEFQPNGSAMEAVKRE

SEQ ID NO: 163253 - protein, 234 aa, Glycine max
  Coding DNA Sequence Number=SeqID_71568
MAQVFFKGRFVHQDVVKEDHDEFVKEGLKVLVHGCLKHAIRIWWNLWHKSSFENQEAMPSSSNSSSIFDIEKCTGEEKGLWLIWMRPAGVKKVRITLDEVIDGPYEVSKWGRVDVFVGVVLSEPVDAEDNIGATNEKDMEINMKCLSLKNQARLNEIMSTPSINEYCKAGVMNVACQVASSSSTMLKKKRALHMRLTWALGEGMGGGRRAGSLGVGCGVCGSSGGGGGLLRILE

SEQ ID NO: 163254 - protein, 97 aa, Glycine max
  Coding DNA Sequence Number=SeqID_71569
MEKIGVVAYCLALPSDSRIHNVFHCSLLKPHQGPMWNDLTPEDTMWEPWDKLRATFHLEDKVSLPVEGVDRTLQPLQPKRNMRSPILGLTMIGRRSL

SEQ ID NO: 163255 - protein, 107 aa, Glycine max
  Coding DNA Sequence Number=SeqID_71570
LKDSASVEGFLSVWGPTENNGGLWWLQVVVSDGESAWDVRNGFGRNKGEEMAFFLSYTIAEAETLKYLLEDPNGKIMDKCLLKLKTKFREDPTVNKGWEAFLTRQLM

SEQ ID NO: 163256 - protein, 129 aa, Glycine max
  Coding DNA Sequence Number=SeqID_71571
  Gene Ontology: Mol. function=structural constituent of ribosome; Cellular component=ribonucleoprotein complex; Biological process =translation
  Homolog annotation: Hit_ID=P51418; Match level="QueryCoverage=86%, HitCoverage=62%, E-value=4e-20, Identity=51%"; Hit description=60S ribosomal protein L18a-2
  Pfam annotation: Domain name=Ribosomal_L18ae; Domain location=18-129; Score=-37.5; E_value=3.7e-05; Accession=PF01775.8; Description =Ribosomal L18ae protein family
MVDVGDGKSAWDIRNGFGRKKEEEMMFFLSYTKAKAKNAQVRNGLGHGNFAHTPNTFSKIRTGQEPLHHQRDFLDDSDTTLNGAVEAMYSEMASRHRVRSPCIQIIKTTTIPAKLCKKESTKQFHNSKI

SEQ ID NO: 163257 - protein, 152 aa, Glycine max
  Coding DNA Sequence Number=SeqID_71572
MEFQHTILHASSICSPQSLGFPQNDDALNRIHADLTGILPESRLLDTFKYLRLLYLKPGMRPVRDLLRRGINLVPEALLLRQPRVPQMKKKAMAAMNKGRVWSRGGVKRKVWEDAQMECNLKERRKTESEVVKKKVLKKEKSECEQSLNYED

SEQ ID NO: 163258 - protein, 78 aa, Glycine max
  Coding DNA Sequence Number=SeqID_71573
  Subcellular localization annotation: CTP_CleavageSite=36; ConfidenceScore=5.44e-01
MVIVRARGPDTSTPSSFAPPAPAPPPAAPSGSFSPRAVARAGGDARGHSRDYPYYHTTCGGYRCWTSGLRYLKKGGLN

SEQ ID NO: 163259 - protein, 92 aa, Glycine max
  Coding DNA Sequence Number=SeqID_71574
  Subcellular localization annotation: CTP_CleavageSite=20; ConfidenceScore=5.38e-01
QSVTSSRLVNGHVSIGLNISAMSSSSSSSPTETTTTSHHAIQPPPLHHGNNGCTTGTIGGPSYYVSSLPYIVVGEEEEGDDVALIWKPVLAW

SEQ ID NO: 163260 - protein, 74 aa, Glycine max
  Coding DNA Sequence Number=SeqID_71575
MVIDYTFEKPFSKIFGLLVIDYYLLDEDGAGETDYAAGMVAAQSTWDPWPTTTQDTPQPAQNAPSSPHDEPTPA

SEQ ID NO: 163261 - protein, 70 aa, Glycine max
  Coding DNA Sequence Number=SeqID_71576
MLKLNHASTIKTKPRDSIESNHVQDDVSYQVEEMSHVNEVIEVESAFGLQDLRGVVEEVNPAYLLTNKEE

SEQ ID NO: 163262 - protein, 88 aa, Glycine max
  Coding DNA Sequence Number=SeqID_71577
MDDFSEDEDQQFFDHINHQSDDEGVGRPTTPLSPPLQYHQPRCPVNLNFDHLSHYIDRHHFVQQQHNVQPPTSSLEVGMTFDEKTQCI

SEQ ID NO: 163263 - protein, 85 aa, Glycine max
  Coding DNA Sequence Number=SeqID_71578
MTGCNPRLTTSRYLAPIVRAIRKSSVNIPKGQKRDDYVNPERGANSNQAHLGLPGSSPKGGAFWRKQPSSHGRAGCQAYPSFSYK

SEQ ID NO: 163264 - protein, 227 aa, Glycine max
  Coding DNA Sequence Number=SeqID_71579
MKDKRDEEEKLENQMKKKDSKAFSSKAKGKEKEKNDSSKKIVKKENHFATKCDIKRALLLKQSFYLLLSRETSLSTAIPIELEVIPQVKELLDKGLVRESLNTCALLVPKISIMRRQIPMIGGMMNVLSGATLFCKITHASNIFMIHIHRDSLGRFVLIFSFNTNLGALVGHLRFVVLLVGIINMEIQKSDQGVPMNPKRIKVIPEWPTPPSIRKIWGFHYLTNFYK

SEQ ID NO: 163265 - protein, 156 aa, Glycine max
  Coding DNA Sequence Number=SeqID_71580
MVTSKKTAKVRLGFVLYRNRETSLEDFTPIEGFLLVWAFNGELRWFMVSTGGCGWVLEERRRKEWLFSKATQKIRLETLKCFCSREKNRFLGTIRHITDRNGQIVDICPMNLQTKFREDPTVNECKRAFLPRWLQAASLRSFSREASLRSFLERLL

SEQ ID NO: 163266 - protein, 151 aa, Glycine max
  Coding DNA Sequence Number=SeqID_71581
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=72%, E-value=3e-24, Identity=69%"; Hit description=LacZ protein
MEMLAEEDDYNYRIQQVDMIDKDIEALSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163267 - protein, 161 aa, Glycine max
  Coding DNA Sequence Number=SeqID_71582
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=3e-26, Identity=54%"; Hit description =Putative uncharacterized protein
MTMITPSSKLTLTKGNKSWVTCYEWVDNNVVLSFYITSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163268 - protein, 199 aa, Glycine max
  Coding DNA Sequence Number=SeqID_71583
MESHNFPEKQFCDMGSIIHLVAWYKVCHLAKPIHHHKDRVYTSLGSRKPKDKVHTNVYPRCRGDGKEDPTLDASSDDEESQPNDTINFDGEEHVDLKKAHQVHLVEFVLETTSPGSVQDAFVCEDVKALLDEKVSSGYKTLKDFQDLEERLKGHVMEACLWGFYGSWILKLQWGPLMVIFHHGDAAEDKGEEMREGTIH

SEQ ID NO: 163269 - protein, 97 aa, Glycine max
  Coding DNA Sequence Number=SeqID_71584
DKSWSVCALLSSRGGEPDDMRRQIMVILHTFSSFGDNRVRWHETNYGHSAPFFHPEAVSPMTCEDKLWGGEPDDVRRYLMVIRAFRQSKGTNSAVSG

SEQ ID NO: 163270 - protein, 85 aa, Glycine max
  Coding DNA Sequence Number=SeqID_71585
MECNIYGVKIKSDGPTNIGARSGIYVGVGGITRAEEGTGVVEEEGAGVSGGAEMSCDQDRESKSGCVMLFNQRDLVGDEVCGVPK

SEQ ID NO: 163271 - protein, 82 aa, Glycine max
  Coding DNA Sequence Number=SeqID_71586
MNVGALISGQISLVAQSNSLRLGFLALITALCMARGVTSDSVTYESLSPAINLAYMKKNYWNLDDPMVNFPGTRKSRARGSE

SEQ ID NO: 163272 - protein, 109 aa, Glycine max
  Coding DNA Sequence Number=SeqID_71587
MVGVWSISWMSLEVSDLLSASQLRDQVCFGIASPGDVVHFETFEIVNESLHDVIVLGQHYFLGLVYVGNLPLDKLSLERLLDDSLEVSDLLGAGQLGEQVCSGIAFPGD

SEQ ID NO: 163273 - protein, 70 aa, Glycine max
  Coding DNA Sequence Number=SeqID_71588
ANGHFGIVAARPGELKLNPAAVSLPRRAGFFTMKLFGGPSEQEASLGELGSRKTKEKTLLPPFFGIVLHS

SEQ ID NO: 163274 - protein, 132 aa, Glycine max
  Coding DNA Sequence Number=SeqID_71589
  Gene Ontology: Mol. function=hydrolase activity, acting on glycosyl bonds; Cellular component=intracellular; Biological process=base -excision repair
  Homolog annotation: Hit_ID=A6TDW9; Match level="QueryCoverage=34%, HitCoverage=13%, E-value=1e-19, Identity=95%"; Hit description =Adenine DNA glycosylase
  Subcellular localization annotation: CTP_CleavageSite=48; ConfidenceScore=5.15e-01
MLSSACCCPFVRRPWRRTKLRIRRSGRPFSSNSGEMTSFFIKVKSACECVRKTGIIQSYPADARVYSHSPLCCNLPPCNRDSGAVALTFLAAQFSAQVLDWYDKYGRKTLPWQIAKTPYKVWLSEVMLQQTQ

SEQ ID NO: 163275 - protein, 171 aa, Glycine max
  Coding DNA Sequence Number=SeqID_71590
  Gene Ontology: Mol. function=sequence-specific DNA binding
  Homolog annotation: Hit_ID=Q5DY06; Match level="QueryCoverage=44%, HitCoverage=66%, E-value=3e-19, Identity=60%"; Hit description =Putative uncharacterized protein
  Pfam annotation: Domain name=HTH_3; Domain location=104-158; Score =48.1; E_value=3.2e-11; Accession=PF01381.13; Description=Helix-turn -helix
MELIDIAWDCSFFSWKVETTARFATWLQAQDDAMIEDVLASLAVLREFGPTLGRPDVDTLVGSRFSNMKELRVQSNGRAIRAFFAFDPARIRNKAAEKILEIHLRQLREELALSQVQLAEKMGVSQPAIAAIEARGDELKLSSLKKYVEALGGKLSVTVELPAGDGRIFQL

SEQ ID NO: 163276 - protein, 303 aa, Glycine max
  Coding DNA Sequence Number=SeqID_71591
  Gene Ontology: Mol. function=transcription factor activity; Cellular component=intracellular; Biological process=regulation of transcription, DNA-dependent
  Homolog annotation: Hit_ID=A6T9F5; Match level="QueryCoverage=99%, HitCoverage=98%, E-value=9e-26, Identity=42%"; Hit description =Putative periplasmic binding protein/LacI transcriptional regulator
  Pfam annotation: Domain name=LacI; Domain location=4-29; Score=23.6; E_value=0.00073; Accession=PF00356.12; Description=Bacterial regulatory proteins, lacI fa
  Subcellular localization annotation: CTP_CleavageSite=31; ConfidenceScore=5.25e-01
MSKVTMSAIAAAAGVGIATVDRVLNRRAPVRAQTEQKVRAAAQRLGYRSSHAPFSAQSDGVTLRMGFILLSTSYSFYQTLTDALRQQTQPFHPAGSEPLFVWHEIDEVAAVVDSLYRLAEQVEAIGVVALDHPLIRHAIAHVSQSRAQRGLDRQPSAASAGSGGRAAGGSPLYLSGELREWFSLVSARAGQCAPRAGTAQNPRIDCRWLSGDSPAAGATCRSGADLRAALREQPQRKVALICHGPVNDGDLALIDGTITVMLRHQIADMARQLAQTVLQRHAERSDHFSQVTLPFEIVMRENV

SEQ ID NO: 163277 - protein, 294 aa, Glycine max
  Coding DNA Sequence Number=SeqID_71592
  Gene Ontology: Mol. function=endonuclease activity
  Homolog annotation: Hit_ID=A6THJ3; Match level="QueryCoverage=99%, HitCoverage=99%, E-value=1e-148, Identity=84%"; Hit description =Putative epimerase/isomerase
  Pfam annotation: Domain name=AP_endonuc_2; Domain location=19-238; Score=125.8; E_value=1.3e-34; Accession=PF01261.15; Description=AP endonuclease family 2
MKIAFDVDVIRDLGITRMVHQVAEWGYKYIEQSPHPQINPFYKHPKASREIMREYKNALNATGLEISSFITVYRWSGPDELRRQAAVKNWKRMIEIAVEMGVQVINTELSGNPNEPEICEEMFYRSMDELLPIFEREGIRVEIQAHPWDFCEESNETADIVKSFRSDNVQYIYSAPHTFYYDKGKGDVKSMLHYAGDDLSHMLIADTMNHTKHCRYIVNPPGVDATIHQHVAVGEGEVNFDALFEALREMDFANRHYKVGGESIISAALFGYPEKMKYQAVETRELIERELLNL

SEQ ID NO: 163278 - protein, 138 aa, Glycine max
  Coding DNA Sequence Number=SeqID_71593
  Gene Ontology: Mol. function=ATP binding; Cellular component =intrinsic to membrane; Biological process=defense response
  Homolog annotation: Hit_ID=Q9FVK3; Match level="QueryCoverage=99%, HitCoverage=28%, E-value=4e-47, Identity=69%"; Hit description =Resistance protein MG63
MGKEIVRRESPTEPWKRSRLWFHDDINQVLQENKGTSKIEIICMNFSSFGEEVEWDGDAFKKMKNLKTLIIKSDCFSKGPKHLPNTLRVLEWWRCPSQDWPHNFNPKQLAICKLPDNSFTSLGLAPLFEKASVLSSFH

SEQ ID NO: 163279 - protein, 70 aa, Glycine max
  Coding DNA Sequence Number=SeqID_71594
MEHNGVWDLVELPKGCKRVGSNDLGLLHETKKFISRNFEVKDMGEQYFCKNDKYSKGAKHMELKYFVVNE

SEQ ID NO: 163280 - protein, 110 aa, Glycine max
  Coding DNA Sequence Number=SeqID_71595
MDRVTSLFRLLPNTFRIVDVLVTSSFTLTKIKEHALRCPYRTRARARVKGKVEEVQEQMKTDMEAMKEQMATMMEAMMSMKKIMEANVVAVVATSAVAKVNPMPHLALTK

SEQ ID NO: 163281 - protein, 469 aa, Glycine max
  Coding DNA Sequence Number=SeqID_71596
  Gene Ontology: Mol. function=aminoacyl-tRNA ligase activity; Cellular component=cytoplasm; Biological process=tRNA aminoacylation for protein translation
  Homolog annotation: Hit_ID=Q83JU6; Match level="QueryCoverage=63%, HitCoverage=61%, E-value=1e-152, Identity=86%"; Hit description =Lysyl-tRNA synthetase
  Pfam annotation: Domain name=HTH_6; Domain location=349-454; Score =22.6; E_value=1.1e-05; Accession=PF01418.8; Description=Helix-turn -helix domain, rpiR family
  Pfam annotation: Domain name=tRNA-synt_2; Domain location=1-299; Score=366.4; E_value=4.7e-107; Accession=PF00152.11; Description =tRNA synthetases class II (D, K and N)
  Pfam module annotation: Pfam domain module=HTH_6::tRNA-synt_2; Domain location=349-454::1-299
MAGIRQFMVNRDFMEVETPMMQVIPGGASARPFITHHNALDIDMYLRIAPELYLKRLVVGGFDRVFEINRNFRNEGISPRHNPEFTMMELYMAYADYKDLIELTESLFRTLAQDVLGTTEVPYGEHTFDFGKPFEKLTMREAIKKYPVAIANELHIKVEKSWGLGRVVTEIFEETAEAHLIQPTFITEYPAEVSPLARRNDENPEITDRFEFFIGGREIGNGFSELNDAEDQAERFLQQVNAKDAGDDEAMFYDEDYVTALEHGLPPTAGLGIGIDRLVMLFTNSHTIRDVILFPALRPTGDLPVPRWERAAVVFSLSPWQKAALVFSLSPWERAGVRAPEITMSAKAATLEGRIRQHWDQLSSHEQRLADVLLAAPGQLAMNTATELAHSAGVSKATTTRFFRHLGYESYEAARRQAREMQSSGSPLYLQPVPSASPLASIMQQHLEKEIANLVNSYRTLDSEQLQQA

SEQ ID NO: 163282 - protein, 232 aa, Glycine max
  Coding DNA Sequence Number=SeqID_71597
  Gene Ontology: Mol. function=catalytic activity
  Homolog annotation: Hit_ID=A2PBV3; Match level="QueryCoverage=87%, HitCoverage=77%, E-value=5e-14, Identity=28%"; Hit description =Putative uncharacterized protein
MVAHCRYPNGLPGNAASTQQGDRVMRWIIALAIGGLSGCSVGHYEYSSEAARRVDMTVTGIPTVLGMGALGTTIPLTREYSLTAAHVAKYSLYRVKAWHPECDIAVVYHANKEANLPPQFRNSHIGDNVNLYGYSFISALPVASSGKNLINTTLSNDWNKASCVVVAANAGVVKGMSGGAVYNASDDTLAGVIVGYSSRIDDNKSGKTLFKDVALYVPYARFQAWLDGVVKS

SEQ ID NO: 163283 - protein, 188 aa, Glycine max
  Coding DNA Sequence Number=SeqID_71598
  Gene Ontology: Mol. function=transcription factor activity; Cellular component=cytoplasm; Biological process=regulation of transcription, DNA-dependent
  Homolog annotation: Hit_ID=P03030; Match level="QueryCoverage=84%, HitCoverage=65%, E-value=1e-61, Identity=62%"; Hit description =Transcriptional activator protein lysR
  Pfam annotation: Domain name=HTH_1; Domain location=6-65; Score=80.3; E_value=6.1e-21; Accession=PF00126.18; Description=Bacterial regulatory helix-turn-helix protein, lysR family
  Pfam annotation: Domain name=MarR; Domain location=4-67; Score=-2.4; E_value=0.063; Accession=PF01047.13; Description=MarR family
  Pfam module annotation: Pfam domain module=HTH_1::MarR; Domain location=6-65::4-67
MAKINWRHIEIFHAVMTSGNLTQAATLLHTSQPTVSRELARLEQQLGLQLFERVRGRLQPTVQGLRLYEEPFLQRYPQVSLNIIPQESPLLEEWLSAQRYDLGLTETQHAPAGTERLALLTCDEVCVLPPQHPLCQRAVLTPQDFHGENYVSLSRSDSYPGGAAAGAGDAQRRVGVRDGARRGGYFDC

SEQ ID NO: 163284 - protein, 534 aa, Glycine max
  Coding DNA Sequence Number=SeqID_71599
  Gene Ontology: Mol. function=penicillin binding; Cellular component =integral to membrane; Biological process=peptidoglycan-based cell wall biogenesis
  Homolog annotation: Hit_ID=A8GEB8; Match level="QueryCoverage=97%, HitCoverage=93%, E-value=0.0, Identity=60%"; Hit description =Peptidoglycan glycosyltransferase precursor
  Pfam annotation: Domain name=PBP_dimer; Domain location=32-188; Score= 136.4; E_value=8.3e-38; Accession=PF03717.6; Description=Penicillin -binding Protein dimerisation domain
  Pfam annotation: Domain name=Transpeptidase; Domain location=226-512; Score=284.2; E_value=2.7e-82; Accession=PF00905.13; Description =Penicillin binding protein transpeptidase domain
  Pfam module annotation: Pfam domain module=PBP_dimer::Transpeptidase; Domain location=32-188::226-512
MGLLLARVGDLQLINHPMLEHEADQRSLRTVTLPTNRGTLLDRDGQALALSVPSRDIIADPLRVLEANPDFTSAKWSYLAAALNLRPDELRTQITANPKKRFLYLGRKIELGIAKDIAELHLKGISSVYDDSRFYPMSEAAAPLIGIVGADNNGLNGLEKGFDRVLQGEPGKEVYRQDGDGNIIAMIDYEPPKQPPTVQLSIDKFDQFTLYSKLRDGVLLNKADSGAAVLVKIDTGEILAMASYPSFNPNNYDNATPAQMRNTAINDSYEPGSTVKPLVVMEGLQRHLVRPDSVIDTTPYSVNGHLIRDVGHWPRLTMTGILQKSSDIGVSHIALAMPAEALVNTYQAFGLGKPTGLGLTGESVGYFPLHRQRWADIERATFRSIAREYATLGSYGVYRPLSITKVTPPVLGRQVADPQIVQTVVHMLESDVLPGGTGVKAAVPGYRLATKTGTAEKMGSSGKYDGGYVNYTAGIAPASHPEVALVVMINHPTAGDHFGGSVAAPVFGNIMGPVLKHMNVAPDAIYSKPASDKS

SEQ ID NO: 163285 - protein, 120 aa, Glycine max
  Coding DNA Sequence Number=SeqID_71600
MTLLAEEKDKIIEAHEEAPPSVPQFERQQFDMLGRSVETQGYVTVDLFGSPSPAGTLSFAHGCQISMPNAPMGPPWSVSGNIPNITDLLGVDSGNEFSAKADERRGDRRRNPDRQARRWE

SEQ ID NO: 163286 - protein, 247 aa, Glycine max
  Coding DNA Sequence Number=SeqID_71601
  Gene Ontology: Mol. function=hydrolase activity, acting on acid anhydrides, catalyzing transmembrane movement of substances; Cellular component=ATP-binding cassette (ABC) transporter complex; Biological process=polyamine transport
  Homolog annotation: Hit_ID=A7MF35; Match level="QueryCoverage=38%, HitCoverage=22%, E-value=8e-45, Identity=89%"; Hit description =Putative uncharacterized protein
  Pfam annotation: Domain name=TOBE_2; Domain location=20-100; Score =73.5; E_value=7.1e-19; Accession=PF08402.1; Description=TOBE domain
MHPLKVQTDVSIVDNVPVHVALRPEKVMLCDEVPADGCNFAVGEVVHIAYLGDLSIYHVRLRSGQMISAQLQNAHRYRKGAPTWGDEVRLCWDADSSSRSSGHTAAALGHAHENAARSQAGDRAALSVANPAVYAAVPHRAEDQFRRYCARHSAVHRSGDLGGRPAQPGAQSGQLPDADRRPAVRRSLSHLAEGGGDLNGDLSADRLSAGVGGGAQQALHAHHPAAAGDPAVVDLVPGSASMRGWGC

SEQ ID NO: 163287 - protein, 279 aa, Glycine max
  Coding DNA Sequence Number=SeqID_71602
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIGGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163288 - protein, 41 aa, Glycine max
  Coding DNA Sequence Number=SeqID_71603
MTLENYSSTTTPQFFISIARPEGKQKGSYTPLKNVQQHSKP

SEQ ID NO: 163289 - protein, 239 aa, Glycine max
  Coding DNA Sequence Number=SeqID_71604
MRFVVFKIKIFWVLMYNVELYKNICFIGFSSMQIIVLEDKKEYISYVSKEEAKTQDRRPADLLHKPKRVESVNADAKSFGDHWESSNCSMHSKVEPLEHMKKRDRGHQSVSLENKTGDSIVVKISEKNNNVDTGDCMILHDHEGEEHCCGKGTNARSISFLPRSQEKKGDSAKVVIKQDMKGGEHKYGFNNNKCEKAEKVRVVDDETGDKHELYEVLRMPSRCVKTDASSFLLRAGGVL

SEQ ID NO: 163290 - protein, 30 aa, Glycine max
  Coding DNA Sequence Number=SeqID_71605
MDGIVPPRHPVDSEKSNRALGFPALITGLY

SEQ ID NO: 163291 - protein, 237 aa, Glycine max
  Coding DNA Sequence Number=SeqID_71606
  Subcellular localization annotation: CTP_CleavageSite=46; ConfidenceScore=5.53e-01
MSIFVCNPKLHFNDVYRIKASPPASPPPSPPPPPPPPISDASASPSAVKRTRKASRLRSLSARPAGVERPVVHIDPATGKADGPHKKKLRTYLGIVARDKAEFEIPEDSDSRTKRKLLQTVGERWRQFKSDLTRKWALAPDTDSVETLSDVRKKAQAIQKQNTAPHVLSRGGYEYLEQKLLAEKTKKKLKEAAQFGSVDGVIDPPSPVRRHVKWKMTRTKKTGEMTTEAAEEIAKKI

SEQ ID NO: 163292 - protein, 563 aa, Glycine max
  Coding DNA Sequence Number=SeqID_71607
  Gene Ontology: Mol. function=nucleic acid binding; Cellular component= nucleus; Biological process=DNA replication
  Homolog annotation: Hit_ID=Q9FHJ6; Match level="QueryCoverage=75%, HitCoverage=19%, E-value=8e-21, Identity=40%"; Hit description =Replication protein A1-like
  Pfam annotation: Domain name=Rep-A_N; Domain location=175-276; Score =131.7; E_value=2.1e-36; Accession=PF04057.3; Description=Replication factor-A protein 1, N-terminal domain
  Pfam annotation: Domain name=Rep-A_N; Domain location=316-415; Score =100.9; E_value=3.9e-27; Accession=PF04057.3; Description=Replication factor-A protein 1, N-terminal domain
  Pfam annotation: Domain name=Rep-A_N; Domain location=4-105; Score =131.3; E_value=2.8e-36; Accession=PF04057.3; Description=Replication factor-A protein 1, N-terminal domain
  Pfam annotation: Domain name=zf-CCHC; Domain location=516-533; Score =13.7; E_value=0.013; Accession=PF00098.14; Description=Zinc knuckle
  Pfam module annotation: Pfam domain module=Rep-A_N::Rep-A_N::Rep-A _N::zf-CCHC; Domain location=175-276::316-415::4-105::516-533
MAVSLTQGAITEICRGNCSENLQPVLQVIELKQVQSQQNSTVERYCVVLSDGSFYQQGMLATQKNDLVHSGKLQKGSVLRLTQFLCNVVQNHKIIIIIDLDVILDYCELIGQPVSTPKHTPKEPGVNFGNSQSLNSSSHAGGMNARPNVSGSSIYYPKANPPARNDPPAYPKAKTLTQGAIMEICSGNDPKNLQPVLQVIEFKLVQSQQNSTIERYRVVLSDGSFYQQGMLATQKNELIYSGRLQQGAIIRLTQFICNVVQNRKIIIIVDLDVICEKCELIGEPVAAPKGAPAESATGQSGFTFGNLQYLDRSSHSGGMTTIQNLAGQSLDLKPVLQVLELELVNSQQHSASVNFHLVLSDGYHFQQAMLTTQKNQLVRSGKLQKGSIVRLTQFVCNVVQSCKIIMVLDLDVVLEKCELLGQPVAAPAEFATGQPSGFTFGNSQSLNSCSHAGGVSGLANDFSAMNLATGQVTPPAYNPINSSSDFDFGMPTNQVGQRYESQYNNFVSAGAPGSYMSCTNCGGSGHSSLLCPNIRNLPLGSGGGASVECCKCHQSDHWGERLP

SEQ ID NO: 163293 - protein, 227 aa, Glycine max
  Coding DNA Sequence Number=SeqID_71608
  Homolog annotation: Hit_ID=A7QQ40; Match level="QueryCoverage=65%, HitCoverage=57%, E-value=2e-57, Identity=69%"; Hit description =Chromosome chr2 scaffold_140, whole genome shotgun sequence
MDPPDSQSQEQEAPKKNGVVFVILRWILAILFPFLLFLSIPFLLGLLVLMFADFSIPNPISLPSQCKIVSTGVDIRSSKICELGLLDYKAKDVFHHFERSKFRCRYDYYWASVFKVEYKDHFSGQTQVAFAEAPNEALPLYCRPNFGAAWLTQYKFKVNETYDCWYTSGISKVRLHQDSLFGCDAHEQSTLEKSRQYSTISLWPLKCVTKFTDLKMANKLGHRLVGI

SEQ ID NO: 163294 - protein, 159 aa, Glycine max
  Coding DNA Sequence Number=SeqID_71609
  Subcellular localization annotation: CTP_CleavageSite=51; ConfidenceScore=5.50e-01
MKSLISLVGSWASNSSIWLMIASATKSSMLLPRNTILSLSNSPITSPSAPLAAVEGVWGEESSKVRLVGFRDWDPKFGFLEGIGEAGVKTHLGGVLEKREWGLGMKKKEEEMGGLGFEERVRMEEGFKLPISSLQVKTNLFFSFFYWLSSDDSRVCPNS

SEQ ID NO: 163295 - protein, 1279 aa, Glycine max
  Coding DNA Sequence Number=SeqID_71610
  Gene Ontology: Mol. function=nucleic acid binding; Cellular component= nucleus; Biological process=regulation of transcription, DNA-dependent
  Homolog annotation: Hit_ID=A7PJ19; Match level="QueryCoverage=92%, HitCoverage=65%, E-value=0.0, Identity=60%"; Hit description =Chromosome chr12 scaffold_18, whole genome shotgun sequence
  Pfam annotation: Domain name=ubiquitin; Domain location=455-511; Score=13.9; E_value=0.011; Accession=PF00240.14; Description =Ubiquitin family
MAMPLPVLCVEDGVAILRFSEIFGIHEPLRKGEKREHRHSIPRDIYKSFDLTDDFVEEDEEEFLKGFSQSLSLSKQVCVVHNDVSESNDVDLEFPKFGFLHADASVDRKDDQQSKDSCHSAEPMKGDFVEDHFWKDHPFMLANFYPLDQQDWEDKILWGNSPVPSYNNVESCEISGPELGASGGSEIEIESGIHNIQMEPQKVLEDKNHNVLMRSSPVKLEPFGSRDSSGAKTNLISRSLFHPQLLRLESRSEVDSSSLADGRDAEISEHNQSGQVKRFTKVISQNRDMMEGSWLDKIIWEELDQPSVKPKLIFDLQDDQMHFEVLDTKDGTHLCLHAGAMILTHSLKLSSGDSSELPGHGSQYGWRYVANDKHYSNRKTSQQLKSNSKKRSAHGVKVFHSQPALKLQTMKLKLSNKDIANFHRPKALWYPHDNEVAVKEQGKLPTQGPMKIIIKSLGGKGSKLHVDVEETLSSVKAKASKKLGRELEDHKSLAAQNVQPNSLLHLVRTKIHLWPKAQRVPGENKSLRPPGAFKKKSDLSVKDGHVFLMEYCEERPLLLSNVGMGARLCTYYQKCSPDDQSGSLLRNTDSRLGHIISLDPADKFPFLGDLKPGCSQSSLETNMYRAPIFPHKVPLTDYLLVRSSKGKLSLRRIDKINVVGQQEPLMEVLSPGSKNLQTYMMNRLLVHMCREFQAAEKRHLPPYIGVDEFLSQFPYQSEASFRKKIKEYANLQRGTNGQSILVKKRNFRIWSEDELRKMVTPELVCAYESMQASLYRLKHLGITETHPTNISSAMSRLPDEAIALAAASHIERELQITPWNLSCNFVACTSQGKENIERMEITGVGDPSGRGMGFSYARAPPKAPVSSAMVKKKAAANRGGSTVTGTDADLRRLSMDAAREVCGWNSIAYLLPRIPAFNLKYGLIQVLLKFNVPEEVIAKQTRWHRIAMIRKLSSEQATSGVKVDPTTISKYARGQRMSFLQLQQQTREKCQEIWDRQVQSLSAVNGDENESDSEGNSDLDSFAGDLENLLDAEECEEGEEGTNDLKRDKGDGVKGLKMRRRPTLAQAEEEIEDEAAEAAELCRLLMDDYEADRKKKKKAKVMVGEARLVPKMQSKFSFDNAEQVKQITNTLQLDGTNHLKEDAITDLREEENVPAKKSKSLKVNKAKKNDIMPISIPNKKIKLNMGEGIKEWCKELWKIKIPSKIAVFAWWLLRDKLPTKKNLLRRQMQIQDMCCPFCRGAEEEAYTTFSPAYRYTDRRIKRQEMEVLVVGDNMGYLEA

SEQ ID NO: 163296 - protein, 132 aa, Glycine max
  Coding DNA Sequence Number=SeqID_71611
  Homolog annotation: Hit_ID=Q8GX29; Match level="QueryCoverage=96%, HitCoverage=33%, E-value=7e-28, Identity=46%"; Hit description=F -box/Kelch-repeat protein At1g31350
MVNVKGDAAKEGVVYDVAEDAWKEMPEGMLYGWRGPVAAMEEEVMYVVDEAKGVLRRYVEEQDAWEDILENKRLKGAEQIVAQRGKLCVVSPSSGISVVDVAAVPPRIVPILLPEEFEPVAVHILPRMPADQ

SEQ ID NO: 163297 - protein, 418 aa, Glycine max
  Coding DNA Sequence Number=SeqID_71612
  Gene Ontology: Mol. function=ATP-dependent helicase activity; Cellular component=cytoplasm; Biological process=translation
  Homolog annotation: Hit_ID=Q84W89; Match level="QueryCoverage=27%, HitCoverage=20%, E-value=9e-39, Identity=65%"; Hit description=DEAD -box ATP-dependent RNA helicase 37
  Pfam annotation: Domain name=DEAD; Domain location=175-332; Score =12.8; E_value=4.7e-06; Accession=PF00270.20; Description=DEADDEAH box helicase
MQVVDNVNTIIAPTLVGENAIDNLMVQQLDGTVNEWGWCKQKPGGDSHDLSVLGYKCEVKFHIGSPYVVAHGPQVYPSNLPNNWYQSRWFKLVIGSDDGVAKMASGQGKYCRWPWLYLWMIKTSARGETTMWKRLTLEGETCWVTSVRSPYVVAYGPQVYPSNLPNSRLRDVPASDFVAKAVDLAARELIAIASPGQGLICVAFCLLLGYSKGINLELLALPDDDVPKLPLHIGCGLGLRGETISENGHHWIGLDISASMLNPGRLVDLLERARVSLQMIRYLALDEADRMLDIGFEPQIRKIVEQVDMPPAGARQTMLFSATFPRDTGTDLIVQRVEYVQESDKTSHLMDLLHAQKANGVQGKQLNAMKYTFPRAYSSYFGLNQLMYADPYIQWSWENVPNQLKWGLCYESNDDFFR

SEQ ID NO: 163298 - protein, 87 aa, Glycine max
  Coding DNA Sequence Number=SeqID_71613
MESFKYNDCDMNRKGIEHLQIECPFEVEKRERVRSWTLLGSVPKEYSKKVAIKLVKCGSINKSKDGKEGRMEVSRVVRRKEESTSLR

SEQ ID NO: 163299 - protein, 216 aa, Glycine max
  Coding DNA Sequence Number=SeqID_71614
  Subcellular localization annotation: CTP_CleavageSite=64; ConfidenceScore=5.13e-01
MVGFYDLSDTDNDNDSAILAGPRRSRFGASLRHQLLRLHRRIPSPLPPRNRFRNLKFFPPSKTKALTFSSTNNQSPNLDPSKHNPNEKPEQGSVSSPNFSPSKHNPNEKPDHGSVSVSVSSPPFGSASASSPSSDESSMSSIFKPTQKEQGSKRNSVSEIFEFPFASTEEGLFVEQQKMPKKAMKEEEKVSREAEKIVQWAKQESARFNLGDQLSD

SEQ ID NO: 163300 - protein, 111 aa, Glycine max
  Coding DNA Sequence Number=SeqID_71615
MEPEYTGGSACCFCFSSSTKKSVARNGKRSTGVLSSEHVVEWGKNDEILSDMSTFSVKEQESRLKKALEEEERVSKEAERLVKWVKQESARIDVSTIKSILSDDENEANVK

SEQ ID NO: 163301 - protein, 484 aa, Glycine max
  Coding DNA Sequence Number=SeqID_71616
  Gene Ontology: Mol. function=transferase activity; Biological process= biosynthetic process
  Homolog annotation: Hit_ID=A7QKQ6; Match level="QueryCoverage=95%, HitCoverage=95%, E-value=0.0, Identity=71%"; Hit description =Chromosome chr2 scaffold_113, whole genome shotgun sequence
  Pfam annotation: Domain name=Glycos_transf_1; Domain location=289 -454; Score=66.4; E_value=9.6e-17; Accession=PF00534.11; Description =Glycosyl transferases group 1
  Subcellular localization annotation: CTP_CleavageSite=41; ConfidenceScore=5.57e-01
MAFDNKSKKSSSPSNSTFFITLVFLVLCTIPVFLLLQTTTTLSKTWSGDLRLAEFAWNKLPFLEHNPSPVPLKIAVFSRKWPIGTTPGGMERHAFTLHTALAQRGHKVHIFTSPPQEESASDTTINHQADANANAPSSPYIHCHEGEPGKWRYNKAWEQFLEQNQKEPFDVVHSESVALPHWLARELPNLAVSWHGIALESLQSSIFQDLARTQHDEASSPDFDKGLQGVLPKILNEIRFFRKYAHHVAISDSCGEMLRDVYQIPKRRVHVILNGVDEDGFREDLELGKEFRTKIGIPSNASLVLGVAGRLVKDKGHPLLHEAYSMLITKYPNVYLIVAGSGPWENRYRDLGRQVLVLGSMSPSMLRAFYNAIDIFVNPTLRPQGLDLTLMEAMMSGKPLLASRFPSIKGSVVVDDEFGFMFSPNVESLLEALQAVVKEGKERLARRGKACREYAISMFTATKMALAYERLFLCIKEDKFCNYP

SEQ ID NO: 163302 - protein, 612 aa, Glycine max
  Coding DNA Sequence Number=SeqID_71617
  Gene Ontology: Mol. function=diacylglycerol kinase activity; Cellular component=nucleus; Biological process=activation of protein kinase C
  Homolog annotation: Hit_ID=A7PBZ3; Match level="QueryCoverage=85%, HitCoverage=85%, E-value=0.0, Identity=68%"; Hit description =Chromosome chr2 scaffold_11, whole genome shotgun sequence
  Pfam annotation: Domain name=ESCRT-II; Domain location=488-607; Score= 4.3; E_value=4.2e-08; Accession=PF05871.3; Description=ESCRT-II complex subunit
  Pfam annotation: Domain name=PPR; Domain location=155-189; Score =16.2; E_value=0.094; Accession=PF01535.11; Description=PPR repeat
  Pfam annotation: Domain name=PPR; Domain location=257-291; Score =42.3; E_value=1.7e-09; Accession=PF01535.11; Description=PPR repeat
  Pfam annotation: Domain name=PPR; Domain location=292-326; Score=4.7; E_value=2.2; Accession=PF01535.11; Description=PPR repeat
  Pfam annotation: Domain name=PPR; Domain location=328-362; Score=6.2; E_value=1.4; Accession=PF01535.11; Description=PPR repeat
  Pfam annotation: Domain name=PPR; Domain location=394-428; Score=2.5; E_value=4; Accession=PF01535.11; Description=PPR repeat
  Pfam annotation: Domain name=PPR; Domain location=54-88; Score=33.8; E_value=6.3e-07; Accession=PF01535.11; Description=PPR repeat
  Pfam module annotation: Pfam domain module=ESCRT-II::PPR::PPR::PPR::PP R::PPR::PPR; Domain location=488-607::155-189::257-291::292-326::328 -362::394-428::54-88
MEEFKQVHAHILKLGLFYDSFCGSNLVATCALSRWGSMEYACSIFRQIEEPGSFEYNTMIRGNVNSMNLEEALLLYVEMLERGIEPDNFTYPFVLKACSLLGALKEGVQIHAHVFKAGLEGDVFVQNGLINMYGKCGAIEHASVVFEQMDEKSVASWSSIIGAHASVEMWHECLMLLGDMSGEGRHRAEESILVSALSACTHLGSPNFGRCIHGILLRNISELNVAVKTSLIDMYVKSGSLEKGLCVFQNMAQKNRYSYTVIITGLAIHGRGREALSVFSDMLEEGLAPDDVVYVGVLSACSHAGLVNEGLQCFNRLQFEHKIKPTIQHYGCMVDLMGRAGMLKGAYDLIKSMPIKPNDVVWRSLLSACKVHHNLEIGEIAAENIFKLNQHNPGDYLVLANMYARAKKWADVARIRTEMAEKHLVQTPGFSLVEANRNVYKFVSQDKSQPQCETIYDMIQQMEWQLKFEGYTPDMSQVLLDVDEDEKRQRLKHHSQKLAIAFALIQTSEGSRIRISRNIRMCNDWSLTHEAREAFLSALVSEGRAEWMDKGHRKCLILWHRIQDWADILIQFAKDNGLEDGVVTIEEIRSGTESQGTGNLLMLIGCIWLAIM

SEQ ID NO: 163303 - protein, 536 aa, Glycine max
  Coding DNA Sequence Number=SeqID_71618
  Gene Ontology: Mol. function=guanyl-nucleotide exchange factor activity; Cellular component=plasma membrane; Biological process =embryonic development ending in seed dormancy
  Homolog annotation: Hit_ID=Q56WM6; Match level="QueryCoverage=97%, HitCoverage=93%, E-value=1e-161, Identity=55%"; Hit description =Putative uncharacterized protein At1g31650
  Pfam annotation: Domain name=PRONE; Domain location=1-450; Score =788.0; E_value=5.9e-234; Accession=PF03759.4; Description=PRONE (Plant-specific Rop nucleotide exchang
MTYNGLESCMLNNQSYEDESRTSRGDECITDSFDDDDSSCSSSKDAFGSFSSKCLTMKRDDKGLEEWELSESPQHFCVKEKPYAIQHSDIEAMKENFSKLLLGEDVTGGTKGLSTALALSNAITNLSVSVFGELWKLEPLSEERKRKWQREMDWLLSPTNYMVELVPAKQSSSNGGIFEIMTPKARADIHMNLPALQKLDSMLIEALDSMINTEFWYAEGGNRAEGRDTDAQHSKRWWLPSPQVPKSGLSDTERKRLLHHGRLVRQVFKAAKAINESVLLEMPVPAIIKDALAKSGKTNLGHELHKVLTAKSSSGEDMLKYLNLKSKNLVLETVNRLEAAIFSWKERISEQVSGKSPVRSSWSPFVKDPMSEVDKLELLLDRAETLLQLIKIRYPNLPQTFLDATKVQYGKDIGHSILEAYSRVLGNLAFSILSRIGDILQEDSLSNPNSPVAIKCSPGINLSQTWEVSSHIKQSLLDKINKADRQYCNSSCYSTSDLELPSIDIKSSSVIATPNRSTVWCISREACKSVSPLNSP

SEQ ID NO: 163304 - protein, 352 aa, Glycine max
  Coding DNA Sequence Number=SeqID_71619
  Homolog annotation: Hit_ID=A7QKN7; Match level="QueryCoverage=93%, HitCoverage=89%, E-value=1e-87, Identity=52%"; Hit description =Chromosome chr2 scaffold_113, whole genome shotgun sequence
MARISEITNIILLVTRSFSLLRLACLFGIRIALTVIYTWTELIRTSISFHVNIILRMITWTFGLISLPARVVNAFQRERQLEQKLHEMHIELENLVWDKKELQEHFQMAVKERKMMEILLAELEEEHDMAIANIEKLEGKLRDQTNENLRLKEIQGKGYWSSKDHNNTDRVQTIDDSNYNISHPILSLNSNYNGSGITLQDLLMRKDIWQDESKTRSELLKLLKAVPKSGQVKSEMREALDHHRDIALSQSLFSALMSLVVGVTAWEAEDPCMPLVVALFAVVGMSLKSVVQFFSTIRNKPASDAVALLSFNWFVLGTLTYPTLPRVARMLSPLAQRLMDQTMIRFGLLSLA

SEQ ID NO: 163305 - protein, 103 aa, Glycine max
  Coding DNA Sequence Number=SeqID_71620
  Homolog annotation: Hit_ID=O65709; Match level="QueryCoverage=79%, HitCoverage=12%, E-value=2e-08, Identity=36%"; Hit description =Putative uncharacterized protein AT4g19380
MEDRSIGRKGSFRLGLGMDGKKDHSVVELGSIDTQRLLLSNGEREKKLQPLTNSLSPRQMKSLTALCDTILPSVADHFVDSSDESVTKFYQISASMTGTPERV

SEQ ID NO: 163306 - protein, 440 aa, Glycine max
  Coding DNA Sequence Number=SeqID_71621
  Gene Ontology: Mol. function=protein binding; Cellular component =membrane coat; Biological process=intracellular protein transport
  Homolog annotation: Hit_ID=A7QKM8; Match level="QueryCoverage=84%, HitCoverage=41%, E-value=1e-164, Identity=77%"; Hit description =Chromosome chr2 scaffold_113, whole genome shotgun sequence
  Pfam annotation: Domain name=Adaptin_N; Domain location=89-440; Score= -128.7; E_value=0.0014; Accession=PF01602.11; Description=Adaptin N terminal region
  Pfam annotation: Domain name=HEAT; Domain location=200-236; Score =23.8; E_value=0.00063; Accession=PF02985.13; Description=HEAT repeat
  Pfam annotation: Domain name=HEAT; Domain location=368-404; Score =7.5; E_value=2; Accession=PF02985.13; Description=HEAT repeat
  Pfam module annotation: Pfam domain module=Adaptin_N::HEAT::HEAT; Domain location=89-440::200-236::368-404
MSSKVVFTVGDPASDHSLILRHPEAPNDAVCCCCSILSVSSSSSSHTFKGGAVEEAGGEGAMGSNNHGNSKEFLELIKSIGESRSKAEEDCIVLREIETLKRRINDADTPKRKIKEYIIRLLYVEMLGHDASFGYIHAVKMTHHDSLLLKRTGYLALTLFLSDDHDLIILIVNTIQKDLASDNYLVVCAALNAVCRLINEETIPAVLPRVVELLHHSKDAVRKKAVMALHRFYLKSPSSVSHLLSNFRKRLFDNDPGVMGASLCPLSNIVSDDVNSFKDLVVSFVNILKQVAEHRLPKTYDYHQMPAPFIQIKLLKILALLGSGDKQASGHMYTVLGDIIRRSDSMTNIGNAVLYQCICCVASIYPNPKLLEAAADVIAKFLKSDSHNLKYMGIDALGRLIKLSPHIAEQHQLAVIDCLEVRDVAHKNQSVVNFDNVEII

SEQ ID NO: 163307 - protein, 127 aa, Glycine max
  Coding DNA Sequence Number=SeqID_71622
  Homolog annotation: Hit_ID=A7P833; Match level="QueryCoverage=81%, HitCoverage=13%, E-value=3e-27, Identity=58%"; Hit description =Chromosome chr3 scaffold_8, whole genome shotgun sequence
MVYRETIEAGEKPTSEILSQILGCLQLPYDTSVKNRLVENLGVSMETSRSSNLCSLMDGFGEYDPRAFSILEESASHGVVPSVSLKVSPVVIDAKELNASTAEVLEKPPKLWSPLYRGGVLKVPHSG

SEQ ID NO: 163308 - protein, 124 aa, Glycine max
  Coding DNA Sequence Number=SeqID_71623
  Gene Ontology: Mol. function=catalytic activity; Cellular component =chromatin; Biological process=auxin mediated signaling pathway
  Homolog annotation: Hit_ID=P33080; Match level="QueryCoverage=65%, HitCoverage=88%, E-value=4e-30, Identity=74%"; Hit description=Auxin- induced protein X10A
  Pfam annotation: Domain name=Auxin_inducible; Domain location=33-122; Score=156.2; E_value=9e-44; Accession=PF02519.5; Description=Auxin responsive protein
MYSMLVLFLSPKTVSELPISSAQLKPQCLQIAYCHLDISWYMASFSAAKATCKGLQVPKGYLAVYVGDKMKRFVIPVSYLNQPSFQELLSQAEEEFGFDHPTGGLTIPCREDEFLNLTSRLNEL

SEQ ID NO: 163309 - protein, 124 aa, Glycine max
  Coding DNA Sequence Number=SeqID_71624
  Gene Ontology: Mol. function=catalytic activity; Biological process =auxin mediated signaling pathway
  Homolog annotation: Hit_ID=P33083; Match level="QueryCoverage=69%, HitCoverage=98%, E-value=5e-26, Identity=66%"; Hit description=Auxin- induced protein 6B
  Pfam annotation: Domain name=Auxin_inducible; Domain location=38-124; Score=151.1; E_value=3e-42; Accession=PF02519.5; Description=Auxin responsive protein
MKKGIYRCNNDKKGIYRCNKPTMSQSPIKFNKQKTKTMGFRLLGVRRARQALSIKGAEVPKGYLAVYVGEEKKRFVIQIECLNQPSFQDLLSKAEEEYGYHHPMGGLTIPCREDVFLHIMSLLA

SEQ ID NO: 163310 - protein, 174 aa, Glycine max
  Coding DNA Sequence Number=SeqID_71625
  Gene Ontology: Mol. function=catalytic activity; Cellular component =chromatin; Biological process=auxin mediated signaling pathway
  Homolog annotation: Hit_ID=P33079; Match level="QueryCoverage=100%, HitCoverage=100%, E-value=8e-37, Identity=78%"; Hit description =Auxin-induced protein 10A5
  Pfam annotation: Domain name=Auxin_inducible; Domain location=1-81; Score=145.2; E_value=1.8e-40; Accession=PF02519.5; Description=Auxin responsive protein
  Pfam annotation: Domain name=Auxin_inducible; Domain location=82-172; Score=150.6; E_value=4.2e-42; Accession=PF02519.5; Description=Auxin responsive protein
  Pfam module annotation: Pfam domain module=Auxin_inducible::Auxin _inducible; Domain location=1-81::82-172
MGFHLPAIRRASFAASKSVQVPKGYLAVYVGEKQKRFVIPISYLNQPSFQELLSQAEEEFGYDHPMGGLTIPCSENEQEKTMGFRIPAIVTQASFSTTQAASKRVEVQKGYLAVYVGDKMRRFMIPVSYLNKPSFQELLSQAEEEFGYDHPTGGLTIPCKEDEFLSTIANLNEL

SEQ ID NO: 163311 - protein, 194 aa, Glycine max
  Coding DNA Sequence Number=SeqID_71626
  Gene Ontology: Mol. function=catalytic activity; Cellular component =chromatin; Biological process=auxin mediated signaling pathway
  Homolog annotation: Hit_ID=A5BR61; Match level="QueryCoverage=98%, HitCoverage=98%, E-value=1e-34, Identity=43%"; Hit description =Putative uncharacterized protein
  Pfam annotation: Domain name=Auxin_inducible; Domain location=1-91; Score=176.2; E_value=8.5e-50; Accession=PF02519.5; Description=Auxin responsive protein
  Pfam annotation: Domain name=Auxin_inducible; Domain location=99-192; Score=145.3; E_value=1.7e-40; Accession=PF02519.5; Description=Auxin responsive protein
  Pfam module annotation: Pfam domain module=Auxin_inducible::Auxin _inducible; Domain location=1-91::99-192
MGFRIPGIIRQTSFSAAKATRTGVEVPKGYLAVYVGDKMKRFVIPVSYLNQPSFQQLLSQAEQEFGFHHSMGGLTIPCKEDEFLNLTSRLNERAEIGVMGTIERQGHMAMSSRTLPQINAASKGVEVPKGYLAVYVGDKMKRFVILVPYLNQPSFQELLSQAEEEFGYDHPTGGLTIPCQEDEFLNVTSRLNEL

SEQ ID NO: 163312 - protein, 243 aa, Glycine max
  Coding DNA Sequence Number=SeqID_71627
  Gene Ontology: Mol. function=structural constituent of cytoskeleton; Cellular component=nucleus; Biological process=regulation of transcription, DNA-dependent
  Homolog annotation: Hit_ID=A7P803; Match level="QueryCoverage=51%, HitCoverage=45%, E-value=2e-46, Identity=74%"; Hit description =Chromosome chr3 scaffold_8, whole genome shotgun sequence
  Pfam annotation: Domain name=Auxin_inducible; Domain location=1-91; Score=176.1; E_value=9.1e-50; Accession=PF02519.5; Description=Auxin responsive protein
  Pfam annotation: Domain name=YEATS; Domain location=182-243; Score =77.7; E_value=3.9e-20; Accession=PF03366.7; Description=YEATS family
  Pfam module annotation: Pfam domain module=Auxin_inducible::YEATS; Domain location=1-91::182-243
MGFRIAGIVRRASFSTTQAATKGVEVPKGYLAVYVGDKMKRFVIPVPYLNQPSFQELLSQAEEEFGYDHPTGGLTIPCQEDEFLNVTSCLNEFDDGSERVKKRRRKSHELCSTKSSCSIKHRQEQPEFSGPTPKSQRTKMGKSEDNDKKNLGKKLKDVEISIPIVYGNIAIWLGKKASEYQSHKWTVNVRGATNEDLGTIIKHAVFQLHSSFNNPTRVVESPPFELSESGWGEFEVAITLYFQ

SEQ ID NO: 163313 - protein, 127 aa, Glycine max
  Coding DNA Sequence Number=SeqID_71628
  Gene Ontology: Mol. function=catalytic activity; Biological process =auxin mediated signaling pathway
  Homolog annotation: Hit_ID=P33083; Match level="QueryCoverage=52%, HitCoverage=74%, E-value=4e-25, Identity=82%"; Hit description=Auxin- induced protein 6B
  Pfam annotation: Domain name=Auxin_inducible; Domain location=32-125; Score=120.1; E_value=6.7e-33; Accession=PF02519.5; Description=Auxin responsive protein
MVSSYPVIYIYSWLQAFRTNRNHSHREAFKIRKPPLPSYLLKYWEGIICCKPSISTAVDLPKGYLAVYAGEKMKQFLIPVSYLNKPSFQELLSQAEEEFGYDHPTGGLTIPFSEDVFWHITYRLSGL

SEQ ID NO: 163314 - protein, 162 aa, Glycine max
  Coding DNA Sequence Number=SeqID_71629
  Gene Ontology: Mol. function=catalytic activity; Cellular component =chromatin; Biological process=auxin mediated signaling pathway
  Homolog annotation: Hit_ID=P33080; Match level="QueryCoverage=53%, HitCoverage=93%, E-value=1e-32, Identity=79%"; Hit description=Auxin- induced protein X10A
  Pfam annotation: Domain name=Auxin_inducible; Domain location=1-90; Score=164.5; E_value=2.8e-46; Accession=PF02519.5; Description=Auxin responsive protein
MGFRLPSIRQTLYNANQEASKSVEVPKGYLVVYVGEKHKRFVIPVSFLNQPSFQDLLCQAEEEFGYDHPMGGLTIPCSEDAFQHTTYCFKGHITAHVLHSLGSDNSIVLRPRETSIYFGRIRKILKFYTHTQNCNSWPQSYTRCCPCPCELPRKVTMDLAPP

SEQ ID NO: 163315 - protein, 38 aa, Glycine max
  Coding DNA Sequence Number=SeqID_71630
MDEELGGIYGERVVSGTRQIKGQTTGVLGIYDDMIVQF

SEQ ID NO: 163316 - protein, 148 aa, Glycine max
  Coding DNA Sequence Number=SeqID_71631
MEINKKLMRTEKPASFDNVVGVDGKQQQQQNPAHCARAANASPVAEEGGGGRSGGTRGSVRGAQQEEVHRARDAPEPPDFQDASCEGRRGIRFLQPRSSRYSLRRVSLRTPSSGGGPTRTPTRFLLARGFSDTLPRGLCRRRIVAVAS

SEQ ID NO: 163317 - protein, 373 aa, Glycine max
  Coding DNA Sequence Number=SeqID_71632
  Gene Ontology: Mol. function=transferase activity, transferring glycosyl groups; Cellular component=chloroplast; Biological process =purine base biosynthetic process
  Homolog annotation: Hit_ID=A9PE93; Match level="QueryCoverage=60%, HitCoverage=38%, E-value=1e-110, Identity=89%"; Hit description =Putative uncharacterized protein
  Pfam annotation: Domain name=Pribosyltran; Domain location=1-142; Score=67.2; E_value=5.7e-17; Accession=PF00156.18; Description =Phosphoribosyl transferase domain
SVYESRRQFGEILATESPVDCDVVIAVPDSGVVAALGYAAKAGVPFQQGLIRSHYVGRTFSEPSQKIRDFGVKLKLSPVRAVLEGKRVVVVDDSIVRGTTSSKIVRLLKEAGAKEVHMRIASPPIIGSCYYGVDTPSSEELISNRMSVEEIRDFIGSDSLAFLPFDSLKRLLGGESPNFCYACFSGNYPVEPRELKVKRVGDFVDDGLNGSLESIDGGWHKASLSGQKSDAVLQSSSSTRPNELEFIAEPSLLNEELDPFSEDEDKVLYNQPWEEDDEEEARPVSLITIVPPRLQNFEESYFQELEYKHSLDHKEVKRPVVEDIYDNWKISYHDLPRFLQAMQQYLLCMLMKKETLLMPPQGGQLIEDFVIFH

SEQ ID NO: 163318 - protein, 273 aa, Glycine max
  Coding DNA Sequence Number=SeqID_71633
  Gene Ontology: Mol. function=phosphoprotein phosphatase activity; Cellular component=nucleus; Biological process=multicellular organismal development
  Homolog annotation: Hit_ID=A7NZ18; Match level="QueryCoverage=31%, HitCoverage=13%, E-value=1e-26, Identity=69%"; Hit description =Chromosome chr6 scaffold_3, whole genome shotgun sequence
MAHYISSSNNDHSCARSFSIFGSYYFLIPSKLKLLFKGFKLVRVLELGCGGKIPFTSILTLGNLQTIDLGHWRRNFPISFPAGIWKLDHLRHLYGQAPIMLRGHCSGSNEGDFLDSVLGAQFNCGSDQGRSGEGAESQNLQWAQGKVGEDRVRVVVFEEHDWVFVGTYDGFSGPDVLDYLLSNLHTAVHKELKGLLWDDGSAPENSMIKEDSSSVVPSFQATAKDFVVAAFVNDKRAFRSRFFQGEHYRLVMEEYGGHGGGERQQRKMESNIQ

SEQ ID NO: 163319 - protein, 407 aa, Glycine max
  Coding DNA Sequence Number=SeqID_71634
  Gene Ontology: Mol. function=hydrolase activity, hydrolyzing O -glycosyl compounds; Cellular component=extracellular region; Biological process=carbohydrate metabolic process
  Homolog annotation: Hit_ID=A7Q7Y2; Match level="QueryCoverage=97%, HitCoverage=98%, E-value=1e-171, Identity=71%"; Hit description =Chromosome chr18 scaffold_61, whole genome shotgun sequence
  Pfam annotation: Domain name=Cellulase; Domain location=43-363; Score= -41.4; E_value=0.00033; Accession=PF00150.9; Description=Cellulase (glycosyl hydrolase family 5)
MISIMNLTSSMAIISVLISALVCEARLLRVTPGFVETKGTELVLNDSPFLFNGFNSYWMMNVAADPNQRYKVSNVFREASAIGLTVCRTWAFSDGGNQSLQISPGLYNEAMFQALDFVVAEARKYRVRLILSLVNNYNDFGGRPRYVQWANSSGVPVANDDDFYTNPVVKGYYKNHVKRVLTRINTITKTAYRDEPTIMAWELINEPRCQVDYSGKTINAWVQEMAPYVKSIDPMHLLEVGMEGFYGDSIPDRKLDNPGFQVGTDFVSNHLIKEIDFATIHAYPDNWLTGQNDTMQMAFMQRWMTSHWEDSRTILKKPLVFTEFGKSKKDQGYSISARDSFMNVVYSSIYSFAQNGGTFAGGLVWQLLDEGMDPYDDGYEIVLSQNPSTSSVISQQSSKMIALEHMH

SEQ ID NO: 163320 - protein, 554 aa, Glycine max
  Coding DNA Sequence Number=SeqID_71635
  Gene Ontology: Mol. function=nitric-oxide synthase activity; Cellular component=intracellular; Biological process=electron transport
  Homolog annotation: Hit_ID=A8R0L3; Match level="QueryCoverage=100%, HitCoverage=99%, E-value=0.0, Identity=65%"; Hit description=Nitric oxide associated 1
  Pfam annotation: Domain name=MMR_HSR1; Domain location=270-368; Score= 11.6; E_value=9.3e-05; Accession=PF01926.14; Description=GTPase of unknown function
  Subcellular localization annotation: CTP_CleavageSite=42; ConfidenceScore=5.42e-01
MALKTLSTFFSPLSLPNTKFLTSKPCLILFEFPRSQKSRLPVADAEGTGAAAPSPGEKFLERQQSFEDAKLILKENNKNKKKKKKDNAIKASRAVASCYGCGAPLHTSDADAPGYVDPETYELKKKHHQLRTVLCRRCRLLSHGKMITAVGGHGGYPGGKLFVSAEELREKLSHLRHEKALIVKLVDIVDFNGSFLSRVRDLAGSNPIVLVVTKVDLLPRDTDLNCVGDWVVEATMRKKLNVLSVHLTSSKSLVGITGVISEIQKEKKGRDVYILGSANVGKSAFINALLKTMAINDPVAASAQRYKPIQSAVPGTTLGPIQINAFLGGGKLYDTPGVHLFHRQTAVVHSEDLPILAPQSRLRGLAFPSSIVSSDNVEEGASTIVNGLNEFSIFWGGLVRIDVLKVLPETCLTFYGPKRIPIHMVPTEQAVEFYQTELGFLLTPPSGGENAENWKGLESERKLQIKFEVVDRPACDIAISGLGWFTVEPVSRSHKISQPKPVETAGELILAVHVPKAVEIFVRPPIPVSKAGAEWYQYVELTEKQEEMRPKWYF

SEQ ID NO: 163321 - protein, 233 aa, Glycine max
  Coding DNA Sequence Number=SeqID_71636
  Gene Ontology: Mol. function=zinc ion binding; Cellular component =intracellular; Biological process=regulation of transcription
  Homolog annotation: Hit_ID=A7R074; Match level="QueryCoverage=74%, HitCoverage=74%, E-value=1e-24, Identity=41%"; Hit description =Chromosome undetermined scaffold_298, whole genome shotgun sequence
  Pfam annotation: Domain name=zf-B_box; Domain location=54-100; Score =37.7; E_value=4.2e-08; Accession=PF00643.15; Description=B-box zinc finger
MNSCSTNSMVPHKQNGTEFFLGKKIFREIRERYIRIILLTSNNNLQQGEEKREMGEYSCALCKKRAMMLCDSDQAKLCWECDEKVHSANFLVAKHSRVLLCRLCHSPTPWKASGTKLMLTVSFCQRCVAHRHVSLTVHPYPSYGYQSSNNNDDVDLDVDDGIDDSDERESHQVMSSSATSPFKRLRNNSFSVDSNDETVSSSSEMFSATWPDDDESTTSLSVLKRHRDDQPNY

SEQ ID NO: 163322 - protein, 74 aa, Glycine max
  Coding DNA Sequence Number=SeqID_71637
MKREGNIVDAASNVEKKALPEGWCVKVVKIQFMGFSSSVSLANLKIAIARAYKQAPHLWKERRGSFDARKSQKI

SEQ ID NO: 163323 - protein, 149 aa, Glycine max
  Coding DNA Sequence Number=SeqID_71638
MFVFICTTHQLGGVASSAPIDGCCGGGVAGDPVLRVGEAELHWERERRDDVQGSPPHLQKSKSCILLLSTSHPSLPLPILRKKSHNNNNHPPRSMKKFPLEKKKKKKKKKLFPSKKRKKMKISHHHQFPKTLHPLPQTHSPNTLPLNPK

SEQ ID NO: 163324 - protein, 236 aa, Glycine max
  Coding DNA Sequence Number=SeqID_71639
  Gene Ontology: Mol. function=methyltransferase activity; Cellular component=cytoplasmic vesicle membrane; Biological process=metabolic process
  Homolog annotation: Hit_ID=A7Q206; Match level="QueryCoverage=100%, HitCoverage=98%, E-value=7e-97, Identity=68%"; Hit description =Chromosome chr13 scaffold_45, whole genome shotgun sequence
  Pfam annotation: Domain name=Methyltransf_11; Domain location=54-154; Score=6.0; E_value=0.023; Accession=PF08241.3; Description =Methyltransferase domain
MFRDVSSCNTYNYGEAVYWDARYIQEDGSCDWYQRYSALRPFVRNFIPLSSRILMVGCGNSVMSEDMVKDGYEDIVNIDISSIAIDMMSRKYEHIPQLKYLQMNVRDMSLFPDESFDGVIDKGTLDSLMCGTDAPISAAQMLAEITYGDPTVRMPHISRPVFNWKITLYNIPRPGFQKPESSTPSRKSYLEPIALTEKGLLSADFVLEDPDSHYIYVCKKINDTEIDNNTCIPINS

SEQ ID NO: 163325 - protein, 284 aa, Glycine max
  Coding DNA Sequence Number=SeqID_71640
  Gene Ontology: Mol. function=tRNA binding; Cellular component =aminoacyl-tRNA synthetase multienzyme complex; Biological process =negative regulation of endothelial cell proliferation
  Homolog annotation: Hit_ID=A7QB33; Match level="QueryCoverage=66%, HitCoverage=71%, E-value=2e-26, Identity=80%"; Hit description =Chromosome chr5 scaffold_72, whole genome shotgun sequence
  Pfam annotation: Domain name=tRNA_bind; Domain location=94-259; Score= 77.9; E_value=3.3e-20; Accession=PF01588.11; Description=Putative tRNA binding domain
  Subcellular localization annotation: CTP_CleavageSite=60; ConfidenceScore=5.90e-01
MANALRVGSVISLCSLRNTRPHLPLLSNATRFRSKFPFFTLSSSPNPSGYPPFRTLSSSSASTDEAVTTEAITSNNASGEAENSIKDAAGLLDMRVGCILRAWKHDEADSLYVEEVDIGEPEPRIICSGLVKYIPLEHLQFRRNTNYCGTNTRHDTNANTLTWLKSKILEHEDNTQDELYVFKKKRQTNLHDCLNSCFCVCPCAWQQCRKGKKVIVLSNLKPRNMRGVKSCGMLMAASDAKHENVELLFPPEEAIPGERIWFGTEDEKDNQPDAATPNQAIALP

SEQ ID NO: 163326 - protein, 534 aa, Glycine max
  Coding DNA Sequence Number=SeqID_71641
  Gene Ontology: Mol. function=diacylglycerol kinase activity; Cellular component=nucleus; Biological process=thiamin biosynthetic process
  Homolog annotation: Hit_ID=A7QRN2; Match level="QueryCoverage=85%, HitCoverage=91%, E-value=1e-162, Identity=59%"; Hit description =Chromosome undetermined scaffold_151, whole genome shotgun sequence
  Pfam annotation: Domain name=PPR; Domain location=133-167; Score =41.5; E_value=3e-09; Accession=PF01535.11; Description=PPR repeat
  Pfam annotation: Domain name=PPR; Domain location=235-269; Score =41.1; E_value=4e-09; Accession=PF01535.11; Description=PPR repeat
  Pfam annotation: Domain name=PPR; Domain location=270-304; Score =32.6; E_value=1.4e-06; Accession=PF01535.11; Description=PPR repeat
  Pfam module annotation: Pfam domain module=PPR::PPR::PPR; Domain location=133-167::235-269::270-304
MASQCQLDSLLQKCTSLIRMKQLQAHLITTDKFQFHLSRTKFLELCAISLAGDLSFAAQILWRIETPSTNDWNAGCARALAFSEATQIHSQLLRFGFEADILLLTTLLDVYAKTGDLDAAQKVFDNMCNRDIASWNAMISGLAQGSHPNEAIALFNRMKDEGWRPNEVTVLGALSACSQLGALKHGQIIHAYDVDKKLDTNVIVCNAVIDMYSKCGLVDKAYLVFVSVSCNKSLITWNTMIMAFAMNGDGCKALEFLDQMALDGVNPDAVLYLAALCACNHAGLVEEGVSLFDMMKGCGVKPNDKHYRSVSLLGACKTHGNVEMAEMASRKLVEMGSHSSGDFVLLSNVYAAQLRWHDVGRVREAMKIRDVRKVPGFSYTEIDGKIHKFVNGDQSHPNSKGIYAKLDEIKFRAKTYGYAAETNLVLHDIGEEDKDNVLNYHSEKLAVAYGLISTSDETPIQRDFTDLKRVFVLAEIIGAGELATVVYLFQITLLGIEVDLSLSKVKHELDGLGIMTFLLDPHKLMTTQQHSSHY

SEQ ID NO: 163327 - protein, 300 aa, Glycine max
  Coding DNA Sequence Number=SeqID_71642
  Gene Ontology: Mol. function=oxidoreductase activity; Biological process=electron transport
  Homolog annotation: Hit_ID=Q4H439; Match level="QueryCoverage=92%, HitCoverage=45%, E-value=6e-73, Identity=53%"; Hit description =Polyamine oxidase
MESPSRSFVIIVGAGVSGEYHHRYNSSSLSASSFFHINNYEFSFLKGISAAKLLAENGVKDLVILEASNCIGGRIRKENFGGVSVELGAGWIVGVGGKESNPIWELVAEYGLRTCFSDYTNVPYNIYDRRRDSISFSIFLLLLLCRFLCSIIPVIVHSSGKIFSSGIAADSYKKAVDSAIRNLTNQEEADREGNSSKTTEPPSSPLELAIDFILHDFEMAEAVPISTFTAFGEREFLVADERGFDYLVYKMAEDFLLTSEGKILDTRLKLNHGNNGLVRYIALNCYIIFIRLLRGFFSAL

SEQ ID NO: 163328 - protein, 1205 aa, Glycine max
  Coding DNA Sequence Number=SeqID_71643
  Gene Ontology: Mol. function=zinc ion binding; Cellular component =nucleus; Biological process=regulation of transcription, DNA -dependent
  Homolog annotation: Hit_ID=A7Q270; Match level="QueryCoverage=100%, HitCoverage=100%, E-value=0.0, Identity=50%"; Hit description =Chromosome chr13 scaffold_45, whole genome shotgun sequence
  Pfam annotation: Domain name=DUF1423; Domain location=735-1199; Score= 750.3; E_value=1.3e-222; Accession=PF07227.2; Description=Protein of unknown function (DUF1423)
  Pfam annotation: Domain name=PHD; Domain location=887-946; Score=8.5; E_value=0.0013; Accession=PF00628.20; Description=PHD-finger
  Pfam module annotation: Pfam domain module=DUF1423::PHD; Domain location=735-1199::887-946
  Subcellular localization annotation: CTP_CleavageSite=52; ConfidenceScore=5.33e-01
MKRLRSSEDLYSYGGDKSNNSCKDSNNLNRSFSSAQRSFYYKQENARKGLVSSSSSSSSRYERDRTVEEDREGSRLVRKRSEHDFEGFDRRKGFDRYRESDRSLIHRSESFCGGGGLRRDQFPKGFRSERERSRREGSVSSWRRGLKDFDDRERVVRSPKGLRDVKSPSWSKDSVSESEQSKKRSSSSPRPFRDGNSVKSKSKSPTWSKDSESELSKSVEVKKVEEELLQQVQSGSGSGSGSEMEEGELEPEPQAETVPPVTEGLPSVAMETDEKQVQKNECHPNDGDTDAAVEEEGKPNEEDGCCEVKDGEKKKEADEMADVRDYQTEKMLVTETEVESVGNGDDDKKEEALDAGAEYEEETKKGACVEEEKEKKVALNEEEDKKDKGKDKDKDKGKGVDLGTSTDVLKPELNDVVSTGNEVPKEVDREMMMENVINIAKDKGKGVSVALVPPTDVVHALDDGLWLDRESRDLLTCSVDVIEGPSTRGFELFSRSPVRKVEKVDHSVLNKHKDDMEQLDLTLSLPNVLLPIGAHETGAHETTSQIPGSPSQARSVQSLSNTFCTNSDGFTASMSFSGSQSFYHNPSCSLTKNSVDYEQSVGSRPLFGGIDQVSQGCWQGQSQSDPKQKEVPFGQRTSANGNGSLFQSQASWGVLDSQAVKGQHSRVLEGSSKMGSGLDRQLSFHKQFSGQSRRHDDVRSPSQSVGSHDIGSNYSFEKKREVRDRGSGSLYRTTGQKEQEQLLMGGVDFVETIIARIVSEPVQAMSRKFHEMTGQSIVCLKEGIREIMLNADKHGQILAFQKVLQNRSDIILDVLLKCHRVQLEILVALKTGLTHFLHLESSISSSELAQIFLNLRCKNLSCRSQLPVDECDCKVCAKKNGFCRECMCLVCSKFDNASNTCSWVGCDVCLHWCHTDCGLRESYIRNGHGTKGMTEMQFHCIACDHPSEMFGFVKEVFQNFAKEWSVETLCKELEYVKRIFSASKDMRGRRLHEIAEQMLPRLANKSNLPEVLRHIMSFLSDGDSSKLPMTTNFSGKEQIKENNGVAGPSPEAAWMKSIYSEKPPLLERPANILPTFDQNDKRTLVQEFQMSSIQKDFCFDELESIVKIKQAEAKMFQSRADDARREAEGLKLIALAKNEKIEEEYTNRIAKLRLTETDEIRKQKFEEAQALERAHLEYLNMKMRMETDIKDLLSKMEATKTSLAM

SEQ ID NO: 163329 - protein, 76 aa, Glycine max
  Coding DNA Sequence Number=SeqID_71644
  Gene Ontology: Mol. function=solute:hydrogen antiporter activity; Cellular component=integral to membrane; Biological process =regulation of pH
  Homolog annotation: Hit_ID=A7Q275; Match level="QueryCoverage=94%, HitCoverage=9%, E-value=7e-19, Identity=59%"; Hit description =Chromosome chr13 scaffold_45, whole genome shotgun sequence
MGLDDECFASSMKGREGGANSILTKGMNDWQQCPELGPIGDVLSGPDFSTSLSVLIIQQHKLRGELDGLDEDFSIM

SEQ ID NO: 163330 - protein, 218 aa, Glycine max
  Coding DNA Sequence Number=SeqID_71645
  Gene Ontology: Mol. function=phosphoribulokinase activity; Cellular component=chloroplast; Biological process=reductive pentose -phosphate cycle
  Homolog annotation: Hit_ID=A5BE19; Match level="QueryCoverage=85%, HitCoverage=45%, E-value=1e-81, Identity=81%"; Hit description =Phosphoribulokinase
  Pfam annotation: Domain name=PRK; Domain location=64-217; Score =142.4; E_value=1.3e-39; Accession=PF00485.9; Description =Phosphoribulokinase  Uridine kinase family
  Subcellular localization annotation: CTP_CleavageSite=54; ConfidenceScore=5.79e-01
MAACTVYSTQSLSTNCSISTPSKTQLSFFHQKQVVFWRNSNRGSSSSRRSYVITCAAGDSQTVVIGLAADSGCGKSTFMRRLTSVFGGAAEPPKGGNPDSNTLISDTTTVICLDDYHSLDRTGRKEKGVTALDPRANDFDLMYEQVKALKDGIAVEKPIYNHVTGLLDPPELIKPPKILVIEGLHPMKHLSLTISLIDLLIVLPSESSEVGGGGVTVV

SEQ ID NO: 163331 - protein, 223 aa, Glycine max
  Coding DNA Sequence Number=SeqID_71646
  Gene Ontology: Mol. function=tyrosine decarboxylase activity; Cellular component=cytoplasm; Biological process=response to chemical stimulus
  Homolog annotation: Hit_ID=A7Q283; Match level="QueryCoverage=95%, HitCoverage=98%, E-value=1e-88, Identity=76%"; Hit description =Chromosome chr13 scaffold_45, whole genome shotgun sequence
  Pfam annotation: Domain name=Lysine_decarbox; Domain location=61-194; Score=230.3; E_value=4.3e-66; Accession=PF03641.5; Description=Lysine decarboxylase family
MEEVKVSPENKHKGRFQRICVFCGSRVGYKSSFSDAALELGKLLVERKIDLVYGGGRLGLMGLISQTVLKGGRHVLGVIPKALLPLEISGETFGEVKTVANMHERKSVMAKHADAFIALPGGYGTMEELLEVIAWSQLGIHDKPVGLLNVDGYFHSLLSLFDKGVEEGFIDNSARHIVVIADTAEELIKRMEEYVPNHHKVATRQSWARDQLLFEPTETGEIL

SEQ ID NO: 163332 - protein, 933 aa, Glycine max
  Coding DNA Sequence Number=SeqID_71647
  Gene Ontology: Mol. function=nucleic acid binding; Cellular component= nucleus; Biological process=regulation of transcription, DNA-dependent
  Homolog annotation: Hit_ID=A7PCH8; Match level="QueryCoverage=49%, HitCoverage=75%, E-value=1e-101, Identity=42%"; Hit description =Chromosome chr2 scaffold_11, whole genome shotgun sequence
  Pfam annotation: Domain name=Helicase_C; Domain location=767-846; Score=49.5; E_value=1.1e-11; Accession=PF00271.22; Description =Helicase conserved C-terminal domain
  Pfam annotation: Domain name=SNF2_N; Domain location=466-760; Score= -122.1; E_value=0.087; Accession=PF00176.14; Description=SNF2 family N-terminal domain
  Pfam module annotation: Pfam domain module=Helicase_C::SNF2_N; Domain location=767-846::466-760
MALASKSKRCSLIWLILFLCLLLSSSTKTIARNLAGYAADEKGPCRRLLGIGRELHPPWVPVACRTRSKRKIESVSGASLKRERVSERGFDCLGGHAGDPIEISDSEAEEGIRHSEKKRFLVQKESKREEGKGCPVFVDKVENFGNDDYSCVPENRISLPDEKEHCVDKSEDCATTGEDFQVDYGESDCYSSSEDSDSSYDDDDDADEDERGGYSKTTTSSKSEIYKQEAMNAAHKAKRVESVNADAQVFGEHWKSSGCSMKRRDRGHQSVSLPKKTEYSTVIKKNLDDHEGKEHHRVKGTGRRSVSLLPKSQEKIGDSAKAARVVDDETGDRDELHEVLRMPSRTKNRCFKLFNEFFWGKNDSVKDDSNWLEEKDDDVGQGQTQPLASRETDSLNWNFMKKEPSSVDNIGTNQARENEENPASQCKHDTIFNEEIGIYCRWVSSGGGNTSQFDGDLMNLVMTQKQFGTTDLAKLKRVDPCSQGGCIVSHAPGTGKTTLTMVFLQTYLQLFPKCLPIIIAPANILLTWEDELRKSNIGIPFHNLNNSELSREEKLINEVDWSGNQKQNKDAIRMVKLFSWYKEKSILLISYNLYEKLAGATSEGDGKKEKKNSKMKKKRRNVQGQGSTLKVEWERFCVTILERKDVSWDWEPDSSGDTADEKINQLKLLMNPFVHVHKGNILQKNLPGLRDCVLVLKPDILQQETLESIECSQIALNFEHKLAWVSVHPSLFLNCSLSKKEESVVHKDKLEKLRLNPYGGDQLESAINWSVGTEVLYMYGKLDQKQKQSLIQCFNDSNSQAKVLLASVKASSDGINLIGASRVMLLDVVRNPSVERQAICRAYRLGQKRVVFTYHLLAQGTPECTKYCKQAEKNRLSELVFSNRNAESDKLKSSGVRFEDRVLDLMVQHKKLKDMFGECLVQPRERYLETLGP

SEQ ID NO: 163333 - protein, 321 aa, Glycine max
  Coding DNA Sequence Number=SeqID_71648
  Gene Ontology: Mol. function=DNA-directed RNA polymerase activity; Cellular component=DNA-directed RNA polymerase III complex; Biological process=transcription from RNA polymerase III promoter
  Homolog annotation: Hit_ID=A5AXE6; Match level="QueryCoverage=57%, HitCoverage=60%, E-value=2e-52, Identity=54%"; Hit description =Putative uncharacterized protein
  Pfam annotation: Domain name=RNA_pol_Rpc4; Domain location=206-316; Score=125.7; E_value=1.4e-34; Accession=PF05132.5; Description=RNA polymerase III RPC4
MDPDQGTSKARKPKFKPRNLKAVRAPKTEADDKRNEDSEVPRALSRRRHQDVMPHDTKILQNASLKSKENILELKTVATHASVEVAFSLGSSSSHSLRTYGTSKSIDSGTSSGSPSKYFANEQIRSIATEDQNDASNASARKIKREYKEPWDYENSYYPTTLPLRKPNSGDPEILDEKEFGEAATSVEYDENTVNSAAELEILESEEQRMFFFQIPTPLPMDKQSNKGKEKIGTSTVSGEATKSKNALEELPRGYMGKMLVYKSGAIKLKLGETLLDVSPGSNCRCVQDVMAVNTAQKQCCNLGEISKRVVVVPDLDSIEL

SEQ ID NO: 163334 - protein, 64 aa, Glycine max
  Coding DNA Sequence Number=SeqID_71649
MSYRNETQKHDVIGFRGLEKRRYELGELLYSISLKLRVDILTPQALTPLRKMKAKIHSVFALKW

SEQ ID NO: 163335 - protein, 187 aa, Glycine max
  Coding DNA Sequence Number=SeqID_71650
  Gene Ontology: Mol. function=hydrolase activity, hydrolyzing O -glycosyl compounds; Cellular component=extracellular region; Biological process=carbohydrate metabolic process
  Homolog annotation: Hit_ID=O64401; Match level="QueryCoverage=100%, HitCoverage=82%, E-value=8e-29, Identity=55%"; Hit description=Endo -beta-1,4-glucanase
  Pfam annotation: Domain name=Glyco_hydro_9; Domain location=1-179; Score=-111.6; E_value=9.5e-09; Accession=PF00759.10; Description =Glycosyl hydrolase family 9
MAGGYYDAGDNVKFSFPMAFTMSMLGWSVLEFGDLMGSELQNAWEAIRWGSVYFLKATKYRNVVVAQVGNPNADHDCWERPEDMESWTLFEPPWLYKATNRSNYRDFVKANIQSMGNPDEFGWGLAPSMLVSQETNIPKLTGAVVGGPAEDDSFRDSRYNVGQSEPTTFINAPFVGVLAYFNKPTIT

SEQ ID NO: 163336 - protein, 129 aa, Glycine max
  Coding DNA Sequence Number=SeqID_71651
  Gene Ontology: Mol. function=protein serine/threonine kinase activity; Cellular component=plasma membrane; Biological process =protein amino acid phosphorylation
  Homolog annotation: Hit_ID=Q32YB5; Match level="QueryCoverage=93%, HitCoverage=10%, E-value=3e-48, Identity=79%"; Hit description =Nodule-specific IRE-like protein
MADSVFSFRLLNENPVQRLGATGATEVKRHAFFKDINWDTLARQKAMFIPTAEALDTSYFMSRYIWNPEDEHCLGGSDFDEITETCSSGSGSDLLEEDGDECGSLAEFSGPPLEVQYSFSNFSFKSWST

SEQ ID NO: 163337 - protein, 430 aa, Glycine max
  Coding DNA Sequence Number=SeqID_71652
  Homolog annotation: Hit_ID=A9PG97; Match level="QueryCoverage=84%, HitCoverage=83%, E-value=3e-89, Identity=53%"; Hit description =Putative uncharacterized protein
MVGKRWGEEIRKGQKAHMASTEAKNHPQRLIEQPPFFHSCYSFPSFVLQDSLSLDLDLLPLPSHFDAFADLVHAPSFAYRRVERHLENELRLQSLSDRVAELESRFDRVLGGDRKYTWTAEIKGAEKNGFDRKYKWVAEVAEEEDKKKKKNKKKQVKVLKDKSARWTLQLENEDAEEEEEKKKKLLKGVARNVKWTAEITGKGENSGSSRKYTFQVQSGDAEKKEKKNKGNGNGLRIVEIQEPIGHRDVVLRQASDLVVEAFAKRFGAVQNERGKKKDLSPQDAALLIQISFRAYLIRRSKALRALRELAIAKSKLKEIRAQFNNFSYRRHVARDAEERQRFSEKIIVLLLTVDAIEGSDIMVRSAKRSMVDELEAMLDVVDPQPGGRSASLYFKRRTFDMPDGVIRKEIEEGVAQVVQMLEEAENSSEA

SEQ ID NO: 163338 - protein, 360 aa, Glycine max
  Coding DNA Sequence Number=SeqID_71653
  Gene Ontology: Mol. function=transferase activity, transferring glycosyl groups; Cellular component=integral to membrane; Biological process=protein amino acid glycosylation
  Homolog annotation: Hit_ID=A7Q7S1; Match level="QueryCoverage=97%, HitCoverage=87%, E-value=1e-152, Identity=72%"; Hit description =Chromosome chr18 scaffold_61, whole genome shotgun sequence
  Pfam annotation: Domain name=Galactosyl_T; Domain location=95-303; Score=195.6; E_value=1.3e-55; Accession=PF01762.12; Description =Galactosyltransferase
MWTRPSNNHENTLLPPRPDCDHKRKLIEGRPGDVMEEVVKTHQAIKSLDKAVSTLEMELTAGRTSQTGGRQQSSNHSAQKAFVVIGINTAFSSKRRRDSIRQTWLPKGNQLKELEKEKGIIVRFVIGHSTTPGGILDKAIDAEEAEHKDFLRLDHVEGYHELSTKTRLYFSTIISTWDADFYVKVDDDIHLNLGMLVSTLAKYRSRPRVYIGCMKSGPVLYQNNLILTSVSGRGAKYHEAEHWKFGEEGNKYFRHATGQIYAISKDLATYISINWPILHRYANEDVSLGSWLLGLEVEHVDERSMCCGTPPDCDWKARTGNVCVASFDWSCSGICKSVERMRDIHKTCGEGDGAVWNVDL

SEQ ID NO: 163339 - protein, 457 aa, Glycine max
  Coding DNA Sequence Number=SeqID_71654
  Gene Ontology: Mol. function=nucleic acid binding; Cellular component= nucleus; Biological process=negative regulation of transcription
  Homolog annotation: Hit_ID=A7PSP4; Match level="QueryCoverage=94%, HitCoverage=26%, E-value=1e-149, Identity=62%"; Hit description =Chromosome chr6 scaffold_28, whole genome shotgun sequence
  Pfam annotation: Domain name=HEAT; Domain location=175-211; Score =2.3; E_value=12; Accession=PF02985.13; Description=HEAT repeat
  Pfam annotation: Domain name=HEAT; Domain location=367-402; Score =29.2; E_value=1.5e-05; Accession=PF02985.13; Description=HEAT repeat
  Pfam module annotation: Pfam domain module=HEAT::HEAT; Domain location=175-211::367-402
EIKNINSSKNFDGIPGALKDWLLDLLACSDPTFPTKDSLLPYAELSRTYGKMCNETGQLLNVIKSSGMFNELLTATQIELDRLSVDDAIGFASKIPTLCNDSSANESLGKNIMDDIESLKQRLLTTSGYLKCVQSPSMIFDMLISGSCVDLQSNLHVTVTSAVAAAVVWMSEFPTRLTPIILPLMASIKREQEEILQMKSAEALAELMYHCVARRPCPNDKLIKNICSLTCMDPSETPQAKSLCSMESIDDQGFLSCRTPVSKQKLKVHVLAGEDRSKVEGFLSRRGSELALRHLCEKFGVSLFDKLPKLWDCLTEVLKPSSSESLLVTNEKSATLSIESVSDPQALINNIQVVRSVAPILNEELKPKLLTLLPCIFKCIQHSHVAVRLAASRCITSMAQSMTVKVMGAVVENAIPMLEDASSVYARQGAGMLISFLVQGLGVELVPYAPLLVVPLL

SEQ ID NO: 163340 - protein, 239 aa, Glycine max
  Coding DNA Sequence Number=SeqID_71655
  Homolog annotation: Hit_ID=O22164; Match level="QueryCoverage=95%, HitCoverage=99%, E-value=9e-62, Identity=52%"; Hit description =Expressed protein
  Subcellular localization annotation: CTP_CleavageSite=29; ConfidenceScore=5.21e-01
MAATATTVPVRWQPPNTRFRIQPQPQMKRLMTVKAFGNGKGGRDMDRVWREAWRSANDGFERFVFEAKKTAERIDRRYSLSRRLSAVARAAADRAREIDREFEIGQRYRAFSMDFQRNWPKYRKQLNNFLDSPVGKSFATLFFIWFALSGWLFRILIIATWVLPFAGPLLIGTLANTIVIKGTCPACKMQFGGYKNQIIRCTGCGNIVWQPKGKGNGGGRTNSKSKSDPDIIDVDFEER

SEQ ID NO: 163341 - protein, 165 aa, Glycine max
  Coding DNA Sequence Number=SeqID_71656
  Homolog annotation: Hit_ID=Q8GEG1; Match level="QueryCoverage=77%, HitCoverage=94%, E-value=2e-72, Identity=100%"; Hit description =Putative uncharacterized protein
MMTFCKLQYWAVESIWHTHKGTELEFVIMNQGITQERTCEQKASKRPGTVKRPRCWRFSIGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTR

SEQ ID NO: 163342 - protein, 98 aa, Glycine max
  Coding DNA Sequence Number=SeqID_71657
MRWRKRVSSWRYGDVGVDGVRETGVAENIEGGERRGRCERGVGVGECGGGKWVPKGGQGGLVFVNDFEGKFESAKLHEHGNKNNMRWWSWRLLHPATF

SEQ ID NO: 163343 - protein, 66 aa, Glycine max
  Coding DNA Sequence Number=SeqID_71658
  Pfam annotation: Domain name=zf-CCHC; Domain location=44-61; Score =9.8; E_value=0.051; Accession=PF00098.14; Description=Zinc knuckle
MWQEYEGDQWGPDPRRKRTVKGRPVSTRIPTEMDEDENERASRKKCGLCRQHGHSRNNCPNYNVLI

SEQ ID NO: 163344 - protein, 143 aa, Glycine max
  Coding DNA Sequence Number=SeqID_71659
  Homolog annotation: Hit_ID=A7PE35; Match level="QueryCoverage=62%, HitCoverage=7%, E-value=3e-17, Identity=46%"; Hit description =Chromosome chr11 scaffold_13, whole genome shotgun sequence
MDVRTNSLVRPSGTIDKDKEKLRIANNGVVQSEEQTLPIGGDGWEKSKMKKKRSCIKLDVSPSTTLTKPVNTFQETKQGMQQRLATDSRFFQFVMELLELENQMVSLNKLGWAYELLPLETTKIIIPLSMIGGVVLLVQTRKG

SEQ ID NO: 163345 - protein, 640 aa, Glycine max
  Coding DNA Sequence Number=SeqID_71660
  Gene Ontology: Mol. function=kinase activity; Cellular component =Golgi apparatus
  Homolog annotation: Hit_ID=A7QQ45; Match level="QueryCoverage=92%, HitCoverage=99%, E-value=0.0, Identity=79%"; Hit description =Chromosome chr2 scaffold_140, whole genome shotgun sequence
  Pfam annotation: Domain name=DUF248; Domain location=80-586; Score =1068.6; E_value=0; Accession=PF03141.7; Description=Putative methyltransferase
  Pfam annotation: Domain name=Methyltransf_11; Domain location=198 -293; Score=26.3; E_value=0.00011; Accession=PF08241.3; Description =Methyltransferase domain
  Pfam module annotation: Pfam domain module=DUF248::Methyltransf_11; Domain location=80-586::198-293
MKHKDGKPINQPNKNRTVTLAVTLIALCGFSFYLGGIFCSGKDSVVVNNIQMALDSPKESSGSLQVKPISFPECSLDYQDYTPCTDPRRWRKYGMYRLTLLERHCPSVFERKECLVPPPDGYKPPIRWPKSRDECWYRNVPYDWINNQKSDQHWLRKEGEKFLFPGGGTMFPDGVGEYVDLMQDLIPEMKDGTVRTAIDTGCGVASWGGDLLDRGILTISLAPRDNHEAQVQFALERGIPAVLGVISTQRLPFPSNSFDMAHCSRCLIPWTEFGGIYLMEIHRILRPGGFWILSGPPVNYERRWRGWNTTIEDQRSDYEKLQELLTSMCFKLYNKKDDIAVWQKAKDNHCYEKLARESYPAKCDDSIEPDSGWYTPLRACFVVPDPKYKKSGLTYMPKWPERLLAAPERITTVHGSSTSTFSHDNGKWKKRIQHYKKLLPELGTDKVRNVMDMNTVYGAFAAALINDPLWVMNVVSSYAPNTLPVVFDRGLIGILHDWCEAFSTYPRTYDLLHLDGLFSAESHRCEMKHVLLEMDRILRPAGHAIIRESVYFVDAIATIGKGMRWVCRKENTEYGVDKEKILICQKKLWHSSNNGDLVLSGPFGLNKYGRDHALSAGFALSAPLTFFVSLLRAKLELTAK

SEQ ID NO: 163346 - protein, 309 aa, Glycine max
  Coding DNA Sequence Number=SeqID_71661
  Gene Ontology: Mol. function=ATP binding; Cellular component =membrane; Biological process=defense response
  Homolog annotation: Hit_ID=A7PG69; Match level="QueryCoverage=45%, HitCoverage=24%, E-value=9e-19, Identity=35%"; Hit description =Chromosome chr6 scaffold_15, whole genome shotgun sequence
  Pfam annotation: Domain name=NB-ARC; Domain location=1-230; Score= -72.8; E_value=1.3e-05; Accession=PF00931.13; Description=NB-ARC domain
MGELGKTTLAKLVFDNKEVYACFNCHLITKLRNGLRNKTYVVVFDDLWSRRFWNDIEFSLIDDKNGSRILITTRDTEVAQFSMKNSLIQLRVHKLEPLSEEKSLELLCKNAFGYGFDGCCPKEYEDVGLEIVGKCQCLPLVKERVLSENFISGILANYMPLKEACPARKVNQRSIEIAKRYAKFVVFLSLELHAYEGGTLHFQMGGFPELKELVLKRLYNLKSIVIDKVGLQSLKKLRLEKIYNLKSTPWHSTLGKHRLLDVVARSNSFEKSVVVALSGGGIVILDEVFEMRPLIQMERSASKLQVPIK

SEQ ID NO: 163347 - protein, 101 aa, Glycine max
  Coding DNA Sequence Number=SeqID_71662
MGGGGVVGARQGDLNTCYLVFLSESVVWTRLGYFPMNGTTWHLRIKARCMHHTEHDRLELWKVDDYLLSSSDIIATRQVVTVAALAKAKKQSLDAFRTKAR

SEQ ID NO: 163348 - protein, 61 aa, Glycine max
  Coding DNA Sequence Number=SeqID_71663
  Homolog annotation: Hit_ID=A6FJQ2; Match level="QueryCoverage=62%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLWWQY

SEQ ID NO: 163349 - protein, 108 aa, Glycine max
  Coding DNA Sequence Number=SeqID_71664
MRIMKLAKYRLKAQVEKDEGPSGEGQSPRVEKDEGPKFISGFLVEPIIRLIKVILVASTLTYLPSLEVASTQTYLPSPGSGVIQTFVACIKRSTPTQVHIIWYQSFGS

SEQ ID NO: 163350 - protein, 95 aa, Glycine max
  Coding DNA Sequence Number=SeqID_71665
MVPIDRPDITSITFDHFRHCYVPWGLTSHLQLEWFKDINFYLGMEVPHDAQEFIVTPMRFDVIEDRGDHTNMMPKEEEEYRELLRDLEPSSKEED

SEQ ID NO: 163351 - protein, 102 aa, Glycine max
  Coding DNA Sequence Number=SeqID_71666
MRSFNGDFPPWRCSGRQRRRGEGRHHPLGNKPWKKELHHQECALDKKLEEDALMEEKKERRGQHEIEGIKEGEKLNFEVASSRSFLEKTSLRSFFEKTSWGS

SEQ ID NO: 163352 - protein, 75 aa, Glycine max
  Coding DNA Sequence Number=SeqID_71667
MKLELSKPKEGREIPNTFVEASFMMMNQVILMMPKAQMIDSRLIQDFKIKHQESNPRFKIQEKKSRSNKSRLHIG

SEQ ID NO: 163353 - protein, 190 aa, Glycine max
  Coding DNA Sequence Number=SeqID_71668
  Pfam annotation: Domain name=zf-CCHC; Domain location=38-55; Score =28.3; E_value=2.8e-05; Accession=PF00098.14; Description=Zinc knuckle
LHSSSSVNGEGSTPKDPLYKILDESRSLKLWKERTSNIKCFKCLGRGHIASQCPTKKIMIIRGQDIYSSQEETTSCLSSSGSEDEVRGEKSSEEVYPHEEGDLLTSDFLITIEEYVGASPSLKNSTVKPVWLGAILSLILEARRVDCQGLEKATYGRVIKKSTISGVTNGIKANLSPSTVWFEDEPSRSW

SEQ ID NO: 163354 - protein, 125 aa, Glycine max
  Coding DNA Sequence Number=SeqID_71669
  Subcellular localization annotation: CTP_CleavageSite=27; ConfidenceScore=5.22e-01
SGPNLDPWAQKSTLRFIRTLRPSLSALAQSSWSLLLMALASNDNSLWHLRMGRKSEKGLEILSKARCMLSNSGLNGSFWDAEINTTYYLGNCSPSIDIDFKNLIEAMKIKDSKSEDSGKAKDDIK

SEQ ID NO: 163355 - protein, 98 aa, Glycine max
  Coding DNA Sequence Number=SeqID_71670
MGTWGNGSSPRRAGACPGEPMLTPEVTGSLRRAAWNSHKLEISVPPIHGVGASYVHQLHLSQSSETLMPNKLYVPTQQLGITKMRSSVTYWFPGRAKP

SEQ ID NO: 163356 - protein, 129 aa, Glycine max
  Coding DNA Sequence Number=SeqID_71671
  Subcellular localization annotation: CTP_CleavageSite=61; ConfidenceScore=5.09e-01
GWCLPSPLLLCLPLHLHGGKSPLKDLIEAQRSGLHRSSTSKLPSLANRLTNPQVSLSSPFRGAAGLVKVHCYDGSFVVRGYRHGGCCGATAKKIVNLYVMRSSQGGDPTPEPWLGNSRMIRPGMQENVL

SEQ ID NO: 163357 - protein, 29 aa, Glycine max
  Coding DNA Sequence Number=SeqID_71672
MVILRPFSFGDSSAGKEIHWPNGVSLERN

SEQ ID NO: 163358 - protein, 69 aa, Glycine max
  Coding DNA Sequence Number=SeqID_71673
MAPCKACRPWIFFINGIFCFLKINGSGMEKEESFSRKLLKETSQGSFSKKLLKEVSQERFSKKLLKEAT

SEQ ID NO: 163359 - protein, 60 aa, Glycine max
  Coding DNA Sequence Number=SeqID_71674
MWDRHRLKGALKPGVFTPKAYTPKSPSGSLPPDLDTAHEVYNTHGLILLFQTRLTHCATI

SEQ ID NO: 163360 - protein, 140 aa, Glycine max
  Coding DNA Sequence Number=SeqID_71675
MVIVPFMYIDNIHHHNDIINIISSQCHYQHQHKHHLISISLSTSTSSHLNIIININIISSQYHYQHQHGLISTLSSTLISYNLNIIINITNFKNKVSDPNFVQGLSMDILILASRIELFDTDYRARGKIIRCFGQECKRY

SEQ ID NO: 163361 - protein, 43 aa, Glycine max
  Coding DNA Sequence Number=SeqID_71676
GDARLAGASSMGGKCAESPPTFIRGKRRKNRKGVVDKGVSLAP

SEQ ID NO: 163362 - protein, 38 aa, Glycine max
  Coding DNA Sequence Number=SeqID_71677
MGGKCAKSPPTFIRGKRRKNQKGKVLAPYASVTRDNNL

SEQ ID NO: 163363 - protein, 245 aa, Glycine max
  Coding DNA Sequence Number=SeqID_71678
  Subcellular localization annotation: CTP_CleavageSite=75; ConfidenceScore=5.02e-01
MASNPARAQKKAKSQKRKQGKCSQAALNRLDTWFTDKSKKVDFKMIYVVKNVRIPKCLNLEWCSQQGFNFPNLLEAQVLSKFMQMKGTFYPELVKVFYTCPKVDMESNLYSIVNGVEMVIDAEVWKAVVGIDMGQTYRGMLLNPTRILRNILDVGGLTEEDRMLIIYGLKSSIQMNWVLLIEDIMLKSRRLMDYEFPYVVDFTKGSNEITERHLKKLGMTYVDHEWIMVRDQPAATNNNQMEEEA

SEQ ID NO: 163364 - protein, 118 aa, Glycine max
  Coding DNA Sequence Number=SeqID_71679
MAAQLIHDRVVMECLEVHPEEPARTLQQPVEWILPTPTPYRLVELVQVIEVSSSKEDPEEDLEELPPEPIVDALDFLEDDEDPLLDVDSPEDIMSAFEADSTEESGPGGTTNSEDSSS

SEQ ID NO: 163365 - protein, 29 aa, Glycine max
  Coding DNA Sequence Number=SeqID_71680
MDVKHFEVVKRRSHANKQWSPEEIKIKGK

SEQ ID NO: 163366 - protein, 302 aa, Glycine max
  Coding DNA Sequence Number=SeqID_71681
  Gene Ontology: Mol. function=inositol-3-phosphate synthase activity; Cellular component=cytoplasm; Biological process=phospholipid biosynthetic process
  Homolog annotation: Hit_ID=A1Z0H8; Match level="QueryCoverage=19%, HitCoverage=15%, E-value=2e-20, Identity=70%"; Hit description=D-myo- inositol 3-phosphate synthase
MAWQYSPLVDVSGPHILVARVSTKGSCVEATANAITEEPFAVDVTTMGLYIVGEECTQLVALGKLFDSGATIHHVPYTNDVVRVSVVTIYNADVRVPFLTLEIQYVREAVNTFIGWPMHLVKPISDDSHNNVVKAVGCVERCNTSAVKDSLGELMKILYDVYQKLVQLPWDGTNYGLPNVEASFFITHCNEENNSTFKGMSDQAAPRWIEAKSHVQTGGYEYGYYVMHWMWCIVTGGLKDEWNMGISWSTNDKIQQANYFGSLTQASAIRVNPDDIVFGGWDINNMNLADAMARAKVFDINL

SEQ ID NO: 163367 - protein, 194 aa, Glycine max
  Coding DNA Sequence Number=SeqID_71682
  Homolog annotation: Hit_ID=A7PHV5; Match level="QueryCoverage=63%, HitCoverage=47%, E-value=7e-42, Identity=69%"; Hit description =Chromosome chr13 scaffold_17, whole genome shotgun sequence
  Pfam annotation: Domain name=DUF1997; Domain location=45-193; Score =36.2; E_value=1.2e-07; Accession=PF09366.1; Description=Protein of unknown function (DUF1997)
  Subcellular localization annotation: CTP_CleavageSite=34; ConfidenceScore=5.70e-01
MASSSSYSFSLLRSIPISFPHTQCALKSQRLSLRASATPSQKARFVARRKESLSVRQLQRPLIEYMRLPASQYSVLDAERIERVNENTFRCYVYRFKFFNLEVCPVLLVKVEEQPDGCCIKLLSCKISLSGFWGQLEGSAMVAAQNDKFDENCGKMRQMLLQLQLQRGCGDLKIAILQASLVIVEHNLKLINDV

SEQ ID NO: 163368 - protein, 98 aa, Glycine max
  Coding DNA Sequence Number=SeqID_71683
MGHTKNTNTGINEGADVTRGSGLKEVTEWEEQDKGQHEPCALPDSKYNETCNQIKEVTSYWVMAQDLGVTCGEREESLITTMINLEERDKIEADKMGK

SEQ ID NO: 163369 - protein, 111 aa, Glycine max
  Coding DNA Sequence Number=SeqID_71684
  Gene Ontology: Mol. function=protein serine/threonine kinase activity; Cellular component=plasma membrane; Biological process =protein amino acid phosphorylation
  Homolog annotation: Hit_ID=A7PT85; Match level="QueryCoverage=84%, HitCoverage=16%, E-value=2e-44, Identity=92%"; Hit description =Chromosome chr8 scaffold_29, whole genome shotgun sequence
  Pfam annotation: Domain name=Pkinase; Domain location=2-109; Score= -86.6; E_value=0.002; Accession=PF00069.16; Description=Protein kinase domain
  Pfam annotation: Domain name=Pkinase_Tyr; Domain location=1-108; Score=-168.6; E_value=0.043; Accession=PF07714.8; Description =Protein tyrosine kinase
  Pfam module annotation: Pfam domain module=Pkinase::Pkinase_Tyr; Domain location=2-109::1-108
MTTAIAIEDVRREVKILRALTGHKNLVQFYEAYEDDDNVYIVMELCKGGELLDRILSRGGKYSEEDARVVMIQILSVVAFCHLQGVVHRDLKPELRNLGIEVFLFLGLITS

SEQ ID NO: 163370 - protein, 86 aa, Glycine max
  Coding DNA Sequence Number=SeqID_71685
MTEDIVTMKLFGGPGEPGVSTDIFLFGNNIVAVGTTNDNQKRKTLDEASLLLSESETQHDHRSTSTSYVSHKPGYRAYNLNVCAKV

SEQ ID NO: 163371 - protein, 144 aa, Glycine max
  Coding DNA Sequence Number=SeqID_71686
GASTWFFKENKGGYIPCGSLACKGFYKVERNLKNRRLLGDWMPLDPTPACLGELSSPGRARLLQNEVTALLGELPSSQMPCFAINRREGRMRKGFLGPEEWKSIYGHAGSPTRLMTMKPHLEFSSSSDALSLIVPIATMYYLRG

SEQ ID NO: 163372 - protein, 113 aa, Glycine max
  Coding DNA Sequence Number=SeqID_71687
MSEFTSDYPPQILANLHQLDFAPYASGSYKAQGNAPELLHDNHMLHSSRILEKMEVEEPWLGLWLPLHYRVDMGARWCLVFDVRPAGLVADLWVAFVVDWVFLADKVVGNEKG

SEQ ID NO: 163373 - protein, 26 aa, Glycine max
  Coding DNA Sequence Number=SeqID_71688
EDLAIGELGEQHSTIDSACKGCSKHD

SEQ ID NO: 163374 - protein, 138 aa, Glycine max
  Coding DNA Sequence Number=SeqID_71689
MYITLDDVSYLLHLPMTSKLINDVLSTFDRVMMKILLMTRLGIPTEEETIEATIAGARVKLTWLAELHQWNVALGSCMWAATTYLLPLVDSMILADKSSTHIHVAYLLYLNNLDACHDYAWGVTTLSYLYNLLSSTSQ

SEQ ID NO: 163375 - protein, 275 aa, Glycine max
  Coding DNA Sequence Number=SeqID_71690
AQYANRLSPRVGRFINAAGTTGFPTGKRAVSATQLIYDHDYEFELGTPKPLCLVYFLNCMMPLSTASEELSRPYVSLSGSVFFCEGQLSGPCLAKSPMASRKRKSIGSRPTTQYDTRRFSSLDAWNRYTDNVLGRNILPERNVELYHTELDDFKTELERRNFHTRLTNLVDGSIDLALVKEFYANLYSSEGPSPKQSRVRGHLVKIDVDSLNTFLETPMVLAEGETLPTYSRYCMLPTDYKEIEAALCIPGRGFILNAEGHPGKILRKDLTTLAQ

SEQ ID NO: 163376 - protein, 169 aa, Glycine max
  Coding DNA Sequence Number=SeqID_71691
MKADIEAMKEQMTMMMEAMMSMRKMMKDNTTTVVAASTATRIGLNVLTFIFHRTQCPLSLCFHMTQHPRLHVFIGLNVLAFIFHKTQHPHLYLSIGLNIVAFIFHRTQRPRLYVSIGLNVLTFIFHRTQRPLSLCFHRTQRPRFYVFIGLNVLCLYVFIGLNVLRLYLP

SEQ ID NO: 163377 - protein, 52 aa, Glycine max
  Coding DNA Sequence Number=SeqID_71692
MMQRKMKGQIRALFSTEARAKLEDSASVEGFLSVWGFNGEQWQFVMATGGCG

SEQ ID NO: 163378 - protein, 215 aa, Glycine max
  Coding DNA Sequence Number=SeqID_71693
  Subcellular localization annotation: CTP_CleavageSite=30; ConfidenceScore=5.21e-01
MPAGNVPQVKRFLIFDAQKSSSVATNVRLRKNQKQELNSSFTAKGALRNSKINGDDDESEGRRTLSSKKLGKRLVLVRDDAHVAEAVAARGEERVLDDLHANRAEEVLVRLRRGGRERAAGGRGGGVGGDGGAFGRFRFDDGGDERPRGELFHERGTEGGYLFFFYCGGVVVNVNSVLGFWSERERRGRACGYGGSSSLRFEVGRTRVGPTTEVM

SEQ ID NO: 163379 - protein, 70 aa, Glycine max
  Coding DNA Sequence Number=SeqID_71694
MMKEERKRFFLSPKMLNAINLGHMRFNCPVFKRRMEKSDKRNFKEKKEKKGYITWEDNVINSSSDSENKS

SEQ ID NO: 163380 - protein, 150 aa, Glycine max
  Coding DNA Sequence Number=SeqID_71695
MPNHKSTESTLKNLEVQVGQLAKQIADKSSNSFVANTEQNPKEECKAVMTRSKRFVEAEDEESVVYNEKVAEKKRNREKEKQIMVQKKEMEDQEKEKEVEKEIENEKEEKIIRMQRRVKVKKMWMKVLKYHILWYLLRRKKCWIKWPQNS

SEQ ID NO: 163381 - protein, 61 aa, Glycine max
  Coding DNA Sequence Number=SeqID_71696
MVKVGTSYVPINVSYSPKVGPGLPGINRDTRIYLFCEVIFRHREGLMHRLYRQRGEVITMD

SEQ ID NO: 163382 - protein, 167 aa, Glycine max
  Coding DNA Sequence Number=SeqID_71697
MGETHEIPHHNLADFEPCLGYATEGQAIGVVKNPHAMAEMGKRKGSGPLKEYPISSPLPKFKVLDFDKYKGDYLPQEPSKDYQYNFDMVPDRMQLQNICKKGDGSFKEHPQKVEGSGGPGGTPNDGKGDDDRDGRHIINTLLCKDGGLRTLKALRIWSSPTKGSKWV

SEQ ID NO: 163383 - protein, 191 aa, Glycine max
  Coding DNA Sequence Number=SeqID_71698
  Subcellular localization annotation: CTP_CleavageSite=34; ConfidenceScore=5.04e-01
MTSFSQMQSQLQSQMQLQGLALPPEPKVGPSATRVSTKWSYVDPSPTDPETGDLDKCGLYIEENPSHLVSLGRVYEGSTAVHNIPFLHRQVRVSVEEVKDAKAPVPVPTDKAVVSPAKPPDRAHPEVDDPLYLMTLTIPHLFLRPLQVMWDATVFGVFNQDFPLYIKHADLSEITHDGQCLSISILQLWIM

SEQ ID NO: 163384 - protein, 149 aa, Glycine max
  Coding DNA Sequence Number=SeqID_71699
  Subcellular localization annotation: CTP_CleavageSite=84; ConfidenceScore=5.19e-01
MNLLPSAVHVSSLIEFGAPRIHCLAMFANSPFSTFIWRPMNSLPSAVHVSSAIESGAPRIDCLALFANFPSSNLIRRPMNSLPSAVHVSSVIKRGASGDWEICFSVICWIGFFAKHKKKRIRNRDKSRHHGKGRTDEINVLSLLSSYLQ

SEQ ID NO: 163385 - protein, 151 aa, Glycine max
  Coding DNA Sequence Number=SeqID_71700
MWAFHTGRQIDWAHLVRYHMHKALRLNAPFPYPHLVTLFLQHFNIPLDSKPYVPIKRSFLIGATVIASFGYRKEHDGSWVKKGAQPIEEEGHLPVREDSSLLQKILDKFDALELQVDMRFNEMDSRITKVEGDVSYIRTSFDLPPPPPPSS

SEQ ID NO: 163386 - protein, 52 aa, Glycine max
  Coding DNA Sequence Number=SeqID_71701
MNSLSEHAALSEFISTHCPLMSLVHILAADVQLSGRCPAKQILQKLNFCNFR

SEQ ID NO: 163387 - protein, 172 aa, Glycine max
  Coding DNA Sequence Number=SeqID_71702
MSFSQEIAPKKLSTKRSRRDATEEGSSAASEFDSHRFRSAEHQQRFEAIRGWSFHRERRVQLREDEYTDFQEEIARRRWTPLVTPMAKFDPEIVLEFYANAWPTEEGVRDMRSWVRGQWIPFDADALSQFLGDPLILEEGQQCEFSQRRSRADDFDEEAIAQLLCIPGQDFA

SEQ ID NO: 163388 - protein, 38 aa, Glycine max
  Coding DNA Sequence Number=SeqID_71703
MEALEEDYGDGNGKNESRQFIEGLMDLALNRESIDWRQ

SEQ ID NO: 163389 - protein, 37 aa, Glycine max
  Coding DNA Sequence Number=SeqID_71704
MDESEYRTQGTKPKLLNLDPSLDRINPSFILRSLLLD

SEQ ID NO: 163390 - protein, 15 aa, Glycine max
  Coding DNA Sequence Number=SeqID_71705
VNAVKIFPDAQNGLG

SEQ ID NO: 163391 - protein, 173 aa, Glycine max
  Coding DNA Sequence Number=SeqID_71706
MKGIFLHHHRCHGTSGDPLAPIPPSLSSCRSSTLFSSDDQRQRYYSQFCNRVIVDPKYLDLEFFDGETFDCYQVLQNSALVDFMSLKLPYFPKLVKVFYNNLKIQDGVLYPELTIWAQHASIAKRSFSVIEESDRASISRPCATCKISALSTVVVFSQAQRMTDAKLKSTYSC

SEQ ID NO: 163392 - protein, 52 aa, Glycine max
  Coding DNA Sequence Number=SeqID_71707
MAFMVYQLFLLFSTDGVGCVPFAICATVWEPDRCGPFAITPAGERGMCCKCD

SEQ ID NO: 163393 - protein, 40 aa, Glycine max
  Coding DNA Sequence Number=SeqID_71708
MPEIMLKVSMHCKGCALHDFWQRKFLLGQSSLTIAPDRHG

SEQ ID NO: 163394 - protein, 215 aa, Glycine max
  Coding DNA Sequence Number=SeqID_71709
  Homolog annotation: Hit_ID=A7PVL8; Match level="QueryCoverage=26%, HitCoverage=7%, E-value=2e-10, Identity=63%"; Hit description =Chromosome chr9 scaffold_33, whole genome shotgun sequence
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPTRGVELRASVSALKKLGDGPHAHSLLLNAHQQRYQYNMGTELEFVIMVIAVSCVKLLSAHNSTQHTSRKHKV

SEQ ID NO: 163395 - protein, 88 aa, Glycine max; identical to SEQ ID NO: 141338
  Coding DNA Sequence Number=SeqID_71710

SEQ ID NO: 163396 - protein, 109 aa, Glycine max
  Coding DNA Sequence Number=SeqID_71711
  Subcellular localization annotation: CTP_CleavageSite=35; ConfidenceScore=5.64e-01
MWVELTQLHWLMATPPASPPPSSPPPPPPVVASTSSSTLKRTRKATQLQSLATRPPGAKRLVVHVDPTTWKVDGLHKKKLRTYLGIVPRDKVEFDIPEASGGRTKKKAL

SEQ ID NO: 163397 - protein, 47 aa, Glycine max
  Coding DNA Sequence Number=SeqID_71712
  Subcellular localization annotation: CTP_CleavageSite=22; ConfidenceScore=5.15e-01
VFQQKAVPSGGSNPARPNRGRRAEQKCSTLLVFHHSSSFFVRSSVFN

SEQ ID NO: 163398 - protein, 70 aa, Glycine max
  Coding DNA Sequence Number=SeqID_71713
MVKVGTSYVPINVSFRQKLAQGFPRSCILAYYVGTDEGVSEVLHVAGEKRCTGASAEYVIQVLIFRFLAH

SEQ ID NO: 163399 - protein, 140 aa, Glycine max
  Coding DNA Sequence Number=SeqID_71714
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MVFPFDSFDVDSISFRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163400 - protein, 231 aa, Glycine max
  Coding DNA Sequence Number=SeqID_71715
  Gene Ontology: Mol. function=chaperone regulator activity; Cellular component=integral to membrane; Biological process=response to stress
  Homolog annotation: Hit_ID=Q8FL94; Match level="QueryCoverage=100%, HitCoverage=85%, E-value=1e-120, Identity=92%"; Hit description=DnaJ- like protein djlA
  Pfam annotation: Domain name=DnaJ; Domain location=165-231; Score =31.8; E_value=2.6e-06; Accession=PF00226.22; Description=DnaJ domain
MAWFANQRERQSLFFSTTFEVMGHLTKSKGRVTEADIQIASVFMDRMNLHGDSRLAAQNAFRIGKSDNYPLREKMRQFRSICFGRFDLIRMFLEIQIQAAFADGSLHPNERDVLYVIAEELGISRMQFDQFLRMMQGGAQFGGGYHQQSSGGTWQQAQRGPTLEDACNVLGVKPTDDVTTIKRAYRKLMSEHHPDKLVAKGLPPEMMEMAKQKAQEIQKAYELIKEKKGFK

SEQ ID NO: 163401 - protein, 58 aa, Glycine max
  Coding DNA Sequence Number=SeqID_71716
MDEVDGMSAGDRGGSDQAYRYRRPRGGARCINESANARGEAVCVLGASGVYTGLLCWH

SEQ ID NO: 163402 - protein, 140 aa, Glycine max
  Coding DNA Sequence Number=SeqID_71717
  Gene Ontology: Mol. function=transferase activity, transferring alkyl or aryl (other than methyl) groups; Cellular component=cytoplasm; Biological process=UDP-N-acetylgalactosamine biosynthetic process
  Homolog annotation: Hit_ID=Q6DAF2; Match level="QueryCoverage=100%, HitCoverage=33%, E-value=8e-58, Identity=81%"; Hit description=UDP-N- acetylglucosamine 1-carboxyvinyltransferase
  Pfam annotation: Domain name=EPSP_synthase; Domain location=6-140; Score=-213.7; E_value=0.01; Accession=PF00275.11; Description=EPSP synthase (3-phosphoshikimate 1-carboxyvinyltransferase)
MDKFRVQGPTRLQGEVTISGAKNAALPILFAALLAEEPVEIQNVPKLKDIDTTMKLLTQLGTKVERNGSVWIDASNVNNFSAPYDLVKTMRASIWALGPLVARFGQGQVSLPGGCAIGARPVDLHIFGLEKLGAEIKLEE

SEQ ID NO: 163403 - protein, 82 aa, Glycine max
  Coding DNA Sequence Number=SeqID_71718
MEDESSEATIPEPFIVEVEAGDTQTTQVAAATPEAISEPPAPAMDPSSQYAADPSTPVLEIPEGQTTLALTLDTSPPAILNS

SEQ ID NO: 163404 - protein, 166 aa, Glycine max
  Coding DNA Sequence Number=SeqID_71719
MLIIHASSAIESGAPTVDCLALFVYPPPSNLIRSHELFVIHASSTIESGAPRIDCLALFIYSPPSNLIRSPMKLLIIHASSTIESGVPTNGLPSAVRLSCTLKSYPEPQKFLSFMHPPPSSLEPQELISLALFVYPAPSNLIRSPMNCLSFMHPPPLSLEPHELIA

SEQ ID NO: 163405 - protein, 98 aa, Glycine max
  Coding DNA Sequence Number=SeqID_71720
MASRKRKSISSRPTTQYDTRRFSSLNAWTRYTDNVLGRNILPKRKVEIYHSKIDEFKAELERRNFHKHLTNLVDGSIDLALVKEFYANLYSSEDRPPK

SEQ ID NO: 163406 - protein, 287 aa, Glycine max
  Coding DNA Sequence Number=SeqID_71721
  Homolog annotation: Hit_ID=A5B1P9; Match level="QueryCoverage=96%, HitCoverage=21%, E-value=5e-13, Identity=25%"; Hit description =Putative uncharacterized protein
  Pfam annotation: Domain name=zf-CCHC; Domain location=263-280; Score =12.9; E_value=0.017; Accession=PF00098.14; Description=Zinc knuckle
MWVLKLQSKFEGDPMVNGFGITVSSTKEDCKEISNDDEDVENLTLMVKKFGKFLKRSKDRKFSKPLKKVESNNTFTCFKCEKQGRIKSNASTSFNASSEEVANVCLMADSKDDSSTIEEIEVNSEFEEVLEAFNEMHEEVQRLVVSNNKLRSNLKWHITKLASTQSELDKLKHENEKLDHYEEHMKLQNELSYLKDLFRKMNKGKSDHSHLLSMQKHTTDKIGLGYNMQTSLSKKTKFASSKKVNPDKVSKKKNILHPNPNAKTCHYCMKTGHTSYKCYVRRFDVPK

SEQ ID NO: 163407 - protein, 95 aa, Glycine max
  Coding DNA Sequence Number=SeqID_71722
MVVIIKKGENVNNAGFDDAKKNSLDNYCHHQKRGRIIIKQGCFQDYFNKHSKVKHCFKINTRLLQQTSITSRSSFCLKTKCFQEIKALVINYQAV

SEQ ID NO: 163408 - protein, 117 aa, Glycine max
  Coding DNA Sequence Number=SeqID_71723
MTNSFENLERTDKTRCEFLGFQSLTNPSPRGDSQEYMIINLEFQVFSLLVLITLLPTLRNPHPILDKLDLLSAELYQQQKTLQTPICLIHMLLKGPPAPEWSVQFGHQSEDGRLNLA

SEQ ID NO: 163409 - protein, 66 aa, Glycine max
  Coding DNA Sequence Number=SeqID_71724
MVSNPSRAQKKEKTSKRKQGECSQAALNRLDTWFTDESKKNDYKMIYVAINMRIPKYLDLEWFSQK

SEQ ID NO: 163410 - protein, 256 aa, Glycine max
  Coding DNA Sequence Number=SeqID_71725
  Gene Ontology: Mol. function=protein serine/threonine kinase activity; Biological process=protein amino acid phosphorylation
  Homolog annotation: Hit_ID=A5B812; Match level="QueryCoverage=52%, HitCoverage=40%, E-value=2e-25, Identity=52%"; Hit description =Putative uncharacterized protein
MLYIVGPVLHTLTFEYVEGPSVKDVFLEFGSRDVDKECMDNIASQIGHAIGKLHDCGLVHGDLTTSNILKEWYQSVGEFIHVFLGPAMSNYPSFILCSMRNIINLCYRSQVDFVYLCVLERAILSMHSSCGNVLTMKRFSAKLGISFLAKTLPMEYIKAFSILFSTVYNPDFIVCALKLIWAKTLGDKVYPFSPMSNLKPYDYGLDTCCIPQVIKAVLIHIEQTSTSIPASEPGEKSCAHARNFFHGGVYTERQTK

SEQ ID NO: 163411 - protein, 83 aa, Glycine max
  Coding DNA Sequence Number=SeqID_71726
  Gene Ontology: Mol. function=phospho-N-acetylmuramoyl-pentapeptide -transferase activity; Cellular component=endoplasmic reticulum; Biological process=polysaccharide biosynthetic process
  Homolog annotation: Hit_ID=A7PVR7; Match level="QueryCoverage=89%, HitCoverage=17%, E-value=5e-23, Identity=66%"; Hit description =Chromosome chr8 scaffold_34, whole genome shotgun sequence
MSDIEYVFLQLSGYIPCPRHRLPRFDPQTGLLTGTNDGTLVNFFLRNLGRKSEKALCIYLLAFQAIACCLCFLLRYFLAGWYK

SEQ ID NO: 163412 - protein, 112 aa, Glycine max
  Coding DNA Sequence Number=SeqID_71727
MRLHCYQASRRPSITTNRPPLFMARINPVESPSVATYPLTGGQAEKHNYVFQKWKMSGVATNIYSRKMLEKPKRGLRILKIRVREFFLHSGGISTPHDHHKGRQPFIECAKM

SEQ ID NO: 163413 - protein, 56 aa, Glycine max
  Coding DNA Sequence Number=SeqID_71728
MGHLRFIVLFCRNNQHENTEKDIEGRSPEYEEPQDLRSNPFQGGGDDAILPPKGIG

SEQ ID NO: 163414 - protein, 175 aa, Glycine max
  Coding DNA Sequence Number=SeqID_71729
MGYVHEEHCVTYDFMYYLIVRIEGKETFCCGVKHDQEQQSDVERHDCVRQLWKDLYSCKAPSCTMPSKPTSIHGTILMGSVVEELFLKAMDDHRVMTRSYYCYARHVEIVKLSSNSYIQVLDVGSKDSKETLPIVESPRTKLKASYTFPPGTRCPLVLETSVEEATLSITKLRAL

SEQ ID NO: 163415 - protein, 180 aa, Glycine max
  Coding DNA Sequence Number=SeqID_71730
  Subcellular localization annotation: CTP_CleavageSite=47; ConfidenceScore=5.65e-01
MMHPLQFHSSISTSSAPTPPTAVALFEGSTLVNQPSNNGVQTPNVTSGNSERQDESNNDGCSNVEKAQKKRKHGEVAPLPPPSTNPTPTNPIAGESVVDQWQVRQLPIGLVNHQKFQHNHKRHKEFKDPQHKKLNKLKQHKERLDNKLNHNKDRKLHQKIKSPKENQVGHLLVLGTIINK

SEQ ID NO: 163416 - protein, 63 aa, Glycine max
  Coding DNA Sequence Number=SeqID_71731
MRGGGCTVASLPQLVMTKDNNRYLKALHWAMRGTVHKPQANLRVDQKFLPGRLRTQKGNLGKN

SEQ ID NO: 163417 - protein, 75 aa, Glycine max
  Coding DNA Sequence Number=SeqID_71732
MTGFLRFFRRFPQINVGGDSAHFPPLEDAPVSLASLARQRDLMMSKRICLIMIAIIKKGKNVNHAGSDDAEKKFT

SEQ ID NO: 163418 - protein, 55 aa, Glycine max
  Coding DNA Sequence Number=SeqID_71733
MAAHQGELVTSPLSYLGVQVSQRLAWASQGPEKLKMTLLPSPLEARIEKRKETEK

SEQ ID NO: 163419 - protein, 88 aa, Glycine max
  Coding DNA Sequence Number=SeqID_71734
  Gene Ontology: Mol. function=ubiquitin-protein ligase activity; Cellular component=ubiquitin ligase complex; Biological process =protein ubiquitination
  Homolog annotation: Hit_ID=A5C882; Match level="QueryCoverage=98%, HitCoverage=34%, E-value=2e-17, Identity=50%"; Hit description =Putative uncharacterized protein
MEGENASKVIELVNEIASIFEYRPLMKKQYCNLVWRLKLLIPMLEEIRDMNKDALAKDTSNAVLAFKEALQSARKLLRFGSEGCKFYM

SEQ ID NO: 163420 - protein, 157 aa, Glycine max
  Coding DNA Sequence Number=SeqID_71735
  Homolog annotation: Hit_ID=Q2HVN2; Match level="QueryCoverage=69%, HitCoverage=32%, E-value=5e-10, Identity=33%"; Hit description =Putative uncharacterized protein
MEALMFHHAHLVLEVTPKMLEVSGWSSKYGGWRRLNEEPRPSKECTWWRDLKKLCQHPQQGQLLNNSIIWQVGCGDQAKFWEDSRTGGGNQLMEKYPRLYTISEQQNQLIQNMGTHKDTSWEWDFKWRRPFFDNEIQMAVSFIQEVEGLRIRPTIGD

SEQ ID NO: 163421 - protein, 172 aa, Glycine max
  Coding DNA Sequence Number=SeqID_71736
MNTVLQTETELKLGCGDKFRFWEDRWVRGGEALMRKYPRLYQVSCQQQRLIQHARRQTETVWEWNLEWRRPLFDNEVDAAFDLWMTYHRYKSKIRSLIAGYGNQKLQDKVRRRKPLTYFLIDQRHGPYGGNPSPGFKPWELFLLIQDNISCSKQLAQMVESSILDGSAGGWP

SEQ ID NO: 163422 - protein, 177 aa, Glycine max
  Coding DNA Sequence Number=SeqID_71737
MSEVFNPDFPLYIKHEDFSEIAHGGQCLSISVLQLWILHLTETSMRAGNSDLYAFLEPQSIQRFGQSQFEIESYIKSWMQSSKRDVYLGAYLNGGHWQMVVILPKEHLVVWFCSLHNRPDNNLKGIINSALKGLDEAPQPKSKAPARWIVVKYFSDPRPLEAERLKALQIQWAGYYL

SEQ ID NO: 163423 - protein, 118 aa, Glycine max
  Coding DNA Sequence Number=SeqID_71738
  Gene Ontology: Mol. function=protein transporter activity; Cellular component=nuclear pore; Biological process=intracellular protein transport
  Homolog annotation: Hit_ID=Q2PEZ3; Match level="QueryCoverage=40%, HitCoverage=9%, E-value=5e-14, Identity=81%"; Hit description =Putative importin alpha
  Pfam annotation: Domain name=IBB; Domain location=1-70; Score=16.8; E_ value=5.6e-06; Accession=PF01749.11; Description=Importin beta binding domain
MDADEGRRRREDTMVEIEKNRREESLQKKRCEGLQSQQIPSSLHSIVIYLTQLLLSQSAQNPNVLICTPNFTIGSSRSCNFVLKDQTISANLCKIKHTQVLSRCGVECEGLETLCIKD

SEQ ID NO: 163424 - protein, 291 aa, Glycine max
  Coding DNA Sequence Number=SeqID_71739
  Gene Ontology: Cellular component=integral to membrane
  Homolog annotation: Hit_ID=Q9SEW6; Match level="QueryCoverage=41%, HitCoverage=38%, E-value=2e-30, Identity=60%"; Hit description=Amino acid transporter b
MFGVKSQIFRKGVHFREQRRDANLEAGADLVVHRGQHRPQRRRRYTSCVGRSGCRGPPPCTRRAPHPHTVDSFLRRDRNRRGARQRRRRQRWKWRRDGIHDMSSNMYMISFGIVEIIFSQIPGFDQLWWLSIVVAVMSFTYSTIGLGLGIGKVIGMNSCYSHVHHDDICSSSITENRGVRGSLTEITIGTVTQTKKVWRTMQALGDIAFAYSYSLILVEIQVMHVLGFDPHAFAHFRDERKRRHNQAKTSLTTNKTLLAPTKSCQTRLLHPGRGCRYADLLANHEQNLQGS

SEQ ID NO: 163425 - protein, 306 aa, Glycine max
  Coding DNA Sequence Number=SeqID_71740
  Homolog annotation: Hit_ID=Q6WAY6; Match level="QueryCoverage=42%, HitCoverage=30%, E-value=5e-16, Identity=30%"; Hit description =Putative uncharacterized protein
VVEIPRKHLEDKAKALVDQGEWTSFADVLALLVFGIVLFPNVDRLVDLAVIDAFLSYHHSKESLKGKANWEELLAAMVGASVNWFPRWKEGGAGVLSSCEGFPSVPLMGTRGCINYNPVLAIRQLGYPMRGISSEEKAEVPEESEEVQALKQNLKEHEWSRKSSRRQPSGGFMGQQQRTQASKGRKGRVEGGKYDIRGQVEGLSKYKEKLNLAASHERRLEDEHAKVLALQAEREAREKVIDSLHGEAMMWMDRFTFTLNGSQVLPRLLAKAKTMADMYSPAEEVHGLFDYCQHMIKLMSHIIRNR

SEQ ID NO: 163426 - protein, 243 aa, Glycine max
  Coding DNA Sequence Number=SeqID_71741
MEFPSGNKGFEEAMNLEVCTKEIKRVGKKKSNTQEFYTGSATTHAYIQSPSDLRSLRFLFNLVNSFTIKDPQGMYPPLFSLNNLVDVPSTRTDPQEMYPLLFSVTITQVDVPSTCTTKDAPSNVLRQSSQAVSPLKFCERGNKRILRREKGDIKEFRRLVPGEFFSTKGEGNEKDEYHNFVFKFYTGSATTRAYVQYSSNPLEISTIFVKSIIKSEPHRDNPSLVFRNPLQQETHSLLTNLIE

SEQ ID NO: 163427 - protein, 72 aa, Glycine max
  Coding DNA Sequence Number=SeqID_71742
MEGSASTSVVQDHVEEHRNPYMDMVIDVTYDVLNPEAKEMEEDPNPSTSKFYNLLSDVDESLWRVARSIQNC

SEQ ID NO: 163428 - protein, 238 aa, Glycine max
  Coding DNA Sequence Number=SeqID_71743
QSFGVLVTPSKVIRPLITRAFVEKYCTPRQAQGDAHQATDAPPPPHQADPAGSLGMERYLQHLVRQQAANHRGQVQIHECLYRFSLSQQGQGFASFACPTLEQFGVEVAWPGDWPEVQAGEEPAGSSGEAEEAHMDEEMTDLLGFLGGSGATFICQLFSMTTDKGSFSFCRSVSHRQPKNIVAPPLLLSSPQPSYVIRIVASLNDNNHLIVVANSSVLMKAKKKIHNARLWMRFDQSG

SEQ ID NO: 163429 - protein, 157 aa, Glycine max
  Coding DNA Sequence Number=SeqID_71744
  Subcellular localization annotation: CTP_CleavageSite=51; ConfidenceScore=5.39e-01
MAEPSKKRKGVATSSAVTGTRSHGTSKVHTYQIPPSISSPTLFSSEEQRIRYNSLFSSRSIIDPKFVDLAFFDDEVFDCFQAFQNSGLIQFISMKLPFYPELVKVFYSNLEIQKDSLISEVYGIKMVIDQSLFFDLTQLSSDGVPFEGILYVTSHFS

SEQ ID NO: 163430 - protein, 105 aa, Glycine max
  Coding DNA Sequence Number=SeqID_71745
MQMADKGRGGGRRTFNRGRRCGFGLGAPITTNPFTFSIHISTLESMIHVIVLTPNTLPTTQDQPNPTFVRESIPTTPVGDASPSAPDDSLTPEYPPDPNCEHIID

SEQ ID NO: 163431 - protein, 156 aa, Glycine max
  Coding DNA Sequence Number=SeqID_71746
MNKIRNGQDKGKWIIANVRAALDEHWGSIDFLNKSSIAKGPNYKRNVYMLGTLSKRFSCSKSAPSTSIAPVEDQIEEMRETINKLNVELLEKANKEKTLEEKMLQLMENHDHQSQDMRQPMQEQSEQIHQQNELMQCILQHLHIQSIIPAPTPSTT

SEQ ID NO: 163432 - protein, 155 aa, Glycine max
  Coding DNA Sequence Number=SeqID_71747
MQSLQELAQQRPIMSIDQFIEKVAWPGARPSFVGDNESFTAQAPQKHELEPENDHLSEAIIPGAIDFLKRRLETRSNKAAHPEPVPASADAPFLGVDPSSPQHTVDSSTLVLEIPEGQTIPVLTLDTSPPATPVLHLTNEEDVQTQDNQDQSQEF

SEQ ID NO: 163433 - protein, 94 aa, Glycine max
  Coding DNA Sequence Number=SeqID_71748
PYNAQWNVSGLLHDKHTLRSSRILRETKVDEPWLGLWLPLNYQVDMGASQHRTPELGFVVDLGMAFVDNWVVGKEKVCYWLSNDIVGLVGNLAV

SEQ ID NO: 163434 - protein, 45 aa, Glycine max
  Coding DNA Sequence Number=SeqID_71749
  Gene Ontology: Mol. function=endonuclease activity
  Homolog annotation: Hit_ID=Q9AY32; Match level="QueryCoverage=66%, HitCoverage=45%, E-value=3e-09, Identity=100%"; Hit description=RRNA intron-encoded homing endonuclease
MPTRDRAISNMMCCSAPYEKSKSLGSGGSMVARLKLKGIDGRAPP

SEQ ID NO: 163435 - protein, 114 aa, Glycine max
  Coding DNA Sequence Number=SeqID_71750
  Homolog annotation: Hit_ID=A1CUV6; Match level="QueryCoverage=39%, HitCoverage=32%, E-value=2e-11, Identity=71%"; Hit description =Putative uncharacterized protein
MWIFNGNVTELGDTGGSPGKSYLFSLTVYNPEISLSGARVQWLVEHNSSVVSGLGVSGLGWKPWDQTRTVYWATFGWTWSGPGALNVKVKKFNQARVNGGSNYDSLKVAKCLVI

SEQ ID NO: 163436 - protein, 136 aa, Glycine max
  Coding DNA Sequence Number=SeqID_71751
MAPRKFSAKRSRKDAVVEGTSATPEFNSHRFRSAGHQQRFEAIKEWSFHRERRVQLRDDDYTDFQEEIARRRWTSLVTPMAKFDPDVVLEFYAQCLAHGGGRAGHAVMDALSQFLGDSLVSEEGQECEYSQRRNLG

SEQ ID NO: 163437 - protein, 124 aa, Glycine max
  Coding DNA Sequence Number=SeqID_71752
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSRVGSSENLSKNRPARR

SEQ ID NO: 163438 - protein, 189 aa, Glycine max
  Coding DNA Sequence Number=SeqID_71753
MSEIEEMQEQTKVNIDAMKEQMTIMMEAMMSMRKMMEVNTVTVVAASTAIKVDPTHPPGSNQVNRPTLDMVGQGSGELGSTGGPHFVQVHSKHSFPPYGLPPNYTPPNVAHAPDENVDNSAPIPIESQQPQSSHAQVPQPMGETHEVPRDHTLVDFEPHLGGPSVSTATTTLTFWGWKSASYHGRKGEI

SEQ ID NO: 163439 - protein, 80 aa, Glycine max
  Coding DNA Sequence Number=SeqID_71754
EFYANLYDPKDKSPKQVRVRGHLIKFDEDTLNTFLKTPIIVEEGESLCAYSRFALLRPDPQELVAKLCIPAKGFELNVDG

SEQ ID NO: 163440 - protein, 100 aa, Glycine max
  Coding DNA Sequence Number=SeqID_71755
LACLWLTKGAGPYGSPACHWTRRLWMKKVQMTTLVSAYQRARLPPVDKRCGTIWFPHMSSDSPSLDDKGTDDNALSLTDSKKNVYMDNHWGISACPLTSR

SEQ ID NO: 163441 - protein, 86 aa, Glycine max
  Coding DNA Sequence Number=SeqID_71756
MKREYMMLSMMILVLRQPGSTDTMIDPPFPIRRHVKWKITRTKKTGQMTSEAAKEIADKIDSLEEQASQGSFVTHGRRDVLTAAIG

SEQ ID NO: 163442 - protein, 118 aa, Glycine max
  Coding DNA Sequence Number=SeqID_71757
  Gene Ontology: Biological process=transposition, DNA-mediated
  Homolog annotation: Hit_ID=Q1J7G7; Match level="QueryCoverage=25%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDIRSEPSPNTVAFVNQGD

SEQ ID NO: 163443 - protein, 66 aa, Glycine max
  Coding DNA Sequence Number=SeqID_71758
MREARRSTFFKYTTWVLAMQMWLDSHVDLNESSFPRRCNSSYFGNGKIFGARTQEEGLIRIILTWF

SEQ ID NO: 163444 - protein, 88 aa, Glycine max
  Coding DNA Sequence Number=SeqID_71759
MSPVESPTVATCPFAGERTRGSRVCFPKEERCTESPPTFICGKRRKNRRKPVEMEILSSGVVFMFEEGRQKRGSCSYVPSIEEEIRPT

SEQ ID NO: 163445 - protein, 346 aa, Glycine max
  Coding DNA Sequence Number=SeqID_71760
  Gene Ontology: Mol. function=motor activity; Cellular component=cell projection
  Homolog annotation: Hit_ID=UPI00016621D1; Match level="QueryCoverage =72%, HitCoverage=39%, E-value=6e-22, Identity=36%"; Hit description =UPI00016621D1 related cluster
VDPWVLVPITFRGLHALAIRGLHVLTFVGLHALTFRGPHVLTFRGLHALAIRGLHVLTFVGLHALTFRGPHVLTFRGLHTLAIRGPHVLTFVGLHALTFRGLHVLTFRGLHALGSEDYTGLRALAFVGLHALTFRGLHVLTFRGLRALAFVGLHALTFRGLHVLTFRGLRALAFVGLHALTFRGLHELTFRGLHVLAFRGQHVLALTFRGLHVLTFRGLHVHAFRGLHVLTFSGLHALTFKGLHALTIRGLRVLTLNSGPPSNIGGRPTVQAQPEWEAITQLLCIPGQDFTRAAAKRRGSRPQDTQWTQRRPTRPWGFQLWLQASANPTGRLDRARKTLCGPEEGQ

SEQ ID NO: 163446 - protein, 83 aa, Glycine max
  Coding DNA Sequence Number=SeqID_71761
MSVKNLVKRLGVHDKTNHTLGDQLGSRYFVRMLQPYGINIGLKENSNWVYLPPRPTLRRVGQGLSLLIQVQPRKHTTPQLFSK

SEQ ID NO: 163447 - protein, 76 aa, Glycine max
  Coding DNA Sequence Number=SeqID_71762
MDSKIYPKVHENPRAFFSSSSPSLLESSIQYPWGVGLHHPLHLGKDLTSNPESMVRSENPFHGHLPMREHGSSPTQ

SEQ ID NO: 163448 - protein, 91 aa, Glycine max
  Coding DNA Sequence Number=SeqID_71763
MIPTPNENIPVVATYPSAGGRRVTRGMRVPRKEYARSRHQRLFEENVGKTGKDAIYELFSEKVRELYLRTGKGVSLCSYVFLNWDEKIRPT

SEQ ID NO: 163449 - protein, 59 aa, Glycine max
  Coding DNA Sequence Number=SeqID_71764
MARAGDNGGVYHQLDGSQRLFLDAMSTQMQRLLNCNKEELYRRIAKSSLFTLKPLSLRE

SEQ ID NO: 163450 - protein, 105 aa, Glycine max
  Coding DNA Sequence Number=SeqID_71765
  Homolog annotation: Hit_ID=O52175; Match level="QueryCoverage=78%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGRQFAPAG

SEQ ID NO: 163451 - protein, 113 aa, Glycine max
  Coding DNA Sequence Number=SeqID_71766
MAKITLKVVVPPDTILNTVSAKDQIYGEVSLSFVVRWKDVLDRLRRFINEDGNFHTVVYNQDLDKLVIVAGWTTLRDFYHVTAYHQVSLTHYGKNVFFLTIFKSSSMPKSFPR

SEQ ID NO: 163452 - protein, 130 aa, Glycine max
  Coding DNA Sequence Number=SeqID_71767
MEAKKEQMATMMEAMMSMKKIMEANAVAVAATSVVAKEMIWGVQAAPYDVQIQNEHAFLPYGLPPNYTPPNVAYTPDEDVNNSAPILIESQQPHHAHVSQPMGETHEISHHNLADFEPCLGYATEGHVVG

SEQ ID NO: 163453 - protein, 97 aa, Glycine max
  Coding DNA Sequence Number=SeqID_71768
MPSLTSGMSRNFTNCLTMGAKYLEVVKRGSHPNNGWSLDEIRTQNDHNLSLRVVGHDQAWAARHRMTIICLYVPPDTIASGWRKGVRNDHNLSPPTS

SEQ ID NO: 163454 - protein, 378 aa, Glycine max
  Coding DNA Sequence Number=SeqID_71769
  Gene Ontology: Mol. function=double-stranded RNA binding; Cellular component=intracellular
  Homolog annotation: Hit_ID=Q5N8Z0; Match level="QueryCoverage=51%, HitCoverage=36%, E-value=8e-18, Identity=35%"; Hit description =Putative dsRNA-binding protein ODB1
  Pfam annotation: Domain name=dsrm; Domain location=151-217; Score =63.6; E_value=6.6e-16; Accession=PF00035.16; Description=Double -stranded RNA binding motif
  Pfam annotation: Domain name=dsrm; Domain location=273-333; Score =40.2; E_value=7.3e-09; Accession=PF00035.16; Description=Double -stranded RNA binding motif
  Pfam module annotation: Pfam domain module=dsrm::dsrm; Domain location=151-217::273-333
MASGVYCLQIFKFILADQLDPQVMQINHADQEDGGRHRRRRTKTWEKEAAAPAAHGRRKKTRMKVEEEEEKPGGREEEKKRWVHEIFKKIKGQFCLFALSAGCTSIATPLILLSLSYYEGFDCSSFVVSSVVEVVKNVEGEGGTASERAMYKTRLQELCQRRSWTLPTYDNSREGPDHNPRFTSTVNVNGVSFHTPSPTRSAKQAQNDAAMLAFLHFSPPSPSTSCPTFPQHSLSISALSSFPQPSLFASSSGSPDPSSVVDDILLTNGVLQPKLEEVCQTSQISGPVIAGPPHAMRFKCKVTVDGQTYESDKFYSTLKDAEHAAAEAALISLSPGRVQEASLSHLYIGHVSDKCWGGVGVRNVSDTSNRRDVHGHAS

SEQ ID NO: 163455 - protein, 42 aa, Glycine max
  Coding DNA Sequence Number=SeqID_71770
MLSGDNPTKGLIPGYVWDLTFMFVVLKGWSTVTPYTNICKFK

SEQ ID NO: 163456 - protein, 71 aa, Glycine max
  Coding DNA Sequence Number=SeqID_71771
VARGSHRWSVVVEEKVGDVRGGFKGRDGGKNEKDPSMDKEDPVTKPKFMEEDSLQASSEESCYEAFLHRLY

SEQ ID NO: 163457 - protein, 67 aa, Glycine max
  Coding DNA Sequence Number=SeqID_71772
MLVATPRAFLPWKMHQIHDVGYNVQDILPENTGVAAQCTRQDKRIEAAGSTMSDTMSRTSCPKILDT

SEQ ID NO: 163458 - protein, 126 aa, Glycine max
  Coding DNA Sequence Number=SeqID_71773
MAPLFFCPISLIYRREEGGGCRLARPGELGCFHQKAPPSFGTLRKAQKLYGLCNDACFSFRNVAKLHELCNDACFSFRNVAKLYGLRNDACFEGFEGSKQGSRTDRKYSWTKLGYDSCPSLLIFYW

SEQ ID NO: 163459 - protein, 181 aa, Glycine max
  Coding DNA Sequence Number=SeqID_71774
  Gene Ontology: Mol. function=chaperone activator activity; Cellular component=integral to membrane; Biological process=embryonic development ending in birth or egg hatching
  Homolog annotation: Hit_ID=Q6ID70; Match level="QueryCoverage=62%, HitCoverage=74%, E-value=1e-43, Identity=74%"; Hit description =Uncharacterized protein At3g03773
  Pfam annotation: Domain name=CS; Domain location=66-141; Score=46.2; E_value=1.1e-10; Accession=PF04969.7; Description=CS domain
MTGQFLKTLFFVWESETSNKRPKRPRTKLDVVLKSLLFHTHIPFSSEHSRFRLLPSHSANEISRHPEVLWAQRSDKVYLTVALPDAKDVFVKCEPQGLFAFSASGVQDKAYSFSLELYGSIEPEGCKTKSGLRNILCSIQKGEKGWWKRLLKSEEKPAPYLKVDWNKWCDEDDEESTCKLL

SEQ ID NO: 163460 - protein, 81 aa, Glycine max
  Coding DNA Sequence Number=SeqID_71775
MAASAPTPRKCSLKRGIEGRVWVYDGDLEGEVRGEIKGPVKEVREGRVVGLEERVVVAIRVVTKGGSSGGGGHVGQLVVIG

SEQ ID NO: 163461 - protein, 125 aa, Glycine max
  Coding DNA Sequence Number=SeqID_71776
MLMCNHQFSSVGLIELLCTIGRTPDGILNILEATMTPTRQNEFVGYLLTGINPKKFDIPSGCTMDEPKDLIKQIAPHGIPPYGIWINLIRNKLADHLCQLRIKYSFCRSTKPYADHVIAYTDQAE

SEQ ID NO: 163462 - protein, 82 aa, Glycine max
  Coding DNA Sequence Number=SeqID_71777
  Subcellular localization annotation: CTP_CleavageSite=59; ConfidenceScore=5.56e-01
MAQSFFLHFCASSPSFSVFGAQCFSVSSFPCDQLGKVKVKVPVFSVVVVVGDIQGTHLRHGAFWCMVDRADQVDPKLILSGL

SEQ ID NO: 163463 - protein, 102 aa, Glycine max
  Coding DNA Sequence Number=SeqID_71778
MLAVKKPGIASSYHLSGVASFCLENQPKQTITQHKLDPKTQIQKHLKQRSNQIDNPCKLDPNGYRANQRNTELEFVITGHSVSGGGEIVIRSQFHTTYEPEA

SEQ ID NO: 163464 - protein, 418 aa, Glycine max
  Coding DNA Sequence Number=SeqID_71779
  Gene Ontology: Mol. function=motor activity; Cellular component=cell projection
  Homolog annotation: Hit_ID=P15305; Match level="QueryCoverage=93%, HitCoverage=79%, E-value=4e-19, Identity=21%"; Hit description =Dynein heavy chain
ELHVLAFRGLLVLTFRGYTSSTSETYTPLPSKDCTSSPLEDYKCSPSNGCTHSPLEDYTSSPSESYTASHSEEYTSSLSEDYTGLNVLAFRALHLLPFRELQAVAFRGLHVFAFRGLHVLTFRGLHVLPFRGLHALPFRGLHVLIFRGLDALAFRGLHDLPFRGLHVLTFRGLHVLPFGGIHVLTFRGLDALAFRGLHDLPFRGLHVLTFRGLHILAFRGLHVLQLKGLQVVAFRGLHVLTFRGLHVLALRGQHILPFRGLHVLTIRGLHSLAFRRLHALQLKGLQVVAFRRLHVLPFRGLHVPALRGLHILPFRGLDVLTIRGIHSLAFRQLHALPFSRQHVLPLRELLALAINGLHVLAFIGLHVLSFRELHALSFRGILVLTIRGQHVLAIRGLHIVTFRGLHVLPFRGLHVLPF

SEQ ID NO: 163465 - protein, 193 aa, Glycine max
  Coding DNA Sequence Number=SeqID_71780
MCMISLRLPAFNEYGSGVIDILTGSVCHIGWCIVGRQAIWWEGMIAIWGGQVHLNNGAVKKVIWAFRLPVTKDETNIQRMCDDMMQMRKSATVGCIIPFEKHIAAVGTTNNNMLSKRKTLDEGSQLSGKSETQHDHRFTSTPYVPMDPVESSTVATYPSAGGRCGAHGCFFQGRKARGVATNVYSRKTSEKPE

SEQ ID NO: 163466 - protein, 81 aa, Glycine max
  Coding DNA Sequence Number=SeqID_71781
MVNLGAFLNPWAHLGPLESFKEKQPARLGEQVASRRSNQLTWASCVATLPPYFAINRCGGLKGRGSTSLRVSTDLLSRNLT

SEQ ID NO: 163467 - protein, 121 aa, Glycine max
  Coding DNA Sequence Number=SeqID_71782
MAGRNKRERLLIEALNNLAQVMANQGGDGGATMYHGLDLFQRNNPPTFKGASMRSFNGGFPPWRCSGRQRRRGERRRHPLRNKPWKKELHHQDEPWIRSLERMLQWRKRKMERKRKGGARN

SEQ ID NO: 163468 - protein, 1314 aa, Glycine max
  Coding DNA Sequence Number=SeqID_71783
  Homolog annotation: Hit_ID=A5C2P7; Match level="QueryCoverage=35%, HitCoverage=70%, E-value=1e-127, Identity=53%"; Hit description =Putative uncharacterized protein
  Pfam annotation: Domain name=DUF547; Domain location=390-520; Score =203.4; E_value=5.5e-58; Accession=PF04784.5; Description=Protein of unknown function, DUF547
  Pfam annotation: Domain name=RRM_1; Domain location=640-704; Score =12.3; E_value=0.011; Accession=PF00076.13; Description=RNA recognition motif. (a.k.a. RRM, RB
  Pfam module annotation: Pfam domain module=DUF547::RRM_1; Domain location=390-520::640-704
MNTRARTTLHSMKPPLNDTPMKGKMETGGGKRAMGGGHKNGRRSNRERKMALIQDVDKLKRKLRHEENVHRALERAFTRPLGSLPRLPPYLPPYTLELLAEVAVLEEEVVRLEEQVVNFRQGLYQEAVYISSKRNAENLNDPIDQNTIRSSKHQRSKSMSQSEFNSTMMGKPQPSLARSASSRKLMFSSDTGNDHTGKLVHGKQLHRKQDSFSSIPEDGRGKENRSFGNFVKDKQSPEKKTTKVVTAIKKSPLKQESPEKCMDHLKLQLDWRLADHERAQSSSSSSDDKVSEIDSTPNRVSEDIVKCLCCIFVRIGTSKDKFGESKTASRSVSAFNQCSKEKDQSCDPYGICSESKTREVGPYKSSCEVIATTVDMNRTTNAVFLIHRLKFLLGKLASLNLKGLTHQEKLAFWINTYNSCMMNAYLEHGIPESPEMVVALMQKATIVVGGQLLNAITIEHFILRLPYHLKFTCPKAAKNDEVKAPGIFGLEWSEPLVTFALSCGSWSSPARERERESGRVRETDRRRASETQRGRVRETERERENQRERETWTAKGQQRGRPGLRDNHGGRVDDKVNARSRSRDNLQEGKWIPVKSRRKAPSKNFPVVRRNIEELKASHKTTARVTQASSWREKLDVTSFYFSRFPEEVREKDLWKIFQEWGKVWEVFIPQKRNKQGHRYGFVHFKGVEDGDRLERILGNNIYIQGIKMFVNKPKYQRGGNRVHKSMAGLYHTTDSTPKEFDTPELKSNQVPMGTKLRSYVEVVKNRNKEGEDRQGPTSANGSTTVNTGPVKIQTTKEKTKWLDKAWVGHLKNKGIVDRVEEELQGMLGVEVKTAYWGDDMVILYDLEEETVNGLNLKEQKHGGSPFFSVQRWKPEMLPSYRLTWLCIWGVPLTVWDAENLASIVSICRELIELDTATEDRTHLDMARVLVRTNEKPPIDRSVLVMVDEIQYSLYVREEFEAGWGRGQRVEDEVRFSPSPFSTAIVDSDTEPHIHGPNRFSPGSFSVSSVGGSSTRTRLCMVERRRRRRNSGFSPSRHQCETPPGADVSPSGRHVPLAASGRSTPACVGQQDSNGPLIPDFRGEGRIDSRMLCHSQQQLPFLEVNVDGKSQENLLEVNTPWVQRNEPSVTSPKAFLGVKHGSNPTCPFEKLSPSLREGAVDHNLGLINISPSSKGNQTPSTFKVYVRRKGSATVNHVAHENCYTGSYKAAPASWTKDLGSNLFKNGEEVILQSSEFVGRTSKQDSSSQTLASNNSFINSDSESEEDFHREIARELGVACDDRNTCKEKRKHGVINSSISLKSAAVVMGMEQPEP

SEQ ID NO: 163469 - protein, 242 aa, Glycine max
  Coding DNA Sequence Number=SeqID_71784
  Homolog annotation: Hit_ID=A7QYD3; Match level="QueryCoverage=70%, HitCoverage=46%, E-value=2e-63, Identity=60%"; Hit description =Chromosome undetermined scaffold_245, whole genome shotgun sequence
MKRLRPRVEIAGSTCCRQTAGASPVGTAPVPVLTGVAPGFAEAMKKDQKAGLKSLTRAVFILLRFSYNCQLTKHFMEGHAKISPISRLPLITVLDNKHHLKDFPVCEIPGNVEYRAKYLIHSKKQCLFLVVYEFSGATNEVVLYWENSDAQVANSKSSTVKGRDAAFIGPNENQFAILDDDKTGLGVYTLPGGASQEAKDNDKVFEENPTATAETSVGSIRGPMPFMFETEVDRIFSTPLGD

SEQ ID NO: 163470 - protein, 417 aa, Glycine max
  Coding DNA Sequence Number=SeqID_71785
  Homolog annotation: Hit_ID=A2Z149; Match level="QueryCoverage=95%, HitCoverage=25%, E-value=1e-148, Identity=67%"; Hit description =Putative uncharacterized protein
  Pfam annotation: Domain name=WD40; Domain location=145-183; Score =1.7; E_value=20; Accession=PF00400.23; Description=WD domain, G-beta repeat
  Pfam annotation: Domain name=WD40; Domain location=191-229; Score =1.8; E_value=19; Accession=PF00400.23; Description=WD domain, G-beta repeat
  Pfam annotation: Domain name=WD40; Domain location=235-273; Score =21.1; E_value=0.0041; Accession=PF00400.23; Description=WD domain, G- beta repeat
  Pfam module annotation: Pfam domain module=WD40::WD40::WD40; Domain location=145-183::191-229::235-273
MEWTTLQHLDLRHVGRGVRPLQPHAASFHPHQALVAVAIGTYIVEFDALTGSKISALDIGAPAVRMSYSPTSGHTVIAILQDCTIRSCDFDLEQTCVLHSPEKKTEQISSDTEVHMALTPLQPVVFFGFHKRMSVTVVGTVEGGRAPTKIKTDLKKPIVNLACHPRLPVLYVAYAEGLIRAYNIHTYAVHYTLQLDNTIKLLGAGAFAFHPTLEWIFVGDRQGTLLVWDVSTERPIMVGIKQVGSQPITSVAWLPMLRLLVTLSKDGNLHVWETRVTVNPNGPPTQANFFEPAAIESIDIPRILSQQGGEAVYPLPRIKALEFHPKSNLAALVFAVTCYLTLFIPCLMRQLPTIQKIRPDTVEKGESSFLQFYKVHEDLQRCYAASVLKEKLSALGSSGVLADHQLQAQLQEHHLKG

SEQ ID NO: 163471 - protein, 205 aa, Glycine max
  Coding DNA Sequence Number=SeqID_71786
  Homolog annotation: Hit_ID=A5BEV8; Match level="QueryCoverage=99%, HitCoverage=32%, E-value=4e-11, Identity=25%"; Hit description =Putative uncharacterized protein
MITLQHTEIKASFETDAHMVGHVFKVTLYKKLLGMVSRYALNQITAEFEQKLSFSYQGLSEPEVTIIEEMEAISKRFEELGVCGKVTLKSKLWKIVYLDLNSMCAPSEKEHAYVENIVNVKTDDNWGYRAIAALLGMSEDSRSLVRNHLLKELAKWFDKYMNLLGDIDRFEKLKQSLLVDGLFMVTMDKWMNITDMSYVIASRYF

SEQ ID NO: 163472 - protein, 55 aa, Glycine max
  Coding DNA Sequence Number=SeqID_71787
MQEQIEEAKEHHLDEDALIPHDVAPCGAWKPWIFFINEVLCFLKINCSGMEKEER

SEQ ID NO: 163473 - protein, 84 aa, Glycine max
  Coding DNA Sequence Number=SeqID_71788
MASYGGERLQSYFFLLHSAVIDLQEAKDSIDEEDPRPKALHGATSSGEEDILVSYLSAIPYVEVVEESLETSFHAVATYTSAGG

SEQ ID NO: 163474 - protein, 118 aa, Glycine max
  Coding DNA Sequence Number=SeqID_71789
  Homolog annotation: Hit_ID=Q2A9Z4; Match level="QueryCoverage=42%, HitCoverage=8%, E-value=2e-07, Identity=62%"; Hit description=Zinc knuckle family protein
HWPKIYPKTHENSRVFSYISGPIFLESPSHGSSDGSPPWEHCIIPSLLKRIGPQIYRPVIIGINYTMWHGMKCAILLNLSTTTKIKSTPLWVLGSPRTKSILISTQGVDGMGNGVYSP

SEQ ID NO: 163475 - protein, 130 aa, Glycine max
  Coding DNA Sequence Number=SeqID_71790
PEIIGKFFGMKHDPSSLLQSPVFPFNYAILLWCNGCRELMNDAFRCAVFSKLAVFKLSAMVTPDSLDDTVFFSLKPRILDSTPWELVGLGSSSSMDSFASWKINGSGMGKEEREETPLQGEDESRRSSPP

SEQ ID NO: 163476 - protein, 85 aa, Glycine max
  Coding DNA Sequence Number=SeqID_71791
MTSTSGDATPPSPKTIRLMAEMIKLGFDDAKKNLLDNCCHHKKKGENMNYKQTRLLQETFKVKQVEIASRLIQGQANKIKKKIRP

SEQ ID NO: 163477 - protein, 119 aa, Glycine max
  Coding DNA Sequence Number=SeqID_71792
MIREGVSSHVGTIILKRKPPRINQALCFMLKGHTLFNGVPRDTTMIGTCNVGMLPSGKWRLIDFSLAYYCHLVIEDTDIWGYKGLVESLAMWELMQSSQGGDPSPEPWLGDSKKIGLEM

SEQ ID NO: 163478 - protein, 137 aa, Glycine max
  Coding DNA Sequence Number=SeqID_71793
ETSLSTAIPLELEVIPQVKELLDEGLVPKIGIVRHQIPMISGMMNVLRGSTLFCKITHASIIFMIHIHRDSLGSDQGVPTDPKRIKVIPEWPTPPNIKEIWGFHDLTNFYKRCRGKKPKVSRTSEFEVKSFSKGGGR

SEQ ID NO: 163479 - protein, 207 aa, Glycine max
  Coding DNA Sequence Number=SeqID_71794
  Homolog annotation: Hit_ID=A5BDN3; Match level="QueryCoverage=42%, HitCoverage=8%, E-value=1e-09, Identity=41%"; Hit description =Putative uncharacterized protein
MLALLGKYARLMCISFMLKVYYDWLTEHELKVKEYVSKYKCMGLGRKWFSTLNSCNASSSEKPCLPHQDLEGCLSVAIKGIQDSHLKTKIKLWESCFWFFRCFTVIKNTQEIMSNTIRIEKFNGKNSFNLWRIKMRALLKEQRVWAPIAPASVKKPVASDSKEMASASKTEELTEQEEKAHSLILLSLSDEVLYEVANEEIQVAYGS

SEQ ID NO: 163480 - protein, 123 aa, Glycine max
  Coding DNA Sequence Number=SeqID_71795
MPPTRHPLDSDKSNRALGFPALITGLCQSFEDPVTPSKAANHRGQVQIHECLYQLSLSQQGQSFVPFVCPTPDQFRAEVAWPGDWPEAQAGEAPVGSPGDAEEARMDEEMMDLLGFLGGSGAT

SEQ ID NO: 163481 - protein, 153 aa, Glycine max
  Coding DNA Sequence Number=SeqID_71796
  Homolog annotation: Hit_ID=A5B939; Match level="QueryCoverage=25%, HitCoverage=24%, E-value=4e-07, Identity=69%"; Hit description =Putative uncharacterized protein
RGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNWYGQGNPTV

SEQ ID NO: 163482 - protein, 46 aa, Glycine max
  Coding DNA Sequence Number=SeqID_71797
  Subcellular localization annotation: CTP_CleavageSite=28; ConfidenceScore=5.09e-01
MTLSSWQNKLNRPMVTPPSSPPPPPPTEAASQSPSTLKHIRKATRL

SEQ ID NO: 163483 - protein, 304 aa, Glycine max
  Coding DNA Sequence Number=SeqID_71798
REIEWRNWHKELTNFSEGSIDVAIVKEFYANLYDPEDKSPKQVRVQGHLIKFDVDALNTFLKTPVVIEEGESLSAYSWLANLRPVPQELATRLCIPGKGFELNADELPLKILRKNLTTLAQTWSVLSFSNLALTSHTSDITLDRSKLIYGLIMKMDMNLGSLISGQISLIAQHDTSRLGFPALITALCKARGGTQKSRARRSEAPPSFAPAPTHASTSAPSASAPSTSTAPVPPSLHQGQLLIMQGLQDVVHQQSVMSIEEFLQKVAWPGVQPSPLGGGEASAAQQPQPAQDDAFVDTSEPSSP

SEQ ID NO: 163484 - protein, 136 aa, Glycine max
  Coding DNA Sequence Number=SeqID_71799
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
FQLIGIRFHGHVEKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 163485 - protein, 281 aa, Glycine max
  Coding DNA Sequence Number=SeqID_71800
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLATLNPVHRPSNEIAPTLCAWVMVECRVLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163486 - protein, 169 aa, Glycine max
  Coding DNA Sequence Number=SeqID_71801
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=71%, E-value=4e-24, Identity=68%"; Hit description=LacZ protein
MKHFTDTLISANIGTKAGTGPPLEVDGIDKLDAVFKTYIHKDTGSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163487 - protein, 137 aa, Glycine max
  Coding DNA Sequence Number=SeqID_71802
MIPKVVISHLMVSRGIIPFDKHIAAVGTTNNNMLSKKKTLDEGSLLSSKSETQHDHRFTSTPYVPMDPVLVESPTVATYPSAGGRREGSRVRLPRKENARSRHQRLFKENVRKTGKAWSTNFKCERFESCIYARGRC

SEQ ID NO: 163488 - protein, 141 aa, Glycine max
  Coding DNA Sequence Number=SeqID_71803
MVTLKENERPSWKIPLQSTGSSCCGVSTENNNGLWWLMVDVGDGESSWDFRNGFGRKKEEEMTFFLSYTKAKAELQAHSRQHLKDPNDQIMDKSVVKLQTKFREDVTVKEGWATFIPRQLHVASSRSFPVASLRSFPKRLL

SEQ ID NO: 163489 - protein, 228 aa, Glycine max
  Coding DNA Sequence Number=SeqID_71804
  Gene Ontology: Mol. function=nucleoside-triphosphatase activity; Cellular component=cytoplasm; Biological process=protein metabolic process
  Homolog annotation: Hit_ID=A1FR34; Match level="QueryCoverage=20%, HitCoverage=6%, E-value=9e-19, Identity=100%"; Hit description=ATP -dependent Clp protease, ATP-binding subunit clpA
  Pfam annotation: Domain name=AAA_2; Domain location=82-193; Score =1.7; E_value=7.9e-06; Accession=PF07724.5; Description=ATPase family associated with various c
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDQGGLLTEKIVKTPHCVLLLDEIEKAHPDIFNILLQVMDRGVLTDQAYRYRRPRGGARYQLLFPLVRVNFELGVIMVIAVSCVKLLSAHNSTQHTSRKHKV

SEQ ID NO: 163490 - protein, 43 aa, Glycine max
  Coding DNA Sequence Number=SeqID_71805
MVAEYAARFENLVRYFPHYQGEAGERSKCMKFVSGLQPEVKMM

SEQ ID NO: 163491 - protein, 84 aa, Glycine max
  Coding DNA Sequence Number=SeqID_71806
MDWWLKEKSFQNMVVHNWSNYHPSGWGGFVLKQKLKFIKNHIRQWSLQNGATKIQNLKKDLNALEAGVNGSNISQAEMELKKSL

SEQ ID NO: 163492 - protein, 113 aa, Glycine max
  Coding DNA Sequence Number=SeqID_71807
  Homolog annotation: Hit_ID=Q2HW90; Match level="QueryCoverage=66%, HitCoverage=14%, E-value=2e-10, Identity=46%"; Hit description =Putative uncharacterized protein
MAKALADQGEWASFIDVFALLIFGVILFPNIEGLVDLAAIDAFLAYHHSKESPVFAILVDVYDMFDRRCEKSGTRIICCTPALYVWLVSHLFCQESRPTYPLQGHRLCTEKGK

SEQ ID NO: 163493 - protein, 89 aa, Glycine max
  Coding DNA Sequence Number=SeqID_71808
MVQMTTLVSMCYRTLSLTDSERVFIRITTWKSFERITAWLYPHVIGLAVSGLQKVRKTTLVSARQRARFPLVDERVSPRANGLTSHNSK

SEQ ID NO: 163494 - protein, 215 aa, Glycine max
  Coding DNA Sequence Number=SeqID_71809
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=100%, E-value=6e-19, Identity=29%"; Hit description= UPI00006A17C9 related cluster
  Subcellular localization annotation: CTP_CleavageSite=9; ConfidenceScore=5.18e-01
MARACSPLMAMTCRPLKVRTCIPLKLRTCSPLKVRACSPLKVRTCNHLEVRVWSPLIDRTCSPLMARMCSPIKVRGCSPLMATTCRPLKVRTCIPLKARTCSHLKVRACSPLKVRTCNPLEVKACSHLMARTCSLLMAGMCSPIKVRACPFMARTSSPLMARACSPVMVRTCSPVMPRTCSPPKHSKGEVVQIFDGEDVQSSDGEGMQPSEGQDM

SEQ ID NO: 163495 - protein, 145 aa, Glycine max
  Coding DNA Sequence Number=SeqID_71810
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=72%, E-value=2e-24, Identity=70%"; Hit description=LacZ protein
MGIYGAVNILISVNCFSFGNISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163496 - protein, 69 aa, Glycine max
  Coding DNA Sequence Number=SeqID_71811
  Gene Ontology: Biological process=transposition, DNA-mediated
  Homolog annotation: Hit_ID=Q1J7G7; Match level="QueryCoverage=42%, HitCoverage=41%, E-value=8e-10, Identity=100%"; Hit description =Transposase
  Subcellular localization annotation: CTP_CleavageSite=44; ConfidenceScore=5.08e-01
MVKVGTFYVPINVSFSPKVAQGFPWLLFLSAVPPVQLLTGWCVTAKAPPDISAGKCSGHAARNHHTRRA

SEQ ID NO: 163497 - protein, 270 aa, Glycine max
  Coding DNA Sequence Number=SeqID_71812
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIGGQGPIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163498 - protein, 268 aa, Glycine max
  Coding DNA Sequence Number=SeqID_71813
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILYVRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163499 - protein, 64 aa, Glycine max
  Coding DNA Sequence Number=SeqID_71814
MVTSKENERVLHYALANLEGLFLVPNVITPPKFKVPDFDKYKGTTCPKNHLKDILSEDGGIRKR

SEQ ID NO: 163500 - protein, 98 aa, Glycine max
  Coding DNA Sequence Number=SeqID_71815
MGVVRTCQLFASHIRGWMTYLIEARWVSQVHLSNAAVLTSIISFMLIMASIIVAIFSFMAFMSALICSYTSSTSPITLALAQGKNAMNNATNEKHGCM

SEQ ID NO: 163501 - protein, 115 aa, Glycine max
  Coding DNA Sequence Number=SeqID_71816
MALGFPALITGLYQSFGVRVNPSKAIRPSIILAFIKKYCTPRQEQGDTPQAADAPPLPHQADPVGSLGMERYLQHLVQIHECLYQLNLSQQGQGFAPFACPTPDQFRAEVAWPGD

SEQ ID NO: 163502 - protein, 85 aa, Glycine max
  Coding DNA Sequence Number=SeqID_71817
MFSKKEEMMRILKLAKYRLKAQVEKDKAPEWRRMKAQVEKDEGPETYQGNSSSVYPDLSSFTGSGVVQKLYSLYQAIRPVRFTSL

SEQ ID NO: 163503 - protein, 85 aa, Glycine max
  Coding DNA Sequence Number=SeqID_71818
  Subcellular localization annotation: CTP_CleavageSite=26; ConfidenceScore=5.04e-01
MVHDILVKVKLEVTGTSTVLNVFGSQQSSDVTRLIFCPNFCKTVTSILQLDLTNLFLKAWSWFNPIIQGKEILTGNTSTTFHRDE

SEQ ID NO: 163504 - protein, 139 aa, Glycine max
  Coding DNA Sequence Number=SeqID_71819
MRDGKRSSYAIGIRVNSGVGLGGKFLIALEPAPKWALPAERVRVRVGAWGASLWMGIGALGCTGAEHAVEGSGSTSGPSHGRKGNDYDDGRHLAEGSSIMSPPQVPTLGGSEQPGQKGKKEICTGAELEESPARAEKLE

SEQ ID NO: 163505 - protein, 54 aa, Glycine max
  Coding DNA Sequence Number=SeqID_71820
MVVQRIVLEGYSSKMVLANNRLRRRFLAKNRLRKFHGKLPFQKQGTSTCQVALS

SEQ ID NO: 163506 - protein, 113 aa, Glycine max
  Coding DNA Sequence Number=SeqID_71821
MVIVAVVGSLSEVHQMNKDQWMYDSIMSEEVDKDDQNEQECGVNEQHVDCSDAFNTSQIIMFIIVFGTRDDVLQWARSVAHENGFVAVIMRSDTNTDSREKISFVLSGCERSG

SEQ ID NO: 163507 - protein, 354 aa, Glycine max
  Coding DNA Sequence Number=SeqID_71822
  Gene Ontology: Mol. function=nucleotide binding; Cellular component =myosin complex; Biological process=keratinization
  Homolog annotation: Hit_ID=A5AF73; Match level="QueryCoverage=85%, HitCoverage=28%, E-value=2e-74, Identity=47%"; Hit description =Putative uncharacterized protein
  Pfam annotation: Domain name=Myosin_head; Domain location=65-354; Score=-113.0; E_value=5.1e-11; Accession=PF00063.12; Description =Myosin head (motor domain)
MEPYNNVFSTLSLLEHTDLAVLLDNEAIYDNNGGEEASVSLSNGNVIKVAISELLPANPDILEGVEDLIQLSYLNEPSVLHNLQSIYSHDMIYSKSGPTLIALNPFKDVQIYGDDYISAYRQKLMDRPHVYAMADAAYNEMMRDEANQSIIISGESGSGKTETAKIVMQYLAALGGGCSGIENEVLLTNFILEAFGNAKTSKNDNSSRFVTVTNAALVMGCSSHELMEALSTHKIQAGKDTITKTLTLWQAIDARHALAKFIYASLFDWLIEQVNKSLEVGKRRTGRSISILDIYGFESFQNNNFEQFCINYANERLQQNFNWHLFKLEQEVSYPNFVRGPLLDDMRPLFGPCK

SEQ ID NO: 163508 - protein, 295 aa, Glycine max
  Coding DNA Sequence Number=SeqID_71823
  Homolog annotation: Hit_ID=A5B714; Match level="QueryCoverage=31%, HitCoverage=12%, E-value=8e-09, Identity=37%"; Hit description =Putative uncharacterized protein
MLRINYEWTRDVQLRKVVTLTRRYEIFSMKEGESMDDTFGRLQVLLNGLEALGHIFLKAQINLKILDDFLKMWNSTHGAWAVMLISRKNCSLTISYSFWPSGKIVCQVMASIVLWWRSKWVKSQSTRVVYAVMLLSRKSCALTISYSFWPSGLEKLASSSKSQSNPDKCDFYGKSGHSKFRSIHKKKYMSKGTNSTRPKMIWVPKSHIVPISNILGRKRLGFKLAMYATRILFKDFSYLMKSAFEISIIGELKFFLGLQVKQDSKGAKPMKTPMHASKHLNKAELGELVDQTIYK

SEQ ID NO: 163509 - protein, 212 aa, Glycine max
  Coding DNA Sequence Number=SeqID_71824
  Homolog annotation: Hit_ID=Q2HTA0; Match level="QueryCoverage=97%, HitCoverage=31%, E-value=2e-19, Identity=30%"; Hit description=IMP dehydrogenase/GMP reductase, related
  Pfam annotation: Domain name=DUF1723; Domain location=111-160; Score =51.5; E_value=3e-12; Accession=PF08330.1; Description=Protein of unknown function (DUF1723)
MRKKPLSVEGQQHRHNVDDVADEFHQESHNPITDHVGADTEGFSGRPQDTSVLTNYAYRVATRVSAGEKHTKLKLTSHGRKVEKFGRHAPEIEGIVATTGISSLITCSLDTSGKTLLSAFVERWHKETSSFHLLIGELTITLDDVASLLHLPITGTFHTFDAIDVEEVVDLLVELLEVSTQEAKDETEQCRRAYVCLAWLRDIYRSKCDTRQ

SEQ ID NO: 163510 - protein, 180 aa, Glycine max
  Coding DNA Sequence Number=SeqID_71825
  Gene Ontology: Mol. function=peptidyl-prolyl cis-trans isomerase activity; Cellular component=nucleus; Biological process=protein folding
  Homolog annotation: Hit_ID=A5BCZ5; Match level="QueryCoverage=37%, HitCoverage=12%, E-value=9e-29, Identity=91%"; Hit description =Peptidyl-prolyl cis-trans isomerase
  Subcellular localization annotation: CTP_CleavageSite=46; ConfidenceScore=5.17e-01
MIAPWSVRFFFISFPFFLGSLQQGQNLVLLKQGLACSTWKRQKNPRLETAISSINSYIDLFLQDAIKKGIGDIKLLNWPVIGDSQGEKKLQNYRLDSTKKMSGVKTEICFLLFVDDEVRLEDDWVPMDEQLNPAELEEVIRSKEAHSRAVVLESIGDIPDAEIKPPDNVLFVCKLNPVTE

SEQ ID NO: 163511 - protein, 271 aa, Glycine max
  Coding DNA Sequence Number=SeqID_71826
MVVPFIVDGSLHDVERDIVDEEVVPLTMNFQEEEEESEGENNIGEYKWVDKGVVALVTNGARLRELSRRKEKVITTNAKEGNKKRKHDDFVDCEVNSKSELHLVQTQFSFLVMNGDNFSGVGDLAKMEKKKMVATQVKKLNGEVSRLKEEVKKYKEEVGCFSNKLSVYKKHVARVEELEQYLVEIQVKLESNIKAFEKYLVKQLHLKGKEKSLLEEVERWRSECNPKDVTAIDDHAKGFNKALAHVVALCPDIDLSDITVKLNFYAKDFYT

SEQ ID NO: 163512 - protein, 75 aa, Glycine max
  Coding DNA Sequence Number=SeqID_71827
MVGVFSQNGVTLNGLPMISPGQSDLTYQYVVKRFFTDMMVRWMAMENLILEDIGTPCSDKMWHRGLGFCIVFIIC

SEQ ID NO: 163513 - protein, 59 aa, Glycine max
  Coding DNA Sequence Number=SeqID_71828
MGMRWGNDGPRQNRMEGQNRIEGVKLNVLPFKGRSDPDAYLDWEMKIEHVFSYNDYIEE

SEQ ID NO: 163514 - protein, 139 aa, Glycine max
  Coding DNA Sequence Number=SeqID_71829
MDSKIYPKVHENPKAFFISSSPILLEPLAHGSGNWSFPREDCIISPRLASGSLGPSNNFMVKKLARLGELQPPQSGLLPINRHPRGVLRGSKFQKWKVSREERNKRKKEEETKPRRYRIATVVIPYIVFLSRVLCATIS

SEQ ID NO: 163515 - protein, 75 aa, Glycine max
  Coding DNA Sequence Number=SeqID_71830
MEAMKKQMTTKMEAIISMRKMMEVNATAVAATSTTTEVDPTHPSGLNQVNRPVSDMVGQAGKTLGSTGGPHFVQV

SEQ ID NO: 163516 - protein, 50 aa, Glycine max
  Coding DNA Sequence Number=SeqID_71831
MGGALRKLHPEHSRRGRGASVTLSRRFREQIREDFPPFFTVLCPFFGLQP

SEQ ID NO: 163517 - protein, 129 aa, Glycine max
  Coding DNA Sequence Number=SeqID_71832
  Homolog annotation: Hit_ID=A2Q1Z1; Match level="QueryCoverage=85%, HitCoverage=31%, E-value=7e-14, Identity=36%"; Hit description =Homeodomain-like
MMMIPFPIQKFNECYKQARKHRRSGSFEKNVLADAHMIYRQDSGKKFEVEQAWLLLKDQPKFDAKFMSKYSKRTKVSISGNYSSSSNPETPIEVKEYDTSSPILTQLDKKQQKGRAKEMNLRTLSIYLT

SEQ ID NO: 163518 - protein, 308 aa, Glycine max
  Coding DNA Sequence Number=SeqID_71833
  Homolog annotation: Hit_ID=A5B7R4; Match level="QueryCoverage=69%, HitCoverage=98%, E-value=4e-16, Identity=24%"; Hit description =Putative uncharacterized protein
MDEVADRHHIMGCLSLTASNMGCLVKCLKLVANVLERATCEEADLKGRLKHCRVQPPGCKLSRLQVTPLSQERGNPTLQKVAWFSSLSQLAFKGGFPKVPQSVVDKLVKIQRRFLWGGGSDQKKIAWIRWETYQGELWARVMESKYGGWRGLEEGGRAANESVGAGDRIKFWEDRWISQEISLAEKYPRLYLISSQQHQPIRQMGSHKDNGWEPIQQQGDDEWEWIGHPSATGSKEDCFAEIWKLRIPRKTAVFAWRLFKDRLPTKKNLHRRQVQIMDLLCPFCGGWHKGQEMAMLVGGCGMVHLADA

SEQ ID NO: 163519 - protein, 553 aa, Glycine max
  Coding DNA Sequence Number=SeqID_71834
  Gene Ontology: Mol. function=guanyl-nucleotide exchange factor activity; Cellular component=membrane; Biological process=biological_ process
  Homolog annotation: Hit_ID=A7PDN1; Match level="QueryCoverage=77%, HitCoverage=22%, E-value=0.0, Identity=89%"; Hit description =Chromosome chr11 scaffold_13, whole genome shotgun sequence
  Pfam annotation: Domain name=Ded_cyto; Domain location=342-546; Score= 373.7; E_value=3e-109; Accession=PF06920.4; Description=Dedicator of cytokinesis
MEVGGVWMNQEGILESLSGGGLVQNWDKGEVLGRWGFVAGEIFANGEIDIAAKFMEGVAVQVQQDSWSWEADPSGSYTVGSTFKLLSRHVTDENKDGVFIDLWKLKVPSKASHFACRLIWDKLPTKALVARNDGVWSKDHVSALRKICPMVSNEITSEASAAEVEGYGASKLTVDSAVKYLQLANKLFSQAELFHFCASILELVIPVYKSRRAYGQLAKCHTLLTNIYESILEQESSPIPFTNATYYRVGFYGVRFGKLDKKEYVYREPRDVRLGDIMEKLSHTYESRMDGNHTLHIIPDSRQVKAEELQPGVCYLQITAVDPVMEDEDLGSRRERIFSLSTGSVRARVFDRFLFDTPFTKNGKTQGGLEDQWKRRTVLRTEGSFPALVNRLLVIKSESLEFSPVENAIGMIETRTAALRNELEEPRSSEGDQLPRLQSLQRILQGSVAVQVCPSDWKTGESVQCPFNKVNSGVLSVCTAFLSGEPATRLRSQELQQLIAALLEFMAVCKRAIRVHFRLIGEEDQDFHTQLVNGFQSLTAELSHYIPAILSEL

SEQ ID NO: 163520 - protein, 223 aa, Glycine max
  Coding DNA Sequence Number=SeqID_71835
  Homolog annotation: Hit_ID=A7PDN1; Match level="QueryCoverage=87%, HitCoverage=10%, E-value=2e-52, Identity=56%"; Hit description =Chromosome chr11 scaffold_13, whole genome shotgun sequence
MDQPITLEQVSIGDCDQWHLQNCRNVHLTEREKQKLQVWSKIMPYKESFTWTIVSLFDSSIGAASVGPASPSSPLAPSISGSSSHEGVFDTSAKISLDGKLSYSNGNSVVVEVSNLNKVKESYTEESLQDPKRKMHKPIKGVLRLEIEKHQISLADLENVSESGSITNDSVDPGDRIVDSLSGKYPSNGCDDPQGSNLRVVSPVLGNGANQHGNSDFNADDQK

SEQ ID NO: 163521 - protein, 46 aa, Glycine max
  Coding DNA Sequence Number=SeqID_71836
MMKAMTFENRFNLLTPKKVVEVVATGVAPSQVEEGEEGEKDEDCWK

SEQ ID NO: 163522 - protein, 61 aa, Glycine max
  Coding DNA Sequence Number=SeqID_71837
MAAWQEALSTHQQVEDRQEHDTLNKIVTQSNSAEIITVDSWGGNFNRVLLVRIESIEVLMR

SEQ ID NO: 163523 - protein, 111 aa, Glycine max
  Coding DNA Sequence Number=SeqID_71838
  Subcellular localization annotation: CTP_CleavageSite=19; ConfidenceScore=5.51e-01
MLRGTPRAFLPWKMPPSPRLASGSSGPSNNFMVKKLACMGELQPPQSGLLPINRYPRGVLRGSKVQKWREWREERNKRKKGEEKKSRCYRIVTVVIPYIFFLSCVLRAIVS

SEQ ID NO: 163524 - protein, 102 aa, Glycine max
  Coding DNA Sequence Number=SeqID_71839
MSGLIRDSPQIPASPHQLDFAPNASGSYNAQWNAPGLLHDKHTLRSSRILRKMEWCLALVVWKVGFVVDLGMVFVDNWVVGKEKGCYWLSNDIVGLVGNLAI

SEQ ID NO: 163525 - protein, 98 aa, Glycine max
  Coding DNA Sequence Number=SeqID_71840
  Gene Ontology: Mol. function=caffeate O-methyltransferase activity; Biological process=lignin biosynthetic process
  Homolog annotation: Hit_ID=P28002; Match level="QueryCoverage=73%, HitCoverage=19%, E-value=7e-15, Identity=54%"; Hit description =Caffeic acid 3-O-methyltransferase
  Pfam annotation: Domain name=Methyltransf_2; Domain location=1-97; Score=-104.2; E_value=0.017; Accession=PF00891.9; Description=O -methyltransferase
MTQINKLFNKGLSDISSITMKKILETYNGFEGVGSVVDVGGGTGAIINMVASKYPTTKCVNFDLPHVIKEAPAYTVRRPIKGAGSNDLEPIVLKIGKG

SEQ ID NO: 163526 - protein, 199 aa, Glycine max
  Coding DNA Sequence Number=SeqID_71841
MRPLSFRNNKVGGKCAKTDFVPFIIQEQQPELVNAQRHILHPLSFRNNKLGGKCAETNYAHSLHLFAIQRRSCPMARRDKLWSFCVSPPRLNRVQQNAETNYGHSASCINQEEHTSRRFMSCSYVVAPRKHAHHEYSNCIHHVYMLESVSNIYRGLFGELHNEVYWSPYHEPRISPDPEKKRNSKGHPISSCILTKMDI

SEQ ID NO: 163527 - protein, 156 aa, Glycine max
  Coding DNA Sequence Number=SeqID_71842
  Gene Ontology: Mol. function=transporter activity; Cellular component= 1-2nm peptidoglycan-based cell wall; Biological process=transport
  Homolog annotation: Hit_ID=Q13P48; Match level="QueryCoverage=98%, HitCoverage=61%, E-value=2e-53, Identity=67%"; Hit description=ABC amino acid transporter, inner membrane subunit
  Pfam annotation: Domain name=BPD_transp_1; Domain location=1-138; Score=-17.6; E_value=0.054; Accession=PF00528.13; Description =Binding-protein-dependent transport s
FVWPFLREPFICAVLALSLCTAAYTAEILRGALLAVPAGQVEAGLACGMSRWLLLRRIIAPIMLRYALPAYSTEAILLVKSTALASLVTVWDVTGVAQQIIQRTYRTMEVFVCAAAIYLILNFIIVQLYALLERRLTPVHRAEKKPLPAVKPLAGE

SEQ ID NO: 163528 - protein, 366 aa, Glycine max
  Coding DNA Sequence Number=SeqID_71843
VVLIVTRFGSQQRDVKAIQLVVQVRRQFGEAFTGSRFDVGAADQFVDQRRRIVGADLADHTLGVAAGGDLAIRDPARLHDLQHLREVMQLFLDQQHHAIRQILAVGRAVFRQDLAGELALAEQRVRRALRFVQKRLVGPQQRQQRVAALFVRHVAADQPHAGLRGLQLAHQVASGVSQCRKLKIGANRDWYVIGLIALLQPTTLQLERRRGYQGPARTGPQVLIGEGLVAFAVVVFVDVVAVFVILTVFTVRIFEVGAPAIVVDAAAFRQRHQLLDLSVDQFGVQADFADHVAAHHHRTVFHFQLFGVGHFVAQLEGFNGGLLQNLKFLGGQMVLDGVERVRIAAVFQQFFDDQAGLFTLFFQQFA

SEQ ID NO: 163529 - protein, 163 aa, Glycine max
  Coding DNA Sequence Number=SeqID_71844
  Gene Ontology: Mol. function=nucleoside-triphosphatase activity; Biological process=defense response
  Homolog annotation: Hit_ID=Q19PL1; Match level="QueryCoverage=77%, HitCoverage=8%, E-value=2e-13, Identity=33%"; Hit description=NBS -NBS-LRR type disease resistance protein
MGKHEKTLCSLINEKPLLEKLLIETADVSEVIDLYITSPMSTLRKLVLFGKLTRLPNWISQFPNLVQLHLYNSRLTNDVLKSLNKMPRLLFLDLSSNAYEVPSGIQHLEKLKDLYIEDMPTEFEQRIAPDGGEDHWIIQDVPHVRIWSEDAEEPLHIFGRSHH

SEQ ID NO: 163530 - protein, 81 aa, Glycine max
  Coding DNA Sequence Number=SeqID_71845
MDWILSAGCSWFDGVLEDDGDDGTEGETGDEVSFGEVAMEKQSFGRGVEEKSPAFQEPRDLRSNPFQGGGNDAILPRKGIG

SEQ ID NO: 163531 - protein, 77 aa, Glycine max
  Coding DNA Sequence Number=SeqID_71846
MPFGLTNAPSTSMRLMNHVLREFMGRPWIFFINGFICFLRSDCSGMEKEKYEWRRHFNPLIQDQVQDSPLSVLRCHE

SEQ ID NO: 163532 - protein, 127 aa, Glycine max
  Coding DNA Sequence Number=SeqID_71847
RTTRLTFRGLHVLTFRGLHVLAIRGLHALTFRGLHVLAIRGLHALALRRLHALAFRGLHVLAVRGLYVLTFRGLHVLTFRGLHALAFRGLHVLHIRGLHVLAFGGLHTPSPLKGYASSLPEGSTSAP

SEQ ID NO: 163533 - protein, 178 aa, Glycine max
  Coding DNA Sequence Number=SeqID_71848
MTWLIGTLVNPLSESSPYDQYEERGTPNLESVFEEFMAYNASSKENQNVMNSQEIDVAKSYSIEKSQRTPVLELYTQGEAEREILVGKLAEEVTQCVARIEEDLVEIEAQEEIPSKEHGLRGKDEMKGEEKAQQWEEYLQQDIQQEIKIFAIVYPLSANLALSAQSSHAKPSLLALST

SEQ ID NO: 163534 - protein, 72 aa, Glycine max
  Coding DNA Sequence Number=SeqID_71849
MGSNQAPSFKKRFYNVKIKSLEVANLQELGQWMDQLQHQAFHKTYGKIWDLAMIEVSVEAIASLVQYYDQSL

SEQ ID NO: 163535 - protein, 60 aa, Glycine max
  Coding DNA Sequence Number=SeqID_71850
MPKDRGTCLDFRDCHHQKGGDCRQRIKLNVLMMPKVHMRLKALFKTKKLKIFKMDDQDSL

SEQ ID NO: 163536 - protein, 111 aa, Glycine max
  Coding DNA Sequence Number=SeqID_71851
VPQQVEDASSEATIPEPFIVKEETSETRVRQEATATLERSREVTSNPPTSVVDLSSPQHATDPSTPILEIPEDPTTPVLTLNTSSPATLVLHLTDEEDVKTQDTQDQSQEF

SEQ ID NO: 163537 - protein, 125 aa, Glycine max
  Coding DNA Sequence Number=SeqID_71852
FDKFKEELERRHWDEKLTDFFDSIIDIAIGKEFYANLYDPEDKPPKQVKVRGHLVKFDEDTLNTFLKTPVVLEEGENLCTYSRFALLRPDPQELAAKLCIPRRGFELNADGQPLKILRKNMTTLA

SEQ ID NO: 163538 - protein, 138 aa, Glycine max
  Coding DNA Sequence Number=SeqID_71853
HALRCPYRTCARARVMGKVEEAQEQMKADMEAMKEQMATMMEAMMSMKKIMEANAVTIAATSAIAKENPMPSSGLNQMNHPTSDMVGKDLGTPPAMAEKGKLDHIEERLKDIEGGEDYAFANLKELFLVPEHGYSQVQ

SEQ ID NO: 163539 - protein, 245 aa, Glycine max
  Coding DNA Sequence Number=SeqID_71854
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSTEKECDVWAHPKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163540 - protein, 105 aa, Glycine max
  Coding DNA Sequence Number=SeqID_71855
  Subcellular localization annotation: CTP_CleavageSite=25; ConfidenceScore=5.10e-01
GGPLGTSALTFRGLHVLTFRRLHVLAFRRLHTLSFSGLDALTFKGFLLSVLGPPPDIGGRPTVRAHPEREVIMQLLCIPGQDFTRTAAKRRVRIMHTNMTTLTQI

SEQ ID NO: 163541 - protein, 370 aa, Glycine max
  Coding DNA Sequence Number=SeqID_71856
  Gene Ontology: Mol. function=transporter activity; Cellular component= integral to membrane; Biological process=transport
  Homolog annotation: Hit_ID=A7MPW3; Match level="QueryCoverage=81%, HitCoverage=38%, E-value=4e-91, Identity=53%"; Hit description =Putative uncharacterized protein
  Pfam annotation: Domain name=Usher; Domain location=1-359; Score= -258.3; E_value=7.7e-08; Accession=PF00577.11; Description=Fimbrial Usher protein
MASALRYRYSTRGFYSLQEALESYGGNSAVYSDHKKSRAELTMSQSLWERGGTLSLSLFNEDYWDNNRRSQSVSLSYNNSWEAVSYGLNYTFNQNGYDSNGNRSSIRDHIVAFNVSVPLSKWLPGSYATYSMNASRNGATSNNLGLSGTALPGNNLNYSISQGYTGRDVGANGNIQADYKGSLAELNLGYGYDRHRRQVNYGVQGGVLVHQNGITLSQPLGDTVALVQAPGASGVNVLNQTGVSTDWRGYAVVPYLTPYRRNIVGLDGESFAEDVDMTLSSQTVIPTRGAVVRARFNPDVGARVLLTLLTRSGAPVPSAPPSALSTAPLTMQPSSGKAARFIWLAWGIAGGCGLSGARTRLSNVRPTINW

SEQ ID NO: 163542 - protein, 161 aa, Glycine max
  Coding DNA Sequence Number=SeqID_71857
MRGCINYNLVLAIRQLGYPMKGGYHKWLKYRVQWIAWLKKLEDLNGKEAEVSEESEEVRVLKAELEKTKVAKEKLKVVVTRVKKECDRMKDINMSTAKALEQEMKKAKKEELSRKRFQGALLRSSNELKLRKAESEKSMMKNVMLKDELRNCRESKESLKE

SEQ ID NO: 163543 - protein, 184 aa, Glycine max
  Coding DNA Sequence Number=SeqID_71858
MTVYHLRVHLMMSRSLIFLFLMPAGWFAPTKRIQPEGFLPAHLVRYHIHKALRSNALLPYPHLITLFLQHFNIPLDSEPFVKVKRSFSIGANVVSSFRYHKERDGSWVKKDAPVQAVEDRSPSPPPQRNDSSSLMHNILDRLDGLHTFVGERFDSLDSRIDAMDARFAGIDTCITKLKEDVSYV

SEQ ID NO: 163544 - protein, 205 aa, Glycine max
  Coding DNA Sequence Number=SeqID_71859
  Pfam annotation: Domain name=Transposase_23; Domain location=122-192; Score=-4.9; E_value=0.004; Accession=PF03017.5; Description=TNP1ENSPM transposase
MTRTKKTGEMMTEATKEITEKIHYGRVHAAGVGVTIKQYFGSAPRTSHSSSLLPPEELQQLTQQIRDQLEESITKKPNAISVSVLDVISGLALPPEHLVGPSGPRVSTKESCVDPLGNDPETGDSDRCNLYIEANPARPVALGRVYEGLTVVHNTLLLPGHVKVGVEEVKDPDAPVPIPSEEVSLVGQAIHTFLGWPTHLVKFLS

SEQ ID NO: 163545 - protein, 141 aa, Glycine max
  Coding DNA Sequence Number=SeqID_71860
METHRFISKFDSAKARSNRKHIRQQKLHPILKIIITNQRRHHIVSMQLSIRLQTMLKIISSFFCFEVNVSGSSDNESSGSTQEYQTLSSVGYANCESSHHDSTMDTGEYFDLGDQLMQCRHCNAKMWYNESILKRSNTSSP

SEQ ID NO: 163546 - protein, 477 aa, Glycine max
  Coding DNA Sequence Number=SeqID_71861
  Gene Ontology: Mol. function=strictosidine synthase activity; Cellular component=endoplasmic reticulum; Biological process =biosynthetic process
  Homolog annotation: Hit_ID=A7QJJ6; Match level="QueryCoverage=68%, HitCoverage=85%, E-value=1e-104, Identity=55%"; Hit description =Chromosome chr8 scaffold_106, whole genome shotgun sequence
  Pfam annotation: Domain name=SGL; Domain location=50-315; Score= -89.3; E_value=0.00028; Accession=PF08450.3; Description=SMP -30GluconolaconaseLRE-like region
  Pfam annotation: Domain name=Str_synth; Domain location=160-248; Score=139.8; E_value=7.8e-39; Accession=PF03088.7; Description =Strictosidine synthase
  Pfam module annotation: Pfam domain module=SGL::Str_synth; Domain location=50-315::160-248
MRRQQLHFAAVVAAIVVTAWVAHMRGGVGQSEAKGWQFEAVPIDGAVGPESFSFDPRGEGPYTGVSDGRIIKWHQTQNRWLNFSAIASSSHWDEECGGPCDEHSKKEHVCGRPLGLCFSTLSNDLYIADSYKGLVVVGPHGGTTRRLVSTIEGEPLAFTNGLDVDQRTGAVYFTSSSSKYPRRNYMSLILSRDKTGMLMKYEPQSEQVSVLLKNLSYANGVALSKDGEYILIIETTTCRVLRYWLETPKTGTLEVFADLPGFPDNIKRSPRGGFWVGIYSRREKIIQWILSYPWIGKVLLRLPLDIPKAYSYLAKLKRSNGMAIRLSEQGDILEIVNEKNGSIGRSISEVEERDGILWVGSIDAPFVGLSGGIRVSDGSRCKKTEMKVARWFGSCGDLGGSGVWVLAAQSSSGASGESCLGDGLVQGGKRKEKGEGGGDKEFVHGGGASGELIEEGGGGEEANDGVNGVFHTRLDID

SEQ ID NO: 163547 - protein, 469 aa, Glycine max
  Coding DNA Sequence Number=SeqID_71862
  Gene Ontology: Mol. function=cystathionine beta-lyase activity; Cellular component=chloroplast; Biological process=methionine biosynthetic process
  Homolog annotation: Hit_ID=A7QJK0; Match level="QueryCoverage=75%, HitCoverage=93%, E-value=1e-152, Identity=75%"; Hit description =Chromosome chr8 scaffold_106, whole genome shotgun sequence
  Pfam annotation: Domain name=Aminotran_1_2; Domain location=130-460; Score=-75.7; E_value=0.0018; Accession=PF00155.12; Description =Aminotransferase class I and II
  Pfam annotation: Domain name=Aminotran_5; Domain location=133-456; Score=-182.6; E_value=0.012; Accession=PF00266.10; Description =Aminotransferase class-V
  Pfam annotation: Domain name=Beta_elim_lyase; Domain location=156 -354; Score=-84.4; E_value=6.1e-05; Accession=PF01212.12; Description= Beta-eliminating lyase
  Pfam annotation: Domain name=Cys_Met_Meta_PP; Domain location=115 -465; Score=587.8; E_value=1.1e-173; Accession=PF01053.11; Description=CysMet metabolism PLP-dependent enzyme
  Pfam annotation: Domain name=DegT_DnrJ_EryC1; Domain location=134 -465; Score=-197.2; E_value=0.017; Accession=PF01041.8; Description =DegTDnrJEryC1StrS aminotransferase family
  Pfam module annotation: Pfam domain module=Aminotran_1_2::Aminotran _5::Beta_elim_lyase::Cys_Met_Meta_PP::DegT_DnrJ_EryC1; Domain location=130-460::133-456::156-354::115-465::134-465
MSSSRSRVLRLVPLPWGYVASGKRVMKETHPRTEEGILEVGTAVVSTTTATRCECLGFNKSENFSTKRELCAEGFKLNCLVENREMDVESSSSSSLVDDASLSLSEEDLGEPSISTLVMNFESKFDPFGAISTPLYQTATFKQPSAIENGPYDYTRSGNPTRDALESLLAKLDKADRALCFTSGMAALSAVVRLVGTGEEIVAGDDVYGGSDRLLSQVVPRTGIVVKRANTCDLNEVAAAIGPKTKLVWLESPTNPRLQISDIQKISEIAHSHGALVLVDNSIMSPVLSRPLELGADIVMHSATKFIAGHSDIMAGVLAVKGEKGGKPERPLEELIKRDLMDNAQKIAEFLASHPRVKKVNYAGLPGHPGRDLHYSQAKGAGSVLSFLTGSLELSKHIVETTKYFSITVSFGSVKSLISMPCFMSHASIPAAVREARGLTEDLVRISVGIEDVNDLIADLDNALRTGPL

SEQ ID NO: 163548 - protein, 140 aa, Glycine max
  Coding DNA Sequence Number=SeqID_71863
  Gene Ontology: Mol. function=pyrroline-5-carboxylate reductase activity; Cellular component=cytoplasm; Biological process=amino acid biosynthetic process
  Homolog annotation: Hit_ID=P17817; Match level="QueryCoverage=100%, HitCoverage=54%, E-value=6e-68, Identity=90%"; Hit description =Pyrroline-5-carboxylate reductase
  Pfam annotation: Domain name=F420_oxidored; Domain location=1-124; Score=8.3; E_value=1.4e-06; Accession=PF03807.8; Description=NADP oxidoreductase coenzyme F420-dependent
MPNTPAAVGEAASEEDGNIIAKLLGSIGKIWKAEEKYFDAITGLSGSGPAYVYLAIEALADGGVAAGLPRDLSLSLASQTVLGAASMVIQTGKHPGQLKDDVTSPGGTTITGIHELENGGFRGTLMNAVVAATKRSRELS

SEQ ID NO: 163549 - protein, 1694 aa, Glycine max
  Coding DNA Sequence Number=SeqID_71864
  Gene Ontology: Mol. function=glutamate synthase (ferredoxin) activity; Cellular component=chloroplast; Biological process =nitrogen compound metabolic process
  Homolog annotation: Hit_ID=Q2HW53; Match level="QueryCoverage=99%, HitCoverage=94%, E-value=0.0, Identity=91%"; Hit description =Ferredoxin-dependent glutamate synthase; Glutamate synthase, large subunit region 1 and 3, ...
  Homolog annotation: Hit description=putative; Glutamate synthase, eukaryotic
  Pfam annotation: Domain name=GATase_2; Domain location=19-340; Score =549.7; E_value=3.1e-162; Accession=PF00310.12; Description=Glutamine amidotransferases class-II
  Pfam annotation: Domain name=GXGXG; Domain location=1441-1636; Score =349.2; E_value=6.9e-102; Accession=PF01493.10; Description=GXGXG motif
  Pfam annotation: Domain name=Glu_syn_central; Domain location=619 -921; Score=568.9; E_value=5.3e-168; Accession=PF04898.5; Description= Glutamate synthase central domain
  Pfam annotation: Domain name=Glu_synthase; Domain location=978-1363; Score=881.3; E_value=4.8e-262; Accession=PF01645.8; Description =Conserved region in glutamate synthase
  Pfam module annotation: Pfam domain module=GATase_2::GXGXG::Glu_syn _central::Glu_synthase; Domain location=19-340::1441-1636::619 -921::978-1363
SLVAQVANLEDILSERGACGVGFIANLENKGSHEIVKDALNALSCMEHRGGCGADNDSGDGSGLMTGVPWELFDNWANTQGIASFDKSHTGVGMVFLPKDAQFLNEAKKGLEVLGWRPVPVNTSVVGYYAKETMPNIQQVFVKIVKEENVDDIERELYSTNTSPRWPLAQPMRLLGHNGEINTIQGNLNWMQSREPSLKSPVWRGRENEIRPFGNPKASDSANLDSAAELLIRSGRSPEEAMMILVPEAYKNHPTLSIKYPEVVDFYDYYKGQMEAWDGPALLLFSDFKNLRSSTLVRKGWFLETDSDGKTVGACLDRNGLRPARYWRTSDNMVYVASEVGVVPVDESKVVLKGRLGPGMMITVDLPGGQVYENTEVKKRVALSSPYGNWIKENLRSLKPGNFLSASVLDNEALMWDYTSTLEAAIKAALKRPHPRRARVLVMDLRVENRFGRKSQDRISRTNWCQIKGEKQWSLYQSYGEIAWGGNRKCKWYLGQDGQRDLGRWLKKLLVNQKVDDLWVKNLGGERYQKGFEQELLMGYTNPLAPKVPREILSKARKKKAVCIAYIQAINDMFERVTTGMGVQDRITTGPIVQNNEEIEGDLKLRIQEGWIMGGTEECFGAFGYSSEDVQMVIESMAAQGKEPTFCMGDDIPLAALSQKPHMLFDYFKQRAKLLISLHLDHVTNPAIDPLREGLVMSLEVNIGKRRNILETGPENASQVMLSSPVLNEGELESLLKDSYLKPQVLPTFFDISKGIEGSLEKALNKLCEAADEAVRNGSQLLILSDHSEALEPTHPAIPILLAVGTVHQHLIQNGLRMSASIVADTAQCFSTHQFACLIGYGASAVCPYLALETCRQWRLSNKTVNLMRNGKMPTVSIEQAQKNYCKAVKAGLLKILSKMGISLLSSYCGAQIFEVYGLGKEVVDLAFRGSVSKIGGLTFDEVARETLSFWVKAFSEDTAKRLENFGFIQFRPGGEYHANNPEMSKLLHKAVRQKSQSAFSVYQQYLANRPVNVLRDLLEFKSDRAPIPVGKVEPASSIVQRFCTGGMSLGAISRETHEAIAIAMNRIGGKSNSGEGGEDPVRWKPLTDVVDGYSPTLPHLKGLQNGDTATSAIKQVASGRFGVTPTFLANADQLEIKIAQGAKPGEGGQLPGKKVSMYIARLRNSKPGVPLISPPPHHDIYSIEDLAQLIFDLHQVNPKAKVSVKLVAEAGIGTVASGVAKGNADIIQISGHDGGTGASPISSIKHAGGPWELGLTESHQTLIENGLRERVILRVDGGFRSGVDVMMAAIMGADEYGFGSVAMIATGCVMARICHTNNCPVGVASQREELRARFPGVPGDLVNYFLYVAEEVRGILAQLGYEKLDDVIGRTDLFQPRDISLAKTQHLDLNYILSNVGLPKWSSTEIRNQEPHTNGPVLDDVLLADPEVADAIENEKVVNKTIKIYNIDRAVCGRIAGVIAKKYGDTGFAGQLNITFTGSAGQSFACFLTPGMNIRLVGEANDYVGKGIAGGELVITPVDKTGFEPEDAAIVGNTCLYGATGGQVFVRGRAGERFAVRNSLAEAVVEGAGDHCCEYMTGGCVVVLGKVGRNVAAGMTGGLAYILDEDDTFIPKVNREIVKIQRVSAPVGQMQLKSLIEAHVEKTGSTKGAAILKDWDKYLSLFWQLVPPSEEDTPEANAKYDTTTADQVTYQSA

SEQ ID NO: 163550 - protein, 775 aa, Glycine max
  Coding DNA Sequence Number=SeqID_71865
  Gene Ontology: Mol. function=phosphatidylinositol phosphate kinase activity; Cellular component=plasma membrane; Biological process =phosphatidylinositol metabolic process
  Homolog annotation: Hit_ID=Q2HW52; Match level="QueryCoverage=100%, HitCoverage=99%, E-value=0.0, Identity=73%"; Hit description =Phosphatidylinositol-4-phosphate 5-kinase
  Pfam annotation: Domain name=MORN; Domain location=102-124; Score =29.1; E_value=1.6e-05; Accession=PF02493.11; Description=MORN repeat
  Pfam annotation: Domain name=MORN; Domain location=125-147; Score =30.3; E_value=7e-06; Accession=PF02493.11; Description=MORN repeat
  Pfam annotation: Domain name=MORN; Domain location=148-170; Score =31.0; E_value=4.3e-06; Accession=PF02493.11; Description=MORN repeat
  Pfam annotation: Domain name=MORN; Domain location=171-193; Score =30.4; E_value=6.6e-06; Accession=PF02493.11; Description=MORN repeat
  Pfam annotation: Domain name=MORN; Domain location=194-216; Score =24.4; E_value=0.00042; Accession=PF02493.11; Description=MORN repeat
  Pfam annotation: Domain name=MORN; Domain location=218-240; Score =32.3; E_value=1.8e-06; Accession=PF02493.11; Description=MORN repeat
  Pfam annotation: Domain name=MORN; Domain location=79-101; Score =37.0; E_value=6.8e-08; Accession=PF02493.11; Description=MORN repeat
  Pfam annotation: Domain name=PIP5K; Domain location=483-771; Score =396.3; E_value=4.5e-116; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=102-124::125-147::148-170::171 -193::194-216::218-240::79-101::483-771
MIGKDSGVMKAWEATMRKTHAVAKKRANSIFGTISLAHVVDEEENNNNDDYDDDNEENGKNETFDVYIEEKVLPNGDYYTGEWANNFPHGLGKYLWTDGCMYVGEWFKGKTKGKGRFSWPSGATYEGDFKSGFMDGNGTYTGCNGETYKGQWVMNLKHGHGFKSYANGDWYDGEWRKDLQDGEGRYVWKDESHYVGEWRNGTIWGKGSFVWAENGKVFEGFWEDGLPKGKGTFKWPNGSFYEGNFSKDGKDQNGTYHNSCESSSDGEEGHSELWDPQELYSELNGYSVCPGEKVQVMPSHKRLAVWRSTKTGESAKNRRISLDGRVSIGLEKPSDRLQIWDGGESDASGAKTPTMGSDLDEDLMGLRVDDGGESLGQLQPIKAPKKSKRQGETICKGHKNYELMLNLQLGIRHSVARPAPTASLDLKPSAFDPKEKVWTRFPPEGSKYTPPHPSCDFKWKDYCPVVFRTLRKLFKVDPADYMLSICGNEALRELSSPGKSGSFFYLTNDDRYMIKTMKKAEVKVLLRMLPSYYNNFRDHQNTLLTKYYGLHCVKLNGPIQKKVRFIIMGNLFCSEYITHRRYDLKGSSLGRFSDKPETDISETTILKDLDLNFIFRLEKSRFEEFCRQVDKDCELLEQEGIMDYSLLLGIYFKDISPDGEIIPLQSRTPVGDSENEANPHTSCEDTDQPPSDPSSIILGMNMPAKVERTVRRSGCELQLVGEPIGEFYNDYDISKKLEHAYKSIQYDPTSISAVDPIQYSRRFRDFIFRIFTEDS

SEQ ID NO: 163551 - protein, 109 aa, Glycine max
  Coding DNA Sequence Number=SeqID_71866
MVVLEVCGCMFGSCRASRCGFNRRDEVFMVTGEWCWGRRTRRYTWIIPRVKLMSMCIKGVNVAQATKDPKGKTPKFVLEICLKKKSVGNIEKMLVFTFNYAILFESFNA

SEQ ID NO: 163552 - protein, 79 aa, Glycine max
  Coding DNA Sequence Number=SeqID_71867
MVYEKRRSFGVEGDGLKIGEKVVAGLVVSVGNLDVPIAQRLFAMRRYGGGILYAALPLHMQGGYFRIRTLDQQVTKAQL

SEQ ID NO: 163553 - protein, 51 aa, Glycine max
  Coding DNA Sequence Number=SeqID_71868
MLSQRAARLVCSQPVQQGFCLFSHLACSSPLSAQSLTLVEQDMLAEHAFLA

SEQ ID NO: 163554 - protein, 272 aa, Glycine max
  Coding DNA Sequence Number=SeqID_71869
  Homolog annotation: Hit_ID=Q6WAY6; Match level="QueryCoverage=81%, HitCoverage=36%, E-value=6e-26, Identity=37%"; Hit description =Putative uncharacterized protein
MGQLQRHAFHKAYGKIWDLAMAEVSTEAIASLAQYYDQPLRKQVENGVVGVPRKCLEAKARILAGKGEWAPFIDILAHLIFGGVPFPNVDGLVDLAAIDAFLAFHDCKESPVVAILANLYDTFDRRCEKSSTRIVCCTPALYVWLVSHLFRQEVRHACPLESHRSCTEKKEASWDRLLASKEGASVNWFPRWKEGRIRVLISCGGFPNVPLMGTRGCINYNLVLAIRQLGYPMRGAPLEEELAPIIARGFNNTNAKALQKVRKAWEMVRGIL

SEQ ID NO: 163555 - protein, 172 aa, Glycine max
  Coding DNA Sequence Number=SeqID_71870
  Subcellular localization annotation: CTP_CleavageSite=50; ConfidenceScore=5.86e-01
MPSPTRTIWRHRLRFGRSAASTTFSPAPSSSGSASGVTRNPCCASLLKVCAARRAGSTGSCSGRAKSIRGLSGVSSLIAIYLPVKIPAQHPCGYAATADRHPAAAAGTVQTETPAAARSCCPAGAAVLRPGKRSAAHRRQGDDRAAPVIFLRDDPPARSRSPAPTPAPDNPC

SEQ ID NO: 163556 - protein, 48 aa, Glycine max
  Coding DNA Sequence Number=SeqID_71871
MKERKGLLKWALGLRRRAQRDTPRLARVDRALSARVVGLARSSIGSQA

SEQ ID NO: 163557 - protein, 120 aa, Glycine max
  Coding DNA Sequence Number=SeqID_71872
MAATGGCGWWRRSLGRWKWFWGRGRERKDCFSKATRKIRLATLKCFCSRERKRLEHTRIHIANRNSQIVESCPMNLQTKFGDDPTVNKCRRVFLPRELHTASLRNFSREASLRSFLERLI

SEQ ID NO: 163558 - protein, 288 aa, Glycine max
  Coding DNA Sequence Number=SeqID_71873
  Gene Ontology: Mol. function=intramolecular transferase activity, phosphotransferases; Cellular component=plasma membrane; Biological process=carbohydrate metabolic process
  Homolog annotation: Hit_ID=A4WC80; Match level="QueryCoverage=87%, HitCoverage=55%, E-value=1e-138, Identity=94%"; Hit description =Phosphomannomutase
  Pfam annotation: Domain name=PGM_PMM_II; Domain location=1-108; Score= 206.2; E_value=7.8e-59; Accession=PF02879.7; Description =Phosphoglucomutasephosphomannomutase, alphabetaalpha domain II
  Pfam annotation: Domain name=PGM_PMM_III; Domain location=110-221; Score=192.9; E_value=7.9e-55; Accession=PF02880.7; Description =Phosphoglucomutasephosphomannomutase, alphabetaalpha domain III
  Pfam module annotation: Pfam domain module=PGM_PMM_II::PGM_PMM_III; Domain location=1-108::110-221
KEYIDHLLGYINVANLKPLKLVINSGNGAAGPVVDALEARFKALNVPVTFVKVHNTPDGNFPNGIPNPLLPECRDDTRNAVIEHGADMGIAFDGDFDRCFLFDEKGQFIEGYYIVGLLAEAFLEKNPGAKIIHDPRLSWNTVDVVSTAGGTPVMSKTGHAFIKERMREEDAIYGGEMSAHHYFRDFAYCDSGMIPWLLVTELLCLKGKTLGELVRDRMAAFPASGEINSKLAQPAEAIARVEQHFAIHALEIDPGGAPERGIPRRHRADGSPNEGHSGAVESVIFAPP

SEQ ID NO: 163559 - protein, 656 aa, Glycine max
  Coding DNA Sequence Number=SeqID_71874
  Gene Ontology: Mol. function=hydrolase activity; Cellular component =intracellular; Biological process=carbohydrate metabolic process
  Homolog annotation: Hit_ID=B0J3K5; Match level="QueryCoverage=49%, HitCoverage=68%, E-value=1e-142, Identity=74%"; Hit description=MlrC domain protein
  Pfam annotation: Domain name=DUF1485; Domain location=311-595; Score =5.6; E_value=6.2e-13; Accession=PF07364.3; Description=Protein of unknown function (DUF1485)
  Pfam annotation: Domain name=MlrC_C; Domain location=598-656; Score= -53.4; E_value=0.0068; Accession=PF07171.3; Description=MlrC C -terminus
  Pfam annotation: Domain name=ROK; Domain location=49-201; Score=62.9; E_value=1.1e-15; Accession=PF00480.11; Description=ROK family
  Pfam module annotation: Pfam domain module=DUF1485::MlrC_C::ROK; Domain location=311-595::598-656::49-201
MKLSKAAISTLIKEMLSAGLLEESIPESNGQGRPSVLLKMRADSAYFLGASLLGDDVYLVLTDMHGRILASTHMPLNPDPALLAGALAAAIPGLLAQKGISADQLIGLGVTLSGFVDENQAVCVQSALLGWKNVPLAALLNAQTGLEVSLENDAKALAGQLHRGAHGGAGEIAHCTVEPGGRPCRCGKRGCLDTLASLTAMRESMREKQLPCTSVAGLETLAVKGNSAAIAILHQAGDALGLAIANIIQMNDPEMIVIAHQPDAFDGLLRTVVMQAVDSHVLPSIMGKTPIASMAIDQLSWARAAATESVMRIAYGGIHTECSTWNPVLNYADDFRIVRGETMTSNPYFAFLQDYAAEFLPTFHARAIAGGPVARVTYDAFKQEFLRRLEAYLPVDGVYLAMHGAVYVEGMEDAEGDWISATRELVGPDCPISVSYDLHGNVSQRIIDAIDMFSTYRTAPHIDVEETMRRSVSMLVNSLQSGIRPGVVWAPIPVVLPGERTSTEDEPTKSLYASLPGINALEHIWDASLMVGYVWADEPRATAAAIMTGTDADVLSEQAAKLALAYWQAREQFVFGCVTGSTEECVRMAISSPGGPVILADSGDNPTGGGVGDRADVLAELLRQNAQDVIVAGITDKPATEAAFAAGVGARLSLTI

SEQ ID NO: 163560 - protein, 555 aa, Glycine max
  Coding DNA Sequence Number=SeqID_71875
  Gene Ontology: Mol. function=transporter activity; Cellular component= integral to membrane; Biological process=transport
  Homolog annotation: Hit_ID=A6X4N9; Match level="QueryCoverage=47%, HitCoverage=83%, E-value=2e-57, Identity=46%"; Hit description=ROK family protein
  Pfam annotation: Domain name=BPD_transp_1; Domain location=120-278; Score=16.8; E_value=0.0011; Accession=PF00528.13; Description =Binding-protein-dependent transport s
  Pfam annotation: Domain name=ROK; Domain location=255-442; Score =87.6; E_value=3.9e-23; Accession=PF00480.11; Description=ROK family
  Pfam module annotation: Pfam domain module=BPD_transp_1::ROK; Domain location=120-278::255-442
LIGGAVVTESVFNWPGIGRLLVDSVKYRDYPVIQGVTLVAVTGVVLMNLIVRFLLGNPSITTGGGLVLLVVLAALFAPLITHWDPIEQDLLNTLQAPSAAHWFGTDDYGRDIFARVIYGARITLFEVSLSVAISMAIGIPLGIISGLAGRKIDALIMWLMDIIFAFPGIVLAILIVSVLGEGLTNMLIAISLFSIPSTLTAGAVVLSAASLSFLGLGVQPPMPEWGTMMSDGRNFLGLNIYVSLFPGLAILITVLGFNVLGDGLRDDRLTLLDQQKIPATDWQAFCARVSEMIAGQHNHFSSQAAVAISTAGIVAPQTGEMFASNIPAFHRRNLARELGEVLQRPVIAHNDADCFALAEALAGSGKGHKVVFGAILGSGVGGGLVADGRIITGQNGLTGEWGHGPITLTEVTLAHRRVRVPRQACPCGQTGCLDTYGGARGLETLHQVLHAESASSVEIIARWQQAEARAQQTIEAWLQLVSEPLAYTINITGASRVAVGGGLASVTPLIAALNDAVQRCVLRSTAHALVVPGEFAHQGGMVGAALLARQALSAS

SEQ ID NO: 163561 - protein, 186 aa, Glycine max
  Coding DNA Sequence Number=SeqID_71876
  Gene Ontology: Mol. function=protein binding; Cellular component =anchored to membrane; Biological process=defense response to fungus
  Homolog annotation: Hit_ID=A7PBE0; Match level="QueryCoverage=88%, HitCoverage=35%, E-value=8e-21, Identity=37%"; Hit description =Chromosome chr16 scaffold_10, whole genome shotgun sequence
  Pfam annotation: Domain name=LRR_1; Domain location=106-127; Score =13.2; E_value=1; Accession=PF00560.24; Description=Leucine Rich Repeat
  Pfam annotation: Domain name=LRR_1; Domain location=132-160; Score =9.0; E_value=6.5; Accession=PF00560.24; Description=Leucine Rich Repeat
  Pfam annotation: Domain name=LRR_1; Domain location=57-80; Score =14.4; E_value=0.45; Accession=PF00560.24; Description=Leucine Rich Repeat
  Pfam annotation: Domain name=LRR_1; Domain location=82-104; Score =14.1; E_value=0.54; Accession=PF00560.24; Description=Leucine Rich Repeat
  Pfam module annotation: Pfam domain module=LRR_1::LRR_1::LRR_1::LRR _1; Domain location=106-127::132-160::57-80::82-104
MDEYFSIWHNNKKGFGLGIIIIPTVATGMESSATTLLPIFFSFTSTLIPPQIGNLSKLRYLDLSDNDFEGMAIPSFLGTMTSLTHLDLSDTGFMGKIPSQIGNLSNLVYLDLSYTNLSKAFHWLHTLQSLPSLTHLYLSDCTLPHYNEPSLLNFSSLQHLYFPWTHNTCSSEFTTFRQSDRSYWGI

SEQ ID NO: 163562 - protein, 68 aa, Glycine max
  Coding DNA Sequence Number=SeqID_71877
MTKGADNQMEMMLVSACYWTLSLTDSKRVCVGYRIGRLYVPTDSWVTIAKGGAVDKSGAFAPTYPQSR

SEQ ID NO: 163563 - protein, 52 aa, Glycine max
  Coding DNA Sequence Number=SeqID_71878
MVNKVWSFNGEEEEEKSNVRSLRAASLVPVPRVSLHPSGPVFERKQYISKPS

SEQ ID NO: 163564 - protein, 51 aa, Glycine max
  Coding DNA Sequence Number=SeqID_71879
MVFHLRLVVSFTTRKGKHRLKRAIKGINSRSINKSQAKAIAQVINGAKHTE

SEQ ID NO: 163565 - protein, 114 aa, Glycine max
  Coding DNA Sequence Number=SeqID_71880
NLYRELCRASSEVGRVIGGYAILLQSWAWYHMPFIAPKVLGPETTYSLAKRWSGGRLEHRSTPHGDLVGYRSRIDHMESHQDLKSTYRDIHTETGRFVGQMASVILKGGELISH

SEQ ID NO: 163566 - protein, 95 aa, Glycine max
  Coding DNA Sequence Number=SeqID_71881
MRVILQQKGDIKRAFLLKKSFYVFLSRETSLSTITIPTLETIPPKLLFDPLFLYANIFKGNPGLLERASDRQVFKIKTDESEYQTQGTSLRQGQI

SEQ ID NO: 163567 - protein, 36 aa, Glycine max
  Coding DNA Sequence Number=SeqID_71882
MLQLYGINIGLKEHSNLMTPKTYTPKSPSGSLPPDS

SEQ ID NO: 163568 - protein, 288 aa, Glycine max
  Coding DNA Sequence Number=SeqID_71883
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDHDRTDAHQVNGKDKERHAFRRIGGGERGIEGPTEIRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163569 - protein, 107 aa, Glycine max
  Coding DNA Sequence Number=SeqID_71884
  Subcellular localization annotation: CTP_CleavageSite=17; ConfidenceScore=5.05e-01
MKNGGKPSRNRPQKRLRSGKIGRWLPPSSPRRAGLLPPEGTVFCWNTLEDCATMLPFDSRHIVELHELRNDGFQVPRSGQAKVASHQTDGPWMKLGYDTNFQGLFNS

SEQ ID NO: 163570 - protein, 144 aa, Glycine max
  Coding DNA Sequence Number=SeqID_71885
  Pfam annotation: Domain name=Retrotrans_gag; Domain location=7-87; Score=-1.9; E_value=0.083; Accession=PF03732.8; Description =Retrotransposon gag protein
MAEEPKRVILEDYSSSSNNLKTWDEVVEKFLKKYFLESKTEEGKAVISSFYQFPNESLSEALERFHDASAGGKIKLKTPEEAMDLIENMFASDIAILIDRAHIPTKRSLLELTSQDALLAQNKLQGVPSVVELIILAAVSPMKN

SEQ ID NO: 163571 - protein, 179 aa, Glycine max
  Coding DNA Sequence Number=SeqID_71886
MAPTRHPLDPDKSNRALGFPALITGLCQSFGVPVAPTKVIRPPITRAFIEKYCTQRWAQGDAPQAAGEPPPPHQAGPAGSFDMEQYLRHLVRQQAANHRAHVQTHDCLYQMSLSMQSQGFASFSCPTPDQFRAEVAWPGDWPEAQAGKAPPEAPGDGEEAHEDEEMADLLDFLGGSGAS

SEQ ID NO: 163572 - protein, 78 aa, Glycine max
  Coding DNA Sequence Number=SeqID_71887
MENCNKQLTAHDSKLMGGGRMNENAIHGAPKKGREWRIALRNHYAWLQTHRLQTMGGGHMNENAIHGAPKKIENGELH

SEQ ID NO: 163573 - protein, 63 aa, Glycine max
  Coding DNA Sequence Number=SeqID_71888
MGAKYLEVVKRGSHPNNGWFPDKIRVCGITIICLRPPLDLLFLNDKGRRICLCAFITQLAKSE

SEQ ID NO: 163574 - protein, 136 aa, Glycine max
  Coding DNA Sequence Number=SeqID_71889
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=80%, HitCoverage=96%, E-value=3e-24, Identity=54%"; Hit description =Putative uncharacterized protein
  Subcellular localization annotation: CTP_CleavageSite=25; ConfidenceScore=5.42e-01
MTMITPSSKLTLTKGNKSWYRAPPRASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASR

SEQ ID NO: 163575 - protein, 81 aa, Glycine max
  Coding DNA Sequence Number=SeqID_71890
  Homolog annotation: Hit_ID=A0PAV3; Match level="QueryCoverage=46%, HitCoverage=17%, E-value=5e-07, Identity=76%"; Hit description =Restriction endonuclease
MVKVGNSYVPINVSFSPKVGPGLPGINRDTRIYLFCEVISVTAVPPVQLLTGWCVTAKAPPDISAGKCSGHAARNHHTRRA

SEQ ID NO: 163576 - protein, 150 aa, Glycine max
  Coding DNA Sequence Number=SeqID_71891
MISVNPDPRSQVVGGDTQVVIHINTLLLSVRLRVRDGEFNDMRRNPSGYSYKTISVNPDPRSQVAETVSPMICADTQVVIQTNQLLLISTREVRWQAEVPQVVIRTNVLLLILTCEVRWQAEIPQVVIRTHSSATPTCDKSGSMRRRPIR

SEQ ID NO: 163577 - protein, 172 aa, Glycine max
  Coding DNA Sequence Number=SeqID_71892
  Pfam annotation: Domain name=Retrotrans_gag; Domain location=1-91; Score=13.3; E_value=0.0027; Accession=PF03732.8; Description =Retrotransposon gag protein
GDALYWWTSLVKERRIHEGGPVEYCNDCESAFGRRQIRPYYEREVNDPSTNRQRSMSVEEYRQQMELLLLRAGLREEERTSIARFLSGLNMEVRDKGAAPSKPKEDKGHIASQCPTKKTMIMRGQDIYSSQEETTSCPSSSGSEDDVRGENSSEEVNPHEEGDLLMVRRLLG

SEQ ID NO: 163578 - protein, 100 aa, Glycine max
  Coding DNA Sequence Number=SeqID_71893
  Subcellular localization annotation: CTP_CleavageSite=62; ConfidenceScore=5.12e-01
VPPVQLLTGWCVTAKAPPDISAGKCSGHAARNHHTRRAYAPLQGASHSPFRLRNCWEGRSVRASSLLRQLAKGGCAARRLSWVTPGFSQSRRCKTTASEL

SEQ ID NO: 163579 - protein, 109 aa, Glycine max
  Coding DNA Sequence Number=SeqID_71894
MTEIELRIFLLLKISPIAKCKHCAKRIFCHALSGESLALSAQPLHLMLIYNDFQDYFDDAKESRVKQVPKNQASRIKSQRIKIQEQLSFKIQDSRKIKIKIQDSRFKRS

SEQ ID NO: 163580 - protein, 73 aa, Glycine max
  Coding DNA Sequence Number=SeqID_71895
  Subcellular localization annotation: CTP_CleavageSite=70; ConfidenceScore=5.68e-01
VDSRGSHPGPLGPSRVFQQKAVPSGGSNPARLENSSRGVSVTLLRRFRGRFREGFPPFFIVLRSFFVVLRSST

SEQ ID NO: 163581 - protein, 73 aa, Glycine max
  Coding DNA Sequence Number=SeqID_71896
MLDICCLEDLGNMIEVLSTMGSQIDISSCIKDIPYGLPPLRGIEHQIELHFLIGQPIGVIRKRQRRSKSNLKG

SEQ ID NO: 163582 - protein, 152 aa, Glycine max
  Coding DNA Sequence Number=SeqID_71897
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-24, Identity=55%"; Hit description =Putative uncharacterized protein
  Subcellular localization annotation: CTP_CleavageSite=46; ConfidenceScore=5.48e-01
MTMITPSSKLTLTKGNKSWYRAPPRGRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163583 - protein, 260 aa, Glycine max
  Coding DNA Sequence Number=SeqID_71898
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPVNFGECNCLTDVSHPSTKKVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163584 - protein, 99 aa, Glycine max
  Coding DNA Sequence Number=SeqID_71899
MTNYYPPDLPPSIGVPRGSQGAVLKKVLHRIAVQSSNFLDPGIKFPPQRHYFMTREKKVGCRFNLTLAEGAEVILKDNLPPNKVFLRWKPIPEKSPSKS

SEQ ID NO: 163585 - protein, 178 aa, Glycine max
  Coding DNA Sequence Number=SeqID_71900
  Subcellular localization annotation: CTP_CleavageSite=41; ConfidenceScore=5.52e-01
MAESSKKRKGSSSTTSAASHHRHGPSEAPTAPSHPSLSSPRSSTLFSSDDQCLRYNSQFSSRIILHPKYLDIDFFNDETFDCYQVFQNSALVEFMSLKLPYYPELVKVFYSNLKIQDGIISSEVHGISMIIDQSLFFSLTKLPSQGAPFEGTIVDDWKFDYSSHDAHRMVCNDQAEMT

SEQ ID NO: 163586 - protein, 139 aa, Glycine max
  Coding DNA Sequence Number=SeqID_71901
DGPSGTSTLVFRGLHVLANRGLHTLTFRGLRVLTFRGLHVLTFRGLHALAIRGLHALTSRGLHVLALRGLHALTLGLHVLANRGLHALTFRGLHVLALRRLHALTLGTSYPHHQRAARPHLERTTCPRLERATRPHLGY

SEQ ID NO: 163587 - protein, 257 aa, Glycine max
  Coding DNA Sequence Number=SeqID_71902
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSGRINTDHRIIRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163588 - protein, 148 aa, Glycine max
  Coding DNA Sequence Number=SeqID_71903
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=3e-25, Identity=56%"; Hit description =Putative uncharacterized protein
  Subcellular localization annotation: CTP_CleavageSite=42; ConfidenceScore=5.37e-01
MTMITPSSKLTLTKGNKSCVDPTRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163589 - protein, 41 aa, Glycine max
  Coding DNA Sequence Number=SeqID_71904
MVEKIKIPHFFKRVWIGSMVEEDISYIRTSFDLPPPPPPSS

SEQ ID NO: 163590 - protein, 617 aa, Glycine max
  Coding DNA Sequence Number=SeqID_71905
  Gene Ontology: Mol. function=metal ion binding
  Homolog annotation: Hit_ID=A7P414; Match level="QueryCoverage=100%, HitCoverage=100%, E-value=0.0, Identity=66%"; Hit description =Chromosome chr1 scaffold_5, whole genome shotgun sequence
  Pfam annotation: Domain name=PHD; Domain location=561-609; Score =30.4; E_value=3.7e-06; Accession=PF00628.20; Description=PHD-finger
MLKVDVVGNKKRKRCGKVFRFKNFGEPGYPVMFNGPFRENVNALLEYANLESNLSMEMPMWSFQLEVHHHPPLHILLFVIEEPIEAALNRHCKHCQYVAQAGAIISFAIRSITLCCPQRRHWLPAQAVKVAVMQLLQLIMIMEFWNRLCYGLQARKVSLNDISQKRGMELRLVNGIAYNESWFGHWGYKFGRGCFGVTQSMYHKAIQAIRSMPLYLIIHHIANSNHGIPLIFSRYQTLSDQSLVTLGDLFCYMLDLKSRLPRETCISSYNTNTLAVETNCRWSPKRIEMATRVIVEALKRTKFRWVSRQEVRDAARAYIGDTGLLDFVLKSLGNHVVGNYLVRRSLNPVTKVLEYCLEDISNVHPYDNEGLVMSNKVKDKYKITRAQLMKDMLYLYKYILIDPKPMMGSEFLSAIPLAARIILDTKYFIKDYFGDIPYQVELGSNDKLNLYCTIWLRNNVGSDEYLNKAIMPPHECFTLKRNATINDLKLEVERNFREIYWGLRSFVVESFRNLSVNNETEMVFGLIEVGGKVVLEGWQGDIGINMIEQICESDPNNGIMDCTCGTIEDDGERMVSCDICEIWQHSRCVRIPNDEEIPHIFLCKKCEQEIVLFPSLP

SEQ ID NO: 163591 - protein, 370 aa, Glycine max
  Coding DNA Sequence Number=SeqID_71906
VVDRYSASVFESCYCSNHWKMTMIKNEQLKHGQQEKWFNNFHENLDLNVTAQELEQQPDFRWELLENRYSQYSELSGKIEKHRDSISLEAQQQGNQIPQTKISEACVNDLLILAQSAEIVAQSEDSVAGEHTNNQKNKDLQSDLIDQMSQEHASNINVDDQECSLELLDRLSAVCHMKHRARSKGNSTVKDGTEKHMDQSLPCNRFKDSSPSVEDVPAHNFRGAIQSSVVRRDIENLKEHQRIARRLRAFKTKKLRQQFRRECKRSVSSAGLHAMGTSLTGLKGYKVLGSPTTMASFCSVVLPRSYQLVSCFSNYNGVDDDAIVAIKEWMLYMNHMHLKEYHRVVACQHRAECVEEKRASNVKKKNNPAL

SEQ ID NO: 163592 - protein, 63 aa, Glycine max
  Coding DNA Sequence Number=SeqID_71907
METPEDLPHSSGSTPACGLWWWSFDGDEGARCLVGGGGLDSGLGVVVLILTTLARRCAGVVGG

SEQ ID NO: 163593 - protein, 269 aa, Glycine max
  Coding DNA Sequence Number=SeqID_71908
  Gene Ontology: Mol. function=metal ion binding; Cellular component =cytoplasm; Biological process=cell redox homeostasis
  Homolog annotation: Hit_ID=A9PIZ7; Match level="QueryCoverage=62%, HitCoverage=72%, E-value=1e-56, Identity=64%"; Hit description =Putative uncharacterized protein
  Pfam annotation: Domain name=zf-C3HC4; Domain location=119-159; Score= 48.0; E_value=3.3e-11; Accession=PF00097.16; Description=Zinc finger, C3HC4 type (RING finger)
MASETEVPDIISSVFERFQQNRDMSLFLPFLFGFSDATPGRNSDDPDHETAPTEAPQRQRIILVNPLTQGMVVIDGGSSLEALFREFTNGKGGRPPASKESIEALPSVEIGEGNEDSECVVCLEEFGVGGVAKEMPCKHRFHGNCIEKWLGMHGSCPVCRYEMPVEEIDWGKKREEEGGERRRSDGGEVWVSFSFNRSSRRNQDHDQADSGDSNDDDGSSSSHGDGAAEENQGFKLRSQLWKLQTNAVDVVGIEVVVVTPKTLILWPKL

SEQ ID NO: 163594 - protein, 351 aa, Glycine max
  Coding DNA Sequence Number=SeqID_71909
  Homolog annotation: Hit_ID=A5BZT9; Match level="QueryCoverage=83%, HitCoverage=75%, E-value=5e-88, Identity=56%"; Hit description =Putative uncharacterized protein
  Pfam annotation: Domain name=mTERF; Domain location=6-277; Score =152.2; E_value=1.4e-42; Accession=PF02536.5; Description=mTERF
  Subcellular localization annotation: CTP_CleavageSite=46; ConfidenceScore=5.16e-01
MPTLKLSLFVSLPKPLNLRPQFSRHPINPNPTTSDRGLVFHEKVLYLKALKVNPDKAFRLNPTLRSSPLSTLKSVTRSLSSLGIPRASMGRILDMLPVLLTCDPYFQFYPLLDFLLHEVPIPYHDIHLSILRCPRLLVSSVNNRLRPTLHFLRKLGFNGPHSLTCQTTLLLVSSVEDTLLPKIEFLKGLGFTHEEVANMVVRSPGLLTLSVEKNLRPKVEFFLREMNGDVAELKRFPQYFSFSLERRIKPRYGMLRRVGVSMDLEDMLKVSDGGFKARLLDLRFKKLEIGQLQFWRQPRDLLRMQATAIAAAFVRNFLQCQGLRHDYDCNVDSCDSKEMRFWFMENKELDL

SEQ ID NO: 163595 - protein, 213 aa, Glycine max
  Coding DNA Sequence Number=SeqID_71910
  Gene Ontology: Mol. function=metal ion binding; Cellular component =integral to membrane; Biological process=ubiquitin cycle
  Homolog annotation: Hit_ID=A7Q6B2; Match level="QueryCoverage=65%, HitCoverage=31%, E-value=2e-35, Identity=55%"; Hit description =Chromosome chr11 scaffold_56, whole genome shotgun sequence
  Pfam annotation: Domain name=PHD; Domain location=97-142; Score=-7.4; E_value=0.096; Accession=PF00628.20; Description=PHD-finger
  Pfam annotation: Domain name=zf-C3HC4; Domain location=98-139; Score =37.3; E_value=5.4e-08; Accession=PF00097.16; Description=Zinc finger, C3HC4 type (RING finger)
  Pfam module annotation: Pfam domain module=PHD::zf-C3HC4; Domain location=97-142::98-139
MLTVSLKRSYHVFLLPFKPSIAVVVCVLTIIISLTSLLLFYIKLCNDGITDDRGKNSASWMVVSFTERKNFGIDWSMVESLPNFKFRVLRGQKEGLNCAVCLNKFKVAKVLRLLSKCKHAFHVECVDSWLDVHSMCPLCCYCMDPEDIFLVEEAKPFHQSHQQQNNDQGCVCLNLDLEKQGIVKSRQRHLFVWGGGRRNNRGVATESEVDDVI

SEQ ID NO: 163596 - protein, 501 aa, Glycine max
  Coding DNA Sequence Number=SeqID_71911
  Gene Ontology: Mol. function=protein binding; Cellular component =cytoplasm; Biological process=red or far red light signaling pathway
  Homolog annotation: Hit_ID=A5AG46; Match level="QueryCoverage=92%, HitCoverage=98%, E-value=1e-42, Identity=29%"; Hit description =Putative uncharacterized protein
MVISAATSNNNNIHQLQSFNSQNNNYHLRDASFSSYLNNKEEILTESGHGYVSSRKDPLGVKKEDDGEIGVFEAEKYFNGEEIGSPPRVADNDANKHRPQKDEQTALVTRKYKVQNGTPSVRSESSLNSQSALLQSAVRNSSRNMKSKLHRKSFLAGLGCKCYCSDKNSVDISDHAGEISFSKNSSHGKTTSRNMFNADPEANHSVKVTRPHAAEISINKDVYFQRPEKLGVGLSKENSLALSGLNSSSGNNPAKMQLQQVEKSRNSLEVFGSPILSSRSKSLSFDKRLAKTSSSSWDAAPKIEETDFSANSGGNYNDADSDASSDLFEIESLTGKSNSFFLGRSSSNVVSSCASPTTCYAPSEVSIEWSVATASALEYSAMSDYDDQRSIGTTRSPITTSLVSSNGKPKVVVKETQRRRPSMLLGCKSQKAVGVALDAFTTYEKTSSNANSRRRSDTFPQVTEFKTETTKEGSFGARHNKQHAYATNPLQRSLSPHPSQL

SEQ ID NO: 163597 - protein, 89 aa, Glycine max
  Coding DNA Sequence Number=SeqID_71912
MVVLVIRLFRKLLCAILLRDATNNYLLTSAESHPKRNIAICLQLNCKKLTKMQLPKIYPMGTVFPPFMKKKGGVGFMTTNQRQWDVLCT

SEQ ID NO: 163598 - protein, 303 aa, Glycine max
  Coding DNA Sequence Number=SeqID_71913
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDIQKRALEIQEQENALLENERIQQDRLPLTNLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIRYQAFPPGGSLVRSPVPAFRFTGVIP

SEQ ID NO: 163599 - protein, 281 aa, Glycine max
  Coding DNA Sequence Number=SeqID_71914
MDIIMPSKLLPERNVVVYYTEFDEFNEELERRHWDEELTSFADGNIDVAIVKEFYTNLYDPEDKSPKQVRVRGHLIKFDEDTLNTFLKTSVILEEGENLCAYSRFALLRLDPQELAAKLYIPGRGFELNADGQPLKILRKNMTMLAQTWSVLSFSNLIPTSHTFDVTLDRAKLIYGIIIKMDMNVGRTVGILMIQQCHLEGQGRPGVRDQRPHYFSGTRDSSSFFFHSSCTSHSDSSYSSCTYSDTTSCSISIPASSSFICRTIRLCIYTTDASFHAPELT

SEQ ID NO: 163600 - protein, 267 aa, Glycine max
  Coding DNA Sequence Number=SeqID_71915
MQVAGCTICGGAHESGCCIPNEEKIAHEVNYMGNQPRGNFNTSGFPRFQNNQLYQQQRQWQNLPGSSTWPQQHMPSLYDRTTKLEETLAQFMQVSMSNQKSTESAIKNLEVQVGQLAKQLAERPSNNFIASTEKNPKEECKAVMTRRKMAIQAEESGADQKVEGVKPQLADELALELVDDLVELEEIVEEAEGDEEGETPIRDYQEKIKKKEEKEKGTKEKEEKEEKEKKLKNEKQKEKVVEIEKKKGKSEANIEKKKEATPIECKE

SEQ ID NO: 163601 - protein, 142 aa, Glycine max
  Coding DNA Sequence Number=SeqID_71916
MSYQAITTPISLCLSASWCMMPTRDPLDPDKSNRALGFPALFTGLCQSFGVPVTPSKAANHRGQVQIHECLYRFSLSQQGQGSAPFACPTPEQFGAEVAWPRDWPDVQAGEEPARSSGEPDASHMDEDMTDLLGFLGGSGAT

SEQ ID NO: 163602 - protein, 103 aa, Glycine max
  Coding DNA Sequence Number=SeqID_71917
  Homolog annotation: Hit_ID=A0PAV3; Match level="QueryCoverage=36%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFRLRNCWERAIGAGLFAITPAGERGMCCKAIKLGNARVFPVTTL

SEQ ID NO: 163603 - protein, 139 aa, Glycine max
  Coding DNA Sequence Number=SeqID_71918
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-17, Identity=32%"; Hit description= UPI00006A17C9 related cluster
  Subcellular localization annotation: CTP_CleavageSite=101; ConfidenceScore=5.71e-01
MTCSPLKVRKCSPPKVRTCSPLKARTCSPLQARTCSPLKVRACSPMKVRACSPMNARVCNPMKARVCSPLRARTCSPVKVRTCSPLKVRTCSPLKVRMCIRMKTRACNPLKARTCSPLKARTGSPLKVRTCSRCRCNWL

SEQ ID NO: 163604 - protein, 184 aa, Glycine max
  Coding DNA Sequence Number=SeqID_71919
MTQISVHVAQLISYAIHQFVGIAPPRHPVDSEKSNRALGFPTLITGTTVGAILAALAGCRCTATTSTSATILRVHLSSHAKDGAPNAPYMQHLADQQATNHRGQMQLNDSFYQYTLHQHHQDPNLYPWPTLEQFRATIAWPGDRPNFQEEASPIEAQGAAQGDKGGAEDDGDMVDLLDFFIGGG

SEQ ID NO: 163605 - protein, 79 aa, Glycine max
  Coding DNA Sequence Number=SeqID_71920
MPRVPPMIRAGCVGIVPLRERRLVNPSGGHYHHLVGDQRWKQVPGSNQVGAEVTTWASPSFFFAPVAPSLLLLVPSGAT

SEQ ID NO: 163606 - protein, 434 aa, Glycine max
  Coding DNA Sequence Number=SeqID_71921
MDEQRLERQLDNNIFIDGVKVFVNRPKFERGKVVNTREKGTSIRGEGDIPQVYKDGNGDKADQVENNIRDKPRSYATVVKEPVHGETEPMKSLVVMPGSDKTNYSPVILQSTKANSEWISKAWTARLKNRGMFERLEEELKWVVEDDSSPCYWADDWVIFPDMDESKAARLIDQEKDNRSTPISELQKWSPEIRPTHRLTWVLLWGLPLTVWEEELMAKVLAEVGEVVEVDEYVEARRRLDVARILVRTQKEPLLQANIPAIIDGIEYVLQVVEDTTSLGRSKKCPYHVSWLPPSPYSTQPNTPASGDVLHPRVFSGVDFPDGVSDDNLGADFDDRDTLLSPNLRRDHWVKTLARSCKDRSFIHDDAKPFQKDKVQIMQGIGAEVALTSSNGQLPRNGAALNEDVERDMQGIMLKAKHPVKDSFLVHAHLTYTI

SEQ ID NO: 163607 - protein, 414 aa, Glycine max
  Coding DNA Sequence Number=SeqID_71922
  Homolog annotation: Hit_ID=Q6WAY6; Match level="QueryCoverage=88%, HitCoverage=61%, E-value=6e-25, Identity=26%"; Hit description =Putative uncharacterized protein
MAETLASQGEWVSFMDVLALLVFEIVLFPNVDRLVDLAAIDAFLAYHHSKESSVIAVLANAYDTFDLRCEKSSAIIVCCTPDLYVWLISHVFNHGSRSVYPLQGHHMCSRKDKANWEELLAGMTGASISWFPRWKEGGAGVLCSCEGFLNVPLMGTRGFINNNPVLAIRQLGYPMRGVPSEETITPFIARGFNKANTKILQKICKAWNKVGRKDKELRGRSNEVPEESEEVKALKAEFEKTKVAKEKLKVAATRVRKKSDKLRDINMTATEALERETKKAKKEEWSRNKFRGALLGRSNELKLRKAERDKSRMESGSLKEQLRKTEENMLIIIDQYKEKVNLAASHGQMLRDKQAKVSALRVKREAREEVMELLHKEGMKWMDRFALTLNESQELPKLLAKAKTVVDTYSAPDE

SEQ ID NO: 163608 - protein, 61 aa, Glycine max
  Coding DNA Sequence Number=SeqID_71923
MKLDRFRLWMEALVFAEIAYSGWSFASLTPLRKVEKRPQLLVVFVMTVAAVLEEEHMAYSD

SEQ ID NO: 163609 - protein, 148 aa, Glycine max
  Coding DNA Sequence Number=SeqID_71924
  Homolog annotation: Hit_ID=Q6WAY6; Match level="QueryCoverage=63%, HitCoverage=16%, E-value=2e-11, Identity=38%"; Hit description =Putative uncharacterized protein
MPPHVCRERERKLGRTLGRYGRGIANVPLMGMRGCINYNPILAIRQLGYPMRGAPIEESIALFIARSFSDPYEKMLQRVRKAWNAVQRKDKDLRGSSNGVIGRYHKWLKAWMQGIIWLPKLKISSGEEAGVPEESEEVQALKAELERT

SEQ ID NO: 163610 - protein, 42 aa, Glycine max
  Coding DNA Sequence Number=SeqID_71925
MDKSLKVGEDDWREKERMSMKFCPSKEPTNPKSSPRFSTKCA

SEQ ID NO: 163611 - protein, 97 aa, Glycine max
  Coding DNA Sequence Number=SeqID_71926
  Homolog annotation: Hit_ID=A5B532; Match level="QueryCoverage=90%, HitCoverage=32%, E-value=2e-09, Identity=38%"; Hit description =Putative uncharacterized protein
MVNWCKSVKEIWKMLEATHEGTADEPKITTIKESKDLASMSMEVLFRKLLVYEHSMDDSSTIEETEEFQKARDSLWYLDSGCSKHMTGDKSKLTDIV

SEQ ID NO: 163612 - protein, 71 aa, Glycine max
  Coding DNA Sequence Number=SeqID_71927
  Subcellular localization annotation: CTP_CleavageSite=26; ConfidenceScore=5.11e-01
TYQGNPCGVYPDLSSFTGSGVYPDLSSFTGSGVYPDLSSFTGSGVIQNLRSLYQTIRSYSGSHHNCRHRSL

SEQ ID NO: 163613 - protein, 160 aa, Glycine max
  Coding DNA Sequence Number=SeqID_71928
  Homolog annotation: Hit_ID=A5BSR3; Match level="QueryCoverage=87%, HitCoverage=42%, E-value=6e-09, Identity=32%"; Hit description =Putative uncharacterized protein
MWMTLFAKNTALVRRSEPSFVRVAETSRGRYKKAQAIQKQNTAPYMLSRRGYEYLEQKLMAEKTKKKLVEAAQSKSTEVVIDPPSLIRWHVKWKMARAKKTGQMTSKSAKEIAEKIDSLEEQASQGSFVLHGCQDVLTTAIGRPEHPSCVRAARAGVTIK

SEQ ID NO: 163614 - protein, 101 aa, Glycine max
  Coding DNA Sequence Number=SeqID_71929
  Subcellular localization annotation: CTP_CleavageSite=52; ConfidenceScore=5.02e-01
EARLKGVSSKGRKCAESPPTFICGKRRKNRRKPVMKNTPDSGVVFMFEEGISTSHVDKSGALAPTYPPSKRKSDLRIELSYPNFVRGPLLDDMRPFFGPCE

SEQ ID NO: 163615 - protein, 98 aa, Glycine max
  Coding DNA Sequence Number=SeqID_71930
QSPSAHLHRLEHCLQPVADQQATKSKAKGSANTLDMHVARYLGYAYDHKKLKSQDHFMITKMMTFKNEFKIESRTLQGSRGNLISRIKNQDSIFKIQE

SEQ ID NO: 163616 - protein, 33 aa, Glycine max; identical to SEQ ID NO: 144085
  Coding DNA Sequence Number=SeqID_71931

SEQ ID NO: 163617 - protein, 389 aa, Glycine max
  Coding DNA Sequence Number=SeqID_71932
  Gene Ontology: Mol. function=transferase activity; Cellular component= cytoplasm; Biological process=metabolic process
  Homolog annotation: Hit_ID=A7PAI6; Match level="QueryCoverage=34%, HitCoverage=44%, E-value=1e-34, Identity=43%"; Hit description =Chromosome chr14 scaffold_9, whole genome shotgun sequence
  Pfam annotation: Domain name=PPR; Domain location=154-188; Score =21.3; E_value=0.0037; Accession=PF01535.11; Description=PPR repeat
  Pfam annotation: Domain name=PPR; Domain location=189-223; Score =24.9; E_value=0.00029; Accession=PF01535.11; Description=PPR repeat
  Pfam module annotation: Pfam domain module=PPR::PPR; Domain location =154-188::189-223
MLRNELELMNKSLEESEAQLQSRTVESNELVSQIALLKKEEERSLDKLNRMKNLKYEKELAGRVLQPELEALRTQYNDLKSYLLGDEAEKENVRKQVFQLKDYNKFYEAFSNNLKLGLDEDSQNKTKLAELLRIRDANKVLNEMTESKIEAQNITGNTLINAYYKFGELKSALKFKNKLLEAGLKHDPFTYEALIHGFYKTNELERANELMINMVDAGFTPSYCTFSWIGDGYNKKDNMDAVLALPDDNVADALLVPVTCSQDVLDLMRIVQKNRVVGATGRELVSNSIVKGCVDVVDLAELDQSNSVTESVCGGVPMICRPFFGDQGVAGRLIEDVWEIGVVMEGKEEGKKIRDNALKVKQTVQDATRPEGQAARDLKTLIEIISTTS

SEQ ID NO: 163618 - protein, 112 aa, Glycine max
  Coding DNA Sequence Number=SeqID_71933
MTPTHDALLYYNVRWNMSRQNEFVGYSFTGKNPKNFDILTGCTMDELKDLIKQVVSRGIPPYGVDETQMSLTDQVDPEVTDQVDPGSLLQIKVIRMLIHKKLTDELHPLTCP

SEQ ID NO: 163619 - protein, 282 aa, Glycine max
  Coding DNA Sequence Number=SeqID_71934
  Homolog annotation: Hit_ID=Q9ZSM7; Match level="QueryCoverage=100%, HitCoverage=64%, E-value=3e-72, Identity=56%"; Hit description =Putative uncharacterized protein
  Subcellular localization annotation: CTP_CleavageSite=44; ConfidenceScore=5.10e-01
MEQLGNVQCLPTDQNTLNKLMALNPGLNNHINNSHNMVNRGALSGSAQAALALNNYQNLLMRQNSTNSSPGSLQREGSSFNNSNQSPSSALQGASPALISGSMQNSSVSGFPSPHLPPQQQQHHLQQRSLSSNALLQQNHHGSQGNQALQQQQMIHQLLQEMSNNNGGMQPLSLGGPNAKNAMGFGGHTPSLSGGSANVPPSLSGGSANVPGNNGPMSRINSFKTASNSDSSAVGGNNRFNQRTSDMPQHLQNVVQDIGNEFTDNPFLNSDLDDNMGFGWKA

SEQ ID NO: 163620 - protein, 581 aa, Glycine max
  Coding DNA Sequence Number=SeqID_71935
  Homolog annotation: Hit_ID=A7QVK0; Match level="QueryCoverage=40%, HitCoverage=62%, E-value=4e-68, Identity=58%"; Hit description =Chromosome chr16 scaffold_189, whole genome shotgun sequence
  Pfam annotation: Domain name=F-box; Domain location=9-57; Score=21.4; E_value=0.0034; Accession=PF00646.24; Description=F-box domain
MSEVKNKVDFIQLLGPDMSIKILTHLDDPCDLIRVSAVSSSWHRFVIEQGLCKQLCLKMFPEISGVAHIVELDNIIEPLINTLGSYVNWESLKRIHRVYAFLASGLTPMRKNCISKSISASSTDNYPEESILHTLEPGDRTQYRASYWSSKGESHPSVPETLVYKLASKLCLVTEIYVHPFQAYFQHGFPIYSAKAVRFRMGHPRHPMELESAVDKMATNDVLGDNQFIWTYTSPEFPMFQVSCTIKMQMASTSDVVDCLDEEAFQNVGGANVWTHGGASNIMKALNPAFDSKEELLVPSWDLSPMLWGTLQLSSRWSIYARNRGSRATMCSTTKPSGHRAYTQQSGELGSCHIMNLAEGKRVDVFSVANYLVFMPRRKDSGKDMATIRSWFPNFTIVDKVEGTVLIEPDELFVSFGNRSETAVKGETLETQKQDSLPFLLRFNNPSQFCSLSLSLAFSVLSIVENCRSFAYLFSIIDKLDYYVHLCSISHVQAMGRSISPEFDVKIHHPSGKCTLKYCPQIDCYVSSSTSSQRSDSSNPSRLRTITSNIMQRGVRRWEQFLLSALLGTATDPVVVDNDDQ

SEQ ID NO: 163621 - protein, 55 aa, Glycine max
  Coding DNA Sequence Number=SeqID_71936
MAQVLLVVEQRIRTNKWRRLWEDQDQEKWKQQSTILRSFQGKMTSGYGESRWKQS

SEQ ID NO: 163622 - protein, 156 aa, Glycine max
  Coding DNA Sequence Number=SeqID_71937
  Gene Ontology: Mol. function=protein binding; Biological process =ubiquitin cycle
  Homolog annotation: Hit_ID=A7QVJ9; Match level="QueryCoverage=87%, HitCoverage=49%, E-value=7e-54, Identity=66%"; Hit description =Chromosome chr16 scaffold_189, whole genome shotgun sequence
MVSIYGDAQSNDPKAKMFKSVAYLQQMWWVEVIGELEFEFPKGNYSVFFKLQLGKPSKRLGRRVCNLDQVHGWDIKPVRFQLSTSDGQRSLSQCYLRGSREWAYYHVGDFAIDKPNGPTNINFSLAQIDCTHTKGGLCIDGVVICPKEFTQGLKQF

SEQ ID NO: 163623 - protein, 252 aa, Glycine max
  Coding DNA Sequence Number=SeqID_71938
  Subcellular localization annotation: CTP_CleavageSite=82; ConfidenceScore=5.20e-01
MVGAFSQNIVTLTGLPMILLSESDLTNPLCGVEGVTRVSIPLASVVNTRTQSSKFLLSPTNLVLACNAEFRDSPAFNSLSFKASAFEDPWRFGGVIALAQHLPPVVKDHCRRDETVQLKDLNGKKPWLVKADKLAKSSPPYDQKPPLSHSGDRSDSSSCACASPLGLYREEAPHQPVHHVAPAEGAHVSTSLRHDSCKITQVINAQVKAVVKGAFQGTQGLTIRWLSEAPSGTCHIDEGIVGSRKETMGFPP

SEQ ID NO: 163624 - protein, 288 aa, Glycine max
  Coding DNA Sequence Number=SeqID_71939
  Pfam annotation: Domain name=zf-GRF; Domain location=60-103; Score =33.8; E_value=6.1e-07; Accession=PF06839.3; Description=GRF zinc finger
MAERKGPPSPTRDHRMLLDALSQRMNQVLREHTEGMYERLESLENQNLNWENEQHGDRDRHEFEAPLVTSWTEENPGRRFYGCGLYKDTGRKGCNFFQWHDPVGNNRQKKIIVGLMKEVDELKLREKDLQAMISDMKMKEKCLWIVLVDGHVLTAGIYMWHDTIWKGRGAPCIDWEISIVQTYSLENKSGLPQLWCCRSGSIDKVDFVVKLSNSDIKRCSKICQADKARSSVPIVLNALLRWFYHDKDNALLLYSMVLNAASIPRPRGYAGLTFNGETGRPQTQLRAS

SEQ ID NO: 163625 - protein, 62 aa, Glycine max
  Coding DNA Sequence Number=SeqID_71940
MIQSFALDNNEEVMMRTSGFNPFFFTFENPMQPEEKLEESQEIVRDSAIAVGTYMSLVRGNG

SEQ ID NO: 163626 - protein, 196 aa, Glycine max
  Coding DNA Sequence Number=SeqID_71941
  Gene Ontology: Mol. function=DNA binding; Biological process =regulation of transcription
  Homolog annotation: Hit_ID=A7PM16; Match level="QueryCoverage=46%, HitCoverage=22%, E-value=1e-21, Identity=56%"; Hit description =Chromosome chr14 scaffold_21, whole genome shotgun sequence
  Pfam annotation: Domain name=NAM; Domain location=63-152; Score= -50.3; E_value=0.0088; Accession=PF02365.6; Description=No apical meristem (NAM) protein
MKTGVKIIHPSSYYGKVPVTRKGKRFVKPFKVTEDMDIDHLRLPNLLLTSCSVFNVSTEWPSFPLGVKFDPSDVELLEHLATKCGIGNTQQHMFINEFIPRLEGDHEICYTHPENLLGQTKKTKAIIEDGKEKLNIYSTSETSQYKKDTKTIPGESHAPKSDIQDQDFPGNAAWLAGESRAEESTEYDGCDDILLC

SEQ ID NO: 163627 - protein, 175 aa, Glycine max
  Coding DNA Sequence Number=SeqID_71942
MAPEDLEQLMQQIKDQLEESIPEKGLALPPEPKVGPSTAHVSTNESCVDPLGNDPDTGDSDKFKVGVEEVRDVDAPIHVPTAEVKLVGHALNTFLAWLTHLFKRLSEQVLCDATVFRLFNEDFPLYIKHEDLFEIPHDGQCLNIFVIQLRILPDNYLKGIINSIPIMLDHWNQRD

SEQ ID NO: 163628 - protein, 357 aa, Glycine max
  Coding DNA Sequence Number=SeqID_71943
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process =ethylene biosynthetic process
  Homolog annotation: Hit_ID=A7NX76; Match level="QueryCoverage=100%, HitCoverage=76%, E-value=5e-77, Identity=47%"; Hit description =Chromosome chr5 scaffold_2, whole genome shotgun sequence
  Pfam annotation: Domain name=2OG-FeII_Oxy; Domain location=192-289; Score=88.8; E_value=1.7e-23; Accession=PF03171.11; Description=2OG -Fe(II) oxygenase superfamily
MVATSTNQSELETSKKDSTYDRIAEVKAFDETKLGVKGLFDSGITKIPRMFHHAKVEDHTETTPNDSNFSIPIIDLQDIDTNSSLRVKALDKIRSACKEWGFFQVVNHGIAVDLLDEMICGIRRFHEQDAEGLNCFFVTPDPPYPEEIPAVCRDIVIGYSEKVRALGFTIFELFSEALGLHSSYLNELDSVDGQYLLCHYYPPCPEPELTMGTSKHTDISFMTILLQDQMGGLQVLHQNQWVDVPPVHGSLVVNIGDLLQVTTTSYQLELKTGKDSTCDRIAEVKDFDKTKIGVKGLLDSGITEIPRMFHHAKVEDHTETTPNGSNFSVPIIDLQDIDTNSSLRVEALDKIRSACKE

SEQ ID NO: 163629 - protein, 184 aa, Glycine max
  Coding DNA Sequence Number=SeqID_71944
LAIISEEQERITEPVSHGPASEREFPAQEFHILQSSVETRGIGRRREPVEAEQYSQQMMECGHGMYYTPATFSEYRSQMYQYPFAGHHTDTFETSHSFGGVAETQPHFSWLSKQKRGDNAAAEEILIVKREDGIDHAAHLHDITDTIMTNFDGLGVYGLWVSVAYGLGLRFMCLGLGLELMGLD

SEQ ID NO: 163630 - protein, 119 aa, Glycine max
  Coding DNA Sequence Number=SeqID_71945
  Subcellular localization annotation: CTP_CleavageSite=66; ConfidenceScore=5.19e-01
MTWMPPLLPAGKLVPPLTTAGTRIPPLATAALSLNRQYERRDRLSRRERGCTADSNGGTRRERGCPADSNGGTRREAVPPFLLAGHANVAVPPLPPTEHLDGKGHMHAESFLCSLCRLG

SEQ ID NO: 163631 - protein, 145 aa, Glycine max
  Coding DNA Sequence Number=SeqID_71946
  Homolog annotation: Hit_ID=A5B3J2; Match level="QueryCoverage=88%, HitCoverage=27%, E-value=2e-07, Identity=33%"; Hit description =Putative uncharacterized protein
MRGRTATGDLAPINLEIEATCRCSNTARKRKEQEAQGSSQTSSPPSPQSYIQMEEDHARRMTLEDYSSTTTPQFFTSIARPEVQAVNISYPYSLIQLIQGNIFHGLPNEDSYAHLATYIEICNTGKQKGSYTPLRVIACVLRKKS

SEQ ID NO: 163632 - protein, 131 aa, Glycine max
  Coding DNA Sequence Number=SeqID_71947
MEISSFHQFPMNPSTRRLTVSTDYSERCLHIGYSEPMQLNIFINGLRPQSKQLLDASAGAKIKLKIPEEAMELIENMAASDHAILCDRAYTPTKRSLLELTAQDATLAQNKLLSQQIEALTETLSKLPQQL

SEQ ID NO: 163633 - protein, 564 aa, Glycine max
  Coding DNA Sequence Number=SeqID_71948
MEVQVKFSPMRAMVFEIPRWPPGGHGVVQNTLAEKLAGGERVHLAGEGVCHHVGLAGAAAVVGENGERVPQKVLAPFFNGGGDGGELANIGRGVQELGEEGLAEKGDGVVLLRENDSYLDAGSISFVSHVIPAEGILRKEEGVGHCWTASILAGTGCTPPGETIWPKYSTSEVAKNLEGGLKMSQVLWEGAKGRVYCSLERRWGVAKPKRHYEELVMAMNQFAPPSLSKSSSIVGIGKRSFTVKYGYRYGRTLTGEAQGVGVSGDSKMKEFIDGVGLNHTTQLGGGDSFNVMGGIAAKFDDGPNDFNQWTPRTTSAPQMGRTWRSRVKGRGGLGGEVKVADEAGLHEVVRASAVHQNDHGAVSKAQLGHLGRPHQPLRERTERRSDALSRRKGSGGGFGGVGSKGVDEEGEEKTLGLGGGGKGRGFGGGGRVRGCNACTSQRMSGSKLEMKQLRSMEGCRPTIRLARDSNWLRGSRWGPRKVKVRIVPRVLLKNQPKWSASGFGSSTKTTLTLGPPCVGEEDEGYVFECAVCSRAEGLWSDMGGRNESTNFVMNKEGGNLAFET

SEQ ID NO: 163634 - protein, 87 aa, Glycine max
  Coding DNA Sequence Number=SeqID_71949
MTLNILVPGPKLAFALVSITLHMCLHCSSNFEHLHRWDVRNSIREERKRNHTKTIQNGGFNPFSFSLMFGNPIRAIGGKTRGISGNH

SEQ ID NO: 163635 - protein, 78 aa, Glycine max
  Coding DNA Sequence Number=SeqID_71950
MNYFDDGLGDVGSSAFGLVASGHDAIEELPALAKLHDKMHKIIVLEEKGENGTQEELSEKNRNVTDAKFVKYERTPNL

SEQ ID NO: 163636 - protein, 485 aa, Glycine max
  Coding DNA Sequence Number=SeqID_71951
  Homolog annotation: Hit_ID=A7PJZ4; Match level="QueryCoverage=50%, HitCoverage=65%, E-value=2e-15, Identity=27%"; Hit description =Chromosome chr12 scaffold_18, whole genome shotgun sequence
MVRTRGLGRALGAGRGRGISEDTHEVDVPLHRRLTASARRQRVRLREDVTERHEDVPQLHEDVPHVSDATQEMTGAADAVQTEGVATDGSLGSPAADEGFLGGPRDPSILTDFAEHVAHNIWSGQERPDLKLVSHGRKVDKIGRPAPEIEGLIAGTGLSPLIRCSVITTDPGLISAFVESFLRSVMRRLHLRPDRLVGLMSGWGGFGTCIKASAGPDDGLLQLARICSTWWAVLFSPTRVQPMDLAQARGFAWGATTLVHMYDHLNDASQASTRQLGGYITLLQCWIYEHFPIVHTSVVHDAYDDGSPRACRWLTGKAHMTGIKGVPYRRRLDALNVTDVCWMPYGSLTGDDIDDRWLHFSDHLVPSGELCVVPGQVAPDYMKWFFRISHPFITWTEETATPRHPPPPHHEEFVEPPIPEVLVAINLPTHSVDLGAIAEDLERVINLRMVIEGTDLHDIMTRCLRRARGDTAYESLRPRQRRRID

SEQ ID NO: 163637 - protein, 72 aa, Glycine max
  Coding DNA Sequence Number=SeqID_71952
  Homolog annotation: Hit_ID=A5AIX2; Match level="QueryCoverage=68%, HitCoverage=4%, E-value=8e-08, Identity=53%"; Hit description =Putative uncharacterized protein
MPFCLCNAPGTFQRCMLSIFSDFLESCIEGFISVLSRILARWPFHYPICCARRWSLILITGVKRLLIASSVQ

SEQ ID NO: 163638 - protein, 340 aa, Glycine max
  Coding DNA Sequence Number=SeqID_71953
  Gene Ontology: Mol. function=protein binding; Biological process =protein modification process
  Homolog annotation: Hit_ID=Q2PER1; Match level="QueryCoverage=93%, HitCoverage=97%, E-value=7e-97, Identity=59%"; Hit description =Putative uncharacterized protein
  Pfam annotation: Domain name=BAG; Domain location=159-237; Score =38.8; E_value=1.9e-08; Accession=PF02179.7; Description=BAG domain
  Pfam annotation: Domain name=ubiquitin; Domain location=69-138; Score= 13.3; E_value=0.012; Accession=PF00240.14; Description=Ubiquitin family
  Pfam module annotation: Pfam domain module=BAG::ubiquitin; Domain location=159-237::69-138
MMGMRNISSSNNNNKTNGHSSIMNNGGSDGNRAEPGSKEWEMRPGGMLVQMRTADSDRNPALVPTIRVRIKFGSIYHEVNISSQATFGELKKMLSGPTGLHHEDQKLFYKDKERDSKAFLDMVGVKDKSKIVLVEDPISQEKRLLERRKNAKMEKAAKSISAISLEVDRLAGRVSAFESIISKGGRVVETDLLNLIELLMNQLLKLDGIVADGDVKLQRKMQVKRIQKYVETLDVLKVKNSMSSSNGDHATVQLQQKHSNGQQQKHSNGHHRSALAPIQEQQQEQEQPPRNSTSGVVVTTNWELFDSVPPLIPVPSTSPSPHPSETNKSGPPKFNWEFFN

SEQ ID NO: 163639 - protein, 131 aa, Glycine max
  Coding DNA Sequence Number=SeqID_71954
MEDWGIFSTESLRRILLQLKCSSWCRGSTASNSDSRWSPVVVGGGKMKCQISLSAIPSRVGIVLSAPFSLSETSKVVIFKIPTVRLWNNVLGVTEHSIGVHSSLENISTQLENIETRLSLSNLLNLDEDEA

SEQ ID NO: 163640 - protein, 21 aa, Glycine max
  Coding DNA Sequence Number=SeqID_71955
MELRSVSPLNLYKGKQKISQA

SEQ ID NO: 163641 - protein, 138 aa, Glycine max
  Coding DNA Sequence Number=SeqID_71956
  Homolog annotation: Hit_ID=A5B4I5; Match level="QueryCoverage=47%, HitCoverage=3%, E-value=3e-09, Identity=46%"; Hit description =Putative uncharacterized protein
  Subcellular localization annotation: CTP_CleavageSite=60; ConfidenceScore=5.49e-01
MVKKTNKILFKGVVGANGLYSFHNLKLQESPSLLMSASAVSSAASSCSALTINNNSSTVMSNSVSSSFSIANLWHARLGHPNDHGFVLVVWVNLRLPSHTSTSVYSPVELIFTDLWGPSHITSYSGYKYYVSFIEAFS

SEQ ID NO: 163642 - protein, 152 aa, Glycine max
  Coding DNA Sequence Number=SeqID_71957
  Homolog annotation: Hit_ID=A5BSR3; Match level="QueryCoverage=49%, HitCoverage=25%, E-value=3e-08, Identity=43%"; Hit description =Putative uncharacterized protein
MGPVLPDSQRPFLGGCAKEGTGHPKIEHCPPHFKLLAEKTKKKLEEAAQSGSVDGVIDPPSPVKRHVKWKMTRTKKSGEMTTEAAKQIAEKIATPGSFVPHGRQDVLTAAIGRPEHPGHVRAVGTGVTIKQYFGSAPRTSRSSSLLPPEEVQ

SEQ ID NO: 163643 - protein, 320 aa, Glycine max
  Coding DNA Sequence Number=SeqID_71958
GHLVKFDEDALNTFLKNPMIIEEGETLPVYSRFALLRLDPQELAAKLCIPGRGFELNANGLPLKILRKNLTTIAQTWSMLSFSNLVPTSHTSDITLDMAKLIYGITQRMDMNVGYLISHQISMIAQHDSSRLGFPALISALCKAREVTSDSKMLERSRKAMGKKSETLPSSEVPLTTSASSTSTPAYSQLLIDATCHDAEPTPRVGHYYAELLELGPAIYHEHGRLSHLAQEPEPTAEHTPAAEDELTSPEPFSFAFDSVVAQEEVPSPEPIPKPSPAPISEDTLPSVPALEQEQPISQDPPATPALDLNEHAEDHPQED

SEQ ID NO: 163644 - protein, 110 aa, Glycine max
  Coding DNA Sequence Number=SeqID_71959
MAPKKLSAKRSRRDAVTEGTSAAPEFDSHRFRSVEHQQRFEAIKGWSFHRERRVQLKEDEYTDFQEEIARRHWTSLVTPMAKFDPEVVLEFYANAWPTEEGVRDMRSWVR

SEQ ID NO: 163645 - protein, 185 aa, Glycine max
  Coding DNA Sequence Number=SeqID_71960
METCPIAEELLQGLINEGQMEICSANKEEWKACMQSGDKNPSKPKPLVIHFTKDITTQRPRGFQPSIAKTPTPFPYKSDKAVPWKYGVQGPDGRKGTSIIRVRNGIPAAMIINIFGTSSMTCSGCIFAPPKLPARLKEKGKAKADIDEREKTGLTVNDKAPIGKIAKEGDDFSKREYQLRRRLSF

SEQ ID NO: 163646 - protein, 197 aa, Glycine max
  Coding DNA Sequence Number=SeqID_71961
  Homolog annotation: Hit_ID=Q0KIL1; Match level="QueryCoverage=52%, HitCoverage=11%, E-value=7e-08, Identity=35%"; Hit description =Gag/pol polyprotein, 3'-partial, putative
  Pfam annotation: Domain name=G-patch; Domain location=82-126; Score =16.8; E_value=0.0018; Accession=PF01585.14; Description=G-patch domain
MVVWAFDDSRHDVRGEIDLPIQIGPYTCQITFQEEGILVTCPSTTPYVEATEESLEASFQALEVVSNAYVESLPVQPRSFSAALMVARVMLGHGYEPGRGLGWNDDDMASLVEFKENRGRFGLGYKPACIDQGPQVGGTPLGHINDSFIITGWKCEWRIAMINDEDPDVDFERLVKNVEDEEDEDWGLPPELQRMVE

SEQ ID NO: 163647 - protein, 150 aa, Glycine max
  Coding DNA Sequence Number=SeqID_71962
MAPTRHPLDPDKSNRALGFPSLITGLYQSFGVPVAPTKVVRPPITRAFIEKYCTQRQAQGDAPQAAGAPPPPHQAGQAGAFDMEQYLRHLVRQQAANHRVHFRAEVAWPGDWPEAQAGVAPPEAPGDGEEAHEDEEMADLLDFLGGSGDT

SEQ ID NO: 163648 - protein, 127 aa, Glycine max
  Coding DNA Sequence Number=SeqID_71963
MSVEQFIKQVAWPRAQPSFDSDNGSSTAQAPQQQKLEPENNQSSEATIPGAFDVAKGRSQMRSGEATYPELVPVPADPPSPVVDPSSPVPEASLPSTPIIISDDPCHTLISSGDLCLITCDHSLVLV

SEQ ID NO: 163649 - protein, 45 aa, Glycine max
  Coding DNA Sequence Number=SeqID_71964
ASEARLMGALSKGGKMRGVTTSEGISTSHSLDHFGVTTMEPFEIP

SEQ ID NO: 163650 - protein, 108 aa, Glycine max
  Coding DNA Sequence Number=SeqID_71965
  Homolog annotation: Hit_ID=A5BEV8; Match level="QueryCoverage=62%, HitCoverage=9%, E-value=2e-07, Identity=41%"; Hit description =Putative uncharacterized protein
MADIFLKEKNSLEVMSDQKEMNLNRVVNWTFRTLYYDGIDSSRCGCVMRTTYGLSCAYELAGYVVGSIPLSVIHMFWRRLSFSYQGLSEPKVSITEEMETIFKRLKSL

SEQ ID NO: 163651 - protein, 73 aa, Glycine max
  Coding DNA Sequence Number=SeqID_71966
DQGVPTDPKRIKVIPDWPTPPTPLIELVRNHVPSWEDVHERGVKGRSPGYEEPRDLRSNPFQGGGHDAILPPK

SEQ ID NO: 163652 - protein, 142 aa, Glycine max
  Coding DNA Sequence Number=SeqID_71967
MNQKSAPVARLCGLCSSADHHTDLCPSMQQFEAIEQPEAYAANINNRPPQPQQQNQPQQNNYDLSSNRYNPGWRNHPNVRWSNPSKQQQQQQPYFQNVASLSRPYVPPPIEQQPQKQQTVEAPPQPSLEELVRQMTMQNMQF

SEQ ID NO: 163653 - protein, 235 aa, Glycine max
  Coding DNA Sequence Number=SeqID_71968
MTTLTQIWMTLLLSNILLRDHNADLPLLKYQLGSRPQDTQWTRRSPTGPWGFQLWLRASVSPIGCSSPPARSCHRDVGKDRAHKTPSGPEGVQQGPGVSTSGIAPARHLVDPEKSNRVLGFPALITGLFQFYGVPVAPNKVIRPPNNRAFIKKYCAPQASAGRDTTVAWGWPAAGNRRTASTFKAPQLIYKGWSFAYDPWPTSRQPSPKPKVSKSTRSVTDKSSRVQLKTLKKRY

SEQ ID NO: 163654 - protein, 103 aa, Glycine max
  Coding DNA Sequence Number=SeqID_71969
MGTSQNGKRFYQVKFKSLDVTSLKEFGRLMGPLQRQAFRKVYRKILDLAAAEVFTEAVVSLAQYYDHPLSCDWRFGKRVGSHEANSEWRSGPASEILGRQGKG

SEQ ID NO: 163655 - protein, 28 aa, Glycine max
  Coding DNA Sequence Number=SeqID_71970
MKSNKSEKAGLEKEMERTTPQSWEIDLS

SEQ ID NO: 163656 - protein, 256 aa, Glycine max
  Coding DNA Sequence Number=SeqID_71971
  Gene Ontology: Mol. function=transporter activity; Cellular component= membrane; Biological process=transport
  Homolog annotation: Hit_ID=Q1LNX4; Match level="QueryCoverage=78%, HitCoverage=40%, E-value=3e-12, Identity=29%"; Hit description=RND efflux system, outer membrane lipoprotein, NodT precursor
MASLGNTVLARVLLSSMATLGLTACMHTEMPALNDDIPTNWNHRATSQIAQNSQPWWHSLNDALLNNIAQTALTQNLSLQQASERIMYARALQQQELASEKPQLSFYAGPNNLSRALASNGAGSGQSNQSQLVSSGAYLAGFDLFWELPLFGQQSGQRQITQAELQISEADLSLKQISLISEIVRVYAELAAAVQRDKQLKMTETNYVNWKTSAIKGVEHAIEAPKSYPAGNRIAKTGCPMRIERSNEYMVAGVAI

SEQ ID NO: 163657 - protein, 120 aa, Glycine max
  Coding DNA Sequence Number=SeqID_71972
MSGRLLASSLPFESSILHYLMVCIVLPRSSNLAQALRLNAPFPNLHLVTLFLQHFNIPLDFEPYVPIKRSFLIGAVVIASFGYQKEHDGSWVKKGARPVDEEGHLHGGEDSCLLQKILDR

SEQ ID NO: 163658 - protein, 77 aa, Glycine max
  Coding DNA Sequence Number=SeqID_71973
MGEDFWSVVRYHLLKELGNFSEDYTRLFGGTKRFEELRMSLHVDGLTKHCCDLAIIILRRSRDQLHILAECSITRAS

SEQ ID NO: 163659 - protein, 54 aa, Glycine max
  Coding DNA Sequence Number=SeqID_71974
PPIELVWNHVPSWEDAQERGVEGRSPEFQEPLDLRSNPFQGGGDDAILTPKGIG

SEQ ID NO: 163660 - protein, 240 aa, Glycine max
  Coding DNA Sequence Number=SeqID_71975
  Gene Ontology: Cellular component=chloroplast
  Homolog annotation: Hit_ID=A7PHJ1; Match level="QueryCoverage=66%, HitCoverage=70%, E-value=2e-67, Identity=76%"; Hit description =Chromosome chr17 scaffold_16, whole genome shotgun sequence
  Subcellular localization annotation: CTP_CleavageSite=70; ConfidenceScore=5.55e-01
MSLMSSLLPPLASSSYINTAPKLKTTHTPNLVLGQRVLPNLLSLALAVTLASPLPSHAIPSLNSQPPPISLTTPFSQSKNLELGLENGKIRPCPSINPGCISTNPKSSSFSFPWLIPSNSSDDAIQKLREAILKTQKNVKFQPVEDTPDGQYLQAEVDGGFGRDILEFLVKGDVVAYRCVAMKVTYVYPFTTAFGDSKGQEARLKQINDQLGWYAPNSFEMLSYTCKLVELKNGTPSPLV

SEQ ID NO: 163661 - protein, 182 aa, Glycine max
  Coding DNA Sequence Number=SeqID_71976
  Gene Ontology: Mol. function=protein binding
  Homolog annotation: Hit_ID=A7QUT8; Match level="QueryCoverage=38%, HitCoverage=16%, E-value=3e-23, Identity=65%"; Hit description =Chromosome chr1 scaffold_180, whole genome shotgun sequence
  Pfam annotation: Domain name=Auxin_inducible; Domain location=18-117; Score=85.2; E_value=2.1e-22; Accession=PF02519.5; Description=Auxin responsive protein
MDLAKGKWKQNMIFKAWERCRLTSRPHLKLKSLSENDDDDHHEKKKKKNSQIAPHGCFSVHVGPERKRFVVKTKYVNHPLFQMLLEEAEHEYGFESDGPIWLPCNVDLFYKVLAEMDGEENHNNNNNIIFHGSRRSFTTMAKRYGFGIAQNKPIPLVSCKFVINVYIFLYTVVEYFWLVNPT

SEQ ID NO: 163662 - protein, 72 aa, Glycine max
  Coding DNA Sequence Number=SeqID_71977
MEINSPKLMRKLGKGIRKAFGGVGTRKFPAVQMIFKKELLLGSVHCSSLGRMSINNERPMMDDVIGVCKNIS

SEQ ID NO: 163663 - protein, 63 aa, Glycine max
  Coding DNA Sequence Number=SeqID_71978
MRLLPTTVMPRPALAWGAILLDESLVNRGPDDLAGGDGHSLELTEARNQSWKPQDPIGLLRVL

SEQ ID NO: 163664 - protein, 128 aa, Glycine max
  Coding DNA Sequence Number=SeqID_71979
  Gene Ontology: Mol. function=protein serine/threonine kinase activity; Cellular component=integral to membrane; Biological process=protein amino acid phosphorylation
  Homolog annotation: Hit_ID=A4L9R1; Match level="QueryCoverage=99%, HitCoverage=12%, E-value=2e-23, Identity=48%"; Hit description=LRR receptor-like protein kinase m3
  Pfam annotation: Domain name=LRR_1; Domain location=18-41; Score=9.4; E_value=5.6; Accession=PF00560.24; Description=Leucine Rich Repeat
  Pfam annotation: Domain name=LRR_1; Domain location=43-70; Score=5.1; E_value=34; Accession=PF00560.24; Description=Leucine Rich Repeat
  Pfam annotation: Domain name=LRR_1; Domain location=71-93; Score =12.8; E_value=1.3; Accession=PF00560.24; Description=Leucine Rich Repeat
  Pfam annotation: Domain name=LRR_1; Domain location=95-117; Score =9.3; E_value=5.7; Accession=PF00560.24; Description=Leucine Rich Repeat
  Pfam module annotation: Pfam domain module=LRR_1::LRR_1::LRR_1::LRR _1; Domain location=18-41::43-70::71-93::95-117
  Subcellular localization annotation: CTP_CleavageSite=60; ConfidenceScore=5.44e-01
MLNLLTGTIPSSFSNLTSLKHLQLAYNSFSSSHILSQLRNLRNLKTLILTGCNLLLCELTGMIPTELCKLSLRSLNLYENKLEGVLPPILVHSPNLYELKLFSNKLIGTLPRDLGSNSPLKHIDVSFN

SEQ ID NO: 163665 - protein, 126 aa, Glycine max
  Coding DNA Sequence Number=SeqID_71980
MGVIELCVEVDIVGASALNVTNSLLSCGNNITVNESKVLRFAINLDEDSNNDDYMISNSYVEDSLDEEEDIDDISNTNEEATRMIQPLTIMQPIKVTLIGVILMKKTSMVSIWHQPSILAKNYLLA

SEQ ID NO: 163666 - protein, 116 aa, Glycine max
  Coding DNA Sequence Number=SeqID_71981
MPLGSKSLRKSWSMATEEAHEDLKPIIVALRKPLPMGDPMEMMGGKAKDEFGVRIVNDGVGLLRLGSMVVLGGGGTCLGEVGVFVFVQVSWVVQETKSEVQEAYALTMVARVGSYH

SEQ ID NO: 163667 - protein, 84 aa, Glycine max
  Coding DNA Sequence Number=SeqID_71982
MEKGTSLPMEKDMMNARMKDGSGNLSFVLGPISNRLSIIGLVKRRTSLTSSAYPDINPDFYNLVGPNSFVKTTTSSLLVQQGPN

SEQ ID NO: 163668 - protein, 250 aa, Glycine max
  Coding DNA Sequence Number=SeqID_71983
MPIFVVKADGKVIYSDKVNGHFIWDVAPEMCDSECSYDDHDEDTNDEDEEFPSLDRKTNPVTKISTKSHIIPTEVGPKGKLKSLSQAEEVLNWQADNARAQNHLLKKINEKIDKIYTQVRTNDERLQYLSERMKKQYHQLSKEISYLEEEWRKPIFGAISNAKEREIRRFKAQVQDLDRYIKLKMIEKQKFVRSLLLFSPLLLLLAILHSRILQIIFPKASSSRSLPTTSAYKKKSELPKKKPVKLNISS

SEQ ID NO: 163669 - protein, 72 aa, Glycine max
  Coding DNA Sequence Number=SeqID_71984
MRQLVLEQASVCGKKGRIRHTLSWKRHIEEDTAYDWRGQFNMRVDTEKTGGTQNPHGLSISIEAKLKGKKFL

SEQ ID NO: 163670 - protein, 180 aa, Glycine max
  Coding DNA Sequence Number=SeqID_71985
  Homolog annotation: Hit_ID=Q9SD22; Match level="QueryCoverage=63%, HitCoverage=27%, E-value=7e-31, Identity=54%"; Hit description =Putative uncharacterized protein F24M12.290
  Pfam annotation: Domain name=Senescence; Domain location=23-179; Score=-105.2; E_value=5e-06; Accession=PF06911.3; Description =Senescence-associated protein
MIHQNDAEKTTRRPSSAPLEATKEALFRIPSAILNLIDKDYSVELVCGNFSVIRLRQGDNVVTMYACVADEIQWPLTKDVTIVKVDDSHYFFSFHVPKGSDPDEEEEDMLSYDLTIASKGQEGLLKELNGGFAERFGVRKEEGDDGGAVRDILVEGELIRTLGSGIWKFKRETREREVHE

SEQ ID NO: 163671 - protein, 97 aa, Glycine max
  Coding DNA Sequence Number=SeqID_71986
  Homolog annotation: Hit_ID=A7PF33; Match level="QueryCoverage=59%, HitCoverage=27%, E-value=5e-10, Identity=40%"; Hit description =Chromosome chr11 scaffold_13, whole genome shotgun sequence
MPLKCSIKGKPDISVTVQEVLEKARSEHVFKNSQKICEGVYFNRVADLISVVEVAASDRVGNITIYKDVMGKEAMKTEYRAFDELLGIEVAWNQVKL

SEQ ID NO: 163672 - protein, 41 aa, Glycine max
  Coding DNA Sequence Number=SeqID_71987
MRQRIQPDNLQDISNCYSEHFPTIASIVAHEDYHERKLHAC

SEQ ID NO: 163673 - protein, 107 aa, Glycine max
  Coding DNA Sequence Number=SeqID_71988
MKLGDMRGYRMVIRTFHQPGANKPVDTQRLTSSSAPFVILTHEGQRVRWQAEIPYGHPHLSSTEANEFDGIRMMFTLVVRRHSSPTMHKILLCWVGTIKFNSVCKLR

SEQ ID NO: 163674 - protein, 83 aa, Glycine max
  Coding DNA Sequence Number=SeqID_71989
  Subcellular localization annotation: CTP_CleavageSite=58; ConfidenceScore=5.04e-01
MTLLFSNILPSDHNANLPLQMYQLGSRLQDTQWTRRSPTGSWSCQALITGLCQFYGVPVTSSKGIRPPTNRAFIKKYCVPRKA

SEQ ID NO: 163675 - protein, 232 aa, Glycine max
  Coding DNA Sequence Number=SeqID_71990
GTNTGVLQRARKAWERVQKKDEELRGSSNGPIGSYHRWLKAYAQGLDWLPNLRTTKEVEGEASEEDEKVQALKTELERAQTTKEKSKSIAVSIRKENAELRDINIATIKALEQETKRARKEEHGRNKFRGALWGSNSKLKLQREERDQSYKEELNLATAHEHKVANEYARVYAEKEARGRVIDSLHQEATMWMDQFTFTLNGSQELPRLLAKAKAMADAYSAPEEIHGLLSY

SEQ ID NO: 163676 - protein, 186 aa, Glycine max
  Coding DNA Sequence Number=SeqID_71991
  Gene Ontology: Mol. function=rhamnulose-1-phosphate aldolase activity; Cellular component=cytoplasm; Biological process=rhamnose metabolic process
  Homolog annotation: Hit_ID=A7ML62; Match level="QueryCoverage=95%, HitCoverage=64%, E-value=2e-76, Identity=73%"; Hit description =Rhamnulose-1-phosphate aldolase
  Pfam annotation: Domain name=Aldolase_II; Domain location=1-161; Score=3.3; E_value=9.9e-06; Accession=PF00596.12; Description=Class II Aldolase and Adducin N-terminal domain
VDDKGLSYKIHWGLSNGGLPTSELAAHFQSHSVRKALSHGADRVIMHCHATHFMALSYVVDLDAARFTRLLWEGSTECLVVFPDGVGILPWMVPGTDGIGQATAEAMASHSLVMWPFHGIFGAGPTLDETFGLIDTAEKSSQVVVMALSMGGIRQSITTEQLIALGERFNVKPWPAALQAERSDVA

SEQ ID NO: 163677 - protein, 185 aa, Glycine max
  Coding DNA Sequence Number=SeqID_71992
MSVCSLVIPPLTKATNVIFNELKYPYSDLFPPLSTSVFSKSDFLPTAHIPLVSPSPNELTHSSQHAETNSTSISADPSRSLNIKFPNSQNLMSSSPLSNVEPNSVTNEHSNTVSDLNRYPSELSSTSSSQSHTVSSPSYNHVLPPQNVHPMQTRFKFGIHQSRLHPSLFMAHCEPKTVKQALADP

SEQ ID NO: 163678 - protein, 107 aa, Glycine max
  Coding DNA Sequence Number=SeqID_71993
  Gene Ontology: Mol. function=zinc ion binding
  Homolog annotation: Hit_ID=O93703; Match level="QueryCoverage=100%, HitCoverage=97%, E-value=1e-38, Identity=68%"; Hit description =Putative uncharacterized protein
  Pfam annotation: Domain name=SWIM; Domain location=41-80; Score=20.9; E_value=0.0019; Accession=PF04434.8; Description=SWIM zinc finger
MISTQTPKNPIKRLDVFYVLSEGVVVAGDVESKSRKGLLHYTRIVLDPLTMKITKASCDCEGYTFRHNCWHIKTLEQMIKEDRELRERIEKARQEMMQIEEDIASWG

SEQ ID NO: 163679 - protein, 354 aa, Glycine max
  Coding DNA Sequence Number=SeqID_71994
RSSKDKAAEGTCSAPEYDSHRFRSAEHQQRFEAIKGWSFLRERRVQLRDDEYTDFQEEIVRRRWASLVTPIAKFDPDIVLEFYANAWPTEEGVRDMRSWVRVLEEGQECEYGQRRNRADGFDEEAIAQLLCIPGQDFARTAAGRRVRIMRTNMTTLTQIWMTLLLSNIQPSDHNSDLPLPKCQLVYAILTRMSIHVAQLIADGPGISALITGLCQSFGVPVAPSKVIWPPITRAFIEKYCTQRQAQGDAPQAADAPPRHQAGPAGSFDTEQYLQHLVRQQAANHRAHPVEPGVATYPSAGGRRVTRGMRVPRKEYARSRHQRLFEENVGKTGKDANYELLSERFGSCIYARGRY

SEQ ID NO: 163680 - protein, 280 aa, Glycine max
  Coding DNA Sequence Number=SeqID_71995
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLDFDSLENVKKADDHDCLRMTTDFDSLENVKKADDHDCLRMTTDFDSLENVKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163681 - protein, 74 aa, Glycine max
  Coding DNA Sequence Number=SeqID_71996
MEGLATGYWDEMLSRLSYLSWLSCRFDSYCFNEYLFLVFLIERAGMEAGMEEGSSRKWHANELALVAWSGILLT

SEQ ID NO: 163682 - protein, 150 aa, Glycine max
  Coding DNA Sequence Number=SeqID_71997
  Subcellular localization annotation: CTP_CleavageSite=25; ConfidenceScore=5.04e-01
PSYEVPTSGSAPTNGSKTYLFQPVQAVHSVVNPHEGRSWGQVIVVVTLPTAGSVPHHDPTQQQLGWMQLAVMDSSIKASSARIQVVQVVHQHAGIMMAMDGGQGRRSRPGQVVEAGVGTYHEGVLVPVVSRDGLGRRREYINLACKSGSE

SEQ ID NO: 163683 - protein, 140 aa, Glycine max
  Coding DNA Sequence Number=SeqID_71998
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=74%, E-value=7e-25, Identity=69%"; Hit description=LacZ protein
  Subcellular localization annotation: CTP_CleavageSite=34; ConfidenceScore=5.01e-01
MTNNNLYIFKVFNTVLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163684 - protein, 66 aa, Glycine max
  Coding DNA Sequence Number=SeqID_71999
  Subcellular localization annotation: CTP_CleavageSite=57; ConfidenceScore=5.18e-01
GKEGRANGFNPSGIEKSIKISEKNCFREKNPSRGASVTLSRRFRKRFRGDSSPFFVLSSSFFGLQL

SEQ ID NO: 163685 - protein, 21 aa, Glycine max
  Coding DNA Sequence Number=SeqID_72000
MSRPVDSRSQPRYLGMGANGG

SEQ ID NO: 163686 - protein, 75 aa, Glycine max
  Coding DNA Sequence Number=SeqID_72001
  Gene Ontology: Biological process=transposition, DNA-mediated
  Homolog annotation: Hit_ID=Q1J7G7; Match level="QueryCoverage=40%, HitCoverage=42%, E-value=2e-10, Identity=100%"; Hit description =Transposase
  Subcellular localization annotation: CTP_CleavageSite=14; ConfidenceScore=5.08e-01
MVKVGTSTCPINVSFSPKVGPGLPRDLPSQWLLFLSAVPPVQLLTGWCVTAKAPPDISAGKCSGHAARNHHTRRA

SEQ ID NO: 163687 - protein, 192 aa, Glycine max
  Coding DNA Sequence Number=SeqID_72002
  Gene Ontology: Mol. function=hydrolase activity, acting on glycosyl bonds; Cellular component=cell outer membrane; Biological process =cell wall organization and biogenesis
  Homolog annotation: Hit_ID=A8GDP6; Match level="QueryCoverage=99%, HitCoverage=81%, E-value=1e-101, Identity=95%"; Hit description =Lytic transglycosylase catalytic precursor
  Pfam annotation: Domain name=SLT; Domain location=28-156; Score =125.5; E_value=1.5e-34; Accession=PF01464.11; Description =Transglycosylase SLT domain
  Pfam annotation: Domain name=Transglycosylas; Domain location=38-90; Score=-10.0; E_value=0.08; Accession=PF06737.5; Description =Transglycosylase-like domain
  Pfam module annotation: Pfam domain module=SLT::Transglycosylas; Domain location=28-156::38-90
SGTTRGGWLKPPPQAPVNRTGTPVAYNDYIRQAASNYGVDETLIKAIIQVESGFNPNVVSTSNAVGLMQLKASTAGRDAYRMKGRSGQPSSRELKDPAVNIDLGTAYINILQSQQLAGINNPQTLRYATIVSYVNGAGAMLRTFSSDKRVAVNRINQMSPDEFYQHIQKKHPAPQAPRYLWKVTTAYQAMSQ

SEQ ID NO: 163688 - protein, 163 aa, Glycine max
  Coding DNA Sequence Number=SeqID_72003
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MMMMWGLKKVIRIMLGDEEDDDDSSDCSEVSYSDFEENSDWTACPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 163689 - protein, 121 aa, Glycine max
  Coding DNA Sequence Number=SeqID_72004
ALRANAPLSYPQLITLFLRHFQISLDDEPFVQVKRSFAIGAGAVTSFGYHDRTPSPPPQRDDSALMIEVLSELWGLRSYVGECFDSLDTRFAGMDIRLTQLEEDVGYIRQSFDLPPPSPPS

SEQ ID NO: 163690 - protein, 118 aa, Glycine max
  Coding DNA Sequence Number=SeqID_72005
MWLKWVKTPVVLFGNHDERTKWHQKRKAPSTPSQVRFDRSRFTSQEAWERYINIVVPRKLLPEKNVVVYYTEFDEFKEQLERRHWDEELTDFTDSSIDVAIVKEFYTNLYDPEDKSPK

SEQ ID NO: 163691 - protein, 155 aa, Glycine max
  Coding DNA Sequence Number=SeqID_72006
MQSLQELAQQRPIMSVEQFIEKVAWPGARPSFVGDNESFTAQTPQQHELELENDHSSETIIPGAVDFSKGRLETRSNEAAHPEPVPVSADAPFPGVDPSSPQHAADSSIPVLEIPEGQTIPVLTLDTSPPATLVLHLIDEEDVQTQDTQDQSHEF

SEQ ID NO: 163692 - protein, 168 aa, Glycine max
  Coding DNA Sequence Number=SeqID_72007
MFDDGGAVTTIDGPRPLADKESPAKPKPLVIHFTRDVASQKPQGSQPISGRKPVPFLYQSDKAILWRYTPQKPSKKKKEATSIDLLFAKITNITDLSGVTRSSCLFIAPNPSGRPTDAKGKAKVVTKETSEASRTLEEDVPAERSRRLQRKESVHGRGQRVLPDHSVQ

SEQ ID NO: 163693 - protein, 184 aa, Glycine max
  Coding DNA Sequence Number=SeqID_72008
MMIWPLCRLYSIANNVLEFNEDGPIGGAGAGTGAGTRAGKGVGVEAGNCGRCGVKVDGAEGSSKVDEERVEVFGAAEVGGTSDLLPLAFLGPLNVTIGSSRFQQFFIYAKLMTGLRLSNDLESNVTPLALHKVVIKVGNPSQEESWLGNDRNLVGDEVAQIHVHLHDNAINQLGSIQCDVGSVG

SEQ ID NO: 163694 - protein, 89 aa, Glycine max
  Coding DNA Sequence Number=SeqID_72009
  Subcellular localization annotation: CTP_CleavageSite=50; ConfidenceScore=5.20e-01
MSGFTSDSPQISASPHQLDFAPYASRSYSAQWNASRLLLDKHTLRSSCILGKMEFEEPWLRLWLPLNYRVNMGARMAFVDNWVVGKEKG

SEQ ID NO: 163695 - protein, 417 aa, Glycine max
  Coding DNA Sequence Number=SeqID_72010
ATPIPAGTAIYTLEYYADPIKTEPPGTAAKYRDPRSPAGQTGQRGQLSPDTGQLPGGIRKNHADRPMGGRQGRSGLVFAGRERQPTGALRQLPDRRAAAGQRRPLRQERGAEPETPVRQPVGAVRPAVYRAGRLAPAAVPGDRRLPSDHQRRHSRSHALLPAPSAGKPDADPALAHPAAARHRQSAGARSAAGNGHAAASVYPSGSQTILRLPPGGADGTAGQQPPVRRSRRLGHRAAADRAVGPPVCLVGSAVGQAAGGAERQPPVRLSGGRSAGSRRCRGARLPAALFGAALDERRADRAADRRRQRPAAAGGAGAPGAVYPSHGRHRRMVQLPSAVRFFPAPALPVGAGAGAAGVAPRRRRGLAGAGVSGGGHSPCAGGQRRQHAARYPAATRLVAVPPQRTGLAGGVPQRAAL

SEQ ID NO: 163696 - protein, 187 aa, Glycine max
  Coding DNA Sequence Number=SeqID_72011
MHSCLCVFLVWLHCSLHSFLEIIIVVIVTKEKDCALRHPYQTRAKARIMSEIDEVHEQMKVNMEAMKEQMTTMMEIMMSMRKMMKDNTTTIIVVSTATEMDSIHPPDFNKVNRPISDVVGQGGKAVKNEYGLPPNYISPTVVYASGENISNFATALIENQQPQFDHAYVSHPMKFPKTILKLGPGFI

SEQ ID NO: 163697 - protein, 335 aa, Glycine max
  Coding DNA Sequence Number=SeqID_72012
  Homolog annotation: Hit_ID=Q2HW90; Match level="QueryCoverage=95%, HitCoverage=69%, E-value=6e-24, Identity=28%"; Hit description =Putative uncharacterized protein
MGTNQNGKRFYQVKIKDLDVTNLKELGRLMGPLQRQAFRKVYGKILDLTIAGVFTEAVVSLAQYYDQPLRCFTFGDFQIVPTVEEFEEILGCPLWGKKTVSFLRVSSLLEQDCSCGRRIGERVGSYEANSKQRSGPTAENTWKARQGIWQIKMSGVPFADILALLIFWDLFDTFDRRCEKNSARIVNCLPALCVWLVSHLFQQDIRHPCPLQSYHSCVVKRRVNWDQHLAGIGGSTINWFPRWKEGNEGVLFSCGDYPNVPLIGTRGCINYNPTLAIRQLGYPMRGAPTEESLSPFLVRDFGAQSLKVVQRVHKAWRSPLRKDKELRGIRNGIIG

SEQ ID NO: 163698 - protein, 134 aa, Glycine max
  Coding DNA Sequence Number=SeqID_72013
MGEVEEVQEKVKADMEAMKVQMATMMEAMMSIMEANAVVVAAARAIAKVNPMPPSHINQMNHPTSARVGKDLGSTSGPHYAQIQNKHAFPPYGSPPKEDVNNSTPILIESQQPQAIMHMSLNPWGRHMECPTTI

SEQ ID NO: 163699 - protein, 349 aa, Glycine max
  Coding DNA Sequence Number=SeqID_72014
  Homolog annotation: Hit_ID=A7R136; Match level="QueryCoverage=97%, HitCoverage=93%, E-value=2e-77, Identity=48%"; Hit description =Chromosome undetermined scaffold_336, whole genome shotgun sequence
MDYSNDNKEPWDWHREDYCLQRSFDYENSQGLWNGVPQNEDLSNVFNDETTPVKACGDFAYNVNNSGIYLCTSIYPPQVPLGWSLMHWVTVNFYYYCYSCILLLYAMLSLIQIRWISELQKESDKCLKSSDQIKRRRMLQFNTQDGGHFLSNEHMSSAYLKGKEESNEDVFPELSHWVSGASGSASASNYEDLESAEGWLADCFKDAEMQLCPDDLNFSGADAVQIDVADLCNFPPACEQNVLQHHVTQTPKNIVFKGGKSFIETPTKLAASVAYPFTFIKPCGAHGDVTLKEINQRILSPPPPLKSQQSMEDPSAYPKSAFSGKPVVGKTKIHIEGGKGSITIMRTKG

SEQ ID NO: 163700 - protein, 210 aa, Glycine max
  Coding DNA Sequence Number=SeqID_72015
MDLLDNKSIKMISIMIVVDQIQCHKRIKLASDMPKGTRGPHLAFLSRAELYPWPKRLSGSVGPKNKDSVRLDVRDSMLNTPSNLPFFIDAIETRWEHDDTLHMDHFYGFLYCRCAPIDVIIPSESHSLPTDDMMSFSRSNSSSKDTKTISPTLMSHRSMLHESQVQLGDEGEELDEDTSFEEDPSMDEEDPVTEPEFMKEDSSHDSSKES

SEQ ID NO: 163701 - protein, 134 aa, Glycine max
  Coding DNA Sequence Number=SeqID_72016
MSTSPNQCISVFSESEQKLHNQLLKIVKGTWPIVSRAIQESNGERKKHKHRRSRHIHIDAAQKELQGTSKAMPKSPYFRFPTEAILSERLSDTKCGNLSTGIRTFVRHVAGTISASPQVTIVEPLKHYNEKDKD

SEQ ID NO: 163702 - protein, 92 aa, Glycine max
  Coding DNA Sequence Number=SeqID_72017
  Pfam annotation: Domain name=zf-CCHC; Domain location=20-37; Score =33.4; E_value=8.2e-07; Accession=PF00098.14; Description=Zinc knuckle
MERSHNFNNGKISQEVSPTLKCYKCNQPGHIKANCPTNESWPKKNEKKSYKERRSKKAYIAWGDNDLSDGSEKEINLLSKDYESDENITQED

SEQ ID NO: 163703 - protein, 137 aa, Glycine max
  Coding DNA Sequence Number=SeqID_72018
  Gene Ontology: Mol. function=protein dimerization activity; Biological process=DNA integration
  Homolog annotation: Hit_ID=A3BRV8; Match level="QueryCoverage=51%, HitCoverage=10%, E-value=1e-17, Identity=54%"; Hit description =Putative uncharacterized protein
MVISDKWSSYKEDDVDKAKFVKETLMKDIWWDKVDYIHTFITPIYDVLRKTDTYLASLHLVYEMWDSMIKKWMYPPLELIHKRCTLSCSQSTTQVDVPSTCTTKDVPSNVLRQRSQAVKPLILCEWGYKRILRRFVL

SEQ ID NO: 163704 - protein, 266 aa, Glycine max
  Coding DNA Sequence Number=SeqID_72019
  Homolog annotation: Hit_ID=A5B939; Match level="QueryCoverage=47%, HitCoverage=80%, E-value=4e-22, Identity=46%"; Hit description =Putative uncharacterized protein
MNHKLGYSAQLCANLDPTKCVGRLRPHDDGHGSRNPLRSVVRHIPSHRGKDQAPMSRRVRLSLQNPGREPKQSGRRCSLGDSIKYSNENFEGRRGDSFYVNGTCTWEFEDVGEGSEKSYLFFNSLPILETAQPKVGFSDWNSTACRMVSSAPPTVLENPRTKCLSCPVILITASRLQGKGSRQNGSITSGEKLALKARHGGPSPEPVNFQWTAQVASMVRAGCHMPVGGRIGNGPFRASSEGVKQPTRSLLCSLRMLTQCDFCPMF

SEQ ID NO: 163705 - protein, 110 aa, Glycine max
  Coding DNA Sequence Number=SeqID_72020
MESSIVDASAASRKRRRDEDEEEELEQVFFIIVSVVTMLSGALTWYHDKYFVKEPTRNLELERHSFLNRLYRGTETDCIEQLRNSIGALDGIHIPVTVSAEDRPRYRNRK

SEQ ID NO: 163706 - protein, 50 aa, Glycine max
  Coding DNA Sequence Number=SeqID_72021
MEGGERRVKKGEGVRERALTAMNMSFNDDDNCDGEREVEKILSMMVRARG

SEQ ID NO: 163707 - protein, 132 aa, Glycine max
  Coding DNA Sequence Number=SeqID_72022
MKLAKYRLKAQVEKDKAPEWRWMKAQTYQGNPCGVYPELSSFTGSGVYPDLSSFTGSGVYPDLSSFIGSGVYHDLSSFTGSGVNPKTLQPTYQVNPCGVYPDLSSFTGSGIYPDLSSFTESDVIQISVTCIK

SEQ ID NO: 163708 - protein, 66 aa, Glycine max
  Coding DNA Sequence Number=SeqID_72023
MGSYLAHGPKIYPKAHENLRAFSCISGSRIYPEVHENPWAFFSSSSSILLEFLAHDSGDWSLPRVS

SEQ ID NO: 163709 - protein, 66 aa, Glycine max
  Coding DNA Sequence Number=SeqID_72024
NWVQHQATSKTNNNHQPTPSSNEEDEAAAAHDTGSNDVREKKQRKKKLRNNEQKRKKMEQKRKKTK

SEQ ID NO: 163710 - protein, 329 aa, Glycine max
  Coding DNA Sequence Number=SeqID_72025
  Homolog annotation: Hit_ID=A5C9E2; Match level="QueryCoverage=95%, HitCoverage=49%, E-value=1e-49, Identity=37%"; Hit description =Putative uncharacterized protein
KQLHRGTNDIVWYKETKWAAECAKAQAEAELSNAKQTVKDLFSMIGESMYKAKAEMRDMAPLKKYVKPRNDDNQYSRVMIELEHAKRELFQLKLHVGSVLEEKLQAENEVKASRSSMLSFSRVAQKLTNEIEEAREEQLVVQLDRMDALNELRDIEQLQNTRNKLKEAIQAIDETKELEMELATTLSDIDMLKNEFKFVREKPTKEEIEAAKKDLASITKQVFKFMASMYVTRKQLKHVSAATIHLKNKESKIGAKVRNLSYKLLREKSKLEAVSAAEEKAKSILSNLTQTLDKLKSKIEAAKKEKDLIINGEVAETKEEIKKALLEIK

SEQ ID NO: 163711 - protein, 260 aa, Glycine max
  Coding DNA Sequence Number=SeqID_72026
  Pfam annotation: Domain name=4F5; Domain location=207-258; Score =42.3; E_value=1.8e-09; Accession=PF04419.5; Description=4F5 protein family
MGAEQIGQSSKLRFDHVAFKHQITGFQVFKIRTPRKKLRKISIFRESDAAQVQDLKPGKIDTTRVIKRQNNIQQFQHHKGFAAEKQEGGQFYRTTQREVEVLDSVLRCSGNPCVHMNGIERARRTEAESCEGLVHVVHEDECVHPLSKEGTGFVVVVVMVAVVEDVREHYVRQITNPVSHCLQALDEGWKLFGFPHGSPPLEAILFRRDRDRERAQARTGGKGKQKDDGLTPEQRRERDAKALQEKAAKKAAQDAGGNNA

SEQ ID NO: 163712 - protein, 56 aa, Glycine max
  Coding DNA Sequence Number=SeqID_72027
MAVIWKEMTPKKLLAKRARKDATREGSSAAPQVDVEFDGHRFRSEEHQHRFEAIKG

SEQ ID NO: 163713 - protein, 102 aa, Glycine max
  Coding DNA Sequence Number=SeqID_72028
MGSKIYPEVHENPRAFFSSSSPILLESLAHGSGSLLNNKEKNKMKDCKNTSGEDVSFTSRISQSLTNSSQALKPAPASSSGLCRSSHSKISKNSLELGPFSI

SEQ ID NO: 163714 - protein, 95 aa, Glycine max
  Coding DNA Sequence Number=SeqID_72029
  Homolog annotation: Hit_ID=O98997; Match level="QueryCoverage=36%, HitCoverage=7%, E-value=6e-08, Identity=74%"; Hit description =Ribulose bisphosphate carboxylase/oxygenase activase, chloroplast precursor
  Subcellular localization annotation: CTP_CleavageSite=30; ConfidenceScore=5.54e-01
MALQLNLNGSGAGVSTPSSTFFGSSLKKVIASRVPNTKIPYEYISTGLRQRRGERRRHPLGNKPWKKEIHQQESALDKKLKEEASMDEKKRERRG

SEQ ID NO: 163715 - protein, 144 aa, Glycine max
  Coding DNA Sequence Number=SeqID_72030
  Homolog annotation: Hit_ID=Q6L477; Match level="QueryCoverage=42%, HitCoverage=10%, E-value=8e-07, Identity=31%"; Hit description =Putative uncharacterized protein OSJNBa0009L15.8
  Subcellular localization annotation: CTP_CleavageSite=67; ConfidenceScore=5.06e-01
MVLEEDRAMFGIELTTMATPPASPPPPLPPPPADASASPSTLKRTRKVTRLRSLATRPPGAERPVVNVDPATGKADGPHKKKLRTYLGIVARDKVDVTYDTWKEVPTAQKDLIWEDIQAEFEIPEASDSRTKKKIIQIVGERWR

SEQ ID NO: 163716 - protein, 75 aa, Glycine max
  Coding DNA Sequence Number=SeqID_72031
MTRVMSKMTATATKSISLKPLGRDGTVRRHLVEEIPIVTKGDAEVAEGAAGDGHVDDKLSVAEGGEEGAEAGNGN

SEQ ID NO: 163717 - protein, 99 aa, Glycine max
  Coding DNA Sequence Number=SeqID_72032
MKLAKYRLKAQVKKDEGPSGEGKSPRVEKDEGPSNPCGVYPDLSSFTGSGVIQNSVASLAIATMKVWLGRELAERDGHLDWRRRKGKGCGVDGSEQEEW

SEQ ID NO: 163718 - protein, 226 aa, Glycine max
  Coding DNA Sequence Number=SeqID_72033
MASMMEAMLDMKRLIESNAATAAATSTVVEADPILPSTANLAHQLAPNMVGQGRDTLGNTNSSCLGYNRSAYPYGLPPKEETHWDPCLMHPGASHDMETCSAVEQLLQRMIDQGRLEIGDEDEKEQHKPNERKEKATDTDSTSAKVTNITGLGGMTRSGRIFVVLDLSVRPVNANRKEKVVAEEANEANPTPDEDVPAGRFTEKGEGLGRKEVSLEEANEFLRIIQ

SEQ ID NO: 163719 - protein, 35 aa, Glycine max
  Coding DNA Sequence Number=SeqID_72034
MSYLSQDQRVRPQSAYGGLPQAKVVAKSVASKSGR

SEQ ID NO: 163720 - protein, 163 aa, Glycine max
  Coding DNA Sequence Number=SeqID_72035
  Homolog annotation: Hit_ID=Q6WAY3; Match level="QueryCoverage=90%, HitCoverage=6%, E-value=3e-08, Identity=28%"; Hit description =Gag/pol polyprotein
MLGHDYEPEMGLGKDNDGKASLVSVKGSRGKFRLGYKPTQADVRKNISGRENKGQGPRSGQQAKEVPPCHISRSFVSAGLRREGQVATICDEDSPRRSNLVQPCPLGFQLGNWRSHEGTNTGDPAVDFEQETSQMEDEEDEDVGLPPELERIIAREDREMKPH

SEQ ID NO: 163721 - protein, 57 aa, Glycine max
  Coding DNA Sequence Number=SeqID_72036
MRLKFGTGWEIEVQIKTDSLTKACRFDLVSQSLYLFRMLFVTCWQGQGLRCKHQFEL

SEQ ID NO: 163722 - protein, 115 aa, Glycine max
  Coding DNA Sequence Number=SeqID_72037
  Homolog annotation: Hit_ID=A5BP71; Match level="QueryCoverage=61%, HitCoverage=16%, E-value=6e-10, Identity=43%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MVIIVNAEAGGYVSMNYYQYIDVVYTNEHILKAYSAQWWPPGNEAVIPPSDDAWTLTPDLTTIRAKGRPKSTRIRNEMDWVEPFEHRQKCSRCGAEGHNRRRCPMQSERGSCSNR

SEQ ID NO: 163723 - protein, 108 aa, Glycine max
  Coding DNA Sequence Number=SeqID_72038
MAKHFSMECPGVFPWYVQVALGSYHFGKGGWKIFPRVITANWLAMRDGKRSSYVIGSGVNSGIGLGGKFLIALELPAGRVVVGVGTWGASLWTSALGCTGAELEEFPA

SEQ ID NO: 163724 - protein, 346 aa, Glycine max
  Coding DNA Sequence Number=SeqID_72039
  Gene Ontology: Mol. function=RNA-directed DNA polymerase activity; Biological process=regulation of transcription, DNA-dependent
  Homolog annotation: Hit_ID=A5ANM4; Match level="QueryCoverage=77%, HitCoverage=15%, E-value=4e-37, Identity=34%"; Hit description =Putative uncharacterized protein
MRTMNTSKLINVINDDNDQNLEQTTKEGSVSEKDINPINAKHWKTPSKLYYQRPTAHDLLLEERGKTQHFIGDPSLWKDRSAELLSNLKCRTLANFRWYRDTFLTRVYNRENSQQPFWKEKFLTGLPRLLGDKVRDKIHSQSVNGDIPYESLSYDQLISYVQKVALKICQDDKIQRQSAKEKAQTKRDLGSFCEQFGLLVCPKQKKKHNPKKGFHENKTFNKKRFLRRKYSHKPSTSKNTDTPKPNTKSKIVCYNWGKQSHISKYYRLKKKLRNLNLDPSIEEHINNLLIETSEEEIEDVSSKENLNVIQQDDQPSSTDDEDTQETNTLTRKHDPLFEAINSIPDP

SEQ ID NO: 163725 - protein, 247 aa, Glycine max
  Coding DNA Sequence Number=SeqID_72040
  Gene Ontology: Mol. function=transporter activity; Cellular component= integral to membrane; Biological process=transport
  Homolog annotation: Hit_ID=A8G7S8; Match level="QueryCoverage=98%, HitCoverage=57%, E-value=1e-123, Identity=89%"; Hit description =Major facilitator superfamily MFS_1
  Pfam annotation: Domain name=MFS_1; Domain location=18-240; Score =58.1; E_value=3.1e-14; Accession=PF07690.7; Description=Major Facilitator Superfamily
MNKATVAAKRWWYIMPIVFITYSLAYLDRANFSFASAAGINEDLGITKGMSSLLGALFFLGYFFFQIPGAIYAERRSVKKLIFWCLILWGGCASLTGVVSNIPMLAAIRFILGVVEAAVMPAMLIYISNWFTKSERSRANTFLILGNPVTVLWMSVVSGYLIHAFGWREMFIIEGIPAVIWAFCWWVLAKDKPAQAGWLSADEKQALQQQLDEEQKGIKAVRNYGEAFRSRNVILLCVQYFAWKHRR

SEQ ID NO: 163726 - protein, 73 aa, Glycine max
  Coding DNA Sequence Number=SeqID_72041
LTRKWALAADQDGVEDTICEKYDISKEKWAQFCQTRRDPSWEDSFEEQAALGSFVPHGRQDVLAAAIGRPEHP

SEQ ID NO: 163727 - protein, 246 aa, Glycine max
  Coding DNA Sequence Number=SeqID_72042
  Gene Ontology: Mol. function=transcription factor activity; Cellular component=intracellular; Biological process=regulation of transcription, DNA-dependent
  Homolog annotation: Hit_ID=Q6F9F2; Match level="QueryCoverage=56%, HitCoverage=60%, E-value=1e-23, Identity=42%"; Hit description =Putative transcriptional regulator
  Pfam annotation: Domain name=FCD; Domain location=109-233; Score =52.7; E_value=1.3e-12; Accession=PF07729.3; Description=FCD domain
MLNCKVFRRQHRFVTSSHFLVPGDDNRQIALLARGGLACSLTKQGVNSTAISSAKPFLEDHAELSSSPSARRNSSPVFKAAQPVDRHSPASRHSGLRISRRRGQSNAEQIYKIRMLLEQEAASDCARLANDDDKHQLYQQLQLIAQASREQDDIKRVEASQAFYETLFRVAKHTIAWEIVQRLNSRISRLRALTLASPERQVAGFERMSRIYDAIENNDPQQARQAVLEHLTEAAQLAKQILSSQE

SEQ ID NO: 163728 - protein, 153 aa, Glycine max
  Coding DNA Sequence Number=SeqID_72043
  Homolog annotation: Hit_ID=A5C5C1; Match level="QueryCoverage=95%, HitCoverage=16%, E-value=8e-18, Identity=36%"; Hit description =Putative uncharacterized protein
KVHYEAWERSNKLSLMFMRMIVADSIKTTLPKTDNAEEFMGLVGERSQTTDKSVAGTLMSTLTTMKFDGSRTMRMNQGAEKKFMKKHDKGKGPLKINDDSLQIQKKKCELNALGFPTIQTIIPDEKFALMENKVKGPMEATKTYRFKLDTNII

SEQ ID NO: 163729 - protein, 73 aa, Glycine max
  Coding DNA Sequence Number=SeqID_72044
  Homolog annotation: Hit_ID=A7P1M4; Match level="QueryCoverage=49%, HitCoverage=4%, E-value=6e-07, Identity=72%"; Hit description =Chromosome chr19 scaffold_4, whole genome shotgun sequence
  Subcellular localization annotation: CTP_CleavageSite=36; ConfidenceScore=5.07e-01
MDSFSGVVLKWKFLSGVDSGIFSFSKTAIDLVQRIRIGNVKVRKGSPLVTCLLEGSRGSGKTALSDTVGIDSH

SEQ ID NO: 163730 - protein, 79 aa, Glycine max
  Coding DNA Sequence Number=SeqID_72045
MGSIMDSTVYDHLEAQKQHGLQQPALHSRKSHGRGTIPYLVVAKGGILLGGLTYLVIVFTLTWAVALTAYAICCTLQYI

SEQ ID NO: 163731 - protein, 143 aa, Glycine max
  Coding DNA Sequence Number=SeqID_72046
MAAQLIHDRVMMECLEGVWETLEGNERCRFRGTIRLTTTSLVHPEQLAHTLQQPVEWILPTPTPCRLVELVQVIEVSSSEGDLEEDPEELPPEPAMDAPDLPEDDEDPVPDVDSPEDIMSASKANSTEESGPGGIAISDNSSS

SEQ ID NO: 163732 - protein, 316 aa, Glycine max
  Coding DNA Sequence Number=SeqID_72047
  Gene Ontology: Mol. function=oxidoreductase activity
  Homolog annotation: Hit_ID=A1FR89; Match level="QueryCoverage=41%, HitCoverage=52%, E-value=3e-65, Identity=92%"; Hit description=NADPH- dependent FMN reductase
  Pfam annotation: Domain name=FMN_red; Domain location=75-283; Score =86.7; E_value=7.7e-23; Accession=PF03358.6; Description=NADPH -dependent FMN reductase
  Subcellular localization annotation: CTP_CleavageSite=54; ConfidenceScore=5.12e-01
VDSRGSHCDEQHDLAAFQIGHGSSRVPARITGSGFISAPACRFAHRAPLVRRARAAVVRQVLDQAVHGIEVGPIADMAALAFTLHQPGLHQLLQVEAERGWGHLQGRGDVARHAPCRASLHQQAEGSQAARHDRARSGAATHPPALRLAAAAVVQPQAGAGSRAIAAPSGWSEGQVWVSPERHGTVTGVFKNQIDWLPLEDGSVRPTQGRTLAVMQVSGGSQSFNTVNTLRVLGRWMRMLTIPNQSSVAKAWQEFDDDGRMKPSPYYDRVVDVMEELVKFTLLTRGRSDYLVDRYSERKGDAHAAVLARAAGAAAS

SEQ ID NO: 163733 - protein, 170 aa, Glycine max
  Coding DNA Sequence Number=SeqID_72048
LIGRDAKGASPEDDVSLCMLHALSQMDSKRMFKRITPLGARMAIDKGDNHLGISACAQLHGLVMTEFDYAEEDVHLRVSTGSMFIGITTWVFPPATYLHGFVMIEIDCVEDVVNFRVSMGSDRDWQRVQKTTLVSTCYRALEIDSAEDDVNLRMSTGSLAAIDKWCRRRH

SEQ ID NO: 163734 - protein, 275 aa, Glycine max
  Coding DNA Sequence Number=SeqID_72049
  Subcellular localization annotation: CTP_CleavageSite=59; ConfidenceScore=5.13e-01
MARTCGLLKWRTCSPLKARTCSPLKARAWSPLKVRACNPLKMHATFVLKCGKCGLRMQQCNVVESCTMFMTFLLYFIGCPFERGDNSCNVILSFANLSGNSVRVYVLFDQGTYWVRTSNLPLGSLEVYAWCLSLPKCRALRKTFRNDKTRSHERPYFTGLGKDNGGITSLINARGNRGKFGLGYKTTQADIRKSIAGRKSESQGSRLRQEDEGSLPCHIIRSFISAGLGDEGQVVAICEDDAPSGSDLVRPCPPDFRLGNWRVEERPDIYATSIM

SEQ ID NO: 163735 - protein, 74 aa, Glycine max
  Coding DNA Sequence Number=SeqID_72050
MWMLIQVACEAIFGKRMMDGEVNLWDSQSRNDKVISWSSIFKTVFPDATNLLCRFHIDRNVKAKCKTLVAQKKA

SEQ ID NO: 163736 - protein, 236 aa, Glycine max
  Coding DNA Sequence Number=SeqID_72051
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGKAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 163737 - protein, 121 aa, Glycine max
  Coding DNA Sequence Number=SeqID_72052
LQVVPSVVRLMKQANVFPLKKTHKKFIIWEINNDKAILKEDFQASSRVPIINKDSEGHTLTISSTKTRVGLQTGQSNKDLMMRILKLAKYRLKAQVEKDEGPRGKGQNPRVEKNEGPSGEG

SEQ ID NO: 163738 - protein, 159 aa, Glycine max
  Coding DNA Sequence Number=SeqID_72053
  Subcellular localization annotation: CTP_CleavageSite=66; ConfidenceScore=5.08e-01
PRGEGDILTTCVFAVFHLVLLFVVKEVSRLWKAKSSAGSSLGNRSDSKVLGSTGLSCCAITRDSVHLSAVNSYMPSSFPDLVFVDERIEVGLRKGKFDCLALTNKKPRANEEKEKEEGTHVVAAIPTWPNFPPVQQCHYSADISPSHYPPPNHPQRPSL

SEQ ID NO: 163739 - protein, 211 aa, Glycine max
  Coding DNA Sequence Number=SeqID_72054
MTLLLSNILPSDHNSDLPLPKCQLVYAILTRMSIHVAQLIADAIYIFAGMVPTRHPLDPDKSNRALGFPALITGLCQSFGVPVTPSKVIRPPITRAFIEKYCMQRQVQGDAPQAADAPPPHQAGPAGLFDTEQYLRHLMSLSPQSQGLTSFPCPTPDQFRAEVAWPGDWPEAQAREAPAGALAEALDEADEAREDEEMTDLLNFLGGSGAT

SEQ ID NO: 163740 - protein, 146 aa, Glycine max
  Coding DNA Sequence Number=SeqID_72055
  Homolog annotation: Hit_ID=A5ZQM3; Match level="QueryCoverage=44%, HitCoverage=92%, E-value=2e-16, Identity=48%"; Hit description =Putative uncharacterized protein
HVWGLMLAQCPKVKEVGDLMTGEPTTEALVNRNRNYNDPKVAKFLIGPPSGGEELLVRYHSRRVRILTLCEDLRAEGQSQAEGSLTARPTRRAGRKVGLSDPTMPSGRTAAQQIKGWVVRPLKRYVSWVQNVVRQFGPYPMWALEH

SEQ ID NO: 163741 - protein, 56 aa, Glycine max
  Coding DNA Sequence Number=SeqID_72056
MVWCLQSSFFHLHSAAIDLQEAKDFIDEEDSRPTSSTWSYIIKEKEQATINCKHQG

SEQ ID NO: 163742 - protein, 443 aa, Glycine max
  Coding DNA Sequence Number=SeqID_72057
  Gene Ontology: Mol. function=protein transporter activity; Cellular component=membrane; Biological process=protein secretion
  Homolog annotation: Hit_ID=A1FZD0; Match level="QueryCoverage=100%, HitCoverage=93%, E-value=4e-59, Identity=80%"; Hit description =Efflux transporter, RND family, MFP subunit precursor
  Pfam annotation: Domain name=TonB_dep_Rec; Domain location=26-197; Score=1.9; E_value=0.045; Accession=PF00593.15; Description=TonB dependent receptor
EAAARRQGEAVPVTAQVVQSRQWSDTLQALGTAKARESISVTAKVSEIVEKVHFESGQHIAAGAPIVTLRGQAQEAALVQAQATFHEADQLYKRQRDAATQRRCRSATAGSTPDANWEGQRWSAGPRTGAGFATFALNAAYRFSSQLQLSAGVDNLFDRAYSEHLNLAGSADFGFPADPVRINEPGRSLWMKVNYRPPPPDALRRAASTLRWLSPPWAAGYTSTHADTAATSLAWNGFKALSRHWTVHVGSYRFDPGPWPQPGRAGRVRRQTGGRRTSAGRSGAGHRAGRAASVAWPGRTFEGVVSTIDARIDPATRAVTVRADFANGDHALRPGMLLDVRLFHPERPALVIPEIAVVQVGRDTFVYRITADDSVERVDVITGARRAGVVEIKQGLEAGQRIVVDGTGKLRPGLKVAAKDAAPASGAKPADAAAPVAAEGHGG

SEQ ID NO: 163743 - protein, 142 aa, Glycine max
  Coding DNA Sequence Number=SeqID_72058
MGKRKLELGFEDQKIDFDLFVEDKSALEHNICLQVMGEGQEVLKRLLLAKCIIVYVLSHEFQALSAQPWHLRLTNSAKLANVSYAKINSRSWSLALNLLAKQIFLRFKLDLMQLSATHDPAKRQHPPAKPNPVKKKLNFEFG

SEQ ID NO: 163744 - protein, 132 aa, Glycine max
  Coding DNA Sequence Number=SeqID_72059
MGRRQRTNLFVDELRSFGGGGGASIARYCDVSPCAYLPMGRSALWSLGKMLLSSNVIHIYVRVVMLVRMIRTRLFAAARVKSCPGMHSSCAIASLSSCARTVGHPPISGGGPGTDKSKLLAPHPGAQASIKH

SEQ ID NO: 163745 - protein, 84 aa, Glycine max
  Coding DNA Sequence Number=SeqID_72060
THLLLEVASPLSLPFFIPLPFIFQEAKEFIDEEDPRPTSSNGAYIKSSQEETTSSPSSSGSEDEVKGEEFSEEVYPHEEGDLLM

SEQ ID NO: 163746 - protein, 102 aa, Glycine max
  Coding DNA Sequence Number=SeqID_72061
  Subcellular localization annotation: CTP_CleavageSite=64; ConfidenceScore=5.29e-01
MSITSAQRLLTRILLPAPYHCHSAPTNKVRDHHSPNTCRKSKRSRLTQSVKFRNVAETKRRCCYATRPSGTFWKLGCLRRKQLGGKLLHIFEKWFPGLPRLP

SEQ ID NO: 163747 - protein, 171 aa, Glycine max
  Coding DNA Sequence Number=SeqID_72062
MAYTNWHLGRGRSELWSLGRTLLSSSVIHIWGICIEGDLVTPHPRVHVPNPLLRGPGVGIEFYDYLRVKFSHRGHLSFPTLASYLFLEVRLLVLPELDTPLPMERPSLDGLEALLVFGTLESVTVKLHGGAGAFPMGVPPGPLRGKLLRSHLLLGTINNANRAWKRKRMVT

SEQ ID NO: 163748 - protein, 47 aa, Glycine max
  Coding DNA Sequence Number=SeqID_72063
MGEGTIATYPSVGGRREAHGCVFQGRKARGVTTNVYLRKMSEKPKKV

SEQ ID NO: 163749 - protein, 121 aa, Glycine max
  Coding DNA Sequence Number=SeqID_72064
MKKIQDSREVDFKMQEKGTSFVVQVEGTSTWVVVTENKIGYISCGSVQVEGTSTWLFKENKGGYIPCGSFACKGFYKGEKKSQGAQVAWGLDEESKGCANSGLDNTFKPELAGKNICSNQV

SEQ ID NO: 163750 - protein, 318 aa, Glycine max
  Coding DNA Sequence Number=SeqID_72065
  Gene Ontology: Mol. function=phosphoprotein phosphatase activity
  Homolog annotation: Hit_ID=A5C6C9; Match level="QueryCoverage=72%, HitCoverage=20%, E-value=3e-21, Identity=32%"; Hit description =Serine/threonine protein phosphatase
  Pfam annotation: Domain name=DUF1723; Domain location=159-208; Score =47.7; E_value=4e-11; Accession=PF08330.1; Description=Protein of unknown function (DUF1723)
  Subcellular localization annotation: CTP_CleavageSite=49; ConfidenceScore=5.05e-01
MAYTRPKSSLRSYLKSQTLTMHTKNRNLNMPNKQRVPVIIANDELVVPTDSAVVHAAEPAEAVDESMVDADIQDTGVDTGAEAAADEPMGFPGGPTDPSVLTEYAEHVAASVWTGEERPELKLSSHRRKVQKLGRPVPAIEGLVAGTGLNPLIVCLADTDDRGLISSFVERWHREMSSFHLPVEEVTITLDDVVSLLHLPIIGDFHTFQPLHVDKAVLMLVDLLLVSPEAARAETGHCHGPAIDVHVVFFDALRDLSQTGRYAWGAAALVHMYDHLNDACISTSRQVAGLSYLISSGDHLFVGMRPSLNHFEVLGTHR

SEQ ID NO: 163751 - protein, 176 aa, Glycine max
  Coding DNA Sequence Number=SeqID_72066
  Pfam annotation: Domain name=G-patch; Domain location=16-60; Score =4.3; E_value=0.056; Accession=PF01585.14; Description=G-patch domain
IASVDSFSGQPCLSDTAMIVARVMLGNCYNPGMGLSKNGGDRTSLISTRGNRGKFGLGYKPTQADIRKSVAGRKSGSQGSQLGREVEGSPPCHISRSFISAGLGHEGQVIAICEDDAPSGSDLVRTCPPGFRLGNWKVEERPDIYATSIISDDESLEGTNTWDPTIDFKQETDQTE

SEQ ID NO: 163752 - protein, 280 aa, Glycine max
  Coding DNA Sequence Number=SeqID_72067
MTEKLASETKIEKALMEEEVDPSIKEKHKENRVTNVGYEDDFLDKPITDLIKKEVEDFIMKRVGASMALESWNFNLLGEPLAFDFVMSMHESSTMEPRQKGLANGFRVDPPWRDTKEAYPVSVNDSVLKDEKKGEEKLGVQTGWKDFDRGGKKMGKGERKNGDTHGSYGESDRGESQSSRIAVELDRRDDTKVAAAWEKKSPMMNVHTVDVSEGDKGKRTNWRESSGLVPMVGILEYKPFLGWVQDCYHPKVSGFESGKSFSSVAGTGTRRDSAGIHSPI

SEQ ID NO: 163753 - protein, 120 aa, Glycine max
  Coding DNA Sequence Number=SeqID_72068
  Homolog annotation: Hit_ID=A7PXB7; Match level="QueryCoverage=67%, HitCoverage=13%, E-value=4e-18, Identity=59%"; Hit description =Chromosome chr12 scaffold_36, whole genome shotgun sequence
MQPQFSQINISVTWRGKKFVVEMNIGANVKDLGQELQKLTNIKEDTMRFIVPQISARTSKLLAPFSKEHALLSLQETSITEIRYTILLIPQSDKHSLKENQSKVIIEIYMCYFPNCSILY

SEQ ID NO: 163754 - protein, 120 aa, Glycine max
  Coding DNA Sequence Number=SeqID_72069
TSSIFGQDVQDIVSDIVDPAASILHLTLHLALCIHHHYHNFPQHYHLSKPPPPSHTTNQNCIDVTVIDVPFGQGNNFHCAEHPQVLRKVPCKGIEGIVVGLAPDAEDDEAVVGEEEGVGE

SEQ ID NO: 163755 - protein, 90 aa, Glycine max
  Coding DNA Sequence Number=SeqID_72070
MGGANSNFEILNWAFQSIFRSWIASGGSKPDRLGELGGNLLPLFLINRLKGTIPRIPQPPGYRIREGFPSFFTVLHPFFIRSSFVLRSST

SEQ ID NO: 163756 - protein, 74 aa, Glycine max
  Coding DNA Sequence Number=SeqID_72071
  Subcellular localization annotation: CTP_CleavageSite=50; ConfidenceScore=5.32e-01
MGLPGLKEHSNPVTPKAYTPKSPSGPLPPDSGLGSSSSMDSFASWKINGSGMEKEEREEMPLQGEDESRRSSPP

SEQ ID NO: 163757 - protein, 27 aa, Glycine max
  Coding DNA Sequence Number=SeqID_72072
MQRIHISRLVDKYEDDYQVLRFLLMHY

SEQ ID NO: 163758 - protein, 152 aa, Glycine max
  Coding DNA Sequence Number=SeqID_72073
MMLKLEPNSDEESERRSAQEAYPRGGSMVYGEFPTATSCVTVTQTLMCLMGLGRVRSAQLRMTYKGLLEVAEDGEERAEAIDGGVPAMAAEEELVLGDIVVHDGAQWWCPSHGRGGRACAGRHHGPRWCAQQQGHRGGTPPRPKGCQGTGRG

SEQ ID NO: 163759 - protein, 203 aa, Glycine max
  Coding DNA Sequence Number=SeqID_72074
  Gene Ontology: Mol. function=3,4-dihydroxy-2-butanone-4-phosphate synthase activity; Biological process=riboflavin biosynthetic process
  Homolog annotation: Hit_ID=A7NZ72; Match level="QueryCoverage=21%, HitCoverage=9%, E-value=2e-10, Identity=70%"; Hit description =Chromosome chr6 scaffold_3, whole genome shotgun sequence
  Subcellular localization annotation: CTP_CleavageSite=56; ConfidenceScore=5.38e-01
MSPPLLGPHNHSQTHLKLSRRLPFPALVSTDLHTTKSLKLSRTWTFLSLELSRHAEASRKGQTPLKNLISGLNRWLCSCSGWLEAVRLAGWPFDQRTSTVHPSSRFFLALSRGLLRSVNGSLSQQIGLAGGFVPIQVFHPNFMIIIDDENEDVEENIIMAASLTSPKDIAFMIKHKLGIVSIGMKDKDLQRLNLPLMSPETER

SEQ ID NO: 163760 - protein, 73 aa, Glycine max
  Coding DNA Sequence Number=SeqID_72075
MQYQCSSPPPAVDIEMEKCTKPGSGAAKAELRKRRRKRNEEETNTNRKNKREASTAQRVVEVVGLNGRTKNSG

SEQ ID NO: 163761 - protein, 375 aa, Glycine max
  Coding DNA Sequence Number=SeqID_72076
  Gene Ontology: Mol. function=unfolded protein binding; Cellular component=cytoplasm; Biological process=response to stress
  Homolog annotation: Hit_ID=A8IXR4; Match level="QueryCoverage=68%, HitCoverage=43%, E-value=1e-116, Identity=78%"; Hit description=Heat shock protein 81-4
  Pfam annotation: Domain name=HSP90; Domain location=46-366; Score =387.4; E_value=2.2e-113; Accession=PF00183.9; Description=Hsp90 protein
MEYDAKSGQYAKKSYTIFNKSSIPRFEAGVVVVSRLKFDEMQMLHLHVVKIATSRKKHSEFISYPISLWIDKTIEKEIFDDEDEEENKDEERKVEDKPIWMRKPQEITKEEYVAFYKSVANDLEERLAVKHFFVEGQLESKAVLFIPKRAPFDLFDTRKKPNNIKLYVRRVFIMDNCEELMPEYLSFVKGILCSEDLPLNISREMLQQNKILKVIRKNLNKEDYNKFYEGFSKNMKLGIHEDSQNKTKLVELLRYDSTKSGDEMTSLKDYVTRMKEGQNDIYYIIGESNKAVENSPFLEKLKKKGYEVLYMVDVIDEYVVGQLKEFEGKNLVSATKEGLKQVKNVDVLAEREASWSQHVLVLEHFPMFKCFSWKL

SEQ ID NO: 163762 - protein, 46 aa, Glycine max
  Coding DNA Sequence Number=SeqID_72077
MGLCVELRKRKTQNDNRNTKPCFSTPMGDRFSRFSTVDMFIYFGNE

SEQ ID NO: 163763 - protein, 168 aa, Glycine max
  Coding DNA Sequence Number=SeqID_72078
MMTITTKHLPRVWMRYLNKELKFHHTHIGGVGGSSNADDDASAVCFLFFFVFFFNLGVGTSALGATTGVGVVGTSAGGELTGTGDGGELIGSGTGGKLTGVTAGGVAVGGVAAGGVATGGVIAGAGAAALNGGDATMGDGTRGVAVATLGMKMEKMKWEKQQAQLILV

SEQ ID NO: 163764 - protein, 159 aa, Glycine max
  Coding DNA Sequence Number=SeqID_72079
MDCCCMRFMLPEDLGNVNPMHEFIWGVVTMLDILGGVSYPNFVRGLLFIDLLILASRLTPGPPNDFRVKEPARLGKPVTSGVSLSSLGRAAYAPSAHFPINRCAREAEEGLQGLEVEGIERREKEEEERRGNEVEALPNHNCDQSLHCSLFGVFRAIVG

SEQ ID NO: 163765 - protein, 100 aa, Glycine max
  Coding DNA Sequence Number=SeqID_72080
MPSSFSGIDRPLASLYDFKSGKFHLVTYQRERKRHAYSRHLLKDPNGQIMEKCLVKLQTNLREDPTVNEVWAAFLPRQLHVASLRSFIKRLPQEASSWLL

SEQ ID NO: 163766 - protein, 79 aa, Glycine max
  Coding DNA Sequence Number=SeqID_72081
MGTNQNGKRFYQVKVKGLDVTSLKELGRLMGPLQRQAFCKVYQKILDLTAAEVFTEAVVSLVQYYDQPLRCFTFGDFQM

SEQ ID NO: 163767 - protein, 123 aa, Glycine max
  Coding DNA Sequence Number=SeqID_72082
  Subcellular localization annotation: CTP_CleavageSite=51; ConfidenceScore=5.29e-01
MTDPINQHDTFSTCFVLTHTLLEKLSKRCRNMPFCGRARRGSRVCFPKEERCAESPPTFICGKRWKNRRKPVDKSGAFAPTYPPSKRKSDLRSSFLRVNHAISFYLKGDHLKVLDLKNDPFTW

SEQ ID NO: 163768 - protein, 66 aa, Glycine max
  Coding DNA Sequence Number=SeqID_72083
MCMPCISHNQQQMIQVTNDVIRSYAQAMPFLDPRIESLLVQARFSDVAKLGQIKIDDALVTALVEK

SEQ ID NO: 163769 - protein, 163 aa, Glycine max
  Coding DNA Sequence Number=SeqID_72084
MTIDELKILNIPSEMFKLFNHSIFPHRGHPTSMQQGQTYILIARFPDPNHGVKTVFRRKRKTYNDGSKVRKDAKISLNYQGTSLKSRLPRRKPRRVPLGVGFQRRATAAYGGHRWLWVVEKKLGTLEMVLGKRKRKERLFFQGYTKNKACNTQVFLLSGKEAS

SEQ ID NO: 163770 - protein, 49 aa, Glycine max
  Coding DNA Sequence Number=SeqID_72085
MGARDKSIMHKGNKNPDPVNDLVHAHSDPVMVQMMDLEKEAGLALVQMA

SEQ ID NO: 163771 - protein, 176 aa, Glycine max
  Coding DNA Sequence Number=SeqID_72086
  Homolog annotation: Hit_ID=Q2HW90; Match level="QueryCoverage=90%, HitCoverage=29%, E-value=1e-22, Identity=39%"; Hit description =Putative uncharacterized protein
MANQEEWVPFADIIALLIFGVVLFPNVDGLVDLAAIDAFLAYHHSKESPVVAILADLFDTFDRRCEKNSARIVCCLPALSVWLVSHLFQQDIRHPCPLQSYHSCIEKRRVDWDQYLAGIGGSTINWFPRWKEGKEGVLFSCGDYPNVPLIGMRGCINYNPALAIRQLGYPMRGALT

SEQ ID NO: 163772 - protein, 100 aa, Glycine max
  Coding DNA Sequence Number=SeqID_72087
MEQISVKVHPEPLAGHEVSHRVKDIITIFGKTQRKDHADKNIWKKRQDKRWSEMSSGFGGDGYTIAVSSTGQRSPNVFFLCMLHNVNQGEETILQLFEKC

SEQ ID NO: 163773 - protein, 154 aa, Glycine max
  Coding DNA Sequence Number=SeqID_72088
  Homolog annotation: Hit_ID=UPI00016621D1; Match level="QueryCoverage =85%, HitCoverage=40%, E-value=1e-11, Identity=32%"; Hit description =UPI00016621D1 related cluster
MTGPLDESIFCFLIWVDPWVLVPIAFRGLHVLDFRGLHALAFRGLHVLAFRGLHALTFKGLHALTFRGLHILTFRWLHVLAFRGLHILTFRGLCVLAFRGLHTLAFRGLHTLAFTGLHALAIKGLHVLAFRGLHTLAFRGLHILTFRGLDALMF

SEQ ID NO: 163774 - protein, 197 aa, Glycine max
  Coding DNA Sequence Number=SeqID_72089
  Homolog annotation: Hit_ID=Q6WAY4; Match level="QueryCoverage=85%, HitCoverage=30%, E-value=8e-22, Identity=37%"; Hit description =Putative uncharacterized protein
MGTNQNGKRFYQVKIKSLDVTSLKELGRLMGPLQRQAFRKVYGKILDLTVVEVFTEAVVSLAQYYDQPLRCFTFGDFQMVPTVEEFEEILGCPLGGRKPYLFSGFLPSLSKIAAVVGDSAKELDRMKQTRNGVVGLPRKYLEGKARDMASQEKWVLFADILALLIFGVVLFPNVDSLVDLAAIDAFLAYHHSKESPV

SEQ ID NO: 163775 - protein, 30 aa, Glycine max
  Coding DNA Sequence Number=SeqID_72090
MVDPIFALGDQDFFFPDVSPLLLRQPQQKV

SEQ ID NO: 163776 - protein, 45 aa, Glycine max
  Coding DNA Sequence Number=SeqID_72091
MSETLEVRDNFLATKGEEFEEVFPSSVPSRLPPLRGIKHQIDLMS

SEQ ID NO: 163777 - protein, 64 aa, Glycine max
  Coding DNA Sequence Number=SeqID_72092
MVSEDIEKTMFVTLWGTCCYKVMSFRKATRLRCIRKDQEMPYESSCAYAFGAQEASYPIHDSVG

SEQ ID NO: 163778 - protein, 89 aa, Glycine max
  Coding DNA Sequence Number=SeqID_72093
MVAKETNEANPTPDEDVPVGRFAEKGEVLGRKEVSLEEANEFLRIIQQSEFKVHVTQDISIEGFEGIVNNITANNYLTFAEEEIPVEGR

SEQ ID NO: 163779 - protein, 221 aa, Glycine max
  Coding DNA Sequence Number=SeqID_72094
  Gene Ontology: Mol. function=methyltransferase activity; Biological process=metabolic process
  Homolog annotation: Hit_ID=A6EJN2; Match level="QueryCoverage=97%, HitCoverage=96%, E-value=9e-66, Identity=56%"; Hit description =Putative uncharacterized protein
  Pfam annotation: Domain name=DUF752; Domain location=3-221; Score =121.8; E_value=2.1e-33; Accession=PF05430.2; Description=Protein of unknown function (DUF752)
MEFVTTGDGSKTLFNAEIGECYHSTHGAVQESRHVFVKTGLEHYVQTTGATDVDILEVGFGTGLNFLQTADFLQDKSFRVEYVGIEGFPLPLSTVAATGYETTVDPKIWTDYLDTYERALVENVQLNERLKLYIDHTLLLNFQSERLFDVVYFDAFAAVHQPEMWNDAALGHIAQFIKPGGVFVTYAITGNLKRSMKALGFSIEKAPGAPGKREMLRATKL

SEQ ID NO: 163780 - protein, 29 aa, Glycine max
  Coding DNA Sequence Number=SeqID_72095
MWEDEFVRYNIRVGQEKDRSGSWLAGVSE

SEQ ID NO: 163781 - protein, 88 aa, Glycine max
  Coding DNA Sequence Number=SeqID_72096
MAYTHIPDSTSDSPQISASPYQLDFTLYASGSYNAQWNALGLLRDKHTLRSSRILGEMEVDEPRLGLWLPLNYQVDVGASQHRTLELG

SEQ ID NO: 163782 - protein, 43 aa, Glycine max
  Coding DNA Sequence Number=SeqID_72097
MKTPPPSFLIFAGAGVLAQDNRLPCSGVFHLSRARQGTTTHRS

SEQ ID NO: 163783 - protein, 181 aa, Glycine max
  Coding DNA Sequence Number=SeqID_72098
  Gene Ontology: Mol. function=aspartic-type endopeptidase activity; Cellular component=chromatin; Biological process=chromatin assembly or disassembly
  Homolog annotation: Hit_ID=A5B2I6; Match level="QueryCoverage=65%, HitCoverage=5%, E-value=5e-14, Identity=33%"; Hit description =Putative uncharacterized protein
  Pfam annotation: Domain name=Retrotrans_gag; Domain location=1-88; Score=36.4; E_value=1e-07; Accession=PF03732.8; Description =Retrotransposon gag protein
MVAMEGKALTWYQWWEFCEKNPNWTDFKNAVIQRFQPSMNQSPYKLLLSLKHEGTVEEYREKFELYAGPLRGTELEYLKGIFLNGLKEVVRAELKLDPVNTLPELMDYAQWIEEKNSLMEKGNVGGLLGGCQTRNSKKGQKKDFVTAVMGNLALVIQQQQQQQQQRLIPLGGVGYMDQLPS

SEQ ID NO: 163784 - protein, 165 aa, Glycine max
  Coding DNA Sequence Number=SeqID_72099
  Subcellular localization annotation: CTP_CleavageSite=54; ConfidenceScore=5.21e-01
PSSFTPIAGIPASSTSALPPALADYLPRALRLQMPNVKACLKDRFSLYKASQAPQQHESKPENNHPSEATISRAVDCKKRRLETRSNEPAHHGPVPASANAPFPGVDPSSPQHIADSSIPVSEIHKGQTIPVLPLDTSPTATPVWHLPDEKNVQIQDNQDQSQEF

SEQ ID NO: 163785 - protein, 66 aa, Glycine max
  Coding DNA Sequence Number=SeqID_72100
MGAKYLEVVKRGSHPNNGRSPDEIRYRHIIQIPSNSFLWVDARRRMTIICLYVLLDTIEPRRQDAE

SEQ ID NO: 163786 - protein, 76 aa, Glycine max
  Coding DNA Sequence Number=SeqID_72101
MGLCQFYGVPVTSSKGIKPPTNRAFIKKYCVPRQAQGETPQQPEDGRQRATDAPPSPLEFTSAHPQKGRKIPWICM

SEQ ID NO: 163787 - protein, 264 aa, Glycine max
  Coding DNA Sequence Number=SeqID_72102
  Gene Ontology: Mol. function=motor activity; Cellular component=cell projection
  Homolog annotation: Hit_ID=UPI00016621D1; Match level="QueryCoverage =92%, HitCoverage=41%, E-value=3e-18, Identity=28%"; Hit description =UPI00016621D1 related cluster
GLHAVAFIGRDVLAFIGLHALAIRGAHVLAFIGIHTLAFRGLHVVTFRGLDILAFRGLHVLAFRGLHILTLRGLHTLAFIGLHAHAIRRAHVLAFRGIHALAFRRLHVLSFRKLHVLAIRGIHILTFKRLHVLAIRGLHVLAFRGLHTLAIRRLHILAFRGLHALAFRGLRVLTIRGLHTLAFIGLDSLAFIGLDMLAFCGQYALAFRGLYALAFTGLHALAFRGLHILTFRALHALAFRGLHAQTFPSEGNTPSPSEDYTSSP

SEQ ID NO: 163788 - protein, 50 aa, Glycine max
  Coding DNA Sequence Number=SeqID_72103
MKCPRAPPRYAHVAFESYPQKNGGMVVTAWVSPSSSPSSFAPVFSFVQAG

SEQ ID NO: 163789 - protein, 107 aa, Glycine max
  Coding DNA Sequence Number=SeqID_72104
FFKGSVKHAMAVPKSEKMQGGSSRCGVSTENNGGLWWLMVAVGDGERAWNVGNGFRRKKEKKMVFFLSYLDYKAQNAQVTNALGNGKFAHTPDSYSKIPTIRSWTSV

SEQ ID NO: 163790 - protein, 160 aa, Glycine max
  Coding DNA Sequence Number=SeqID_72105
  Homolog annotation: Hit_ID=Q6WAY4; Match level="QueryCoverage=80%, HitCoverage=23%, E-value=9e-13, Identity=35%"; Hit description =Putative uncharacterized protein
MGTNQTGKRFYQVKIKGLYVTSIKELGRLMGPLQMQAFRKAYGKILDLTIAKIFTEAVVSLTQYYDQPLRCFTFGDFQLVPTIEEFEEILGCPLGGRKPYLFSMFLPSLSKIAVVVRDSARVLDRVKKTQNGVVGLPRKYLEGKARDMENQEECVPLWTY

SEQ ID NO: 163791 - protein, 172 aa, Glycine max
  Coding DNA Sequence Number=SeqID_72106
MHKALRANAPLPYPQLVTLFLRHFQIPLDDEPFVQVKRFFAIGTGVVTSFGYRKDRNGQWLKKDALPSQDERTPSPPPQRDDSALMTEVLSELRGLRTYVGEHFDSLDNRFAGMDIRLTQLEEDVGYIRQSFDLPPPPPPSSSLVYNFLFKPCILAMDLNCHHQKGGDCRSK

SEQ ID NO: 163792 - protein, 94 aa, Glycine max
  Coding DNA Sequence Number=SeqID_72107
MEKKGRRRRRRRRRRRRKGLNGARACVRKAEEARSFCTHDTRRYLTVIRTPLPFRHSRVRWHAETKFGHSAPMIRGDTLWLFAPILLLSVRQNA

SEQ ID NO: 163793 - protein, 243 aa, Glycine max
  Coding DNA Sequence Number=SeqID_72108
MDFFSNESFECIQAFQNSNLIPFMSLNLPVYSELVKAFYSNLEIQESTLISEVYGIKMVIDQSLFYDLTQLSSEGVPFEGTLDDDWKFDFSVHDARRLVCTNQADMTGRLLAGSLALESLILHYLLFVFYFQDLQTLLRSFLIGAAVVASFGYRKERDGSWVKKGAQPNDDEGHLSVEGDSSLLQSILDRFDGLQTYVGERFDSLELQVNTRFEEMNSRIAKVEEDVTIIHDCLDLPPSPPSV

SEQ ID NO: 163794 - protein, 226 aa, Glycine max
  Coding DNA Sequence Number=SeqID_72109
MHTGARFPPCRQKDECGSCPNRALGFPALVTGLCQSYRVPVPPARSCHRDIGSHPQRHLVDPEKSNKGPGVSSSGYGPLSVLQGARSPSEESHPQRHLVDPEKSNKALGFPALVTGLCSPAGCPFPLERSRHHDGSRLQDTQWIRRSPTGSWSCQALITGLCQFYGVPVTSSKGIKPPTNRVFIKKYCVPRQAQGETLQQPGDGQQRATDAPPSPLEFTSAHPQKG

SEQ ID NO: 163795 - protein, 124 aa, Glycine max
  Coding DNA Sequence Number=SeqID_72110
  Gene Ontology: Mol. function=helicase activity; Cellular component =chromatin; Biological process=viral genome replication
  Homolog annotation: Hit_ID=Q2A9E0; Match level="QueryCoverage=86%, HitCoverage=7%, E-value=7e-24, Identity=50%"; Hit description =Putative uncharacterized protein
MDKPEYVWQQTWQWMADDIKLNHRKQDEQKSIIDTIIRVVDTQSAGVYFLYGYDGTGKTFIWTTLSFAIRSNGGIVCTVASSGIASVLFPSGRTTHSKFSIPVPATQNSTCNIHQSSDLAKFIE

SEQ ID NO: 163796 - protein, 62 aa, Glycine max
  Coding DNA Sequence Number=SeqID_72111
MTEHASQWGDQSGSRCFARMLQPYGIDIDLKEHSNRMTPKAYTSKSSSGPLPPDSGPTQKNI

SEQ ID NO: 163797 - protein, 46 aa, Glycine max
  Coding DNA Sequence Number=SeqID_72112
MDTRLRVIGDPMNEVQWGRGHKPLFEDSPSECGGGAATVRYGLISK

SEQ ID NO: 163798 - protein, 36 aa, Glycine max
  Coding DNA Sequence Number=SeqID_72113
MGNGYREQEQGVKRVGGVAGALSHVHIITVAAHINV

SEQ ID NO: 163799 - protein, 320 aa, Glycine max
  Coding DNA Sequence Number=SeqID_72114
  Gene Ontology: Mol. function=protein serine/threonine kinase activity; Cellular component=cytoplasm; Biological process=protein amino acid phosphorylation
  Homolog annotation: Hit_ID=A7NUV0; Match level="QueryCoverage=100%, HitCoverage=100%, E-value=1e-147, Identity=76%"; Hit description =Chromosome chr18 scaffold_1, whole genome shotgun sequence
  Pfam annotation: Domain name=Pkinase; Domain location=4-242; Score =231.9; E_value=1.4e-66; Accession=PF00069.16; Description=Protein kinase domain
  Pfam annotation: Domain name=Pkinase_Tyr; Domain location=4-246; Score=-37.6; E_value=4.3e-10; Accession=PF07714.8; Description =Protein tyrosine kinase
  Pfam module annotation: Pfam domain module=Pkinase::Pkinase_Tyr; Domain location=4-242::4-246
MERYEILKDIGSGNFAVAKLVRDNYTNELFAVKFIERGQKIDEHVQREIMNHRSLKHPNIIRFKEVLLTPTHLAIVMEYASGGELFERICNAGRFSEDEQICHRDLKLENTLLDGSTAPRVKICDFGYSKSSVLHSQPKSTVGTPAYIAPEVLTRKEYDGKIADVWSCGVTLYVMLVGAYPFEDPADPRNFKKTIGKILSVQYSVPDYVRVSMECRHLLSQIFVASPEKRITIPEIKNHPWFLRNLPMELTEGGSWQMNDVNNPSQNVEEVLSIIQEARKSLNVPKVGGLLTGGSMDLDDFDADEDLEDLETSGEFVCPI

SEQ ID NO: 163800 - protein, 110 aa, Glycine max
  Coding DNA Sequence Number=SeqID_72115
MAETADKSQSLAEEYYVNDKQTTVVEKAVEVKEVENPKVAASEEPVAEKTVEETTPVAPAVAQESSEVTPPPAEESTEEQSSGNVEENSGNEDVAEETPEIKHWTLLIIC

SEQ ID NO: 163801 - protein, 141 aa, Glycine max
  Coding DNA Sequence Number=SeqID_72116
  Homolog annotation: Hit_ID=A5BP71; Match level="QueryCoverage=53%, HitCoverage=19%, E-value=8e-10, Identity=44%"; Hit description =Putative uncharacterized protein
  Pfam annotation: Domain name=zf-CCHC; Domain location=114-131; Score =19.2; E_value=0.0019; Accession=PF00098.14; Description=Zinc knuckle
MKDKYLVLSLLKNLEKIKNKLVRTSFACMKSTPQACGYASINYYQYIDVVYTNEHILKAYSAQWWPLGNEAAIPPSDDAWTLIPDLTTIRAKGRPKSTRIRNEMDWLEPSEHQQKCNRCGVEGHNRRRCPMQSDRGSCSFN

SEQ ID NO: 163802 - protein, 74 aa, Glycine max
  Coding DNA Sequence Number=SeqID_72117
MSCFFISGWGGSEKRLGGGCGGQAPDCPALAVAPAAGALAKAPGPKARTKAPSCTVLPILQCHVSVFRGKRLQE

SEQ ID NO: 163803 - protein, 260 aa, Glycine max
  Coding DNA Sequence Number=SeqID_72118
  Gene Ontology: Mol. function=inorganic diphosphatase activity; Cellular component=cytoplasm; Biological process=phosphate metabolic process
  Homolog annotation: Hit_ID=Q2HTA8; Match level="QueryCoverage=39%, HitCoverage=50%, E-value=7e-45, Identity=82%"; Hit description =Inorganic pyrophosphatase
  Pfam annotation: Domain name=Pyrophosphatase; Domain location=194 -258; Score=-50.1; E_value=0.00056; Accession=PF00719.10; Description= Inorganic pyrophosphatase
MVAAAVATPLWQPQEQGFEEICGLLEQQISHSSSVDKAQIWQHLQRYSHLPDFNNYLAFIFSHAVLLRNCSFFSCECFFLVPIIQVSSMICSRCFVERPNSESIRRGKNSIEKSLLVWVVLSVRVMFLIQEALLWRGKQWSLEIIMSDNGEEAGENRLVPRLNERILSSLSRRSVAAHPWHDLEIGPEAPQIFNCVVEITKGSKVKYELDKKTGLIKVDRVLYSSVVYPHNYGFIPRTLCEDNDPIDKIHSKTKRMSTRR

SEQ ID NO: 163804 - protein, 170 aa, Glycine max
  Coding DNA Sequence Number=SeqID_72119
  Homolog annotation: Hit_ID=A5BMY4; Match level="QueryCoverage=58%, HitCoverage=44%, E-value=3e-11, Identity=37%"; Hit description =Putative uncharacterized protein
MAVYASIIPGDPIDPSPGSPDKLKKCILSQENLDYWHNIHDTCILYEGQMGTLATIERPEIFTCVMGDVAEKVETTIDEAQRVVDIIEDVAEGVDKVAEEAVKHLPDGKFRDAVEFVEKVAEDIDKRAERAEDALEKVENMEKEFESFIESTTHHQENSVTTTAEAKEQK

SEQ ID NO: 163805 - protein, 70 aa, Glycine max
  Coding DNA Sequence Number=SeqID_72120
MAGVCEMQCDGDGVVIWFQSGDVKIGFQGFDERKQEKVRRENSVVVVVVVARCNSVRGRWKWCRDRILRF

SEQ ID NO: 163806 - protein, 158 aa, Glycine max
  Coding DNA Sequence Number=SeqID_72121
  Gene Ontology: Mol. function=oxidoreductase activity, acting on single donors with incorporation of molecular oxygen, incorporation of two atoms of oxygen; Cellular component=cytoplasm; Biological process=flavonoid biosynthetic process
  Homolog annotation: Hit_ID=A7NUS8; Match level="QueryCoverage=94%, HitCoverage=42%, E-value=2e-41, Identity=53%"; Hit description =Chromosome chr18 scaffold_1, whole genome shotgun sequence
MSSVKELVESKCLSSVPSNYICLENPEDSILNYETDNIPTIDFSQLTSSNPSVRSKAIKQLGDACRDWGFFMLINHGVSEILRDEVIRTSQGFFDLTEKEKMEHAGRNLFDPIRYGTSFNVTVDKTLFWRDYLKCHVHPHFNAPSKPPGFRKRKRKVP

SEQ ID NO: 163807 - protein, 131 aa, Glycine max
  Coding DNA Sequence Number=SeqID_72122
MSTKGQKSRQIEGGGRKHPVCVLGVGGTESPKGGCATVPTGHWKKEWYESGSHTKQIKVHVRDIPRGDARVRLHAAVTGDSKTREGLVAMFTPVYGGTTVKGGSRTKKMRNYCPVLCQARQGELRRLLIPY

SEQ ID NO: 163808 - protein, 357 aa, Glycine max
  Coding DNA Sequence Number=SeqID_72123
  Gene Ontology: Mol. function=phosphoribosylaminoimidazolesuccinocarbox amide synthase activity; Cellular component=chloroplast; Biological process=purine nucleotide biosynthetic process
  Homolog annotation: Hit_ID=Q07463; Match level="QueryCoverage=83%, HitCoverage=95%, E-value=1e-140, Identity=78%"; Hit description =Phosphoribosylaminoimidazole-succinocarboxamide synthase, chloroplast precursor
  Pfam annotation: Domain name=SAICAR_synt; Domain location=98-331; Score=346.4; E_value=5.1e-101; Accession=PF01259.9; Description =SAICAR synthetase
  Subcellular localization annotation: CTP_CleavageSite=50; ConfidenceScore=5.63e-01
MGDFTVALNPPKTFRADILLSTTNNRTSPAARGFQTVLAFKPPRAFRGIRASVMPREGQQASLGDALVNTPRRSDFVEAIRRTAALSSCLSETSLHATVPGLESKTRGKVRDIYDAGDYLVLVTTDRQSAFDRILASIPFKGQVLNQTSLWWFERTKHIVSNAVVLAPDNNVTIARKCSVFPVEFVGFVTGSTDTSLWTVYNKGVRNYCGNVIPDGMVKNQKLPKNILTPTTKAADHDVPITPDEQVALEHGLILVDTKYEFGKANDGSIMLIDEVHTPDSSRYWIANSYLERFQNGLEPENIDKEFLRLWFISHCNPYEDEVLPDAPEDLVCELAWRMLMLSISKLPKLFHAKMYW

SEQ ID NO: 163809 - protein, 630 aa, Glycine max
  Coding DNA Sequence Number=SeqID_72124
  Gene Ontology: Mol. function=protein binding; Cellular component =nucleus; Biological process=apoptosis
  Homolog annotation: Hit_ID=Q9AUH6; Match level="QueryCoverage=97%, HitCoverage=96%, E-value=0.0, Identity=72%"; Hit description=F-box containing protein TIR1
MRDKSESHPSTNSEDDHRSSPLLDLACAEITESSNSKTRTCGPFPGSGPSEPQAPFPDQVLENVLENVLHFLPSRRDRNAASLVCRSWYRAEALTRSELFIGNCYALSPTRATARFTRVMSVTVKGKPRFADFDLMPPDWGAHFGPWASALAQAYPWLEKLHLKRMLVTDADLALIADSFAGFRELVLVCCEGFGTPGLAAVASKCRLLRVLELVESVVEVEDDEEVDWISCFPETQTNMESLVFDCVEVPINFEALEGLVARSPRLKKLRLNQFVSMAQLYRLLLRAPQLTHLGTGSFSATEAGVVGDQEPDYAAAFEACRSLVCLSGFREIWADYLPAIYPVCANLTSLNLSYADINTDQLKSVICHCHKLQIFWVLDSIRDEGLQAVAATCKDLRELRVFPMDAREETDGPVSEVGFEAISQGCRKLESILFLCQRMTNAAVVAMSKNCPDLVVFRLCIIGRYRPDPVTQEPMDEGFGAIVMNCKKLTRLAVSGLLTDRAFEYIGTYGKLVRTLSVAFAGDTDVGLKYVLKGCPNLQKLEIRDSPFGDGALRSGLHHYYNMRFLWMSTCKLTLQACQEVARVLPNLVFEVINNNSEENAGDEVETLYMYRSLDGPRDDAPRFVTILQ

SEQ ID NO: 163810 - protein, 77 aa, Glycine max
  Coding DNA Sequence Number=SeqID_72125
  Subcellular localization annotation: CTP_CleavageSite=50; ConfidenceScore=5.79e-01
MNQSLIFSSSRHLRLSTLFASTLGISSQVPTCKSIVSSNSNLRTPVLTSSATMTSRVSVRYISRQLIELKEVETYSS

SEQ ID NO: 163811 - protein, 112 aa, Glycine max
  Coding DNA Sequence Number=SeqID_72126
MEAHFTPLSFAPSIPSSLHKVVDDGVGWWYLCGAVMLCGWVEVRHGGSKWLGGLWRGSFVCLGFLEVQEEKRKDMPSRPTARKTFNTRDPQAKDPLSSSYLSESLVKSNHQF

SEQ ID NO: 163812 - protein, 298 aa, Glycine max
  Coding DNA Sequence Number=SeqID_72127
GRDDIPNTAIGRPDHGGRVRAAGSGVTISQCYGRASRGSTSSSISISQEQMEVKDAITIEMSQKGSQVAAPTHMDINVLGARVSTKESNAEVAVNRSGEEQVAHMTPTMGLYVERQDSTKLVALGKIYQGASTIYCVAYADDVVRVSVDKVIDGEAEVPCPTSEIKYDSAISAKQVVEVVDRVKDVAVQDPLRELIKCLVDIYDNPVQFEWDGSKFGIPNALKMTDDGKVPQTTPQWIEVKSHVQRGGYECGYYVMHWMWNIITGELKTDWSLVHIDDFEGIIDEGVAKVVVGLTLLV

SEQ ID NO: 163813 - protein, 163 aa, Glycine max
  Coding DNA Sequence Number=SeqID_72128
  Gene Ontology: Biological process=response to stress
  Homolog annotation: Hit_ID=A5B0M7; Match level="QueryCoverage=82%, HitCoverage=82%, E-value=5e-46, Identity=71%"; Hit description =Putative uncharacterized protein
MSSGGNLSCVLVAVDGSEESMNALRWALNNLKLRSPTLDSTGAPSFIIFHVQSPPSIATGLHPGAIPFGGDIEVPAFTAAIEAHQKRITNAVLDHVLGICSEFNLTSKGRTHVLVGDPKEKICEAVQDLHADVLVMGTYHTQKNKGLINNLDKYSLFENVNKC

SEQ ID NO: 163814 - protein, 116 aa, Glycine max
  Coding DNA Sequence Number=SeqID_72129
MTKPLKLEQFLQRRSMLGMIEASEDLEVELGGLGKMVFFEVDDIQKVANGVLEELGGGLIPVVSVAGVQRGFHGVGVVEVRWQRWRHNQPRCFAEAFLRRWKGLWGLRVKVWEKEK

SEQ ID NO: 163815 - protein, 245 aa, Glycine max
  Coding DNA Sequence Number=SeqID_72130
  Gene Ontology: Mol. function=DNA binding; Cellular component =chromatin; Biological process=regulation of transcription, DNA -dependent
  Homolog annotation: Hit_ID=A5B0M9; Match level="QueryCoverage=92%, HitCoverage=60%, E-value=1e-73, Identity=59%"; Hit description =Putative uncharacterized protein
  Pfam annotation: Domain name=DUF296; Domain location=62-185; Score =154.3; E_value=3.4e-43; Accession=PF03479.6; Description=Domain of unknown function (DUF296)
MFSKLQPQHQQQHQPFQFSRECQTSEDDDSRSSGGPNTAVAQKSVLGGGGCSDGATIEVPAMSPFILEIPGGSDVVEALARFSRRKNTGLCVLTGSGTVANVTLRQPSFSPAGATVATVTFHGRFDILSMSATFLHHASPAAIPNAFAVSLSGPQGQIVGGFVAGRLLAAGTVFVIAASFNNPSYHRLSSEEEAQNNSGGGAGDAQSPPVSGGGLESGHVPAESFMYSCHLPSDVIWAPTPRPPF

SEQ ID NO: 163816 - protein, 374 aa, Glycine max
  Coding DNA Sequence Number=SeqID_72131
  Gene Ontology: Mol. function=nucleic acid binding
  Homolog annotation: Hit_ID=A2ZCQ6; Match level="QueryCoverage=31%, HitCoverage=13%, E-value=1e-12, Identity=34%"; Hit description =Putative uncharacterized protein
DFKEILCPDDKNGGNEANINLIAWFRMVLEQCSPDVKRKGLKNSYHFEEAWLQNDGCAKVVDKYGIRVDRWKPRATWLDYGDKNSKFFYHMARQRRKRNTIDRIKNDQGVCFEEEENIDLSSVLDKAFTTKEVKCALDQMHPSNAPEIDGTLSSIILPTFLTSDGIDDFERLMGVKTMGSFSKYTRLPTIVRRSKKQTFQFIPDCVWKKLKSWMEKVLSRARCEVLIKAFNLALLVKQWWRLVHDVDFLFSGTFKYFPRCQPVNAKMSSYQSATWSGIKASKWIIDQGTFWRIGDGINVKEHNVEGLQALPHSQALVDCVEAMKIWFASRWGRNIWVFEGKWISIDQVLARDDSVTMSNPQKSDPSRTTHHLRI

SEQ ID NO: 163817 - protein, 73 aa, Glycine max
  Coding DNA Sequence Number=SeqID_72132
MKIKISRGVVSQGNGFASKFVMADKKMDNKIPMVTKKEGFLHKNHVDDVESKRQLLKQQMLFNQQRDIQVGSN

SEQ ID NO: 163818 - protein, 177 aa, Glycine max
  Coding DNA Sequence Number=SeqID_72133
MEVEKGKQRGFISLQTSTSLSRNGHVDHLICYLERQRFHRHEAPVMVVIGGERQCHIISGTNLRNAIIHNVNVLFVSDTLFSALRVRASPPLDPVRRILIPISIPSSLTRTFSQLHNTFLCHGTKIVGWQKEKREVLLEWVARDTKVVANCFSGRLSHVVRDFGIISIWVSVNSGVC

SEQ ID NO: 163819 - protein, 31 aa, Glycine max
  Coding DNA Sequence Number=SeqID_72134
MLQRAASNAYSWWWASHIRTKQSKWLDQASK

SEQ ID NO: 163820 - protein, 269 aa, Glycine max
  Coding DNA Sequence Number=SeqID_72135
  Gene Ontology: Mol. function=DNA binding; Cellular component=nucleus; Biological process=regulation of transcription
  Homolog annotation: Hit_ID=A7NUL7; Match level="QueryCoverage=88%, HitCoverage=37%, E-value=5e-46, Identity=44%"; Hit description =Chromosome chr18 scaffold_1, whole genome shotgun sequence
  Pfam annotation: Domain name=Myb_DNA-binding; Domain location=194 -244; Score=20.3; E_value=0.007; Accession=PF00249.22; Description =Myb-like DNA-binding domain
MKKTSNVFFSEDEAAVLLQRYNAQTILTLLQELANYPDSKFDWDDLVAKTSTGISNAREYQMLWRHLAYGHSFDENSDLDNQPLDDDSDLECEREALPRPNKEIAAEASACVQLNESTPTSSVIQAPLTINVPVFRSSRIANMESSQSSSSGMQETNIVFPVTVKRQALPNVPSTRAVETRGSGSGYTSMKKKREPWSEEEDLQLRAAVRRWGEGNWATMAKSDDFPIQRSTTQLSKHHWSGLTFGICRHIDQFDLDCVVERGSFSLFM

SEQ ID NO: 163821 - protein, 99 aa, Glycine max
  Coding DNA Sequence Number=SeqID_72136
  Gene Ontology: Mol. function=zinc ion binding; Cellular component =intracellular
  Homolog annotation: Hit_ID=Q308N9; Match level="QueryCoverage=84%, HitCoverage=32%, E-value=2e-10, Identity=46%"; Hit description=Salt -tolerance protein
MICCADEAALSAKCDVEKEAPQFAELEWLTDVGIFGEQFAQEALAAAEVPQLLVTHNNSSVASNRTSKSYISHKKPRIEVLNDQDDDDEFSIFIVPDLG

SEQ ID NO: 163822 - protein, 627 aa, Glycine max
  Coding DNA Sequence Number=SeqID_72137
  Gene Ontology: Mol. function=magnesium ion binding
  Homolog annotation: Hit_ID=A7PBN9; Match level="QueryCoverage=33%, HitCoverage=65%, E-value=7e-92, Identity=75%"; Hit description =Chromosome chr16 scaffold_10, whole genome shotgun sequence
  Pfam annotation: Domain name=Extensin_2; Domain location=333-621; Score=-141.7; E_value=0.096; Accession=PF04554.4; Description =Extensin-like region
  Pfam annotation: Domain name=YqaJ; Domain location=62-205; Score =95.1; E_value=2.2e-25; Accession=PF09588.1; Description=YqaJ viral recombinase family
  Pfam module annotation: Pfam domain module=Extensin_2::YqaJ; Domain location=333-621::62-205
  Subcellular localization annotation: CTP_CleavageSite=44; ConfidenceScore=5.34e-01
MVKLLLHSLLFGCNVSGTKNLRPITSNNPSRKLGSLGGMLKYTSVETYSVLQASCLQHWFKNWQALRRNKLTASTFAAAIGFWHRQRVQLWLEKIGAIEPFSGNLATCWSNIKEEDALERYKLITGNTVRFPEFQVYDAHPEDSWLAASPDGVIDSMVHELPSCGVLEIKCPYFDGDISKAFPWFRIPILYIPQTQGLMEILGRDWMDFYVWTPNVSSLFRIYRDAEYWDLMKIALSDFWWKHVYPARELFKELIVRCDYLKLEIGDWSETGLKVHAFVTDLWWVLSIVTCGCNCSLDSQVMEDSEQRKKRLKQMRVQADQAEVSGGREGSVVPGFLSNPLIEAPSTMPSRDTSYAAPRFDYYTDPMSAFSSKRNNASTQAAPDNFPPSKFGGPPMAQYSSPHPAYRNPVWSGPGGPAHYNFPLHPSSGGTYPSPRFEPSGGPLYNTAQGIAHQPSYSPNPPYPGYVNSPRPSYSPNPSPGYSNCPMPSYSPNPSPGYRNSPSPGQGRGRGFWRNTGSPVSGWGSGQGPNFHGHRSNENTVHGPDRFYKRSMVEDPWEHLEPIIWKANDGYLNTSRVPLNSQPWISKASSTKGEGSSAASVKSSSEPSLAEYLASAFNEAANDAENV

SEQ ID NO: 163823 - protein, 40 aa, Glycine max
  Coding DNA Sequence Number=SeqID_72138
MTIDFDPWRDRGGSKKRKGCHASSWNAAKGWGIQKVSSQC

SEQ ID NO: 163824 - protein, 103 aa, Glycine max
  Coding DNA Sequence Number=SeqID_72139
MSGTGQGGENPIPVGDGDGINLADDEDEEDDDYLVSNSYVEESLDEDDSVEGIQNPFWNDALHYNNINWSYPDKEDVCGLEMLSSFNVGQELYVGMDFDSKDA

SEQ ID NO: 163825 - protein, 121 aa, Glycine max
  Coding DNA Sequence Number=SeqID_72140
  Homolog annotation: Hit_ID=A5BH36; Match level="QueryCoverage=79%, HitCoverage=5%, E-value=3e-07, Identity=28%"; Hit description =Putative uncharacterized protein
MESALSTVVERVMNFVLDQSVRHVAYIVRYGQNVDELYHNVKDLGLEKERIDHQRDEAEKNLHRTEGTVKEWFQKVDEFETTVEKFRNDEAHCYGGSNTKQVPPVALSAICLCVFNPVRIC

SEQ ID NO: 163826 - protein, 170 aa, Glycine max
  Coding DNA Sequence Number=SeqID_72141
MAEHAIVEDCGVQRDEVVVAVGHDLSYVLPNQVGVQFDSLGDGAKDDPDLFKGFFKGGGDGDAVEDAAYGKIGSRFGSWAWCSSTNLGSRWGEGVVGPNGGFHGEEVVQGFEAKLEHPVRFIFEFRDDEVDCVSIKAFGDQERVDVDGEAKLLVVVTVIAMEAFADVIIA

SEQ ID NO: 163827 - protein, 44 aa, Glycine max
  Coding DNA Sequence Number=SeqID_72142
MSAMETSSMPTTEAANGNDAEETKEEEARRRRLDVNEVETMAYG

SEQ ID NO: 163828 - protein, 1897 aa, Glycine max
  Coding DNA Sequence Number=SeqID_72143
  Homolog annotation: Hit_ID=A5AK28; Match level="QueryCoverage=70%, HitCoverage=94%, E-value=0.0, Identity=57%"; Hit description =Putative uncharacterized protein
GPIEYVSIGEIKLSLRLSLLEHGVGFSTWDPKLQLIVCNLEVVTRPSNKSSEKKKKTRKSSGRSSGKGKWKTISNIARYLSVCMTNLVLKTPKATVEIGKLNVDISKVGGSESDLLVRVHILPIVVSEPQVSCNQLSDLSGGECSASSQASIATIKKAPALFICEKFCVSCEFGHDREVGILIKSVDISIGEVTVNLNEGLLVKKKSSVESSSGSEKSVGSNVDSMSAKEPPKKREKIIGYISKFPQKVSFNLPKLNVSFVHRERGLSVENNIMGIQFKSIKSRPSKDAGESTRLHFQLEFSEIHLLREAGSSILEILRVNLVTFVYVPVQGCLQSTHLSANNISNMGTTVHTELGELNLNLANENEECLKERIFGAESKSGYILHITKVSLDWGKKDLKSSEEGAPKCVLGLSVNMTSMGVYLTFKRVESFISTAISFQVLFKSLSASKKKTTQTRARSSKSSGKGTQMLKFNVEQCSVYVLGETGIENAVVPDPKRVNFGSQGGRVIINVSADGTPRTANIISTVSDDYRKLKYCISLEIFHFKLSVNKEKRSKQVELGRARSIYQEYMDENRPVSKVALFNMQTIKFVQRLGGLKENAACSLFSATEITMRWEPDVHLSLIELVLQLKLVVHNTKLQEHGNDEHVEDMSNVKDTNRKNEATVESGHSEKKKESVFAVDVEMLNISAGLGDGVDAMVQVQSIFSENARIGVLLEGLMFYFNGARIIKSSRMQISRIPSKSAASASDAKGPVATIWDWVIQGLDIHICLPFRLQLRAIDDALEDMLRALKLIVAAKTNMIFPVKKDSSKAKKPSSVKFGCVKLFVRKLTFDIEEEPIQGWLDEHYHLLKKEAGELAVRLNFLDEFISKAKQDPKPTDDTNNSPQEKKVYFNDVEVDVNNPSTIESMREEIYKKSFRSYYQACQNLVLSEGSGACIDDDFQAGFKPSTSRTSLLSISALDLDVSLTKIDGGDDGMIEVLRKLDPIRDYTYPLFAGSSGKCEGRLVMAQQATSFQPQMLQDVYVGAWRKKGEVSFGVSYEPVFADISYAFTVLLRRANLSVINPGPLIVPPKKEKSLPWWDDMRNYIHGRISLLFSETRWHILASTDPYEKLDKLILLTRSMEIHQSDGRILLSAKDFNIFLSSLESMAKKRGSKIPPGVSSAFFEVPLFTLEVAMDWDCDSGKPLNHYLFSLPDEGKPREFVFDPFRSTALSLRWNLSFRSLPPSSEKQCPPSVARDSIEGYATVSQPPHTSQNVSPASPTIKLGAHDLAWITKFWNLMYLPPHKLRMFSRWPRFGVPRIIRSGNLALDKVMTEFMIRIDSTPICIKNMPLHDDDPARGLTFMMTKLKIELCFGRGKQKFTFESYRGLLDLVYQGIDLHMPKVFLSKEDCCSVSKLISMATKSSQSASKDNVPSEKGCMTQKNPDDGFILSCDYFSIRKQSAKADPDTLGAWREEGKINPEKTTCVQFERGKQSETNEHTQSDPSDDDDGYNVVIADSCQRVFVYGMKLLWNIENRNAVCFWVAALSKAAAPAKPSPSRQYAQRKLHEDNKKDDAAETNQDDDACQTHQDDGAKIQQDDEAESHRDDGAETCQDEGAETHKDEVSTSLNTNSISDSPSSQAAKNPELPSSPPHLDNADNLPSTKNENADDTEEGIRHFMVNIIEPQFNLHSEDANDITQLHKTGLLEENSPSLISTSYAISSLSLSGQPSIAIPFQDPTTNSSRPQLRRVRVTTIKGRFLLAAVSGRILAQSFHSVLHVGYEMIEQALSTTDVNGSEYQPEIAWKRWELSVMLEHVQAHVAPTDVDPGAGVQWLPKILRGSPKVMRTGALLERVFMPCDMYFQFTRHKGGTPEMKVKPLKELTFNSHNITATMTSRQFQVMLDVLCNLLLARVPKYG

SEQ ID NO: 163829 - protein, 3731 aa, Glycine max
  Coding DNA Sequence Number=SeqID_72144
  Gene Ontology: Mol. function=ubiquitin-protein ligase activity; Cellular component=intracellular; Biological process=protein modification process
  Homolog annotation: Hit_ID=A3CGV1; Match level="QueryCoverage=98%, HitCoverage=93%, E-value=0.0, Identity=54%"; Hit description =Putative uncharacterized protein
  Pfam annotation: Domain name=DUF908; Domain location=152-464; Score =92.1; E_value=1.8e-24; Accession=PF06012.3; Description=Domain of Unknown Function (DUF908)
  Pfam annotation: Domain name=DUF913; Domain location=512-857; Score =176.6; E_value=6.4e-50; Accession=PF06025.3; Description=Domain of Unknown Function (DUF913)
  Pfam annotation: Domain name=HECT; Domain location=3406-3691; Score =492.2; E_value=6.5e-145; Accession=PF00632.16; Description=HECT -domain (ubiquitin-transferase)
  Pfam annotation: Domain name=UBA; Domain location=1349-1386; Score =43.4; E_value=7.9e-10; Accession=PF00627.22; Description=UBATS-N domain
  Pfam annotation: Domain name=UIM; Domain location=1393-1410; Score =22.7; E_value=0.0013; Accession=PF02809.11; Description=Ubiquitin interaction motif
  Pfam module annotation: Pfam domain module=DUF908::DUF913::HECT::UBA:: UIM; Domain location=152-464::512-857::3406-3691::1349-1386::1393-1410
MTTLRSSWPSRLRQLLSSGGAIGPSVKVDSEPNAEVQTYALTHKASIVASGICMVFCACTVFSGKFLVPSFKLWLLRLHAPFLPPKIKAFIEKIIQCPLQDIAIPLSGFRWEYNKGNFHHWRPLLLHFDTYFKTYLSCRNDLTLLDNLEDDSPLPKHAILQILRVMQKILENCPNKSSFDGLEHFKLLLASTDPEILVATLETLSALVKINPSKLHGSPKMICCGSVNSYLLSLAQGWGSKEEGLGLYSCVMANEKAQDEALCLFPSEEIGHDQSNCRIGTTLYFELHGPNAQSKEHSADAVSPSSTVIHMPDLHLRKEDDLSLMKQCTEEFSIPSELRFSLLTRIRYARAFRSPRICRLYSRICLLSFIVLVQSGDAQEELVSFFANEPEYTNELIRIVRSEEVISGSIRTLAMLALGAQLAAYTSSHHRARISGSSLTFAGGNRMILLNVLQRAILSLKISNDPSSLAFVEALLQFYLLHVVSTSTSGNNIRGSGMVPTFLPLLEDFDPTHIHLVCFAVKTLQKLMDYSSSAVSLFKELGGIELLAQRLQKEVHRVIGLVGGTDNMMLTGESLGHSTDQLYSQKRLIKVSLKALGSATYAPANSTRSQHSQDSSLPITLSLIFKNVDKFGGDIYYSAVTVMSEIIHKDPTFFSALHEIGLPDAFLLSVGSGILPSSKALTCIPNGLGAICLNAKGLEAVRESSSLRFLVDIFTSKKYVLAMNEAIVPLANAVEELLRHVSTLRSTGVDIIIEIIHKITSFGDGNGAGFSGKAEGTAMETDSENKEKEGHCCIVGTSYSAVEGISDEQFIQLCVFHLMVLVHRTMENAETCRLFVEKSGIEALLNLLLRPTIAQSSDGMSIALHSTMVFKGFAQHHSIPLAHAFCSSLREHLKKTLVGFGAASEPLLLDPRMTTDGGIFSSLFLVEFLLFLVASKDNRWVTALLTEFGNESKDVLEDIGCVHREVLWQISLLENRKPEIEEDGACSSDSQQAEGDVSETEEQRFNSFRQYLDPLLRRRTSGWSIESQFFNLINLYRDLGRSTGSQNRLVGPRSSSSNQVQHSGSDDNWGTANKKESDKQRAYYTSCCDMVRSLSFHITHLFQELGKVMLLPSRRRDDVVNVSPASKSVASTFASIAFDHMNYGGRCVNLSGTEESISTKCRYFGKVIDFMDNVLMERPDSCNPIMLNCLYGRGVIEIVLTTFEATSQLLFTVNRAPASPMDTDDANAKQDDKEDTDNSWIYGSLASYGKLMDHLVTSSFILSSFTKHLLAQPLTNGDTPFPRDAETFVKVLQSRVLKTVLPVWTHPKFVDCSYEFISTVISIIRHVYTGVEVKNVNGSAGARITGPPPNETTISTIVEMGFSRSRAEEALRQVGSNSVELAMEWLFSHPEEAQEDDELARALAMSLGNSESDSKDAVANDNALQLEEEMVQLPPVDELLSTCTKLLSKEPLAFPVRDLLVMICSQDDGQHRSNVVSFIVERIKECGLVPSNGNYAMLAALFHVLALILNEDAVAREAASTSGLIKIASDLLYQWDSSLDIKEKHQVPKWVTAAFLALDRLLQVDQKLNSEIAEQLKKEAVNSQQTSITIDEDRQNKMQSALGLSMKYADIHEQKRLVEVACSCMKNQLPSDTMHAVLLLCSNLTRNHSVALTFLDSGGLSLLLSLPTSSLFPGFDNVAASIVRHVLEDPQTLHQAMESEIKHSLVVASNRHPNGRVNPHNFLLNLASVISRDPVIFMQAAQSVCQVEMVGERPYIVLLKDRDKDKAKDKEKDKDKTLEKDKVQNIDGKVVLGNTNTAPTGNGHGKIQDSNTKSAKGHRKPTQSFINAIELLLESVCTFVPPLKGDIASNVLPGTPASTDMDIDASMVKGKGKAVATDSEGNETGSQDASASLAKIVFILKLLTEILLMYSSSVHVLLRRDAEMSSIRGSYQKSPAGLSMGGIFSHILHNFLPYSRNSKKDKKADGDWRQKLATRANQFMVGACVRSTEARKRVFGEICCIINEFVDSCHGIKRPGKEIQVFVDLLNDVLAARTPAGSSISAEASTTFIDAGLVKSFTCTLQVLDLDHADSSEVATGIIKALELVTKEHVQLVDSSAGKGDNSAKPSVLSQPGRTNNIGDMSQSMETSQANPDSLQVDRVGSYAVCSYGGSEAVTDDMEHDQDLDGSFAPANEDDYMHENSEDARDLENGMENVGLQFEIQSHGQENLDEDDDEDDDMSEDEGEDVDEDEDDDEEHNDLEEVHHLPHPDTDQDEHEIDDEDFDDEVMEEEDEDDEEDEDGVILQLEEGINGINVFDHIEVFGRDNSFANEAFQVMPVEVFGSRRQGRTTSIYSLLGRTGDTAVPSRHPLLLEPSSFPPPTGQSGQFLRIVYSSLENNSLGLDNIFRSLRSGRHGQRLHLWTDNNQQSGGTNTVVVPQGLEDLLVTQLRRPIPEKSSNQNIAEAGSHGKVGTTQAQDAGGARPEVPVESNAVLEVSTITPSVDNSNNAGVRPAGTGPSHTNVSNTHSQEVEMQFEHADGAVRDVEAVSQESSGSGATFGESLRSLDVEIGSADGHDDGGERQVSADRVAGDSQAARTRRANTPLSHISPVVGRDAFLHSVTEVSENSSRDADQDGAAAEQQVNSDAGSGAIDPAFLDALPEELRAELLSAQQGQVAQPSNAESQNTGDIDPEFLAALPADIRAEILAQQQAQRLHQSQELEGQPVEMDTVSIIATFPSDLREEASFSVHCCYIKVLLTSPDTILANLTPALVAEANMLRERFAHRYSRTLFGMYPRSRRGETSRREGIGSGLDGAGGTISSRRSNGVKVVEADGAPLVDTEALHAMIRLLRVVQPLYKGQLQRLLLNLCAHSETRTSLVKILMDLLMLDVKRPVSYFSKVEPPYRLYGCQSNVMYSRPQSFDGVPPLLSRRILETLTYLARNHLYVAKILLQCWLPNPAIKEPDDARGKAVMVVEDEVNIGESNDGYIAIAMLLGLLNQPLYLRSIAHLEQLLNLLDVIIDSAGNKSSDKSLISTNPSSAPQISAVEANANADSNILSSVDDASKVDGSSKPTPSGINVECESHGVLSNLSNAELRLLCSLLAQEGLSDNAYNLVAEVMKKLVAIAPTHCELFVTELAEAVQKLTSSAMNELRVFSEAMKALLSTSSTDGAAILRVLQALSSLVTLLTEKENDRGTPALSEVWEINSALEPLWHELSCCISKIESYSESASEISTSSSTFVSKPSGVMPPLPAGSQNILPYIESFFVVCEKLHPAQPGDSHDSSIPVISDVEYATTSATPQKASGTAVKVDEKHMPFVRFSEKHRKLLNAFLRQNPGLLEKSFSLMLKVPRFIDFDNKRAHFRSKIKHQHDHHHSPLRISVRRAYVLEDSYNQLRLRSTQDLKGRLTVHFQGEEGIDAGGLTREWYQLLSRVIFDKGALLFTTVGNESTFQPNPNSVYQTEHLSYFKFVGRVVGKALFDGQLLDVHFTRSFYKHILGVKNDISDVLDLTFSIDADEEKLILYERTEVTDYELIPGGRNIKVTEENKHQYVDLVAEHRLTTAIRPQINSFLEGFNEMIPRELISIFNDKELELLISGLPDIDLDDLRANTEYSGYSAASPVIQWFWEVVQGLSKEDKARLLQFVTGTSKVPLEGFSALQGISGSQKFQIHKAYGSPDHLPSAHTCFNQLDLPEYPSKHHLEERLLLAIHEAIVYLQWEMPLAVFQSTVLHCNDALFISVTQVSGVAESAKIVY

SEQ ID NO: 163830 - protein, 95 aa, Glycine max
  Coding DNA Sequence Number=SeqID_72145
MGDRLEALETQVENVTTLQELALQMQQHAQQMQQQSVIMTELSKQMGKKTARQEDSTGDSSHSESRLVGKKVKLPLFEGEDPVTCITRAEIYCDV

SEQ ID NO: 163831 - protein, 131 aa, Glycine max
  Coding DNA Sequence Number=SeqID_72146
  Gene Ontology: Mol. function=carbohydrate binding; Biological process= carbohydrate metabolic process
  Homolog annotation: Hit_ID=A7NUJ3; Match level="QueryCoverage=83%, HitCoverage=20%, E-value=1e-32, Identity=53%"; Hit description =Chromosome chr18 scaffold_1, whole genome shotgun sequence
MQVVKFGDIIFEPPRDGPTLWEIDIPDRSAAGFYVPDPNPKYINKLFVNQTSLGNMWVSVTTQDWFFAHVTGKQEDGSYQGTTWQIKFNLDDVETSNIYRLRLALASANISELQVWNLTKLFCVISHYMDV

SEQ ID NO: 163832 - protein, 72 aa, Glycine max
  Coding DNA Sequence Number=SeqID_72147
MKIRTETAAIRSMKAESTKPREKRSEQGWRVNAVRETNFDERIRETENRNPWMDRRKKENEALKVECATCIG

SEQ ID NO: 163833 - protein, 41 aa, Glycine max
  Coding DNA Sequence Number=SeqID_72148
MGLIFRLQFLLMRDLDIVIEKEILEYYEMHYVVKTNLKFQL

SEQ ID NO: 163834 - protein, 70 aa, Glycine max
  Coding DNA Sequence Number=SeqID_72149
MSIGFNGEICAISGEKEWAKRAFTAKRNFSALSAIEEFGRASISRSRTKREISALSAAVVFSQAQCTNWR

SEQ ID NO: 163835 - protein, 348 aa, Glycine max
  Coding DNA Sequence Number=SeqID_72150
  Homolog annotation: Hit_ID=Q8LGT8; Match level="QueryCoverage=79%, HitCoverage=93%, E-value=1e-122, Identity=74%"; Hit description =Phosphoglycerate mutase-like protein
  Pfam annotation: Domain name=PGAM; Domain location=79-287; Score =30.4; E_value=4.6e-06; Accession=PF00300.13; Description =Phosphoglycerate mutase family
  Subcellular localization annotation: CTP_CleavageSite=64; ConfidenceScore=5.27e-01
MMLTVNKYQPFPCELSTNQNFLNSNFVPTKPNLTLPLLFSLLYFSFHFLPLFLAIDSSSGSGMDAAASQSLYPLHRCKTVHLVRHAQGVHNVAGEKNHDAYNSYEFFDAHLTSLGWEQTFCRDWYRYSALVNNLRKHVKASGLSKNIELVVISPLLRTMQTAVGVFGGEAYTDGIGEPPLMTENVGHSDHPAVSSMNCPPFIAVELCREQIGVHPCDKRRTISEYRNMFPAIDFSLIESDEDILWESDVREKTDEVSARGLKFLEWLWTREEKEIAVVTHSSFLFNTLRAFGNDCHPDIKSEICTHFANCELRSIVIIDRGMIGSSESTTNYPGKIPRGPDVPSEAAD

SEQ ID NO: 163836 - protein, 349 aa, Glycine max
  Coding DNA Sequence Number=SeqID_72151
  Gene Ontology: Mol. function=transcription regulator activity; Cellular component=nucleus; Biological process=regulation of transcription
  Homolog annotation: Hit_ID=A7NUH5; Match level="QueryCoverage=100%, HitCoverage=100%, E-value=1e-108, Identity=59%"; Hit description =Chromosome chr18 scaffold_1, whole genome shotgun sequence
  Pfam annotation: Domain name=HLH; Domain location=165-230; Score =32.6; E_value=1.4e-06; Accession=PF00010.17; Description=Helix-loop -helix DNA-binding domain
MELQDHDFLEELMSLRRETWDTNPCSQENQLFSNGWSFDCFEDQNYHQAFPPNSFSCQQVPQSYNNKGYNYNEIYSSLLHEFSAPQVIDSSSYNTLDTSPFLAQEDYPLSMMEEEDPGFLGEELHCLDLQTTCKMEPSHSTEMPIFNTTSSFVERKNRAKKLQGQPSKNLMAERRRRKRLNDRLSMLRSIVPKISKSIGLKYLNVKPHRTTMMDRTAILGDTIGYMKELLEKINNLKQEIEVDSNMAGIFKDVKPNEIIVRNSPKFDVERRNVNTRVEICCAGKPGLLLATVNTLETLGVEIQQCVISCFNDFTVQASCSEELLQKTILSSEDIKQALFRSAGYGGRYL

SEQ ID NO: 163837 - protein, 118 aa, Glycine max
  Coding DNA Sequence Number=SeqID_72152
MGAHSSFGLGMPISLPKITQEAFGKGLIVVVDQLLCSAILLLVSRAKHATRCKVWKSHGGYGDADVVEREERRGVTVECSLCDCDYKCERERDCEREGVKYGGGVEVVAALAWWRTRL

SEQ ID NO: 163838 - protein, 334 aa, Glycine max
  Coding DNA Sequence Number=SeqID_72153
  Gene Ontology: Mol. function=protein dimerization activity; Cellular component=nucleus; Biological process=regulation of transcription, DNA-dependent
  Homolog annotation: Hit_ID=Q8RVH8; Match level="QueryCoverage=99%, HitCoverage=96%, E-value=1e-111, Identity=62%"; Hit description =Aux/IAA protein
  Pfam annotation: Domain name=AUX_IAA; Domain location=66-334; Score =293.0; E_value=5.9e-85; Accession=PF02309.7; Description=AUXIAA family
MSKPLLGIAEEEGQSNVTLLVSSSATMESVCLNSSKLKERNYMGLSDCSSVDSSAPSFSDETKSNLNLKATELRLGLPGSQSPERDSDLCLRSSIQFDEKPLFPLHPATDEHHSSSKPAVLGNKRGFSDVMSGFAEEKLLVSSEVNTILPPRPSSNVGLKPSSMLENVGAQQQAKELATVKVGHERSHAVNESRPNLNDSTNNNSSAPATKAQVVGWPPIRSFRKNSLVTTSKNVEEVDGKVGPGALFVKPFCQDPVTAYVDVMSGSCGSHGNLGGEVLNETKLKDLLHGSEYVLTYEDKDGDWMLVGDVPWEMFTETCKRLRIMKSSEAIGLG

SEQ ID NO: 163839 - protein, 188 aa, Glycine max
  Coding DNA Sequence Number=SeqID_72154
  Subcellular localization annotation: CTP_CleavageSite=61; ConfidenceScore=5.08e-01
MGYFEIVCRDMLGAPSNIAGAPSNLLKGQFCPSFKNIKNFFPLSEAFCLLSSAKNLFSSLLSSAKASFLGGLLLREASPPSSSPQGFSLPFAFEMNFRVEDAGKNSGSLVTVSLPEDFRKKGSSEGNETTFGRTGLPESSRNTSSRMFPEDVLLPETFRKKVLPDDLSVVPEALSGRSFFRNVSGKID

SEQ ID NO: 163840 - protein, 174 aa, Glycine max
  Coding DNA Sequence Number=SeqID_72155
MSFEKILAGIGQTNPSWRCLELSSSFTTLWITHSSPKPEMKEEDRASKFNTVVALSIQQSIQILISIALLKSSPKNNNPLTPIKLVRRQNNVVHCWLHSCTNKISLRNSFDTSIRVRGTSSGAQDHGSDGGGANYDNVIVLVAVTIMIAMLVVVMTILVLDWGVKQSNQTKSIK

SEQ ID NO: 163841 - protein, 101 aa, Glycine max
  Coding DNA Sequence Number=SeqID_72156
MNDKKVVVVGVSLSETYALSENHPLSEAPIPLSESGESIEESAKHLRAQRVISSLSESERLKILISKSVERKTEVQNRARKPKTSALKRILGLGVISRFLE

SEQ ID NO: 163842 - protein, 56 aa, Glycine max
  Coding DNA Sequence Number=SeqID_72157
MSKSGCQSQDSSRANPEAIGSPITLYPVAQEQNLPQEVIVMSTTYREKGYISNCEQ

SEQ ID NO: 163843 - protein, 110 aa, Glycine max
  Coding DNA Sequence Number=SeqID_72158
  Gene Ontology: Mol. function=transferase activity; Cellular component= plastoglobule
  Homolog annotation: Hit_ID=Q9ASX5; Match level="QueryCoverage=64%, HitCoverage=17%, E-value=2e-12, Identity=50%"; Hit description =Uncharacterized aarF domain-containing protein kinase At5g05200, chloroplast precursor
MRSNFTTIQRLTSLDHRSTEIVDIVAYIFALVPTMQPQELDTEIVVATTTGTATNATAVAANVVVDERQMNALFLGVLLYFDRYTRLLAPNLNMLQDQRISIASNRRSRV

SEQ ID NO: 163844 - protein, 620 aa, Glycine max
  Coding DNA Sequence Number=SeqID_72159
  Gene Ontology: Mol. function=solute:hydrogen antiporter activity; Cellular component=integral to membrane; Biological process =regulation of pH
  Homolog annotation: Hit_ID=A7NY62; Match level="QueryCoverage=94%, HitCoverage=98%, E-value=4e-89, Identity=36%"; Hit description =Chromosome chr6 scaffold_3, whole genome shotgun sequence
  Pfam annotation: Domain name=Na_H_Exchanger; Domain location=56-406; Score=-59.2; E_value=0.0034; Accession=PF00999.12; Description =Sodiumhydrogen exchanger family
MNINELFESVDILNISEHHANFNVCLHTPPHIVSDGIWGGHITEAPPLRSSFSLFLLQVIVIYTVTRALHFPIKKLGLPSIISQMMVGLIIGPSLNILEEDKIMLFPYGSQDTLATIASLGHVLFVFENGVKMDFSITTRIGKKEWVIALVGLLLPLLIGYTQLEIISTLLTQVIASVLNDLQILNSELGRLALSSALVGDILSNILIISTVVFDVNQQVDGIGIPLKDAMSLAILLNCKGVVEVAMYSSALDKNDLEPDIYTVVITTIMITNSIVHLMVKRLYDPSRKYVGYQKRNIFNLKPDSNLRILVCIHKQYHTIPIIRALDLCTPTPEYPTTVDVLHLIELVGRSSPIFVSHKMKKGVLSHTRNSYSENVILSFKIYEDEKKGATTINPYTAISPPTLMHEDVCFLALDKVASIIILPFHRKWSINGKIEHEDKTIRSLNCKVMEKAPCSVGILVSRFVHQRDSPLRLAMIFLGGNDDREALCLANRAAKDSSVNLVVYHITTNNKDEIQDVDTMLDHAMLKDAKKECSNLKTVIHKEIIVEDGAQISSILRQMIDEHDFFIVGRRHGIVCPQTKGLQGWSEFSELGLIGDFLASTDLECKSSVLVVQQQQLFH

SEQ ID NO: 163845 - protein, 552 aa, Glycine max
  Coding DNA Sequence Number=SeqID_72160
  Gene Ontology: Mol. function=methyltransferase activity; Cellular component=nucleus; Biological process=mRNA modification
  Homolog annotation: Hit_ID=A2Q4A7; Match level="QueryCoverage=98%, HitCoverage=97%, E-value=0.0, Identity=76%"; Hit description =Tetratricopeptide-like helical
  Pfam annotation: Domain name=PPR; Domain location=113-147; Score=2.5; E_value=3.9; Accession=PF01535.11; Description=PPR repeat
  Pfam annotation: Domain name=PPR; Domain location=148-182; Score =13.8; E_value=0.18; Accession=PF01535.11; Description=PPR repeat
  Pfam annotation: Domain name=PPR; Domain location=210-243; Score =20.8; E_value=0.0051; Accession=PF01535.11; Description=PPR repeat
  Pfam annotation: Domain name=PPR; Domain location=273-307; Score =29.3; E_value=1.4e-05; Accession=PF01535.11; Description=PPR repeat
  Pfam annotation: Domain name=PPR; Domain location=374-408; Score =45.0; E_value=2.7e-10; Accession=PF01535.11; Description=PPR repeat
  Pfam annotation: Domain name=PPR; Domain location=409-443; Score=0.7; E_value=6.5; Accession=PF01535.11; Description=PPR repeat
  Pfam annotation: Domain name=PPR; Domain location=445-479; Score=0.5; E_value=6.8; Accession=PF01535.11; Description=PPR repeat
  Pfam annotation: Domain name=PPR; Domain location=511-545; Score=1.5; E_value=5.1; Accession=PF01535.11; Description=PPR repeat
  Pfam module annotation: Pfam domain module=PPR::PPR::PPR::PPR::PPR::PP R::PPR::PPR; Domain location=113-147::148-182::210-243::273-307::374 -408::409-443::445-479::511-545
MESKHYLMQLLNAAKTIDHLKQTHALFLKLLRQQPPHHYHYFMGRLLHQVLRCTGEKTNLCYAHQLFDTMPNCPSSFLWTSLIRALLSHQAHLHHCISTYSRMHQNGVLPSGFTFSSILSACGRVPALFEGKQVHARVMQSGFHGNKIVQTALLDMYAKSGCISDARAVFDGMDDRDVVAWTAMVCGYAKVGMMVDAQWLFDKMGERNSFTWTAMVAGYANCEDMKTAKKLYDVMNDKNEVTWVAMIAGYGKLGNVREARRVFDGIPVPQGASACAAMLACYAQHGYAKEAIDMYEKMREAKIKITEVAMVGAISACAQLRDIRMSNTLTGHLEEGCCDRTHIVSTALIHMHSKCGNINLALSEFTTMRYRDVYTYSAMIAAFAEHGKSQDAIDLFLKMQKEGLKPNQVTFIGVLNACGSSGYIEEGCRFFQIMTGVFGIEPLPEHYTCIVDLLGKAGQLERAYDLIKQNASSADATTWGSLLATCRLYGNVELGEIAARHLFEIDPEDSGNYVLLANTYASKDKWEHAQEVKKLISEKGMKKKPSGYSSIQ

SEQ ID NO: 163846 - protein, 85 aa, Glycine max
  Coding DNA Sequence Number=SeqID_72161
MCIVAPSSGILPASVEVDINDGYHPSLQSIDLDLEEGSGDSEDASVGATYAFEGIHLNDSQEIVSQGIGSQKSRKREKELITLKS

SEQ ID NO: 163847 - protein, 121 aa, Glycine max
  Coding DNA Sequence Number=SeqID_72162
MPQPNEDKVLINDPICDMINDTFGHHPDNNDMEEDKDVCLEASQTMSDDIIELLEDEGPLVGIMEGGRGRGEKGYVRGGEGRGKVNHSVGGFVNNVCNGDWKSEEAKETWSEGRGLGILDC

SEQ ID NO: 163848 - protein, 57 aa, Glycine max
  Coding DNA Sequence Number=SeqID_72163
MSVKNLVGCLGVHDKTNHTLHKLKGALKLGVFTPKAYTPKSPSGPLPSNSSPTQKIF

SEQ ID NO: 163849 - protein, 401 aa, Glycine max
  Coding DNA Sequence Number=SeqID_72164
  Gene Ontology: Mol. function=mismatched DNA binding; Biological process=maintenance of fidelity during DNA-dependent DNA replication
  Homolog annotation: Hit_ID=Q9LVW1; Match level="QueryCoverage=99%, HitCoverage=47%, E-value=1e-107, Identity=53%"; Hit description=DNA mismatch repair protein MutS2-like
  Pfam annotation: Domain name=MutS_V; Domain location=1-212; Score= -99.4; E_value=9.3e-08; Accession=PF00488.12; Description=MutS domain V
  Subcellular localization annotation: CTP_CleavageSite=43; ConfidenceScore=5.04e-01
DAALDNAPPVPVDFLVSQKTRVIVITGPNTGGKTICLKTVGLAAMMAKSGCRLTKALNSDFESNVGLYVLASESAQIPWFDSVFADIGDEQSLSQSLSTFSGHLKQISVRNNGTNPLEGAALGMALLESFAQDSCLLTMATTHHGELKTLKYSDEAFENACMEFDEVNLKPTYKVLWGVPGRSNAINIAERLGLPSVVVDTARMLYGSASAEIDEVITDMERLKQEYQELLDEARHYLRHSRGLYNSLLNTRRKIIEYSTNLRFKKMRDVSEAAAMARSILHKKVRELDASAKQPSQNNKTISSSNLSATNKSQTVAENKEPTIADKSASSVKVFNRSRSVVIHLIDVADKSGPPKVGDMVHVSSLGKQVTVLKVDSSKGEIVVQAGNMKLKLKLTDIQRS

SEQ ID NO: 163850 - protein, 253 aa, Glycine max
  Coding DNA Sequence Number=SeqID_72165
  Gene Ontology: Mol. function=mismatched DNA binding; Biological process=maintenance of fidelity during DNA-dependent DNA replication
  Homolog annotation: Hit_ID=A7QET1; Match level="QueryCoverage=94%, HitCoverage=38%, E-value=2e-60, Identity=50%"; Hit description =Chromosome chr16 scaffold_86, whole genome shotgun sequence
DQLWSLNQTFEESLKLLEETNAAVEMNKHGTLRLHLGHLDAMLVKTAIQHARRSIPVSGYEARAIVALLQCAEIVQGDLKAVIKEDKDWHNRFMPLTEVARQQVQVIERKVIPVYFTIFHTVGSGDTGCIRDVQQLIESIIRNEKSETSTLEVNNIDGRWCVRVDSGQKTSFKGLLLSSGSGVGSTIEPLSAVPLNDELQRARSLVVKAEADVLLALTKKMQLDLDDIEKTLNSLVELDVEFAYWFSFQWSSS

SEQ ID NO: 163851 - protein, 76 aa, Glycine max
  Coding DNA Sequence Number=SeqID_72166
MLSYVLMEKEEVVYHPKDLAMILGSEQIFAISLTFKQLLDNSNSPPANQYHTNKNQGIRPLVEALRMSFGATVVAM

SEQ ID NO: 163852 - protein, 245 aa, Glycine max
  Coding DNA Sequence Number=SeqID_72167
  Gene Ontology: Mol. function=molecular_function; Cellular component =membrane; Biological process=auxin mediated signaling pathway
  Homolog annotation: Hit_ID=A7QGC1; Match level="QueryCoverage=86%, HitCoverage=60%, E-value=9e-47, Identity=44%"; Hit description =Chromosome undetermined scaffold_91, whole genome shotgun sequence
  Pfam annotation: Domain name=DUF6; Domain location=69-199; Score =16.0; E_value=0.0084; Accession=PF00892.11; Description=Integral membrane protein DUF6
  Pfam annotation: Domain name=Multi_Drug_Res; Domain location=94-190; Score=-19.9; E_value=0.015; Accession=PF00893.10; Description=Small Multidrug Resistance protein
  Pfam module annotation: Pfam domain module=DUF6::Multi_Drug_Res; Domain location=69-199::94-190
MEKLRLQTWAGKAKCVGAILCVGGALVNSLYKGKEFYLGHHSHHAQTATAAHKTNMLRGTLFLICSCFSLTACYFQLKKVKLLRIFPLRFWGTMIACILAAIQAAIIGAFLDSSKASWRLEWDLQLITIVYSGALATAASFCFLSWAIKIKGPSYPPMFNPLALIFVAISEAIVLGQPIGVETLVGMVLIIMGLYFFLWGKNNDTQRLPQPNGLTSMPDTSIVAPSSSPTDTSVLLQIDKTCNKN

SEQ ID NO: 163853 - protein, 43 aa, Glycine max
  Coding DNA Sequence Number=SeqID_72168
MGWCGTMVGLVHHEELTLDGCGGFWVEVGYSGYGGLGEMLGLA

SEQ ID NO: 163854 - protein, 143 aa, Glycine max
  Coding DNA Sequence Number=SeqID_72169
MEIYNLLKMLKLPWPRHYEQGEQGPYPCICKEAVSGFEPMTNKSPRHNFTAAPGLALKNFVPHCPEALRYAKEKCSTRKPLLPIPRGKRRDFASEPLLEPSIVQEVSFDDDNEEEEFLDEFEYISVEVLKCTDEDDDDSDDDE

SEQ ID NO: 163855 - protein, 40 aa, Glycine max
  Coding DNA Sequence Number=SeqID_72170
MVASLVLSRAPPLVALLGFLCVRKEKGAEVFCKSCSRKQA

SEQ ID NO: 163856 - protein, 132 aa, Glycine max
  Coding DNA Sequence Number=SeqID_72171
  Gene Ontology: Mol. function=ribonuclease activity; Cellular component=cytoplasm; Biological process=carbohydrate metabolic process
  Homolog annotation: Hit_ID=A7Q2X2; Match level="QueryCoverage=48%, HitCoverage=6%, E-value=1e-20, Identity=70%"; Hit description =Chromosome chr12 scaffold_47, whole genome shotgun sequence
MNNGSGQSAFSGKSATSVDELCKIIWTVEADLEDGHLLYITGDPAVLGCWKPNMAVLMSPTEDANTWKAEFQNSRSRGALLLHKKGYLALLTGLLKLSDFSSNSQNSGDFSGDCQNSDNFSDNCQKFRQLFR

SEQ ID NO: 163857 - protein, 352 aa, Glycine max
  Coding DNA Sequence Number=SeqID_72172
  Gene Ontology: Mol. function=transcription factor activity; Cellular component=transcription factor complex; Biological process =regulation of transcription, DNA-dependent
  Homolog annotation: Hit_ID=A7PP63; Match level="QueryCoverage=98%, HitCoverage=84%, E-value=3e-89, Identity=50%"; Hit description =Chromosome chr8 scaffold_23, whole genome shotgun sequence
  Subcellular localization annotation: CTP_CleavageSite=52; ConfidenceScore=5.42e-01
MKRKSGMTDSEGESQAQKWSNSPGYTNVSNVTNNSPFKTPVSAKGGRAQKAKASKEGRSCPPTPMSNAGSPSPLTPASSCRYDSSLVLEQNSYIKPYRGIESSTSGEVDGDISVLKAEVEKLSLEEQGLDDQIREMQERLRNLSENENNQKCLFVTEEDIKGLPCFQNETLIAIKAPHGTTLEVPDPEEAVDYPQRRYRIILRSTMGPIDVYLISQFEEKFEEVNGAELPMIPLASSSGSNEQLMTEMVPAECSGKELEPQTQLSSHAFSDLNASQEFAGGMMKIVPSDVDIIGFYQMLTTILYSLTPNKTATVDWNGIDMLHPDFGIISRPQSPSSGLAEVPSTGANSIQK

SEQ ID NO: 163858 - protein, 453 aa, Glycine max
  Coding DNA Sequence Number=SeqID_72173
GQKYGFVQFVGVENPKILEIKLDKIYISNVKLHVNLPRFRRREGMQLSQEQPEGGDKGRGSKGLCRTLVNIKGTGSPLMGTKDFHTTDGLELWEGSDMLVETTNEAWLSKSLVRRLHEPEKIFDLQDMFILDALSSIKAQYIGDNRVLLIGHDSDILLLDMSDNRLVWVRYKRLLLNTWNEVGFGRVVVPIGTLIRINDRVWSVRIVEELGDKRDKCCCFHEKENEGDEEEFIVAALGRVVSKRMRSMSSWGVHRDIWGVKRIFLLRMFSKVLETVSLLTGVGLMEECSTFGLQAQLGLSNLSPILPTQRKGFVDVSETQYMNPLLDDPTNITGSLMVREPMADDGDHVLKVIDVAIRPPIAPPKCKENEGGTTEGLWEVEGCSKEPMRELPEPYKIIWTHSKFDSGPRSSSECQGSQWIKDDQQEAKDKLEVDKFTKLEMWDNNNYMDKHER

SEQ ID NO: 163859 - protein, 416 aa, Glycine max
  Coding DNA Sequence Number=SeqID_72174
  Homolog annotation: Hit_ID=A5BZ92; Match level="QueryCoverage=80%, HitCoverage=53%, E-value=7e-20, Identity=24%"; Hit description =Putative uncharacterized protein
MVNWRKRNNMIRGVHADGVWKEEPLEVKEEVWNDDNDMLLGSFGKEEIVEAIWDCRSSKSLNPDGINVSFIALIPKVGDPQGVIDERQSAFLGGRNLLHSALIANEVVEDARKNRKKYFYSLGPPREFKPQKGLRKGDPLAHFLFNIVAEDLSVLIREASLKSLSKGYLVGKLGVETTCAPKNHGGLGVKDIAMFNEALLTKWKWNLFHDRGSLWLVCGGRSDGWFDNILEWRIESGELVRDMGSWSLEGWRLEFKWRKEWFDWELSVVEEFLNVLTNVNIANQGEDHWLEDSSSMYSIKSVYMALYDLRVGSNEIDIFKSLWQIKIPHKVAFLLWRVFYDGIPTKSRRVSTQLYLSRLASISDNVLMVYRVIGGKRVGVQLCGPFGRKEMQCFLNEETLRLNNFGRELCLRCGLG

SEQ ID NO: 163860 - protein, 698 aa, Glycine max
  Coding DNA Sequence Number=SeqID_72175
  Gene Ontology: Mol. function=hydrolase activity, hydrolyzing O -glycosyl compounds; Cellular component=integral to membrane; Biological process=carbohydrate metabolic process
  Homolog annotation: Hit_ID=A7NYK5; Match level="QueryCoverage=74%, HitCoverage=99%, E-value=1e-171, Identity=71%"; Hit description =Chromosome chr6 scaffold_3, whole genome shotgun sequence
  Pfam annotation: Domain name=Glyco_hydro_3; Domain location=251-409; Score=87.1; E_value=5.6e-23; Accession=PF00933.12; Description =Glycosyl hydrolase family 3 N terminal domain
  Pfam annotation: Domain name=Glyco_hydro_3_C; Domain location=481 -693; Score=171.6; E_value=2e-48; Accession=PF01915.13; Description =Glycosyl hydrolase family 3 C terminal domain
  Pfam module annotation: Pfam domain module=Glyco_hydro_3::Glyco_hydro_ 3_C; Domain location=251-409::481-693
MRKKCKGSFGILKKCWVHLAILRVKLRHPVFAVGRCSEEESQDPGIGEVEVVSAACGGVHGELVLEDEATVVDGNQALQDHGGVVGLLKAVHQDLHSDQGGREPSPEERSVAECFSVGGVEESWPVTPAGPRRRTWRPAGSKVSLYRVPFGRQICMTEERSSLRGTLHLQYMDCLYMNPQESIEARVKHLLSLMTLNEKIGQMTQIERSVATPSAIKHFSIGSVFSAPHNGRFEKVLSSDSADMVDGFQKLALESRLAIPIIYGVDAIHGNNSVYGATIFPHNVGLGATRNNVVACAKHFVGDGGTEKGVNEGNTILSYEDLERIHMAPYVDCIAKGVSTIMVSYSSWNGNKLHGHHFLLNEILKEKLGFKGFVISDWEGIDELCQPYGSDYRHCISTAINAGIDMVMVPFRYEIFVEELMSLVQSGEIPIARIDDAVERILRVKFAAELFEFPLTDRSLLDVVGGKLHRDLAHEAVRKSLVLLKNGKDPSKPFLPLNRNAKRILVAGTHADDIGYQCGGWTGTKYGSSGRITIGTTILDAVKEAVGNETEVIYEQCPSTDIIECSEVSFAVVVVGEGPYAECGGDNSELVIPFNGAGIIDLVADKIPTLVILISGRPLLLEQCLLEKIDALVAAWLPGTEAQGITDVIFGDHDFKGQLPMTWFRRVEQLDQPVGVSSCEPLFPLGYGLTYDKENLHD

SEQ ID NO: 163861 - protein, 545 aa, Glycine max
  Coding DNA Sequence Number=SeqID_72176
  Gene Ontology: Mol. function=transferase activity, transferring glycosyl groups; Cellular component=integral to membrane; Biological process=metabolic process
  Homolog annotation: Hit_ID=Q5IFH7; Match level="QueryCoverage=84%, HitCoverage=98%, E-value=1e-170, Identity=63%"; Hit description =Triterpene UDP-glucosyl transferase UGT71G1
  Pfam annotation: Domain name=UDPGT; Domain location=8-473; Score= -70.0; E_value=4.4e-07; Accession=PF00201.9; Description=UDP -glucoronosyl and UDP-glucosyl transferase
MAEMNKKEELIFFSIPGSGHLPSSLELAQLLIKHHNHLSITILCMKLPYAPYSDAYIRSVTASQPQIQAIDLPQVEPPPQELLRSPPHYILTFLQTLKPHVKAIVKNISSSHSNTVVGLVIDVFCAPLIDVANDLGIPSYLYMPSNVGFLNLMFSLQKREVGDAFNDSDPQWLVPGLPDPVPSSVLPDAFFNKQGGYATYYKLAQRFKDSKGIIVNSFSELEQYAIDALCDGQIQTPPIYAVGPLINLKGQPNQNLDQAQHDRILKWLDEQPDSSVVFLCFGSRGSFEPSQTREIALALQHSGVRFLWSMLSPPTKDNEERILPEGFLEWTEGRGMLCEWAPQVEILAHKALVGFVSHCGWNSILESMWFGVPILTWPIYAEQQLNAYRMVREFGLAVELKVDYRRGSDLVMEEEIEKGLKQLMDRDNAVHKKVKQMKEMARKAILNGGSSFISVGELIDVMTDVVKQLCYSFYPVLFYCLDYRRGSDLVMAEEIEKGLKQLMDVANMVHKKVKKMKEVARKVVLNGGSSFVSVGELIDVMTDSK

SEQ ID NO: 163862 - protein, 448 aa, Glycine max
  Coding DNA Sequence Number=SeqID_72177
  Gene Ontology: Mol. function=DNA binding; Cellular component=nucleus; Biological process=response to DNA damage stimulus
  Homolog annotation: Hit_ID=A5BX89; Match level="QueryCoverage=94%, HitCoverage=76%, E-value=0.0, Identity=76%"; Hit description =Putative uncharacterized protein
  Pfam annotation: Domain name=WD40; Domain location=192-231; Score =15.3; E_value=0.23; Accession=PF00400.23; Description=WD domain, G -beta repeat
  Pfam annotation: Domain name=WD40; Domain location=237-276; Score =20.8; E_value=0.0051; Accession=PF00400.23; Description=WD domain, G- beta repeat
  Pfam annotation: Domain name=WD40; Domain location=346-381; Score =4.5; E_value=8.8; Accession=PF00400.23; Description=WD domain, G -beta repeat
  Pfam annotation: Domain name=WD40; Domain location=52-91; Score=21.0; E_value=0.0043; Accession=PF00400.23; Description=WD domain, G-beta repeat
  Pfam annotation: Domain name=WD40; Domain location=96-135; Score =18.3; E_value=0.029; Accession=PF00400.23; Description=WD domain, G -beta repeat
  Pfam module annotation: Pfam domain module=WD40::WD40::WD40::WD40::WD4 0; Domain location=192-231::237-276::346-381::52-91::96-135
HTTLTCPHRVSTEHGVVPAPRRKACKPLEYVFERQLRPSLPSIKPKYVIPDQVNCAVIRYHSRRITCLEFHPTKNNILLSGDKKGQLGVWDFGKVYEKVVYGNIHSCLVNNMRFNPTNDCMVYSASSDGTISCTDLETGISSSPLNLNPDGWQGPNTWKMLNGLDINSEKGLVLVADSFGFLHMVDIRSNNRSGDAILIHKKGKVVGIHCNPIQPDIFLTCGNDHFARIWDLRQIEAGSSLYDLKHTRVVNSAYFSPISGTKILTTSQDNRLRVWDSIFGNVDSPSREIVHSHDFNRHLTPFKAEWDPKDPSESLAVVGRYISENYNGAALHPIDFIDTSTGQLVAEVMDPNITTISPVNKLHPRDDILATGSSRSLFIWKPKEKSELVEEKDEQKIVVCGKAEKKRGKKNGNISDESDDEGFMSKSKKSKSKKTEWKLSRCTTKDNR

SEQ ID NO: 163863 - protein, 179 aa, Glycine max
  Coding DNA Sequence Number=SeqID_72178
  Gene Ontology: Mol. function=nucleoside-triphosphatase activity; Cellular component=integral to membrane; Biological process=transport
  Homolog annotation: Hit_ID=A3C3E3; Match level="QueryCoverage=80%, HitCoverage=10%, E-value=2e-19, Identity=39%"; Hit description =Putative uncharacterized protein
  Subcellular localization annotation: CTP_CleavageSite=57; ConfidenceScore=5.03e-01
MEKRRQKWKIFSLSCVHVPNVHLLHLLRPYGSWPFIFPTFSSGYFFSILLPVESSFRFSHPKSVTGKLFSLSFLSGIQMTLLAMSLSIPGWWICFYYICPIPWTLRGIIMPQLGDVETKILGPGFEGTMKEYLAVSLGYEAEINGFSAVGLSVIVLLGFILLFFGSFAVSVKLLNFQKR

SEQ ID NO: 163864 - protein, 84 aa, Glycine max
  Coding DNA Sequence Number=SeqID_72179
MDEDLENNTEVCDGNNAMTPMVRKKSELVVVANNNSRLQMLRNFMTNLQEVFFGTKLVVLFPAVPLAVVANFYSFGRTTFINNY

SEQ ID NO: 163865 - protein, 181 aa, Glycine max
  Coding DNA Sequence Number=SeqID_72180
  Subcellular localization annotation: CTP_CleavageSite=52; ConfidenceScore=5.24e-01
MLTNDVNIGFSQKTDVHYFPRALFFFFFLALRFSSSSSLLLLRDLTVHAFVTARYPGGHCKEVRACKLQGDQGGDFQSVGVHKVLARCFVLPRCLFYNFGYIWFMSPISAFNTNTNTAVSVRNVRLRPIICQNARNRRRNPMDIKSEDLVARRREYLCLGGLLSSGLSIHQLHSSSLRESI

SEQ ID NO: 163866 - protein, 340 aa, Glycine max
  Coding DNA Sequence Number=SeqID_72181
  Homolog annotation: Hit_ID=A5BAL1; Match level="QueryCoverage=85%, HitCoverage=65%, E-value=3e-26, Identity=33%"; Hit description =Putative uncharacterized protein
  Subcellular localization annotation: CTP_CleavageSite=24; ConfidenceScore=5.52e-01
MKKILTSSSSSSSYSSTLSLDSSLCNSKSATTAGCLTAILRRILCSGGLPTHPSDQIGELDSMPKMSDKVQEFKTKHNTESIATATTTTITPGILERLMGLESMVVERDTNTANESTSSSSLPRSKSMNSVDYLGECKRMEGLHKRAKSSSFREVPTFLLHESENFLVLSFESGCDGGEFRSKERKKEKGSKERSELKKNKREKVHDDMFSVNVGNDGEFAQTTTLFMACSEKEYVGSEMVGFSFSHPVKRKEVTNGEKLKRRKKGTTCYAEKKVDTECSSEDSSPVSIFDFERGAPETEMDTSWRRKLSPELENEQLDDLHCDSNLMIKERKVNWDQIG

SEQ ID NO: 163867 - protein, 407 aa, Glycine max
  Coding DNA Sequence Number=SeqID_72182
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum membrane; Biological process=fatty acid biosynthetic process
  Homolog annotation: Hit_ID=P48625; Match level="QueryCoverage=100%, HitCoverage=100%, E-value=0.0, Identity=86%"; Hit description=Omega -3 fatty acid desaturase, endoplasmic reticulum
  Pfam annotation: Domain name=FA_desaturase; Domain location=84-328; Score=335.3; E_value=1.1e-97; Accession=PF00487.15; Description =Fatty acid desaturase
MVKDTKPLAYAANNGYQQKGSSFDFDPSAPPPFKIAEIRASIPKHCWVKNPWRSLSYVLRDVLVIAALVAAAIHFDNWLLWLIYCPIQGTMFWALFVLGHDCGHGSFSDSPLLNSLVGHILHSSILVPYHGWRISHRTHHQNHGHIEKDESWVPLTEKIYKNLDSMTRLIRFTVPFPLFVYPIYLFSRSPGKEGSHFNPYSNLFPPSERKGIAISTLCWATMFSLLIYLSFITSPLLVLKLYGIPYWIFVMWLDFVTYLHHHGHHQKLPWYRGKEWSYLRGGLTTVDRDYGWINNIHHDIGTHVIHHLFPQIPHYHLVEALTILYWELGGERGSQPSFLGVHALILLTQAAKPVLGDYYREPERSAPLPFHLIKYLIQSMRQDHFVSDTGDVVYYQTDSLLLHSQRD

SEQ ID NO: 163868 - protein, 1115 aa, Glycine max
  Coding DNA Sequence Number=SeqID_72183
  Gene Ontology: Mol. function=N-acetyltransferase activity; Cellular component=chromatin; Biological process=metabolic process
  Homolog annotation: Hit_ID=A7NYD4; Match level="QueryCoverage=90%, HitCoverage=98%, E-value=0.0, Identity=36%"; Hit description =Chromosome chr6 scaffold_3, whole genome shotgun sequence
  Pfam annotation: Domain name=Acetyltransf_1; Domain location=941 -1018; Score=21.2; E_value=0.0039; Accession=PF00583.15; Description =Acetyltransferase (GNAT) family
  Pfam annotation: Domain name=Agenet; Domain location=42-123; Score =17.0; E_value=0.0048; Accession=PF05641.3; Description=Agenet domain
  Pfam annotation: Domain name=PHD; Domain location=721-792; Score =44.5; E_value=3.9e-10; Accession=PF00628.20; Description=PHD-finger
  Pfam annotation: Domain name=PHD; Domain location=793-846; Score=0.7; E_value=0.011; Accession=PF00628.20; Description=PHD-finger
  Pfam module annotation: Pfam domain module=Acetyltransf _1::Agenet::PHD::PHD; Domain location=941-1018::42-123::721-792::793 -846
MSLNHSPMDVDGENSHVSNKRRKGSRKRKLLVNQRVEDPLMFCCQFLVLLKSVEEGFQGSWHPGTVVRCGRQKRHVKYDNILDDDGSKYLVDVVYVSAVLDGLGSSDCSNERGFIRPLPPPLAFGERDLPFGLCVDVNYEEAWWEGVIFDHCNGTKERSILFPDLGDEIKVGIHQLRLTQDWDEATENWELRGKWVFLEMVEEFDKESVIAVSLKQIWYDVRATKEFDDNLKHWTCNVKELWRDLVKEVIGDYYLLTLEQVFPALNLPEEFLKETPESVDRIQVEPNLLDGNTKCGGIIPLQEEYDKDPLVDLESEKEIILQVEPASPVQEIMPEAGEVMPGASRCAKKRKRRRTASICWKRLELRNAEFCPDVINEYIRGCGSKTVRELLKTKVRKHLAYLGWKIEWAEDKYFPGRGRYRYKSPDDAQDQKVYTSIIQVLTQLQMESNMNNVQPQIDHNRMHSTNDSNLSHLLSDLPPNDQDVDVCHPKQKPSNAKVVVEPEFCPEAVVKYYLNASKRHHWVDKVKWRLKAKKHLLAEGWTFEYPTKKRKTTLYMSPGNQWLGFLRGACRIHIKEKISEWTNSGMIPLNVPAVNESKNGEGDVDSEDLLQILSQLLKKEPALLTASPECRSTENRNHRCTRNSKASMPKSRRKGSPTRVLWSSKRVQKVSAPSPSHKRHQNVLSWLIDNSVVMSRCKVYYWAGGRNSKVSEGRITYDGIKCSCCSKIYGLGGFVNHAGGSSDCRPSASIFLKDDGGELVLCDQCPSAFHSTCLDLEDIPDGDWFCPSCCCGICGQTKIEGTEDGDLLACIQCEHKYHVGCLKDREKYESRIYMKNWLCGKECEQIYEGLQSLLGKPLIVGTDNLTWTLVKFINSESCDVGSTKNDLLAETYSKLSVALSVMHECFEPLKNPFTSKDIIDDVIFNTRSDLNRLNFEGFYTVLLEQNEELISVATIRVFGQKVAEVPLIGTRIQYRRLGMCRILMDELEKRLTQIGVERLVLPAVPDMLETWTNSFGFAKMTNFERSQFLDCAFLEFQETVMCQKLLTRSPSPKLGLTRGLHLTHFRCNQNHMMFVKCKIEFDKSSSAFEVDQAEELDKSRKDLQVVECVPTLPTS

SEQ ID NO: 163869 - protein, 67 aa, Glycine max
  Coding DNA Sequence Number=SeqID_72184
MESNRKSLNKLRRRKRKGKRRRTTPPPRVKGEIEGLKQFDSTKWLHETPSFPFDSVYCNRPLAGTGH

SEQ ID NO: 163870 - protein, 198 aa, Glycine max
  Coding DNA Sequence Number=SeqID_72185
MARINDLGKKDELQPLFEEELSIRIQLQEMFWEMIRRNESLLRHKSRSNWLLDRDGPGKVKELVISFFTSRFSEDEIRRPYLDGAEFSKISQVDYGWSIFHENGSLWRDTLESKYEGESFGGGNWSEGIDGIMGQKDEVFFQIWEIDIPPKSKHLIWRVMLDRMPSRENLRKRNVNLDDYLCPFCTQREETISHVILS

SEQ ID NO: 163871 - protein, 99 aa, Glycine max
  Coding DNA Sequence Number=SeqID_72186
MSGHRSKSEKHDVDGGGDEKQLRWDPYEVLGVLHELGNQNRVPQNGAQALNNDDVDNILRHSSYYYFSMRTPSPSSVPKEARLTQQGSHAQRSWEGLLV

SEQ ID NO: 163872 - protein, 1746 aa, Glycine max
  Coding DNA Sequence Number=SeqID_72187
  Gene Ontology: Mol. function=protein transporter activity; Cellular component=clathrin coat of trans-Golgi network vesicle; Biological process=intracellular protein transport
  Homolog annotation: Hit_ID=Q2QYW2; Match level="QueryCoverage=97%, HitCoverage=96%, E-value=0.0, Identity=84%"; Hit description =Clathrin heavy chain, putative, expressed
  Pfam annotation: Domain name=Clathrin; Domain location=1036-1181; Score=132.7; E_value=1.1e-36; Accession=PF00637.11; Description =Region in Clathrin and VPS
  Pfam annotation: Domain name=Clathrin; Domain location=1185-1326; Score=134.2; E_value=3.7e-37; Accession=PF00637.11; Description =Region in Clathrin and VPS
  Pfam annotation: Domain name=Clathrin; Domain location=1331-1477; Score=124.0; E_value=4.4e-34; Accession=PF00637.11; Description =Region in Clathrin and VPS
  Pfam annotation: Domain name=Clathrin; Domain location=1480-1639; Score=87.6; E_value=3.9e-23; Accession=PF00637.11; Description =Region in Clathrin and VPS
  Pfam annotation: Domain name=Clathrin; Domain location=594-736; Score= 70.7; E_value=4.8e-18; Accession=PF00637.11; Description=Region in Clathrin and VPS
  Pfam annotation: Domain name=Clathrin; Domain location=743-885; Score= 98.3; E_value=2.3e-26; Accession=PF00637.11; Description=Region in Clathrin and VPS
  Pfam annotation: Domain name=Clathrin; Domain location=890-1029; Score=127.6; E_value=3.6e-35; Accession=PF00637.11; Description =Region in Clathrin and VPS
  Pfam annotation: Domain name=Clathrin-link; Domain location=387-410; Score=33.0; E_value=1.1e-06; Accession=PF09268.1; Description =Clathrin, heavy-chain linker
  Pfam annotation: Domain name=Clathrin_propel; Domain location=110 -143; Score=6.9; E_value=10; Accession=PF01394.11; Description =Clathrin propeller repeat
  Pfam annotation: Domain name=Clathrin_propel; Domain location=158 -193; Score=10.9; E_value=2.4; Accession=PF01394.11; Description =Clathrin propeller repeat
  Pfam annotation: Domain name=Clathrin_propel; Domain location=19-55; Score=22.6; E_value=0.0015; Accession=PF01394.11; Description =Clathrin propeller repeat
  Pfam annotation: Domain name=Clathrin_propel; Domain location=251 -291; Score=17.5; E_value=0.051; Accession=PF01394.11; Description =Clathrin propeller repeat
  Pfam annotation: Domain name=Clathrin_propel; Domain location=309 -344; Score=15.2; E_value=0.25; Accession=PF01394.11; Description =Clathrin propeller repeat
  Pfam annotation: Domain name=Clathrin_propel; Domain location=352 -386; Score=20.4; E_value=0.0068; Accession=PF01394.11; Description =Clathrin propeller repeat
  Pfam annotation: Domain name=Clathrin_propel; Domain location=59-97; Score=2.3; E_value=54; Accession=PF01394.11; Description=Clathrin propeller repeat
  Pfam module annotation: Pfam domain module=Clathrin::Clathrin::Clathri n::Clathrin::Clathrin::Clathrin::Clathrin::Clathrin-link::Clathrin _propel::Clathrin_propel::Clathrin_propel::Clathrin_propel::Clathrin _propel::...
  Pfam module annotation: Pfam domain module=Clathrin_propel::Clathrin _propel; Domain location=1036-1181::1185-1326::1331-1477::1480 -1639::594-736::743-885::890-1029::387-410::110-143::158-193::19 -55::251-291::309-344::352-386::59-97
MAANAPITMKETLTLGSVGINQQFITFTHVTMESDKYICVRETGPQNSVVIIDMSMPMQPLRRPITADSALMNPNSRILALKGQMANFGQLDLIHKWQRSIMTLCGYGSHHVQDVVAALHDAWITPNTLGIVTQTSVYHWSVEGDGEPMKMFDRTANLANNQIINYRCDPNEKWLVLIGIAPGSAEHYLGHISSDVGLNTPFHTLHNASSGGCNEDYPKRPQLRQRPQLVKGNMQLFSVDQQRSQALEAHAASFATFRVAGNDKESTLICFASKSLNAGQVTSKMHVIELGAQPGKPSFTKKQADLFFPPDFADDFPVSMQISNKYGLIYVITKLGLLFVYDLETSTAVYRNRISSDPIFLTTEALSVGGFYAINRRGQVLLATINEAAIVPFVSGQLNNLELAVNLAKRGNLPGAEELVVKRFQELFSQTKYKEAAELAAESPRGILRTPDTVAKFQSVPVQAGQTPPLLQYFGTLLTRGKLNSYESLELSRLVVNQNKKNLLENWLAEDKLECSEELGDLVKTVDNDLALKIFIKARATPKVVAAFAERREFDKILIYSKQVGYTPDYMFLLQTILRADAQGAVNFALMMSQMEGGCPVDYNTITDLFLQRNLIREATAFLLDVLKSNLPEHGYLQTKVLEINLVTFPNVADAILANGMFSHYDRPRIAQLCEKAGLFIRALQHYSELPDIKRVIVNTHAIEPQALVEFFGTLSKEWALECMKDLLLVNLRGNLQIIVQTAKEYCEQLGVDACIKLFEQFKSYEGLYFFLGAYLSSSEDPDIHFKYIEAAAKTGQIKEVERVTRESNFYDAEKTKNFLMETKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVSNKNSLFKLQARYVVERMNADLWEKVLNPENEFRRQLIDQVVSTALPESQSPDQVSAAVKAFMTADLPHELIELLEKIVLQNSAFSGNFNLQNLLILTAIKADPSRVMDYINRLDNFDGPAVGEVAVEANLYEEAFAIFKKFNLNVQAVNVLLDNLRTIDRAVEFAFRVEEDAVWSQVAKAQLREGLVSDAIESFIRADDSTHFLEVIKASEDAEVYHDLVRYLLMVRQNTKEPKVDSELIYAYAKIDRLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEFYQNRGCFNELISLMESGLGLERAHMGIFTELGVLYARYRPEKLMEHIKLFSTRLNIPKLIRACDEQQHWMELTYLYIQYDEFDNAATTVMNHSPEAWDHMQFKDIIVKVASVELYYKAVHFYLQEHPDILNDLLNVLALRVDHTRVVDIMRKAGHIRLVKPYLIAVQSNNVSAVNEALNEIYVEEEDYDRLHESIDLHDNFDQIGLAQKIEKHELLEMRRVAAYIYKKAGRWKQSIALSKKDNLYKDCMETCSQSGDRELSEDLLVYFIEQGKKECFASCLFVCYDIIRPDVALELAWMNNMIDFAFPYLLQYTGKVDELIKDKIEAQKEEKAKEKEEKDVIAQQNMYAQLLPLALPAPPMPGMGGGGYAPLTTPPMGGMGMPPMPPFGMPPMGGSSGSY

SEQ ID NO: 163873 - protein, 386 aa, Glycine max
  Coding DNA Sequence Number=SeqID_72188
  Homolog annotation: Hit_ID=A7NYC2; Match level="QueryCoverage=96%, HitCoverage=92%, E-value=5e-94, Identity=49%"; Hit description =Chromosome chr6 scaffold_3, whole genome shotgun sequence
MLQEENESEIITSLKKKLEVHMARNELLLKENQELREEVVRLKSQIISLKAHNMERKSVLWKKIQKSIDDNNNSEAHQQHKAPPVQVITGEKSSQYENVHTNPNFKDTTPKKDKPAAIVTPAPPPRPSPTLLLPLHKKEKGLKVQQAIAPPPPPTPPKLSSVGLKTLRRVPEVIELYRSLTQKDANMENRIHSNGIPTVAFTRNMIEEIENRSTYLSAEVESTSFADVSEVEAFVKWLDGELSSLVDERSVLKHFPQWPEQKVDALREAACNYRDLKNLESEVSSYEDNPKELERSVSAKERMRESTSKRYKNFHIPWEWMLDIGIIGQMKLSSLRLAKEFMKRMTKELVSNELLQEDNLFVQGVKFAFRVHQVALILRPYKHFKN

SEQ ID NO: 163874 - protein, 455 aa, Glycine max
  Coding DNA Sequence Number=SeqID_72189
MATIDMVERLRTDMGGVVLVEGAEDSWALCERIEDSNINDTLVDMWKVKLPPKGKNPKAGFEGSNLQQKKEEDTEALPLFSWSLLLSAPLMLVLPVFPAFYHASLSLPTPSKTPCPQVSQEELQEIQQYGSAKHPCCSDRGGGIGVGEEDAKWWRSRPAIPRSVRDGGTSHVMGFGPIPGVGFGSGPSDTGVASFGSGCAVLRPNGTTRAHGAWLTPPGEPKGLTVELPAVEFAAAVEADEGPTASAPRSSKVTGKPIILLAKSSNSFRNKGGVVRNWCGFGRGGGRHRSMAMKKRVHVEGHTAHGIVKTSMGLVEGKNPKADFEGSNLQQKEEEDTEESNNGFCFHMIAYEGATTTSRIWGFTTLLLVPSPLCTINAGASCVSGILSCFPIIGAMNHDKGRMGDQQGKCRYARKQKYGIAGFQPRTKGVTGDIGMAGEYHNGYNVIDWHKGTMC

SEQ ID NO: 163875 - protein, 101 aa, Glycine max
  Coding DNA Sequence Number=SeqID_72190
  Gene Ontology: Mol. function=peptidase activity
  Homolog annotation: Hit_ID=Q8H6W2; Match level="QueryCoverage=77%, HitCoverage=98%, E-value=1e-08, Identity=44%"; Hit description=Gag -protease polyprotein-like protein
MASSNFLFPEWNSINRPPIFNGVEAIDLNIWEAIEIGPYIPTTVAGNATVEKPREQLDEEEKKLVQYNLKAKNIITSALGMDEYLGCQIAKVQKICGIPYK

SEQ ID NO: 163876 - protein, 485 aa, Glycine max
  Coding DNA Sequence Number=SeqID_72191
  Gene Ontology: Mol. function=small protein activating enzyme activity; Cellular component=cytoplasm; Biological process=protein modification process
  Homolog annotation: Hit_ID=A7NYA8; Match level="QueryCoverage=96%, HitCoverage=41%, E-value=1e-164, Identity=62%"; Hit description =Chromosome chr6 scaffold_3, whole genome shotgun sequence
MARFRCVFCSLLHYMLPRKRASEGGVVVEGDTDPTNSSNSGAASFSKKARIGSLAACSGAGAAESAVNVSGQGFGSGSGDDSVGNSVGGMALGNSQPAEIDEDLHSRQLAVYGRETMRRLFASSILVSGMQGLGVEIGNLVLRYADHTSSGFLTPLLIKENCLVVTVVLFDGIGVRKIDNLVPGLLSKNLILAGVKSVTLHDEGNVELWDLSRQRLLLAVVFTEVSLEKAIEFNDYCHSHQPPIAFIKSEVRGLFGSLFCDFGPEFTVVDVDGEDPHTGIIASISNDNPALVSCVDDERLEFQDGDLVVFSEVHGMEELNDGKPRKIKNARAYSFTLEEDTTNYGRYEKGGIVTQVKQPKVLNFKPLREALSDPGDFLLSDFSKFDRPPLLHLAFQALDKFVSEIDRFPVAGSEDDAQKLISIASNINGSLGDGRLEDVNPKLLQQFAFGARAVLNPMAAMFGGIVGQEVVKACSGKFHPLFQCN

SEQ ID NO: 163877 - protein, 41 aa, Glycine max
  Coding DNA Sequence Number=SeqID_72192
MVFWMERSHGVVFGNAEFREVTGVHREWYTSYTACAPSNKT

SEQ ID NO: 163878 - protein, 31 aa, Glycine max
  Coding DNA Sequence Number=SeqID_72193
MAMKGVLELQKKGDDKNKVSMRSKLKNWVEK

SEQ ID NO: 163879 - protein, 364 aa, Glycine max
  Coding DNA Sequence Number=SeqID_72194
  Gene Ontology: Mol. function=hydrolase activity, acting on ester bonds; Cellular component=cellular_component; Biological process =lipid metabolic process
  Homolog annotation: Hit_ID=A7NY66; Match level="QueryCoverage=92%, HitCoverage=92%, E-value=1e-115, Identity=55%"; Hit description =Chromosome chr6 scaffold_3, whole genome shotgun sequence
  Pfam annotation: Domain name=Lipase_GDSL; Domain location=35-348; Score=172.3; E_value=1.3e-48; Accession=PF00657.13; Description=GDSL- like LipaseAcylhydrolase
MAYTIYFIILMHFCTFVVVTTSISNDLMRTKFLSILVFGDSTVDTGNNNYINTLAKGNHLPYGKDFPGHMPTGRFSNGKLVPDFIASMLNLKDTVPPFLDPNLSDEELLTGVSFASGGSGFDDLTTALTGAIALSKQIEYFKVYVARLKRIAGENETKRILRDALVIISAGTNDFLFNFYDIPTRKLEFNIDGYQDYVQSRLQIFIKELYDLGCRKFAVSGLPSIGCIPIQITTKSVSLKDRKCEEDENSDAKLYNRKLARQLLKIQAMLPGSRVVYTNVYDPLNNLINQPEKYGFKETSKGCCGTGLFEVAPLCNEFTPICEDPSKYVFWDSVHPTEITYQYIAKYLEMEVLPKFQFHTDYVF

SEQ ID NO: 163880 - protein, 62 aa, Glycine max
  Coding DNA Sequence Number=SeqID_72195
LGLWVWVFDAVLVVVWVWVFDAVLVVVWVWVFDAVLVEEGVAEWWLVVASGSRRGRVVLSGG

SEQ ID NO: 163881 - protein, 295 aa, Glycine max
  Coding DNA Sequence Number=SeqID_72196
  Homolog annotation: Hit_ID=A7NY64; Match level="QueryCoverage=52%, HitCoverage=89%, E-value=2e-27, Identity=48%"; Hit description =Chromosome chr6 scaffold_3, whole genome shotgun sequence
  Subcellular localization annotation: CTP_CleavageSite=58; ConfidenceScore=5.19e-01
MSNHTQPKLEPTSLELDLAPLSMGSPSTSNGHMGNIRVSGATLMVVWVLAMRSSRGARGEENWEIEEKEEVMENSRMRAENRPRREEEVGKEEGRMVPVESWKEGEVRKSVDCDEEGGGGGGGGVVIAIAGVVHEFGRWRSLDLIRIVHLNGYVEEITRPITAGEVLKANPNHVLSKPSSQGVVRRILILAPETELKRGGIYFLIPAASLPAEKKKRHMKHVKHVSGNHGGDDSSNKNAVIKKVSSKKSNHDLSSSQQRDNGGFVVSKEKKCSGRDRRSGRGGLWQPRLESISED

SEQ ID NO: 163882 - protein, 614 aa, Glycine max
  Coding DNA Sequence Number=SeqID_72197
  Gene Ontology: Mol. function=protein binding; Cellular component =cytoplasm; Biological process=protein modification process
  Homolog annotation: Hit_ID=A7NY58; Match level="QueryCoverage=95%, HitCoverage=96%, E-value=1e-173, Identity=51%"; Hit description =Chromosome chr6 scaffold_3, whole genome shotgun sequence
  Pfam annotation: Domain name=LRR_1; Domain location=100-123; Score =4.3; E_value=48; Accession=PF00560.24; Description=Leucine Rich Repeat
  Pfam annotation: Domain name=LRR_1; Domain location=126-149; Score =2.4; E_value=1.1e+02; Accession=PF00560.24; Description=Leucine Rich Repeat
  Pfam annotation: Domain name=LRR_1; Domain location=151-173; Score =5.3; E_value=31; Accession=PF00560.24; Description=Leucine Rich Repeat
  Pfam annotation: Domain name=LRR_1; Domain location=177-199; Score =2.1; E_value=1.3e+02; Accession=PF00560.24; Description=Leucine Rich Repeat
  Pfam annotation: Domain name=LRR_1; Domain location=203-225; Score =5.7; E_value=27; Accession=PF00560.24; Description=Leucine Rich Repeat
  Pfam annotation: Domain name=LRR_1; Domain location=227-250; Score =4.4; E_value=47; Accession=PF00560.24; Description=Leucine Rich Repeat
  Pfam annotation: Domain name=LRR_1; Domain location=253-273; Score =3.0; E_value=87; Accession=PF00560.24; Description=Leucine Rich Repeat
  Pfam annotation: Domain name=LRR_1; Domain location=279-305; Score =4.5; E_value=44; Accession=PF00560.24; Description=Leucine Rich Repeat
  Pfam annotation: Domain name=LRR_1; Domain location=329-352; Score =6.8; E_value=17; Accession=PF00560.24; Description=Leucine Rich Repeat
  Pfam annotation: Domain name=LRR_1; Domain location=355-378; Score =8.5; E_value=8; Accession=PF00560.24; Description=Leucine Rich Repeat
  Pfam annotation: Domain name=LRR_1; Domain location=381-404; Score =1.8; E_value=1.4e+02; Accession=PF00560.24; Description=Leucine Rich Repeat
  Pfam annotation: Domain name=LRR_1; Domain location=432-457; Score =4.3; E_value=50; Accession=PF00560.24; Description=Leucine Rich Repeat
  Pfam annotation: Domain name=LRR_1; Domain location=458-481; Score =9.0; E_value=6.5; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1; Domain location=100-123::126-149::151-173::177-199::203-225::227 -250::253-273::...
  Pfam module annotation: Domain location=279-305::329-352::355 -378::381-404::432-457::458-481
MEQPPDTTTNLFDHLSKELLYTILDHLNDDPFARKSLSQSCKSFHALEATHRTSLKPRRLEFLLPKTLHRYRSISHLDLTLCPCVDDATLKSLSLAWHSSLRSIDLSKSRLFSHVGLSALAVNCTCLVEIDLSNRPDLTDLAAKAIAEAVNLERLCLGRCKGITDLGIGCVAVRCSRLRHVGLRWCIRVTDFGVGLIAIKCKEIRSLDLSYLPITEKCLHHILQLEHLEDLVLEHCLGIEDHGLATLQASCKSMKMLNLSKCQNIGHIGIASLTSGAHNLEKLILSSSLSVTTDLAKCLQSFPRLRSVKLDSCLGTKSGLKAIGNLGASLKELNLSKCVGVTDENLPFLVQTHKDLEKLDITCCHTITHASISSLTNSCLRITSLRMESCSLVSREGLQSISRCTKLSCLKLGICLMITDDGLKHIASSCSKLKHLDLYRSSRITDEGIVAAALGCPSLEVVNIAYNNNITDTSLESFSKCQKLELLKSEGALVFHQRVSQILLPSIKLSYCSVTDVGLIALASISCLQHVSIFHVEGLTSNGLAAFLLACQNLTKVKLHACFESLIPQQILNYMEARGCTLVWRDKTFEASGYVLLDISDLYFKLVMQELNHL

SEQ ID NO: 163883 - protein, 274 aa, Glycine max
  Coding DNA Sequence Number=SeqID_72198
  Gene Ontology: Mol. function=protein dimerization activity; Biological process=alkaloid metabolic process
  Homolog annotation: Hit_ID=A7PJA8; Match level="QueryCoverage=83%, HitCoverage=68%, E-value=2e-88, Identity=64%"; Hit description =Chromosome chr12 scaffold_18, whole genome shotgun sequence
  Pfam annotation: Domain name=Methyltransf_2; Domain location=17-253; Score=254.2; E_value=2.9e-73; Accession=PF00891.9; Description=O -methyltransferase
MEHTRYHTQLWPTHATLKPRCFTTNPPIQNSLRPSLDANHDPFWLPMSVTPFLHSILDPILTNPWNQFSNWFKNGDPTPFETAHGMMFWDYAGADSKLNNLFNDAMASDARLVTSLVIEKCKGVFMGLGSLVDVGGGTGTMAKAIAKSFPQLDCIVFDLPHVVSGLQGSENLKFVGGDMFEAIPPADAILLKKCKEAITRKGKEGKVIIIDMVVENEKRDDEPIGTQLFFDMLMMVLVTGKERSKKEWVKLNSSADYNNYKITPVLGLRSLIEI

SEQ ID NO: 163884 - protein, 506 aa, Glycine max
  Coding DNA Sequence Number=SeqID_72199
MAQVRNVFPFGIGVGEKHSALLWWGKGWEVWTKKGWRKKHGEECFGSTMKNGHPDKIGYLQQGMLSSLKNLSLKNDRLLETQLDSIMFRDTKLHANMPHFKKGYGWASGAGRTVGNGVGGSHLKQVPSVLCFKYAEARRNKNNLHEKARDAWVVEIVEEGMEWLYQSLVRSLKDVVIFDKLQDVFFMEKNRELKLRYLGDKLVLIFGMGEKTSQERIEKGDEGFFEELGELGMVVKMDKDTEKYGKLEYVRVLVKSSAHKILDVYKRVQISALVHQERVMEETSSMVLQCKCWLWNKGASSNGDSMSKSNIRVEVMSSNLECSVIDEGDGFIINPMWQPHKGSHQRGEPNVDMVEGPLQAMVMERPLEMMVENQMWSWSTKSTEVNSVHTSTTTRVGDGSEPKSNEGNGLVEKKCTKGTNEVASLDETHDNNMSRGLVDVSQASSSVLETPRARQNYLSNEITRVVKDRRALQEGGDFKWIENPSVNSVGGLVCIWNGDVFVLRRS

SEQ ID NO: 163885 - protein, 997 aa, Glycine max
  Coding DNA Sequence Number=SeqID_72200
  Gene Ontology: Mol. function=protein binding; Cellular component =viral envelope
  Homolog annotation: Hit_ID=O24293; Match level="QueryCoverage=100%, HitCoverage=100%, E-value=0.0, Identity=72%"; Hit description =Chloroplast inner envelope protein, 110 kD (IEP110) precursor
  Subcellular localization annotation: CTP_CleavageSite=34; ConfidenceScore=5.67e-01
MNPSTLTPSHTHRPLLLPSPFHTRRRRFKVSLPRCSSSSAASSPPPPPPPPPQRPPKDLKGIDVLVDKLSPPARLATSAVIVAGAAAAGYGLGSRFGGSRYAALGGAVALGAAGGAAAYALNAAAPQVAAVNLHNYVAAFDDPSKLKKEEIEAIASKYGVSKQDEAFKTEICHIYSEFVSSVLPPGGEELKGDEVDRIVSFKNSLGIDDPDAAAMHMEIGRKFFRQRLEVGDRDADVEQRRAFQKLIYVSNLVFGDASSFLLPWKRVFKVTDSQIEVAVRDNAQRLFASKLKSVGRDIDAEKLVALRKEQQLCRLSDELAENLFRDHTRKLVEENISEANRILKSRTKAVFSPGATQAIAELDKVLAFNNLLISFKNHPDVDRFARGVGPISLVGGEYDGDRKIEDLKLLYRAYVSDALSGGRMEDDKLAALNQLRNIFGLGKREAEAISLDVTSKVYRKRLAQAAADGELEMADSKAAFLQNLCDELHFDPQKASELHEEIYRQKLQRCVADGELNEEDVAALLRMRVMLCIPQQIVEAAHSDICGSLFEKVVKEAIASGVDGYDAEIQKSVRKAAHGLRLTREVAMSIASKAVRKIFINYIKRARAAGNRTESAKELKKMIAFNTLVVTNLVEDIKGESTDISSEEPVKEDITQTDDEEWESLQTLKKIRPNKELTEKLGKPGQTEITLKDDLPERDRTDLYKTYLLYCLTGEVTRVPFGAQITTKKDDSEYLLLNQLGGILGLSSQEIVEVHRGLAEQAFRQQAEVILADGQLTKARVEQLNNLQKQVGLPQEYAQKIIKSITTTKMAAAIETAVTQGRLNMKQIRELKEADVDLDSMVSENLRETLFKKTVDDIFSSGTGEFDTEEVYEKIPSDLNINKEKARGVVHELAKGRLSNSLIQAVSLLRQRNQQGVVSSLNDLLACDKAVPSQPVSWEVPEELSDLYTIYLKSNPTPENLSRLQYLLGINDSTAAALREIGDRLLNTTAEEEKFVF

SEQ ID NO: 163886 - protein, 182 aa, Glycine max
  Coding DNA Sequence Number=SeqID_72201
  Homolog annotation: Hit_ID=A5B1P6; Match level="QueryCoverage=73%, HitCoverage=50%, E-value=1e-35, Identity=54%"; Hit description =Putative uncharacterized protein
  Pfam annotation: Domain name=TB2_DP1_HVA22; Domain location=3-52; Score=-24.7; E_value=0.061; Accession=PF03134.10; Description=TB2DP1, HVA22 family
MAQFTVLEKFTDIFIGWLPMYGLMKLVLFVYLWYPKTKGTGYVYETVLGPYVSRLISHEHDIDMKLLELKATGWDNVIYYWQYCAKFWQSAFVKALQHLASQSSGFSANPNTENKDAQGQSVPQAPPNQTQSSFMKQSSTLSKSKKWPPSPPSENQNSQTEYMDEEEEEPWEPKSVTINGQH

SEQ ID NO: 163887 - protein, 222 aa, Glycine max
  Coding DNA Sequence Number=SeqID_72202
  Homolog annotation: Hit_ID=A7PP57; Match level="QueryCoverage=93%, HitCoverage=21%, E-value=8e-14, Identity=30%"; Hit description =Chromosome chr8 scaffold_23, whole genome shotgun sequence
MINNVAGVILYHILNLNVRIPSEGNASDVHDDVKTFSKCLNEVERVICYDPESNGSESINVTYLGAHWEGFMSSFNINSSNSEICSKRSGIFAFVFCEDQSLLLASIFLLLILTESKDLDCLLSSMSGLSEKEDEMLQTDDTSISKSVDESIFIRFMPEILNALLNVLAFQQPLSIMMLWNAGWCLQKLLNFHREGLNGDNLLLFTFSIFLPSYCQVSDYLS

SEQ ID NO: 163888 - protein, 251 aa, Glycine max
  Coding DNA Sequence Number=SeqID_72203
MARKSRQDFSVSKVRFFSLFVAEYESQLKGKPKQKNSEALPLSHAAFFLSSSSTIVSQQSSNLWPSFLLQIAKGGHFRGREVRVYEWDFEISEFSAFALFCLAVIAVLFECCFAWMLWKLGRIDGDPVLRETRIWATWEVKLPAFIVDHRVVPGDMSRGSGDLGDVRRAPGSQQIKGTKTTKQGGLWWLVSCETRLICEIWSLVIDYQGLENEVRKLGKPLVIDYQGASGNRLPACVIDYTEEWVTGNRLP

SEQ ID NO: 163889 - protein, 53 aa, Glycine max
  Coding DNA Sequence Number=SeqID_72204
MSRQNEFVGYSFIGKNPKKFGIPTGCTMDELKDLIKQVVPTGIPLMVLIESNY

SEQ ID NO: 163890 - protein, 15 aa, Glycine max
  Coding DNA Sequence Number=SeqID_72205
MGKILKNLVVSLVLN

SEQ ID NO: 163891 - protein, 79 aa, Glycine max
  Coding DNA Sequence Number=SeqID_72206
MKAERFFGSKRRRGEMEEGRKSQSEKRSFWANGGYSNSYTFMCSLAVKAQNPRLKANMIIGQFDFFIYWNTWMLGDKIG

SEQ ID NO: 163892 - protein, 38 aa, Glycine max
  Coding DNA Sequence Number=SeqID_72207
MDTSTLTVVNLAKSENVLMKYIVVRVAYKSMWLFMEGL

SEQ ID NO: 163893 - protein, 28 aa, Glycine max
  Coding DNA Sequence Number=SeqID_72208
MEDILTQLKKEMAAPHNRKLVQPPEGTV

SEQ ID NO: 163894 - protein, 112 aa, Glycine max
  Coding DNA Sequence Number=SeqID_72209
  Homolog annotation: Hit_ID=A7PP69; Match level="QueryCoverage=98%, HitCoverage=38%, E-value=1e-15, Identity=45%"; Hit description =Chromosome chr8 scaffold_23, whole genome shotgun sequence
  Subcellular localization annotation: CTP_CleavageSite=28; ConfidenceScore=5.07e-01
MSGRNGSGLKLDLNLNLPPPTIVNQGLESSARSAIVSLTSSSYSCLSTELNQDDNNNNNNNHGYSNISEAISIVLVGCPHCLMYVMINEGDLKCPKCKSSTLIHFLNENNIP

SEQ ID NO: 163895 - protein, 104 aa, Glycine max
  Coding DNA Sequence Number=SeqID_72210
MDRVACKGIVDGSFTMKSVYVKLVRAKGLKHIWVDSDSKEALDLIEDLSHDLKARRQGETLVIQVALALDHAVAKHLLVTTEKSVILDDSDNHALEYKEKKVLL

SEQ ID NO: 163896 - protein, 177 aa, Glycine max
  Coding DNA Sequence Number=SeqID_72211
  Gene Ontology: Mol. function=structural constituent of ribosome; Cellular component=ribonucleoprotein complex; Biological process =translation
  Homolog annotation: Hit_ID=A7PP71; Match level="QueryCoverage=71%, HitCoverage=90%, E-value=7e-58, Identity=88%"; Hit description =Chromosome chr8 scaffold_23, whole genome shotgun sequence
  Pfam annotation: Domain name=Ribosomal_S17e; Domain location=1-122; Score=229.5; E_value=7.5e-66; Accession=PF00833.9; Description =Ribosomal S17
MGRVRTKTVKKSSRQVIERYYSRMTLDFHTNKKVLEEVAIIPSKRLRNKIAGFSTHLMKRIQKGPVRGISLKLQEEERERRMDFVPDVSAIRTDQIEVDKETLDMLAALGMSEVPGIVQVDPVAVQAPLGFGRGGPGRRICCVVSKDLNIARGFGLVTLVDVEDKWDSNYGRGQLTL

SEQ ID NO: 163897 - protein, 95 aa, Glycine max
  Coding DNA Sequence Number=SeqID_72212
  Homolog annotation: Hit_ID=A7PP91; Match level="QueryCoverage=98%, HitCoverage=17%, E-value=3e-32, Identity=73%"; Hit description =Chromosome chr8 scaffold_23, whole genome shotgun sequence
MRVKLNRSLEDEEFCDGLVQALYDATRVFELAIKEHKSFSRMSWLSTAWLGVDQNAWVKALSCQAAVYSLLQAASEISSQSDGRDRNVNVFVQKR

SEQ ID NO: 163898 - protein, 340 aa, Glycine max
  Coding DNA Sequence Number=SeqID_72213
  Homolog annotation: Hit_ID=Q5XM22; Match level="QueryCoverage=34%, HitCoverage=89%, E-value=8e-24, Identity=39%"; Hit description =Resistance-like protein HAAS-2
ATTRDGVVEDPLTAVEEFNEEQQQPPIEEGVTDVEGFLGGPNDISILRDFKNHELPELKLSSHGRKMTKFGRLALEIEGLVTASGLKVTITLDDMASLLYLSIIGVFHSFEQLHVDDAVDMLVELLEVSTAEARAETIQCHGSYVRLSWLQDVYQTKIDACHWIVAVRAYLLHMLGCTLFANKSTTHVHVVFLNALRDLMQSGTYAWGAAALVHMYDNLNECWIYELFPSVGSAIAAEDYDERISGACRWTSGKALPVSMYHRHLNKLALDVDPLTVIHELERVVRQFGYIQTISPYSAAASASVEEIDARWMYQGILLEFRRFSNMTHLLNLMCLSNRW

SEQ ID NO: 163899 - protein, 190 aa, Glycine max
  Coding DNA Sequence Number=SeqID_72214
  Gene Ontology: Cellular component=integral to membrane
  Homolog annotation: Hit_ID=Q9FFZ7; Match level="QueryCoverage=90%, HitCoverage=87%, E-value=1e-41, Identity=52%"; Hit description =Putative UPF0497 membrane protein At5g06200
  Pfam annotation: Domain name=DUF588; Domain location=30-179; Score =187.3; E_value=3.9e-53; Accession=PF04535.3; Description=Domain of unknown function (DUF588)
MSTTIDVPESSNVAKEKVVLAAPSRSGGWKKGVAIMDFILRLGAIAAALGAAATMGTSDQTLPFFTQFFQFEASYDSFTTFQFFVITMALVAGYLVLSLPFSIVAIIRPHAVGPRLFLIILDTVFLTLATASGASAAAIVYLAHNGNQDSNWLAICNQFGDFCAQTSGAVVSSVFGEMLLDGADLALDAY

SEQ ID NO: 163900 - protein, 267 aa, Glycine max
  Coding DNA Sequence Number=SeqID_72215
  Homolog annotation: Hit_ID=Q9FNG5; Match level="QueryCoverage=15%, HitCoverage=21%, E-value=7e-11, Identity=75%"; Hit description =Arabidopsis thaliana genomic DNA, chromosome 5, P1 clone:MHF15
MDVKTTFLNGDLLEEIYMTQPEGHGKKTRTRGYPLESGPTLTGNTRVDRVWVRIRVFPDVQGSGTAKKSTTQGPLKRHSVGPKSEPDEEGMTMYVMQNPKHTKTLTITKKIDRKENLEKLCHLSKGSFAIEISPKPWLNCFQFCELCFKLEEENESGCSVGVRGRGRGVCVGSGEQEGCDFVGVHSPKCRLCNSLLKFVFKVETRNSNWLNIVMADAENPNWLPEDNGHLATQKKYRQKKDGQKATRKKKHNLMKFGKKPTLPDYTN

SEQ ID NO: 163901 - protein, 319 aa, Glycine max
  Coding DNA Sequence Number=SeqID_72216
  Homolog annotation: Hit_ID=A7PPA7; Match level="QueryCoverage=78%, HitCoverage=95%, E-value=1e-112, Identity=80%"; Hit description =Chromosome chr8 scaffold_23, whole genome shotgun sequence
  Subcellular localization annotation: CTP_CleavageSite=56; ConfidenceScore=5.92e-01
MTTFSFFSHFLSSTIPPSPSPSSKNSIFYALFKGNTKQFTFSKATNLLQLQPRITVFSSLKDAGSSDNTPSNFCIIEGPETIEDFVQMQLQEIQDNIKSRRNKIFLLMEEVRRLRVQQRTRRGQKVVNEEGEEKPDEMPDIPSSIPFLSHVTPKTLKKLYLTSMSFISAIIVFGGLIAPTLELKLGLGGTSYEDFIRSMHLPLQLSQVDPIVASFSGGAVGVISVLMLIEANNVEQQEKKRCKYCHGTGYLACARCSASGVCLNIDPISVCSASARPLHAPTTRRCPNCSGAGKVMCPSCLCTGMMMASEHDLRIDPFD

SEQ ID NO: 163902 - protein, 453 aa, Glycine max
  Coding DNA Sequence Number=SeqID_72217
  Gene Ontology: Mol. function=transferase activity, transferring glycosyl groups; Cellular component=cytoplasm; Biological process =multicellular organismal development
  Homolog annotation: Hit_ID=O82039; Match level="QueryCoverage=98%, HitCoverage=55%, E-value=0.0, Identity=60%"; Hit description =Probable UDP-N-acetylglucosamine--peptide N- acetylglucosaminyltransf erase SPINDLY
  Pfam annotation: Domain name=Sel1; Domain location=189-220; Score =11.7; E_value=0.57; Accession=PF08238.3; Description=Sel1 repeat
  Pfam annotation: Domain name=Sel1; Domain location=304-335; Score =8.9; E_value=1.3; Accession=PF08238.3; Description=Sel1 repeat
  Pfam annotation: Domain name=Sel1; Domain location=338-369; Score =8.5; E_value=1.5; Accession=PF08238.3; Description=Sel1 repeat
  Pfam annotation: Domain name=TPR_1; Domain location=114-147; Score =32.9; E_value=1.1e-06; Accession=PF00515.19; Description =Tetratricopeptide repeat
  Pfam annotation: Domain name=TPR_1; Domain location=155-188; Score =8.5; E_value=0.51; Accession=PF00515.19; Description=Tetratricopeptid e repeat
  Pfam annotation: Domain name=TPR_1; Domain location=189-222; Score =37.7; E_value=4.2e-08; Accession=PF00515.19; Description =Tetratricopeptide repeat
  Pfam annotation: Domain name=TPR_1; Domain location=223-256; Score =48.1; E_value=3.1e-11; Accession=PF00515.19; Description =Tetratricopeptide repeat
  Pfam annotation: Domain name=TPR_1; Domain location=304-337; Score =28.6; E_value=2.2e-05; Accession=PF00515.19; Description =Tetratricopeptide repeat
  Pfam annotation: Domain name=TPR_1; Domain location=338-371; Score =42.8; E_value=1.2e-09; Accession=PF00515.19; Description =Tetratricopeptide repeat
  Pfam annotation: Domain name=TPR_1; Domain location=372-405; Score =26.8; E_value=8.2e-05; Accession=PF00515.19; Description =Tetratricopeptide repeat
  Pfam annotation: Domain name=TPR_1; Domain location=406-439; Score =45.0; E_value=2.6e-10; Accession=PF00515.19; Description =Tetratricopeptide repeat
  Pfam annotation: Domain name=TPR_1; Domain location=48-79; Score=0.7; E_value=4.4; Accession=PF00515.19; Description=Tetratricopeptide repeat
  Pfam annotation: Domain name=TPR_1; Domain location=80-113; Score =22.2; E_value=0.002; Accession=PF00515.19; Description =Tetratricopeptide repeat
  Pfam annotation: Domain name=TPR_2; Domain location=114-147; Score =24.7; E_value=0.00033; Accession=PF07719.8; Description =Tetratricopeptide repeat
  Pfam annotation: Domain name=TPR_2; Domain location=155-188; Score =6.0; E_value=5.4; Accession=PF07719.8; Description=Tetratricopeptide repeat
  Pfam annotation: Domain name=TPR_2; Domain location=189-222; Score =22.8; E_value=0.0013; Accession=PF07719.8; Description =Tetratricopeptide repeat
  Pfam annotation: Domain name=TPR_2; Domain location=223-256; Score =36.8; E_value=8e-08; Accession=PF07719.8; Description=Tetratricopepti de repeat
  Pfam annotation: Domain name=TPR_2; Domain location=304-337; Score =18.6; E_value=0.023; Accession=PF07719.8; Description=Tetratricopepti de repeat
  Pfam annotation: Domain name=TPR_2; Domain location=338-371; Score =32.4; E_value=1.7e-06; Accession=PF07719.8; Description =Tetratricopeptide repeat
  Pfam annotation: Domain name=TPR_2; Domain location=372-405; Score =17.8; E_value=0.039; Accession=PF07719.8; Description=Tetratricopepti de repeat
  Pfam annotation: Domain name=TPR_2; Domain location=406-439; Score =39.9; E_value=9.2e-09; Accession=PF07719.8; Description =Tetratricopeptide repeat
  Pfam annotation: Domain name=TPR_2; Domain location=46-79; Score=5.0; E_value=7.2; Accession=PF07719.8; Description=Tetratricopeptide repeat
  Pfam annotation: Domain name=TPR_2; Domain location=80-113; Score =19.1; E_value=0.016; Accession=PF07719.8; Description=Tetratricopepti de repeat
  Pfam annotation: Domain name=TPR_4; Domain location=114-139; Score =0.8; E_value=32; Accession=PF07721.5; Description=Tetratricopeptide repeat
  Pfam annotation: Domain name=TPR_4; Domain location=189-214; Score =1.8; E_value=24; Accession=PF07721.5; Description=Tetratricopeptide repeat
  Pfam annotation: Domain name=TPR_4; Domain location=223-248; Score =9.7; E_value=2.7; Accession=PF07721.5; Description=Tetratricopeptide repeat
  Pfam annotation: Domain name=TPR_4; Domain location=338-363; Score =0.5; E_value=34; Accession=PF07721.5; Description=Tetratricopeptide repeat
  Pfam annotation: Domain name=TPR_4; Domain location=372-397; Score =5.3; E_value=9.1; Accession=PF07721.5; Description=Tetratricopeptide repeat
  Pfam annotation: Domain name=TPR_4; Domain location=406-431; Score =9.9; E_value=2.6; Accession=PF07721.5; Description=Tetratricopeptide repeat
  Pfam module annotation: Pfam domain module=Sel1::Sel1::Sel1::TPR _1::TPR_1::TPR_1::TPR_1::TPR_1::TPR_1::TPR_1::TPR_1::TPR_1::TPR _1::TPR_2::TPR_2::TPR_2::TPR_2::TPR_2::TPR_2::TPR_2::TPR_2::TPR _2::TPR_2::TPR_4::TPR_4::...
  Pfam module annotation: Pfam domain module=TPR_4::TPR_4::TPR_4::TPR _4; Domain location=189-220::304-335::338-369::114-147::155-188::189 -222::223-256::304-337::338-371::372-405::406-439::48-79::80-113::114- 147::155-188::...
  Pfam module annotation: Domain location=189-222::223-256::304 -337::338-371::372-405::406-439::46-79::80-113::114-139::189-214::223- 248::338-363::372-397::406-431
MAWTEDSDGNNGREKLVGENGFLKVSEPSSDGSVGDGGSVSKRCEGKDDVSYANILRSRNKFVDALALYERVLESDGGNVEALIGKGICLQMQNMGRLAFESFAEAIRLDPQNACALTHCGILYKDEGRLVEAAESYQKALQVDPSYKAAAECLAIVLTDIGTNIKLAGNTQEGIQKYFEALKIDPHYAPAYYNLGVVYSEMMQYDMALTFYEKAASERPMYAEAYCNMGVIYKNRGDLEAAITCYERCLAVSPNFEIAKNNMAIALTDLGTKVKLHKLTTSNHRVLLMEIIVLKALYYNWHYADAMYNLGVAYGEMLKFDMAIVFYELAFHFNPHCAEACNNLGVIYKDRDNLDKAVECYQLALGIKPNFSQSLNNLGVVYTVQGKMDAAASMIEKAIIANPTYAEAYNNLGVLYRDAGDIALAINAYEQCLKIDPDSRNAGQLKVFIAGAM

SEQ ID NO: 163903 - protein, 195 aa, Glycine max
  Coding DNA Sequence Number=SeqID_72218
  Homolog annotation: Hit_ID=A7Q6X7; Match level="QueryCoverage=54%, HitCoverage=23%, E-value=6e-40, Identity=66%"; Hit description =Chromosome chr12 scaffold_57, whole genome shotgun sequence
  Pfam annotation: Domain name=Kelch_1; Domain location=2-47; Score =41.1; E_value=3.8e-09; Accession=PF01344.16; Description=Kelch motif
  Pfam annotation: Domain name=Kelch_1; Domain location=49-87; Score =9.9; E_value=0.2; Accession=PF01344.16; Description=Kelch motif
  Pfam annotation: Domain name=Kelch_2; Domain location=2-47; Score =20.6; E_value=0.0059; Accession=PF07646.6; Description=Kelch motif
  Pfam module annotation: Pfam domain module=Kelch_1::Kelch_1::Kelch_2; Domain location=2-47::49-87::2-47
MPFCGCSIGVVDGCIYALEGFSRSSTIKYVWQYDPIKNSWAEASPMSVGRAYCKTGVTRGRGGLIPLQSAEVYDPHTCMWSLLPSMHFARAQVLPTVVLADLLKPIAGFIQRKVILGKLQQEMFLFMISPNWNLLISSLDYLKNFMMTCKMNMLSQLSLNEYCHHQITHSVKMLNLLQKHRENFGRLLLLPQPGF

SEQ ID NO: 163904 - protein, 379 aa, Glycine max
  Coding DNA Sequence Number=SeqID_72219
MDTIKGELKQAIKLELLQIASQQSPPLQAHDIQLLAARVSTKGSCAAPETNAIGKTTSDMHGDSIELHVIADKSTKLLALGKQFDNFGTIHNVAYADDVVQDPEKLVSSPLKAAEEDNALVPVDPFGELVKNLFEIYQKSIELPWDGTKFGIHNVKDGFFVTHADVTEIILGDKCLNISILQLWLMFMHDWAANIDYGALYGFAEPQCIHNAKTRREDCENYIGRWIKESQKQLYIASYLNEAHWQLLVLCPAENTVVWFCSLQKKPDAAIKAVVNSAMKLVTKSAEGKPPQPVPQWIKAKSHVQTGNYECGYYVMHWIWCIVSAGLKDEWIRVIRSSCLHMFMAQRVCCPHLSFGVLVSASGMHLCPGFNSWNAFQNL

SEQ ID NO: 163905 - protein, 84 aa, Glycine max
  Coding DNA Sequence Number=SeqID_72220
MDEGGDVRNNIHSHGVCSSDICDGGKVGCEDRRKWKKVTNVLRELEDGCNIRIGKLGQMMDVIDVGNTLIGPMNCEYLAVVHNF

SEQ ID NO: 163906 - protein, 265 aa, Glycine max
  Coding DNA Sequence Number=SeqID_72221
  Subcellular localization annotation: CTP_CleavageSite=60; ConfidenceScore=5.49e-01
MAESSKKQNGSSSTTTVAGHRHHRPSSDPPTPIPLPLSSPKLAVGVSLNEACALSENHTLSEALSPLNELGESREEFEKHLRVQRVISSLSETFVSSHVKYLCWEILAKLDAKFNETSENEIDLAHLVRYRMHKTLRANAPLPYPHLVTLFLQHFKVPLDDEPFVKVKRSFTIGVGVVTYFGYRKDMDGQWVHKQDLPPPIPDERTPSPPPQRDASSSHLTEVLTELCDLQEFVGDRFDAMDSCIIWLEDDISFIRRCFDPPTDS

SEQ ID NO: 163907 - protein, 191 aa, Glycine max
  Coding DNA Sequence Number=SeqID_72222
  Homolog annotation: Hit_ID=A5BSR3; Match level="QueryCoverage=58%, HitCoverage=35%, E-value=2e-08, Identity=31%"; Hit description =Putative uncharacterized protein
MTHTKKIGQITFEATKEIANKIDSLKEQASQGSFVTHGRHDILTVAIGRPEHPSRICAAGAGVTIKQYFGLTPKISRTSSSKAPEDLEQLAQKIRDQLEESITKKPKMQSQGLALPPEPEVGPSAVCAGTKESCVDPSRHDPGTGESEKYGLYVDENPAHLVALGRLYEGSTTVYNIPLGNDQVEVNVEEV

SEQ ID NO: 163908 - protein, 178 aa, Glycine max
  Coding DNA Sequence Number=SeqID_72223
GEVAETLQYMVSPQGRNTWIVDDLVSYVEKITILSEEKERIAEPVAHGPATERRFTPQEFHMLQSSVEIRGFGRRWEAVEAEEFSQQMEKHGHGMYYTPPTFSQYPSQMYQYPFEGHHTDMSASEHSLGAPQWNVPGAIPDMGDLVGIDLRHEFSAEAEQVEAGRHRGRRNPDRQAQR

SEQ ID NO: 163909 - protein, 182 aa, Glycine max
  Coding DNA Sequence Number=SeqID_72224
MLESFQQQNQMSVLELYVKKDVVGGSMFHSANSLTSCGNNLSNNEAQPPTNVSNLHGDEDDDDDDYLMSNSYVEESLDKDDSVDGISDTDDEVADMIQPVRIVHPAEGVQGIENPFWNDALHYNNINWSHPDEEDICGMIREDPSIKVSLIQERINSEFAYKVSYKKAWLAKQKAIALEYGD

SEQ ID NO: 163910 - protein, 373 aa, Glycine max
  Coding DNA Sequence Number=SeqID_72225
  Gene Ontology: Mol. function=phosphoprotein phosphatase activity
  Homolog annotation: Hit_ID=Q5XM22; Match level="QueryCoverage=35%, HitCoverage=89%, E-value=5e-32, Identity=47%"; Hit description =Resistance-like protein HAAS-2
MASLLHLPITSALHTFEPLVTSDAISLLTELLEVSHEEATFETRQAGGHHVRLGWLRDFYQSQCRTRRWVVAARTYLLHLVGCTIFANKSSTHVHVVHLEAFRDLAQTGGFTWGAAALVHMYNHLNDASQASTRQLGGYITLLQGWIYEHFPIVHTSVIHYAYDEGSPRACRWLTGKAHITGIKGAPYRRRLDALSVTDMCWMPYGEHRRVRACDLISSYTGQLRWGQIVVWRQTTWSGFFGYCTHSSRGPRRLLRRDIRLPFIIRSSSSHPIPEVSVATDLPTHSVVDCEGCQVMAEDLGAIAEDLERVINLRMVTEGTDLYDIMTRCLRRARGDAADGSCRNLPFGGRATRDSLDACSTKGIRAESPPTFI

SEQ ID NO: 163911 - protein, 167 aa, Glycine max
  Coding DNA Sequence Number=SeqID_72226
MSKIFIREGRQQMSPMHKRSIERYNSICIKYVGGNQVCLTGQESEDTEALIFGGGFFVKPKPLQQKAMLGSFGSMGGDDEESISAFIGNGDEDDWSLCEDEFEMTRRWYRRLGIVSRRRSTELVGLGSSSSMDSFASWKMNGSGMEKEEREETPLQGEDESRRSSPP

SEQ ID NO: 163912 - protein, 209 aa, Glycine max
  Coding DNA Sequence Number=SeqID_72227
  Gene Ontology: Mol. function=transcription regulator activity; Cellular component=nucleus; Biological process=regulation of transcription
  Homolog annotation: Hit_ID=A2Z1A1; Match level="QueryCoverage=45%, HitCoverage=18%, E-value=6e-13, Identity=49%"; Hit description =Putative uncharacterized protein
  Pfam annotation: Domain name=HLH; Domain location=81-162; Score=15.0; E_value=0.0039; Accession=PF00010.17; Description=Helix-loop-helix DNA-binding domain
  Subcellular localization annotation: CTP_CleavageSite=68; ConfidenceScore=5.72e-01
MLVAEKCNSLFNNNNNTSSNQPQLPFKLSTTASLDLSNPLTKLTIFNNSLSLMNGVLELRLRLTVAVRVSRSRGLEPGGDKPRTHTASPKGYVSLSQFLRRERIAERMKALQELVTNANKCSTAIPSYIIPIISFRNVKLETAKTDKASMLDEIIDYVRFLQLQVKGTPSSNLANHVDFAKVLQPIQSQISEFPIPLSHFFWLRGSKTI

SEQ ID NO: 163913 - protein, 214 aa, Glycine max
  Coding DNA Sequence Number=SeqID_72228
MLYFNGRVYEDNDGVIFEGSKNAIQIKRGISFNGLKKKLEIRFLVSGKYVALQICDDEDVETMIESFQQQQQMSVLELYVEKDVAGGSMFHAANSVTSCGRNVSHHESELPRNISNLHDDEDDDDDDYLASNSYVEESFDEDDSDDGISDTDDEVTDIVEPVSIVHPTEGMIREDPSIKISLIQERINSEFSYKVSYRKAWMAKQKAIAIEYGD

SEQ ID NO: 163914 - protein, 102 aa, Glycine max
  Coding DNA Sequence Number=SeqID_72229
  Subcellular localization annotation: CTP_CleavageSite=43; ConfidenceScore=5.14e-01
MLTDHLIRKAPSDFRQRFPPSPTTLEQKKVKFTGLTSTVDARRSSSKKKLEEEDAGSFLAPPPHLLNEEEEEPQRRRRKKKAQEEEAGRRSRKKKKCDEAGR

SEQ ID NO: 163915 - protein, 59 aa, Glycine max
  Coding DNA Sequence Number=SeqID_72230
MGHECLMDKRLSAEEMAVGGVPHWDLLVKQAHRERESRDCVWSFDKFLCSLGMDDVGTA

SEQ ID NO: 163916 - protein, 288 aa, Glycine max
  Coding DNA Sequence Number=SeqID_72231
  Gene Ontology: Mol. function=oxidoreductase activity, acting on paired donors, with oxidation of a pair of donors resulting in the reduction of molecular oxygen to two molecules of water; Cellular component=chloroplast; ...
  Gene Ontology: Cellular component=Biological process=fatty acid biosynthetic process
  Homolog annotation: Hit_ID=A9UKE1; Match level="QueryCoverage=100%, HitCoverage=74%, E-value=1e-155, Identity=78%"; Hit description =Plastidial delta-12 oleate desaturase
  Pfam annotation: Domain name=FA_desaturase; Domain location=38-233; Score=171.5; E_value=2.2e-48; Accession=PF00487.15; Description =Fatty acid desaturase
VFEIDDVKAWKSVLISVTSYALGLFMISKAPWYLLPLAWVWTGTAITGFFVIGHDCAHRSFSSNKLVEDIVGTLAFMPLIYPYEPWRFKHDRHHAKTNMLREDTAWHPVWKDEFESTPLLRKAIIYGYGPFRCWMSIAHWLMWHFDLKKFRPSEVPRMSTFTMVHHTAPHIPFKYSEEWNAAQAQLNGTVHCDYPKWIEILCHDINVHIPHHISPRIPSYNLRAAHKSLQENWGQYLNEASWNWRLMKTIMTVCHVYDKEQNYVAFDELAPEDSRPITFLKETMPDYA

SEQ ID NO: 163917 - protein, 174 aa, Glycine max
  Coding DNA Sequence Number=SeqID_72232
MLYSGGVSGMVVGWNSDSNGGDDDDSSDEMQQWWNGDGGSDNNSGGDNDNGERWNSDNDDNENDNNSDSGGGGECNKGEVRWRENDRGNSGCDDDSGSGDNNNDRMPRVVVFTAGETKRCDHPENYMGFGPFAHLWLMTRDDDIHSVVQIQWSFFPLGILQPYMETVSLIIFLP

SEQ ID NO: 163918 - protein, 50 aa, Glycine max
  Coding DNA Sequence Number=SeqID_72233
MGFVQFNASGLNWMDEQRSRAKGKEGWKGVCDRIREQRLSKAKMMRLWEN

SEQ ID NO: 163919 - protein, 471 aa, Glycine max
  Coding DNA Sequence Number=SeqID_72234
  Gene Ontology: Mol. function=sequence-specific DNA binding; Cellular component=nucleus; Biological process=regulation of transcription, DNA-dependent
  Homolog annotation: Hit_ID=A7LHG7; Match level="QueryCoverage=74%, HitCoverage=98%, E-value=1e-125, Identity=58%"; Hit description =WRKY24
  Pfam annotation: Domain name=FLYWCH; Domain location=327-389; Score =3.5; E_value=0.031; Accession=PF04500.7; Description=FLYWCH zinc finger domain
  Pfam annotation: Domain name=WRKY; Domain location=119-177; Score =109.7; E_value=8.5e-30; Accession=PF03106.6; Description=WRKY DNA -binding domain
  Pfam annotation: Domain name=WRKY; Domain location=297-391; Score =83.1; E_value=9.2e-22; Accession=PF03106.6; Description=WRKY DNA -binding domain
  Pfam module annotation: Pfam domain module=FLYWCH::WRKY::WRKY; Domain location=327-389::119-177::297-391
MGPELHFGLCINVQAYEQFRLCNLETVESPEKETIERGAVQPLQTQTENRLQVSVCSIPLSDLSPTSVTQSLSIVSSPTVQKQKISTPKVNNTHVPEVDRKNPSGRKTLSAVSVARTSASDGYNWRKYGQKQVKSPTGSRSYYRCTHSDCCAKKIECCDDSGHVIEIVYKSEHSHDPPRKTNSIRENKFLSSSEPIVENSVPEQPVRVLKDADPSISSKESLQEAPCSNDKKRQNTSNISGNDKVILKEEHAIILNVLSFNLIIRMKKGDLTEMDSPVKPGKKPKFVVHAAGDVGISGDGYRWRKYGQKMVKGNPHPREDEISYLLKQRCVGGGVVLLLPCYAEKSSTLSGQNGKNRCTSAGCPVRKHIETAVDNSDAVIITYKGVHDHDMPVPKKRHGPPSAPLVAAAAPASMNSLQVKKPDSPQNKKISTQWSVDTEGELTGEALELGGEKAMESARTLLSIGFEIKPC

SEQ ID NO: 163920 - protein, 133 aa, Glycine max
  Coding DNA Sequence Number=SeqID_72235
  Gene Ontology: Mol. function=voltage-gated potassium channel activity; Cellular component=integral to membrane; Biological process=potassium ion transport
  Homolog annotation: Hit_ID=Q9M0A4; Match level="QueryCoverage=28%, HitCoverage=5%, E-value=9e-12, Identity=92%"; Hit description =Putative cyclic nucleotide-gated ion channel 9
MEHIVQMKGRLKLNVTTTSNGALESIIQIFSVPEALKDRKLELLPIMVREQELDVLLRESIKAPRHSNDDGGSTLGQGLQTSTYPGEVIFSIALAISGLILFALLIGNMQFVQNMLEFPWACNCSCQIDWILE

SEQ ID NO: 163921 - protein, 67 aa, Glycine max
  Coding DNA Sequence Number=SeqID_72236
MVVRALNSGLEWGCDWGCCNFGGGGDDLVGDDDEEEDGQTIITHDMPAWSINNHLCKGYGLSVVDKK

SEQ ID NO: 163922 - protein, 352 aa, Glycine max
  Coding DNA Sequence Number=SeqID_72237
  Gene Ontology: Mol. function=signal recognition particle binding; Cellular component=signal recognition particle receptor complex; Biological process=SRP-dependent cotranslational protein targeting to membrane
  Homolog annotation: Hit_ID=A7PFQ9; Match level="QueryCoverage=75%, HitCoverage=48%, E-value=1e-122, Identity=80%"; Hit description =Chromosome chr11 scaffold_14, whole genome shotgun sequence
  Pfam annotation: Domain name=SRP54; Domain location=143-352; Score =170.2; E_value=5.5e-48; Accession=PF00448.13; Description=SRP54-type protein, GTPase domain
MANLSIVVQGQGEAESLRELCFVVANVNAKHSGGIGKENESSHVGAFDVSRLQKLKGKKGNGKKKDALVVAAAAMEEPKKVDKRSRGKANLEKSDLEPALKALKDRLMTKNVTAMEEALVPILTPRRSIDILRDVYAAKEQRKPYVVVFVGVGKSTNLAKVAYWLLQHNISVMMAACDTFRSGAVEQLRTHARRLQIPIFEKGYEKDPAIVAKEAIQEASRNGSDVVLVDTAGCMQDNEPLMRALSKLVYLNNPNLILFVGEALVGNDAVDQLAKFNQACYSTQKLADLSTSPTPRLIDGILLTKFDTIDDKVSALSMVYVSGAPVMFVGCGQSYTDLKKLNAKSIAKTLLK

SEQ ID NO: 163923 - protein, 256 aa, Glycine max
  Coding DNA Sequence Number=SeqID_72238
  Homolog annotation: Hit_ID=A7PFQ2; Match level="QueryCoverage=100%, HitCoverage=98%, E-value=2e-43, Identity=43%"; Hit description =Chromosome chr11 scaffold_14, whole genome shotgun sequence
MKGVVPMEPPYEVYQDQRARLRHQSLLQDYEDLHKETEAMRRKLQATKQKKFMLEDEVRFLRQRYNYLLKHPILKPQPKQQVVKPQKLKIQAPIISKGKNYNKKEPNLRPHHPASHLNSNGRISNVADVPLKKTGHLFDLNLNARSSSKKDASINISGPPVLNLNHKERINSSKEATKKSVTPFFDLNQISREEEELQGNSEPMGIEEPKRSSQRVATDEQHGDIKLSAACRSVGDGSNRAGKRKISWQDQVALRV

SEQ ID NO: 163924 - protein, 185 aa, Glycine max
  Coding DNA Sequence Number=SeqID_72239
  Homolog annotation: Hit_ID=A7PFQ1; Match level="QueryCoverage=94%, HitCoverage=49%, E-value=1e-25, Identity=34%"; Hit description =Chromosome chr11 scaffold_14, whole genome shotgun sequence
  Pfam annotation: Domain name=zf-U1; Domain location=143-176; Score =4.3; E_value=0.038; Accession=PF06220.3; Description=U1 zinc finger
MWAKAKPDVDPYGAKRKAGKPPTIDDNHHSGFSVEKKPKREWSCGLCQITTTNEKGLNNHLEGKKHKAKASLRTKKIGLDARLDGQKLQRGITSTNIGILEPRKEDQVVQNSQGLGGLDNENEIATSKETGETNALTKRKKFKFYCAFCKVQTASEIIMQSHKNGKRHLAMIKKFSQNNVVANFY

SEQ ID NO: 163925 - protein, 337 aa, Glycine max
  Coding DNA Sequence Number=SeqID_72240
  Gene Ontology: Mol. function=protein binding; Cellular component =cytoplasm; Biological process=protein modification process
  Homolog annotation: Hit_ID=A7PFP9; Match level="QueryCoverage=97%, HitCoverage=97%, E-value=1e-125, Identity=65%"; Hit description =Chromosome chr11 scaffold_14, whole genome shotgun sequence
  Pfam annotation: Domain name=F-box; Domain location=12-60; Score =29.8; E_value=9.6e-06; Accession=PF00646.24; Description=F-box domain
  Pfam annotation: Domain name=LRR_1; Domain location=150-175; Score =7.8; E_value=11; Accession=PF00560.24; Description=Leucine Rich Repeat
  Pfam annotation: Domain name=LRR_1; Domain location=176-203; Score =10.1; E_value=4.1; Accession=PF00560.24; Description=Leucine Rich Repeat
  Pfam annotation: Domain name=LRR_1; Domain location=248-271; Score =1.9; E_value=1.3e+02; Accession=PF00560.24; Description=Leucine Rich Repeat
  Pfam annotation: Domain name=LRR_1; Domain location=273-297; Score =13.1; E_value=1.1; Accession=PF00560.24; Description=Leucine Rich Repeat
  Pfam module annotation: Pfam domain module=F-box::LRR_1::LRR_1::LRR _1::LRR_1; Domain location=12-60::150-175::176-203::248-271::273-297
MKTETEPNETESDWSELTRECLINILSRLSVEDRWRGTMLVCKSWFSVFKEPSLHFVFNLDPQFDSPTESTRWWTPEFEAKIDNMLRSVVEWAQSSLTHIRIRHCSDRSLALVAQRFQLSPKFQYPFVFPSLIDGGPNWVSKLWSFNCPNLEVLFIRSCPRVTDDSISRIALSCPKLRELDISYCYEITHESLVLIGRNCPNLKVLKRNLMNWLDPSQHRGIVPDDYLNACPQDGDDEAAAIANSMPGLEQLEIRFSKLTAKGLNSICQGCPNLEFLDLSGCANLTSRDIANASSSLVHLKEIKKPNFYIPRSVFHTERYGHWSLYDERFQTDIFQI

SEQ ID NO: 163926 - protein, 133 aa, Glycine max
  Coding DNA Sequence Number=SeqID_72241
  Gene Ontology: Mol. function=homocysteine S-methyltransferase activity; Biological process=methionine biosynthetic process
  Homolog annotation: Hit_ID=P56707; Match level="QueryCoverage=44%, HitCoverage=17%, E-value=2e-21, Identity=84%"; Hit description =Selenocysteine methyltransferase
MECGSIAESGNKVVAVGINCTPPRFIHGLIVLLKRVTTKPIVIYPNSGETYDADLKEWVQTEVQKLLKQLADERFSEASNHSSNVNLVDKSRKVKVLRRLINVQKAKSRESKEDPLELRYPVTKDTLVTESME

SEQ ID NO: 163927 - protein, 860 aa, Glycine max
  Coding DNA Sequence Number=SeqID_72242
  Gene Ontology: Mol. function=transferase activity, transferring glycosyl groups; Cellular component=integral to membrane; Biological process=cell wall organization and biogenesis
  Homolog annotation: Hit_ID=A8R7F0; Match level="QueryCoverage=98%, HitCoverage=82%, E-value=0.0, Identity=85%"; Hit description =Cellulose synthase catalytic subunit
  Pfam annotation: Domain name=Cellulose_synt; Domain location=57-856; Score=2078.6; E_value=0; Accession=PF03552.5; Description=Cellulose synthase
MAKFSYNMWHAVIKAGNGKLDEAKEDRMDDWKLQQGNLGHEPDEDPDAAMLDEARQPLSRKVPIASSKVNPYRMVIVARLVILAFFLRYRLMNPVHDALGLWLTSIICEIWFAFSWILDQFPKWFPIDRETYLDRLSIRYEREGEPNMLAPVDVFVSTVDPMKEPPLVTANTVLSILAMDYPVDKISCYISDDGASMCTFEALSETAEFARKWVPFCKKFSIEPRAPEMYFSEKVDYLKDKVQPTFVKDRRAMKREYEEFKVRINALVAKAQKVPQGGWIMQDGTPWPGNNTKDHPGMIQVFLGHSGGHDTEGNELPRLVYVSREKRPGFQHHKKAGAMNALIRVSAVLTNAPFMLNLDCDHYVNNSKAAREAMCFLMDPQTGKKVCYVQFPQRFDGIDRHDRYANRNTVFFDINMKGLDGIQGPAYVGTGCVFRRQALYGYNPPKGPKRPKMVSCDCCPCFGKRKKVKYEGNDANGEAASLRGMDDDKEVLMSQMNFEKKFGQSSIFVTSTLMEEGGVPPSASPASQLKEAIHVISCGYEDKTEWGIELGWIYGSITEDILTGFKMHCRGWRSIYCMPKRAAFKGTAPINLSDRLNQVLRWALGSIEIFFSRHCPLWYGYKEGKLKWLERFAYANTTVYPFTSIPLVAYCVLPAVCLLTDKFIMPPISTFAGLYFVALFSSIIATGLLELKWSGVSIEEWWRNEQFWVIGGVSAHLFAVIQGLLKVLAGIDTNFTVTSKAADDEEFGELYTFKWTTLLIPPTTILIINIVGVVAGISDAINNGYQSWGPLFGKLFFSFWVIVHLYPFLKGLMGRQNRTPTIVVIWSVLLASIFSLLWVRIDPFVLKTKGPDTKLCGINC

SEQ ID NO: 163928 - protein, 117 aa, Glycine max
  Coding DNA Sequence Number=SeqID_72243
MGVEGNGGGVGGEGEAFDEDVEEEDVGFGNGEEEGTCVARGADVEELLGELSDGGEAVLVTVADELRVGFGKVREGARFVDAANAPSNHCMHLNTLVRYSLQRLIVCYLWTLVLKMI

SEQ ID NO: 163929 - protein, 1154 aa, Glycine max
  Coding DNA Sequence Number=SeqID_72244
  Gene Ontology: Biological process=protein modification process
  Homolog annotation: Hit_ID=A7PFL5; Match level="QueryCoverage=100%, HitCoverage=100%, E-value=0.0, Identity=65%"; Hit description =Chromosome chr11 scaffold_14, whole genome shotgun sequence
MNSCVTGSLVHQGQLLVHIAENGHSFELDCNENTLVESVMRSIESVTGINFSDQLVLCLDMKLESQRQLSAYKLPSDDREVFIFNKTRLQNNSPVPPPEQVDIPSHLEPPLPASSHDPHPLDDASDPALKALPSYERQFRYHYHQGHVIYTGTMMKYEHCERLLREQMVQERAVEVARGNLDQYYRMINQNYVDFMKRYMQQHRMHSDLLVNFGKDVEKLRSIKLHPALQTANRKCLLDLVKEENLRKSVENCTCSHRQFENKVTQFKQTFGEVKRRAEELLSSRAFLPIKNLEQVIKEHQRYINEQKSIMQSLSKDVNTVKKLVDDCLSSQLSSSLRPHDAVSALGPMYDVHDKNHLPKMQTCDRAISKLVEFCKENKNEMNLFVHNYMQNITYVSYLIKDQKLQFPVFKEAMARQDGLFVDLKLFHGIGPAYRACLAEIVRRKASMKLYMGMAGQMAERLAIKREAELRRREEFLRVHSSCIPKEVLASMGLFDTPNQCDVNIAPFDGGLLNIDISDVDHYAPEYLTGVTSKLEKQGSVKSSSALSSDSSHLAEAVDITGDSIERYDSEDLLDGSELIEIAGTCKMEVENAKLKAELAGRIALICSLCPELEYESLDDERVNNILKNATEKTEEALHLKDEYIKHVQSMLKMKQMQCVSYEKRIQELEQKLSDQYVQGQKMSSVNDTADFPLVAGKTDNYKSESISGEANMPCISTSEPMDEVSCISSSLDAKLGLFTEHTGKALDGVDENMLDSSGVQNPQLDSSMMEPHREEAQSADKDKKGKIIVQLGMSLTNSSTGENMPVSHDLVPCDSAVCQDLESKVNDEKVLELQSALADKSNQLNETETKLKTVMEEVAVIRRELEASQKLLDESQMNCAHLENCLHEAREEAQTQKSSADRRASEYSLLRASVIKTHSFFERLKTCVYSPGGVAGFADSLRNLAQSLANSANDRDDDDIAEFRKCIHVLADRVGFISKHREELHEKNTRTEAANEQLRKELEEKIDQVKTYYNKHQLEKQANKEKICFGCLEVHDIAAFVLTPAGHYEAITRNCSNYYLSDESVALFADRLPTRPNYIVGQIVHIERQIVKMPTPRPEHGGADKFTPDKGTDWLTLNSGSTPNPYGLPVGCEYFLVTVAMLPDTTIHSSSPS

SEQ ID NO: 163930 - protein, 154 aa, Glycine max
  Coding DNA Sequence Number=SeqID_72245
  Gene Ontology: Mol. function=nucleoside-triphosphatase activity
  Homolog annotation: Hit_ID=A7QBP6; Match level="QueryCoverage=35%, HitCoverage=7%, E-value=3e-11, Identity=64%"; Hit description =Chromosome chr1 scaffold_75, whole genome shotgun sequence
MEEASSSEYSIFKKRKTTAFHIPCDRRRGTDSEGLTFFAGVLLEKHIVVVCSNLDDIEKLVSKLEDKVCAPEEGSCMDAIILHLHGCLPPELQASSFDWIQFSDIDALIILTSAVPQIKHGFDPTKGPRSEFYFDGLTKLYFIHIILKTAKGFS

SEQ ID NO: 163931 - protein, 107 aa, Glycine max
  Coding DNA Sequence Number=SeqID_72246
MIKAYLPLNQPSSVLSILVTGDFLPGLSPNASWGLSLNHNFCDKTKYFRKAWRFHIKKPGDSRTFCNVQLKKYGDSRTFCKSKSPLLSGSGGKANPGYDVSKPSSNC

SEQ ID NO: 163932 - protein, 72 aa, Glycine max
  Coding DNA Sequence Number=SeqID_72247
MRSEFGDTKLRAPHPTYRVCPSQSSLNLSEREIGSYQTKRARSKIKHGIVICGSKEDKESSSNTNRHGMEEE

SEQ ID NO: 163933 - protein, 260 aa, Glycine max
  Coding DNA Sequence Number=SeqID_72248
  Gene Ontology: Cellular component=photosystem II; Biological process =photosynthesis
  Homolog annotation: Hit_ID=A9PE66; Match level="QueryCoverage=35%, HitCoverage=77%, E-value=9e-24, Identity=65%"; Hit description =Putative uncharacterized protein
  Pfam annotation: Domain name=PsbX; Domain location=82-118; Score =10.0; E_value=0.058; Accession=PF06596.2; Description=Photosystem II reaction centre X protein
  Subcellular localization annotation: CTP_CleavageSite=52; ConfidenceScore=5.89e-01
MASTSAVSMVMPVTYASQKRVVPSSDAFFKPLTLRSSKVVAASNSNGRFQVRTSMKEKVVTGLTAAALTASMMVPDVAEAAVSPSLKNFLLSIAAGGVVVVAIIGAVIELDARDLNRLEFPEIVGLPAARAVRSDGEEFSRERHGGAVVHLFVRGESLDGASFAIYDGGANAAPASENGVVLFVRGNEKRGDPVRSETKTTSFCWLMNWELELTETPSARRWSALAWGGGWRLLRSTEKTSKPYWTLPTVSLLLSESVSV

SEQ ID NO: 163934 - protein, 319 aa, Glycine max
  Coding DNA Sequence Number=SeqID_72249
  Gene Ontology: Mol. function=RNA binding; Cellular component =ribonucleoprotein complex; Biological process=gynoecium development
  Homolog annotation: Hit_ID=A7QUD9; Match level="QueryCoverage=86%, HitCoverage=58%, E-value=1e-109, Identity=73%"; Hit description =Chromosome chr11 scaffold_177, whole genome shotgun sequence
  Pfam annotation: Domain name=KH_1; Domain location=147-214; Score =47.3; E_value=5.3e-11; Accession=PF00013.20; Description=KH domain
  Pfam annotation: Domain name=KH_1; Domain location=54-115; Score =50.9; E_value=4.6e-12; Accession=PF00013.20; Description=KH domain
  Pfam annotation: Domain name=KH_2; Domain location=54-95; Score=4.5; E_value=0.096; Accession=PF07650.8; Description=KH domain
  Pfam module annotation: Pfam domain module=KH_1::KH_1::KH_2; Domain location=147-214::54-115::54-95
MATAEPLQNGSAENPLPVDNAPAAQPPTETEADAAATASTPPEKRWPGWPGDCVFRLIVPVGKVGSIIGRKGELIKKMCEETRSRIRVLDAPLGTPDRIVLVSGKEDPEAALSPAMDAVVRIFKRVSGFSETDAENQESAAGLAFSSIRLLVASTQAINLIGKQGSLIKSIQENTSASVRVLSGDEVQFYATANERIVEIQGEALKVLKALEAVVGHLRKFLVDHSVLPLFEKTYNAPTSQDRQAETWSDKSLLHTSSRTSIFADIPLSTKRDSVLADRESQLDLFLPSSTMSLYGQDSSLSGVHSSALGRVGAPIVTT

SEQ ID NO: 163935 - protein, 81 aa, Glycine max
  Coding DNA Sequence Number=SeqID_72250
MVEGNKTQHFITLLLLFHEIYVSAKRIPSIVIIFVGEREVMVNNLKSIGDHGGVMVGDEVGLGVLLGRTQGKGGRYSKLRG

SEQ ID NO: 163936 - protein, 276 aa, Glycine max
  Coding DNA Sequence Number=SeqID_72251
  Gene Ontology: Cellular component=protein complex
  Homolog annotation: Hit_ID=A7PNV7; Match level="QueryCoverage=93%, HitCoverage=79%, E-value=5e-68, Identity=53%"; Hit description =Chromosome chr8 scaffold_23, whole genome shotgun sequence
MASEKLVLAVIRAARPTFRNQNDKIAFAVHSSFLTSGYVLTATGPQALSDNAFSDPSNDEVSVDHWNELNDEYAFVYANPEKGSEKVLVKCLVMNDKLLVHAFTQGSSEPLSLEIDVGDYAGEDGVSNYSQQFKNLDKLVKKIDGDILSKLDGSAKASSSSRRILFEKLSHCLLYSSETSNRTRQEIPDPVAGFGEPGGPPTQFIFPSVPIGSGSDLVPGPAAGVFPSRGGHGIGGSMLVELLMLSSTMEAGPNDPRWFGGVGGIGGDPAFPGGLP

SEQ ID NO: 163937 - protein, 121 aa, Glycine max
  Coding DNA Sequence Number=SeqID_72252
MAMNCMLIAALGLNSPKCPLFMPPPEGMINANFDASIKIGKGMGFGLVFRNHKGEVLASATRLEDQCYSPQIAEYLAFKWSIQMANQLLLQNDCRDMTTHIDTVALVHTKKIGNIVADSLA

SEQ ID NO: 163938 - protein, 765 aa, Glycine max
  Coding DNA Sequence Number=SeqID_72253
  Homolog annotation: Hit_ID=A5B6D5; Match level="QueryCoverage=98%, HitCoverage=98%, E-value=0.0, Identity=58%"; Hit description =Putative uncharacterized protein
  Pfam annotation: Domain name=DUF630; Domain location=1-60; Score =113.9; E_value=4.9e-31; Accession=PF04783.3; Description=Protein of unknown function (DUF630)
  Pfam annotation: Domain name=DUF632; Domain location=322-674; Score =466.8; E_value=2.8e-137; Accession=PF04782.3; Description=Protein of unknown function (DUF632)
  Pfam module annotation: Pfam domain module=DUF630::DUF632; Domain location=1-60::322-674
MGCSHSRLDDEEAVRLCKDRKKFIRQAVEQRTQFATGHIAYIESLKRVSAALRNYIEGDEPREFSLDTVITPPFTPVKRKTGSGFIPISAKPFATTGAIEFGIGPNSTLKVNYLRPGGNPAISVEERPQSPERVQVETYYGIDGFFNMQSSPVNPSIFAYSPNNRTTIPPPSPHSQWDFFWNPFSSLDSYGYPSGGSIEQTAMDDEYRGLRQVREEEGIPDLEEDETEHEDCVGKRNVAEERTRHDINSSKEVIVEDFNDDDDEEEEEEEEEEEETDIEDETETEHNAKDSQAHGSASFEVSKAEAAGHIESRHREMTIGKQEAVEDTPGFTVYVNRRPTSMAEVINDLETQFTVVCNAANDVSALLEAKKSQYLLTSNELSASKLLNPVALLRSASSRSSSSRFLVNCSSTSAEGCGEGTKDLSAEHCMLSGSHHATLDRLNTWEKKLYEEVRSGERVRIAYEKKCKQLRNLDVKGEDPSCADKTRAAIRELDTQITVSIHSIEAISRRIETLRDKELHPQLLELVQGLERMWKVMAECHQTQKRTLDEAKILLAGTPSKSRARKQSSISMTDPNRLARSASNLEFELRNWRNAFESWITSQRSYIHALTGWLLRCMRFEPDVSKLPCSPRRSSSTHPLFGLCVQWSRRLDAIQEKAVLDGLDFFAAGMGSLYAHQLREDSRRNSFGSKQSNGNMEMVEVGEVEEVMAPEKLAEVAIKVLCAGMSVAISSLAEFALDSSEGYNEVVKQWDNGKCQNTTSSETRT

SEQ ID NO: 163939 - protein, 44 aa, Glycine max
  Coding DNA Sequence Number=SeqID_72254
MLEESYGTARDTAITVGLHTRARLEDPLRATSFCMTSIVIGFIV

SEQ ID NO: 163940 - protein, 89 aa, Glycine max
  Coding DNA Sequence Number=SeqID_72255
MWVSGSVGGSVGSTNDNVGVDGAVLADFGREEKENNNFRQEDDKEKSWKMPLWLPVSISNGERKRELQFQFMEKLRLLHVGFLVGVKEF

SEQ ID NO: 163941 - protein, 199 aa, Glycine max
  Coding DNA Sequence Number=SeqID_72256
  Gene Ontology: Mol. function=heparin binding; Cellular component =cytoplasm; Biological process=cell motility
  Homolog annotation: Hit_ID=A7L4A5; Match level="QueryCoverage=80%, HitCoverage=39%, E-value=2e-51, Identity=61%"; Hit description =Transducin family protein
  Pfam annotation: Domain name=WD40; Domain location=140-178; Score =28.4; E_value=2.6e-05; Accession=PF00400.23; Description=WD domain, G-beta repeat
  Pfam annotation: Domain name=WD40; Domain location=55-94; Score=20.1; E_value=0.0084; Accession=PF00400.23; Description=WD domain, G-beta repeat
  Pfam annotation: Domain name=WD40; Domain location=99-137; Score =40.9; E_value=4.4e-09; Accession=PF00400.23; Description=WD domain, G-beta repeat
  Pfam module annotation: Pfam domain module=WD40::WD40::WD40; Domain location=140-178::55-94::99-137
MSGHVAPPIYEYNDEVISDEFFLDESDILHELSMDDEDLPDVDDDSETEHVEEVDDAIDTFKSHNGELYAVACSPTDATLVATGGGDDRGFLWKIGEKGDWVSELQGHKDSVSSLAFSYDGQFLASGCFHGIVQVWDAYGNLKNVFEGLGGGIEWLRWHPRQRTLLAGSEDFNVWIWNATDRITPPYLLCWSSWQCDLW

SEQ ID NO: 163942 - protein, 1036 aa, Glycine max
  Coding DNA Sequence Number=SeqID_72257
  Gene Ontology: Mol. function=nucleotide binding; Cellular component =intrinsic to membrane; Biological process=defense response
  Homolog annotation: Hit_ID=Q2HVE0; Match level="QueryCoverage=81%, HitCoverage=84%, E-value=1e-154, Identity=40%"; Hit description =Leucine-rich repeat; Leucine-rich
  Pfam annotation: Domain name=Arch_ATPase; Domain location=188-379; Score=-92.4; E_value=0.034; Accession=PF01637.9; Description =Archaeal ATPase
  Pfam annotation: Domain name=LRR_1; Domain location=645-666; Score =8.5; E_value=8; Accession=PF00560.24; Description=Leucine Rich Repeat
  Pfam annotation: Domain name=LRR_1; Domain location=668-690; Score =10.2; E_value=3.9; Accession=PF00560.24; Description=Leucine Rich Repeat
  Pfam annotation: Domain name=LRR_1; Domain location=692-713; Score =6.8; E_value=17; Accession=PF00560.24; Description=Leucine Rich Repeat
  Pfam annotation: Domain name=LRR_1; Domain location=715-734; Score =4.4; E_value=47; Accession=PF00560.24; Description=Leucine Rich Repeat
  Pfam annotation: Domain name=LRR_1; Domain location=736-757; Score =6.6; E_value=18; Accession=PF00560.24; Description=Leucine Rich Repeat
  Pfam annotation: Domain name=LRR_1; Domain location=759-780; Score =10.4; E_value=3.7; Accession=PF00560.24; Description=Leucine Rich Repeat
  Pfam annotation: Domain name=LRR_1; Domain location=782-801; Score =5.5; E_value=29; Accession=PF00560.24; Description=Leucine Rich Repeat
  Pfam annotation: Domain name=LRR_1; Domain location=803-824; Score =8.9; E_value=6.8; Accession=PF00560.24; Description=Leucine Rich Repeat
  Pfam annotation: Domain name=LRR_1; Domain location=845-870; Score =3.0; E_value=86; Accession=PF00560.24; Description=Leucine Rich Repeat
  Pfam annotation: Domain name=LRR_3; Domain location=622-641; Score =32.9; E_value=1.2e-06; Accession=PF07725.3; Description=Leucine Rich Repeat
  Pfam annotation: Domain name=LRR_3; Domain location=645-665; Score =5.4; E_value=5.5; Accession=PF07725.3; Description=Leucine Rich Repeat
  Pfam annotation: Domain name=NACHT; Domain location=204-353; Score= -4.8; E_value=0.00014; Accession=PF05729.3; Description=NACHT domain
  Pfam annotation: Domain name=NB-ARC; Domain location=167-455; Score =118.0; E_value=2.9e-32; Accession=PF00931.13; Description=NB-ARC domain
  Pfam annotation: Domain name=TIR; Domain location=13-142; Score =174.0; E_value=4e-49; Accession=PF01582.11; Description=TIR domain
  Pfam module annotation: Pfam domain module=Arch_ATPase::LRR_1::LRR _1::LRR_1::LRR_1::LRR_1::LRR_1::LRR_1::LRR_1::LRR_1::LRR_3::LRR _3::NACHT::NB-ARC::TIR; Domain location=188-379::645-666::668 -690::692-713::715-734::...
  Pfam module annotation: Domain location=736-757::759-780::782 -801::803-824::845-870::622-641::645-665::204-353::167-455::13-142
MSKNNASQTKYDVFVSFRGVDIRRGFLSHLIGTFKSKQINAFVDDKLERGEEIWPSLIEAIQGSSISLIIFSPDYASSRWCLEELVTILECKEKYGQIVIPIFYHIEPTEVRHQRGSYENAFAEHVKKYKSKVQIWRHAMNKSVDLSGIESSKFQDDDELLKEIVKLVLKRLGKHLVNSKGLVGIDKKIADIESLIRKESKDTRLIGIWGMGGIGKTTLPQEVFNKLQSEYQGSYFLANEREQSSKDGIISLKKEIFTELLGHVVKIDTPNSLPNDTIRRMKVLIVLDDVNDSDHLEKLLGTLDHFGAGSRILITTRDEQVLNANKADEIYRLREFNFDKAFELFKLNAFNQSDNQSEYDELSQRVVNYAKGIPLVLKVLARLLRGKNKEVWESELDKLEKMPLREVCDIMKLSYVDLDRKEQQIFLDLACFFLRSQTKITIDYLNSLLKDSESDNSVVVGLERLKDKALITFLENNFISIHDSLQEMACEIVRQESTGDPGSRSRLWDLDDIYEALKNYKGNEAIRSILLHLPTTKKENLSPRLFAKMNRLRFLEVSVEDNYDCLDQLHILGTNLCWPKQQKTRIVDILAKGLKFLATELRFLSWKSYSGKSLPEIFSTEKLVILKLPYSGMEKLWLGVKNLVNLKELDLRCSKKLKELPDISKATNLEVILLRGCSMLTNVHPSIFSLPKLERLNLSDCESLNILTSNSHLRSLSYLDLDFCKNLKKFSVVSKNMKELRLGCTKVKALPSSFGHQSKLKLLHLKGSAIKRLPSSFNNLTQLLHLELSNCSKLETIEELPPFLETLNAQYCTCLQTLPELPKLLKTLNVKECKSLQSLPELSPSLEILNARDCESLMTVLFPSTAVEQLKENRKQVMFWNCLNLDEHSLVAIGLNAQINMMKFANHHLSTPNREHVENYNDSFQVVYMYPGSSVPGWLEYKTRNYHITIDLSSAPPSPQRSFVFCFVLGEFQRTDIIRTLEFSITMNEGEGKEDSVSMYIDYLGWSSIESDHVCVMYDQRCSEFLWCQPHKDLGI

SEQ ID NO: 163943 - protein, 251 aa, Glycine max
  Coding DNA Sequence Number=SeqID_72258
  Pfam annotation: Domain name=RecR; Domain location=39-83; Score=3.3; E_value=0.087; Accession=PF02132.6; Description=RecR protein
MAASDHAILRDRTYAPTKRSLLELTTQDATLAQNKLLFRQIEALIETLNKLPQQLQAVGGCHTCGGIHEPGQCMIQEDPSREVNYMGIPNRHGFQGYNQGGPSGFNQGSTGFNSGPSGFNQGRNFTQGSRWRNHPGNQYNKEQQARGDIEPIHTVFNVKLPQHKHLDQKLGNAEIQQESILQVNTPPHQLIVKEERHGEHEKALNVILSLIATTSLAIMWKLLPEYTSFMVSLAKRRKCKEDVFYVIFMPP

SEQ ID NO: 163944 - protein, 806 aa, Glycine max
  Coding DNA Sequence Number=SeqID_72259
  Gene Ontology: Mol. function=nucleotide binding; Cellular component =intrinsic to membrane; Biological process=defense response
  Homolog annotation: Hit_ID=Q2HVE0; Match level="QueryCoverage=82%, HitCoverage=68%, E-value=1e-122, Identity=39%"; Hit description =Leucine-rich repeat; Leucine-rich
  Pfam annotation: Domain name=LRR_1; Domain location=393-414; Score =7.2; E_value=14; Accession=PF00560.24; Description=Leucine Rich Repeat
  Pfam annotation: Domain name=LRR_1; Domain location=416-438; Score =13.7; E_value=0.68; Accession=PF00560.24; Description=Leucine Rich Repeat
  Pfam annotation: Domain name=LRR_1; Domain location=440-467; Score =3.7; E_value=64; Accession=PF00560.24; Description=Leucine Rich Repeat
  Pfam annotation: Domain name=LRR_1; Domain location=484-505; Score =6.1; E_value=23; Accession=PF00560.24; Description=Leucine Rich Repeat
  Pfam annotation: Domain name=LRR_1; Domain location=507-528; Score =14.3; E_value=0.46; Accession=PF00560.24; Description=Leucine Rich Repeat
  Pfam annotation: Domain name=LRR_1; Domain location=530-551; Score =11.0; E_value=2.8; Accession=PF00560.24; Description=Leucine Rich Repeat
  Pfam annotation: Domain name=LRR_1; Domain location=572-593; Score =6.4; E_value=20; Accession=PF00560.24; Description=Leucine Rich Repeat
  Pfam annotation: Domain name=LRR_3; Domain location=370-389; Score =20.3; E_value=0.0072; Accession=PF07725.3; Description=Leucine Rich Repeat
  Pfam annotation: Domain name=LRR_3; Domain location=507-526; Score =6.4; E_value=4; Accession=PF07725.3; Description=Leucine Rich Repeat
  Pfam annotation: Domain name=NB-ARC; Domain location=2-227; Score= -29.9; E_value=2.3e-08; Accession=PF00931.13; Description=NB-ARC domain
  Pfam module annotation: Pfam domain module=LRR_1::LRR_1::LRR_1::LRR _1::LRR_1::LRR_1::LRR_1::LRR_3::LRR_3::NB-ARC; Domain location=393 -414::416-438::440-467::484-505::507-528::530-551::572-593::370 -389::507-526::2-227
MEMVVASCALCSRGGGVLPSRFVVWWCGSLFDDSDGAWRDCRKEEEGAYRKDVLIVLDDVSDSDHLGKLLGTLDNFGSGSRILVTTRDEQVLKAKKVKKTYHLTELSFDKTLELFNLNAFNQSDRQKEYYELSLRVVNYAKGIPLVVKVLAGLLHGKNKEEWESLLDKLKKIPPTKVYEVMKLSYDGLDRKEQQIFLDLACFFLRSNIMVNTCELKSLLKDTESDNSVFYALERLKDKALITISEDNYVSMHDSLQEMAWEIIRRESSIAGSHSRLWDSDDIAEALKNGKNTEDIRSLQIDMRNLKKQKLSHDIFTNMSKLQFLKISGKYNDDLLNILAEGLQFLETELRFLYWDYYPLKSLPENFIARRLVILEFPFGRMKKLWDGVQNLVNLKKVDLTSSNKLEELPDLSGATNLEELKLGGCSMLTSVHPSIFSLPKLEKLFLINCKSLTIVTSDSKLCSLSHLYLLFCENLREFSLISDNMKELRLGWTNVRALPSSFGYQSKLKSLDLRRSKIEKLPSSINNLTQLLHLDIRYCRELQTIPELPMFLEILDAECCTSLQTLPELPRFLKTLNIRECKSLLTLPVLPLFLKTLDASECISLKTVLLSPSTAVEQLKENSKRILFWNCLNLNIYSLAAIGQNAQTNVMKFAGQHLSTPNHHHVENYSDYKDNYGSYQAVYAYPASNVPPWLEYKTRNDYIIIDLSSAPPSPLLGFIFGFVFGESTDMNERREVNITISDVKGKGKRETNRVRMYIDYGIGKIISDQAQWAVDPGLKEFGVSPISTLTYKSFIDIEEMELHDSD

SEQ ID NO: 163945 - protein, 60 aa, Glycine max
  Coding DNA Sequence Number=SeqID_72260
MKKLGEEPMDELQAVTLAQVDDSHVQSTGVVSVLDTDNGRVSDTGHGKGLEYPCFIVTRD

SEQ ID NO: 163946 - protein, 64 aa, Glycine max
  Coding DNA Sequence Number=SeqID_72261
MACGGLLVGFVVACNLFRCALWWVCDEFHGGSQWYRVVEEYEDVVYLKVVEASLPLLALVSLQH

SEQ ID NO: 163947 - protein, 664 aa, Glycine max
  Coding DNA Sequence Number=SeqID_72262
  Gene Ontology: Mol. function=scavenger receptor activity; Cellular component=membrane; Biological process=regulation of transcription, DNA-dependent
  Homolog annotation: Hit_ID=A2Q1M2; Match level="QueryCoverage=78%, HitCoverage=93%, E-value=0.0, Identity=70%"; Hit description =Speract/scavenger receptor; Cyclin-like F-box; Galactose oxidase, central
  Pfam annotation: Domain name=F-box; Domain location=247-295; Score =27.0; E_value=6.8e-05; Accession=PF00646.24; Description=F-box domain
  Pfam annotation: Domain name=Kelch_1; Domain location=344-394; Score =23.2; E_value=0.00097; Accession=PF01344.16; Description=Kelch motif
  Pfam annotation: Domain name=Kelch_1; Domain location=397-444; Score =15.7; E_value=0.04; Accession=PF01344.16; Description=Kelch motif
  Pfam annotation: Domain name=Kelch_1; Domain location=449-497; Score =5.1; E_value=0.76; Accession=PF01344.16; Description=Kelch motif
  Pfam annotation: Domain name=Kelch_1; Domain location=502-553; Score =2.5; E_value=1.5; Accession=PF01344.16; Description=Kelch motif
  Pfam annotation: Domain name=Kelch_1; Domain location=571-619; Score =10.1; E_value=0.19; Accession=PF01344.16; Description=Kelch motif
  Pfam annotation: Domain name=Kelch_2; Domain location=344-392; Score =14.4; E_value=0.42; Accession=PF07646.6; Description=Kelch motif
  Pfam annotation: Domain name=Kelch_2; Domain location=397-444; Score =27.8; E_value=4e-05; Accession=PF07646.6; Description=Kelch motif
  Pfam annotation: Domain name=Kelch_2; Domain location=448-494; Score =12.7; E_value=1.3; Accession=PF07646.6; Description=Kelch motif
  Pfam annotation: Domain name=Kelch_2; Domain location=502-553; Score =38.0; E_value=3.3e-08; Accession=PF07646.6; Description=Kelch motif
  Pfam annotation: Domain name=Kelch_2; Domain location=571-619; Score =33.4; E_value=8.4e-07; Accession=PF07646.6; Description=Kelch motif
  Pfam module annotation: Pfam domain module=F-box::Kelch_1::Kelch _1::Kelch_1::Kelch_1::Kelch_1::Kelch_2::Kelch_2::Kelch_2::Kelch _2::Kelch_2; Domain location=247-295::344-394::397-444::449-497::502 -553::571-619::344-392::...
  Pfam module annotation: Domain location=397-444::448-494::502 -553::571-619
MKKTLSCKDIKCILALMLKIKCIWRAVAQRLSCVLVTDWSWIQIRKQPLCICKGKAVHNYPPPYLRLARSLWALGLYLYKLLLFLSSTLLSTLEVFLACQFMIPYMLRIAKLGCYKKYFIDSTTLDFRFLQCRGPFAKRRHPLVDSTVVSEIRRCLDEGVEFQGELLNFRKDGSPLMNRLRLTPIYGEDEITHVIGIQFFTEANIDLGPLPGSTIKESTKSSDRFHSVLSSLNPVPVGDRNVTRGICGIFQLSDEVLSLKILARLTPRDIASVGSVCRHLYELTKNEDLWRMVCQNAWGSETTRVLETVPGARRLGWGRLARELTTLEAAAWRKLTVGGAVEPSRCNFSACAVGNRVVLFGGEGVNMQPMNDTFVLDLNSSNPEWQHVQVSSPPPGRWGHTLSCVNGSRLVVFGGCGTQGLLNDVFVLDLDAKPPTWREISGLAPPLPRSWHSSCTLDGTKLIVSGGCADSGVLLSDTFLLDLSMEKPVWREIPVAWTPPSRLGHTLSVYGGRKILMFGGLAKSGALRFRSSDVFTMDLSEEEPCWRCVTGSGLPGLPGTGNPGGIAPPPRLDHVAVSLPGGRILIFGGSVAGLHSASQLYILDPTDEKPTWRILNVPGRPPRFAWGHSTCVVGGTRAIVMGGQTGEEWMLSELHELSLASSVS

SEQ ID NO: 163948 - protein, 36 aa, Glycine max
  Coding DNA Sequence Number=SeqID_72263
MLQPYGINVGLKEHSNQVTPKAYTPKSPSGPLPLDS

SEQ ID NO: 163949 - protein, 705 aa, Glycine max
  Coding DNA Sequence Number=SeqID_72264
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q9SZW4; Match level="QueryCoverage=80%, HitCoverage=59%, E-value=0.0, Identity=58%"; Hit description =Putative cadmium/zinc-transporting ATPase 3
  Pfam annotation: Domain name=E1-E2_ATPase; Domain location=1-200; Score=199.4; E_value=8.6e-57; Accession=PF00122.11; Description=E1 -E2 ATPase
  Pfam annotation: Domain name=Hydrolase; Domain location=204-431; Score=104.4; E_value=3.4e-28; Accession=PF00702.17; Description =haloacid dehalogenase-like hydrolase
  Pfam module annotation: Pfam domain module=E1-E2_ATPase::Hydrolase; Domain location=1-200::204-431
MVAMSSLTSMAPQKAVIAETGELVDVNDVKINTILAVKAGDAIPLDGIVVEGKCEVDEKMLTGESLPVTKELDSVVWAGTINVNGYISVKTTVLAKDTVVARMSKLVEEASSRKSRTQRFIDHFAKYYIPAVVLISASIAVVPAALKVPNIKPWFHLAIVVLLSACPCALILSTPVAIFCALTKAAISGLLLKGGDYIETLSGIKTVAFDKTGTITRGEFTVTDFSVSVDDISIETLLYWVSSVESKSSHPMAAALVEYGMLNSVKPIPENVENFQNFPGEGVYGIINGKDIYIGNRRIGARAGSERVDCRTQCQSPEISTPNQCCGPTLVGVFRLADTCRSGALEAIEELKLLGVRSVMLTGDSSQAAMYAQSQLNHALDIVHAELLPAEKAVIIENFKKDGLIAMIGDGMNDAPALATADIGISMGISGSALANETGNAILMSNDIRKIPEAIRLARKTTRKLIENVIISIGFKSVILALAIAGYPIVWLAVLTDVGTCLLVILNSMLILQEKTKYERKSTSSKYGTFSEDMTTALLDKKSNSNENKAVLSAEKCGKDCCKNDTYREATTNKNESSGLSKLSSLKGNHNGNLVSIEVHIVKPCNGCGLGKVKMCEDFSCRTNNSSSDCCQEQSKTEKSDTGSIVTQEASIATLESDGYKGKSMDISKLSGTSVTPKCCKNLCCNDSVNNISNLSLSQPEIVIE

SEQ ID NO: 163950 - protein, 79 aa, Glycine max
  Coding DNA Sequence Number=SeqID_72265
MEQDVLEKKHYQKERKRENALELSESVVARSELKLNTDLRDRECRRERSHKAENEKLSIGRGDAKRHHCSGRRSNRRSC

SEQ ID NO: 163951 - protein, 123 aa, Glycine max
  Coding DNA Sequence Number=SeqID_72266
MAESIGNCLGRLQLWNEEVEGGEKERIYRFKKVWLNDGEGCENIFQQSWIKGGNPLVNLSRTSMNYWEIGGDQNFGQISKMIKDLRKKLNHLLQKVQSEEVLNMVATVEKELDDLLVLEEEIW

SEQ ID NO: 163952 - protein, 269 aa, Glycine max
  Coding DNA Sequence Number=SeqID_72267
  Gene Ontology: Mol. function=nucleic acid binding
  Homolog annotation: Hit_ID=A2Y784; Match level="QueryCoverage=61%, HitCoverage=56%, E-value=2e-09, Identity=25%"; Hit description =Putative uncharacterized protein
VKRVKKLEAELNKLESEAELSGLKINFAKSRFGAFGISDQWKHDAAKVLNSKYGGWRNLDIKDIKTFNTALLGKCRWELFQQPDEPWARVLFLKYGGWRSLEEGKTGAVWEWQLTWRRPLFNNEIAMADDFIGRIAQKEISPHRPNIWWWKPDPGDKFSSKSAYGLLWGDLTRINQEVVFKELWNLKIPPKASVFAWRLVKDRLPTKLNLNPTSMVGITILDWNSHCTSSTPNEALYAAWALGCYGAGFVPSNNNRNQLAPKICNFSTT

SEQ ID NO: 163953 - protein, 46 aa, Glycine max
  Coding DNA Sequence Number=SeqID_72268
MAMAVRNTTNPEELQIAVIHEIASLQGRSPSCDLVNNTRIVDLYLC

SEQ ID NO: 163954 - protein, 483 aa, Glycine max
  Coding DNA Sequence Number=SeqID_72269
  Homolog annotation: Hit_ID=A5BT79; Match level="QueryCoverage=90%, HitCoverage=52%, E-value=3e-95, Identity=40%"; Hit description =Putative uncharacterized protein
  Pfam annotation: Domain name=Ank; Domain location=132-164; Score =15.3; E_value=0.2; Accession=PF00023.21; Description=Ankyrin repeat
  Pfam annotation: Domain name=Ank; Domain location=166-198; Score=4.6; E_value=7.2; Accession=PF00023.21; Description=Ankyrin repeat
  Pfam annotation: Domain name=Ank; Domain location=97-131; Score=0.1; E_value=32; Accession=PF00023.21; Description=Ankyrin repeat
  Pfam module annotation: Pfam domain module=Ank::Ank::Ank; Domain location=132-164::166-198::97-131
  Subcellular localization annotation: CTP_CleavageSite=46; ConfidenceScore=5.75e-01
MDMVNNANSAATSSPSQTQVVVPMASAQFSSPSVELTTSSPPAHVVQMASPQPRHPSREYLEKCIPLYKLALRGDWNAARRMIDADTSLLNAAITKEWGTLLHVVAGTDQVHFVDLLVKLLNPDDLELKNFNGNTAFCYAAASGNLQIASLMIKKNAGLPKIRGGEGATPFYMAALQGKDDMARHLYDLTTGILEEDEWTTLFFLCIKNGLYDIALKMLQEHSMLALERDENNDTALHLLARMPSGFTGHGQWYPPSQILNNSMKPTPFVQLVECLWNKLLEQDYDETEMRTFISVPSQITFDATQVGNFQFVAALMRSYPDLLWEVDDKNRSIIHIAVIHRHSSIYSLIHELGSFKDFIATFEDDEGNNILHYAAKLTPPDKLGLISGAALQMTHELLWFKEVKELMLLLDVEKKNAKGKTPREIFAEEHKELLTKAESWTKSTSISCMLVSTLITAGVFTATFMLPAMQRKNVSSCSLKGY

SEQ ID NO: 163955 - protein, 295 aa, Glycine max
  Coding DNA Sequence Number=SeqID_72270
  Homolog annotation: Hit_ID=A5BT79; Match level="QueryCoverage=86%, HitCoverage=26%, E-value=5e-29, Identity=30%"; Hit description =Putative uncharacterized protein
MQTIIKVISEPSQVIFIATEVGNFEVLAELVRSCPELMWEVDTKNRSIIHIAALHRHIDIYNLIHETSSIRNFVVTLEDEDKNNLLHYAAKLSPPSKLNLLPGPVLQMKFELMWYEQVAGIQISFSNLSISERISHPKEVKKIMQPCFIEMRNSNGKTPRELFTEEHLELVTKAESWMKSMINSCITISTVTATLVLATAFSIKREDNHKPTITRDFIGRLFEVTAAEDMVGTGDTIYLHSILVDDIYHCLLHNVPSTGAKIIFLGAFNKPINNGISSVSIWVTRQHKPTLLVTQ

SEQ ID NO: 163956 - protein, 193 aa, Glycine max
  Coding DNA Sequence Number=SeqID_72271
IFREKKMYPAEEAFAGSSTTTKCSLRKKESVKEPSTLLPRDPAEEHLLPLQFPEATFRRAEEGSFRGRTFVFNLHHHRSLMSSILRFLRPFTPFKQIRGGNEGAEEEGNKPISGKKKHEWRLLGARERNKRGSKGKKKGYFGYFIELLGAPSNTLSIFLMKLVLMSSADVIIFPRNQNYFDTMCYRNYMPGLL

SEQ ID NO: 163957 - protein, 108 aa, Glycine max
  Coding DNA Sequence Number=SeqID_72272
MSNYCSTDASIKNLEMQVGQLAKKMAERPSKIQQESILQVNTPPHQLIVKEERHGEHEKALNVILSLIATTSFAIMWKVLLEYTIFMASLAKRRKCKEDVFYVTFMPP

SEQ ID NO: 163958 - protein, 88 aa, Glycine max
  Coding DNA Sequence Number=SeqID_72273
MAVHLFECVAHIVTHLEEDEVIAFELVEDLVADDLAVLNVMLPECAKGNAEHGTAIVAFIATPTGTRSTWHPMTRPSEADRHQRSSVT

SEQ ID NO: 163959 - protein, 519 aa, Glycine max
  Coding DNA Sequence Number=SeqID_72274
  Homolog annotation: Hit_ID=A5BCG5; Match level="QueryCoverage=76%, HitCoverage=76%, E-value=3e-78, Identity=39%"; Hit description =Putative uncharacterized protein
  Pfam annotation: Domain name=Ank; Domain location=114-146; Score=9.2; E_value=1.5; Accession=PF00023.21; Description=Ankyrin repeat
  Pfam annotation: Domain name=Ank; Domain location=148-180; Score=4.9; E_value=6.4; Accession=PF00023.21; Description=Ankyrin repeat
  Pfam annotation: Domain name=Ank; Domain location=215-273; Score=3.5; E_value=10; Accession=PF00023.21; Description=Ankyrin repeat
  Pfam annotation: Domain name=Ank; Domain location=79-108; Score=12.9; E_value=0.44; Accession=PF00023.21; Description=Ankyrin repeat
  Pfam module annotation: Pfam domain module=Ank::Ank::Ank::Ank; Domain location=114-146::148-180::215-273::79-108
MTVVDSPTQQQQPQMGNAASARHNRPNLEFIEATDEEAKDKFLSLCVPLYKFALEGNWPAAKVILQKDVRLKNAAIAVGWATLLHVAVGANHAPFVKELLQELDNQDIKLKDIKGNTAFCFAAASGNMEIVQLLKQRVENLPIIRGGGDHTPLYFAVMQRKCDMVEYLYDKTKDVFDVKDRESLFFTSITTRNYHLALKMATECKELAYARDHLNNDTALHILAMAHDQNPLDSCCHCSEQQTPIMINPEVGNFGFLSELISAHPSLIWEVDDKKQSIIHTAVSHRHASIFNVVHEIGSIKDIIVEGFVKGNNTLLHLAAKLAPSDRLELVSGAAFQMSHELIWFEEVKKIMPPSFIMLKNSEDKTAQELFTREHEGLRRKAEDWMKRTAEFCILISTVIATAVFSAAINIPGGIDDQTKKPNYLDKTSFLVFAISDGIAFISSATSILIFLSILISRYAEYDFHNAFFITYDSGLKVVPDSISILASGSSGLNEYGGDHAFNVRFTLSAGLLRGLSLR

SEQ ID NO: 163960 - protein, 63 aa, Glycine max
  Coding DNA Sequence Number=SeqID_72275
MGADQLSFHTTFALSALIALSKYDAHILIPNFFILPSVKRALLAESVYHTERLRRAKRTTSDL

SEQ ID NO: 163961 - protein, 132 aa, Glycine max
  Coding DNA Sequence Number=SeqID_72276
  Gene Ontology: Mol. function=transcription factor activity; Cellular component=nucleus; Biological process=regulation of transcription, DNA-dependent
  Homolog annotation: Hit_ID=A5AVA4; Match level="QueryCoverage=83%, HitCoverage=82%, E-value=1e-22, Identity=48%"; Hit description =Putative uncharacterized protein
  Pfam annotation: Domain name=AP2; Domain location=18-70; Score=74.5; E_value=3.4e-19; Accession=PF00847.11; Description=AP2 domain
MEEAHKGDEDKEKRGEEVKYRGVRRRPWGKFGAEIRDPTKPTGRQWLGTFDTAEEAARAYDRAAIELRGVLAILNFPDECYSQLPFVSSNPTSTANGSSFAPTHKEVIEFECLDNKVLEDLLESEVKRRNED

SEQ ID NO: 163962 - protein, 235 aa, Glycine max
  Coding DNA Sequence Number=SeqID_72277
MRQAYAWSKMTHPMKLTTWAVIIIKDSIKEDHQDSIRAIIFCKTTIGDIIQHPSQGQSQQEKPPISIEEMLLSLIQETRANTQETRAFIQETRAFIQETRSHQKSTDAAIRNLEIQIGQLAESTAEKPTKTFAVNAEMKHKEDCKVIFTEREEEEKKNEEDVHDEEGEKKEERERNEEKAQQWEKYSQVEIQQGSILQVNTPPYQLIVKEERHGKHEKALSVIISLIATTSLAIM

SEQ ID NO: 163963 - protein, 25 aa, Glycine max
  Coding DNA Sequence Number=SeqID_72278
MEIFRKKLLPETFRMTFFRKLFGRS

SEQ ID NO: 163964 - protein, 65 aa, Glycine max
  Coding DNA Sequence Number=SeqID_72279
MSMKKCINASGLGILVQVLFANVDDAKDLTWKTDERNYDGMLCHLADSSQWKKINRMYPKFEKEA

SEQ ID NO: 163965 - protein, 1203 aa, Glycine max
  Coding DNA Sequence Number=SeqID_72280
  Homolog annotation: Hit_ID=A5B9N2; Match level="QueryCoverage=98%, HitCoverage=97%, E-value=0.0, Identity=49%"; Hit description =Putative uncharacterized protein
  Subcellular localization annotation: CTP_CleavageSite=58; ConfidenceScore=5.18e-01
MEAGKKGGGGSSNQKKLLKDVETMNKALYLDRNSSRSSIPSANSRSKFTGKPQLPDPRSKSKASNDHNGENAQKDKKSIWNWRPLRALSHIRNKRFNCSFYLQVHLIEGLPPSFDDAGLAVYWKRRDGVLVTQPAKVVQCVAEFEEKLTYTCSVYGSRSGPHHSAKYEAKHFLLYASLLSVPEMDLGKHRVDLTRLLPLTLEELEEEKSSGKWTTSFRLMGLAKGATMNVSFGYTVVGDNASATRDSLPKALSSRQNSFSLTPTKFDVKPRQFDGSSTMRRATSLQYSPQASDEVKDLHEVLPLTKSALASSITSYIELDEEKLCSPLDDKTELDSFTENLGPIKPDAYASDLGKERLEEHATKDESTCDKPELYVFQEKLETVKPDGYFLPDFGNKNPEQCHDNEFFVVDKGIELSSNERVKLEESIIKAPDDASMVDTVCTLGISGIQISSEDSVKHDFLDEANDSSKDQGVVEEFASIKAPEDASTVDTSCTLGISGRQVSSEDSVEHDFLDEANGLDTNELLMQELESALNSVSNLERVALESPKTTEAKSEHKMTKSHSLDDVTASVATEFLSMLGLDHSPMGLSSESEPESPRELLLRQFEKEALNGGFSSLFDFDMNYDSEAAGGYDASASSEQWNFSEGVKSSSFLQDLLEEPPVESQDVRSKQRAQMLEDLETEALMRQWGLNENAFHHSPPKDFAGFGSPIHLPPEEPPTLPPLDDGLGPFLQTKDGGFLRTMSPSIFKNSKSCGSLIMQVSNPVVVPAEMGSGIMEVLQCLASVGIEKLSMQAKELMPLEDITGKTMQQIAWEAMPSLEGAERQCHLRHDPITVPDSAGVQRDLKGMPSKQKSGKFSSRTVANQTGSEFVSVEDLAPLAMDKIEALSMEGLRIQSGMSEEEAPSNIIAQSIGDISALQGKGVDISGSLGLDGAAGLQLMDVKDGGDGVDGIMSLSLTLDEWMKLDSGEIDDIDNISEHTSKLLAAHHANSFDFIRGSSKGEKRRGKSRCGLLGNNFTVALMVQLRDPMRNYEPVGTPMLALIQVEREFMLPKQRIFNSVSEIRKNYYEDDESNIVAKLKTKDTEKEEKSSEEEGGIPQFRITEVHVAGLKPEPQKKKLWGTSSQQQSGSRWLLANGMGKSNNKLSLMKSKAASKSNAPVTTKGQPGDSLWSISSRIDGARGKWKELAALNPHIRNPNVILPN

SEQ ID NO: 163966 - protein, 299 aa, Glycine max
  Coding DNA Sequence Number=SeqID_72281
SSQVEDDKFVETPSVDECCSMLGVGEGLTPDWWGHFSASQEGATFRYFQRACPSYCDPFPFASRDDVLKYKSSLTSAASVATLQRQACESDDFSFLRAVPCRSPLFFMYKYLFEVLATSVVTNGMPLMFNKDGEPYFLIYWQSDPTRFKSYDEDPLTLVERVRPMGGTVSLSVRSKFNLPLVKDLANKCRGRSLDLLSFSSDSCEKVILTCEATPLMVMRSKYDFHLIKGLPSTELGFVESYVQHRCYALAFMALAVSDMYWRHNGESDSGGVLERVTKAQNATLEDTMAITWSLYEEA

SEQ ID NO: 163967 - protein, 83 aa, Glycine max
  Coding DNA Sequence Number=SeqID_72282
MSHEPTITNGERQKRKAKRSEILFLSSFKEIKVTERSSYRERYKSSYGERSRSCGNRSTVDQGAIEDADFAMSLPHANGGTIK

SEQ ID NO: 163968 - protein, 833 aa, Glycine max
  Coding DNA Sequence Number=SeqID_72283
  Gene Ontology: Mol. function=binding; Cellular component=nuclear speck; Biological process=embryonic development ending in birth or egg hatching
  Homolog annotation: Hit_ID=Q3EC58; Match level="QueryCoverage=80%, HitCoverage=78%, E-value=0.0, Identity=72%"; Hit description =Uncharacterized protein At2g06210.2
  Pfam annotation: Domain name=TPR_1; Domain location=120-153; Score =21.8; E_value=0.0026; Accession=PF00515.19; Description =Tetratricopeptide repeat
  Pfam annotation: Domain name=TPR_1; Domain location=192-221; Score =3.6; E_value=2; Accession=PF00515.19; Description=Tetratricopeptide repeat
  Pfam annotation: Domain name=TPR_1; Domain location=268-301; Score =6.2; E_value=0.95; Accession=PF00515.19; Description=Tetratricopeptid e repeat
  Pfam annotation: Domain name=TPR_1; Domain location=302-335; Score =7.2; E_value=0.73; Accession=PF00515.19; Description=Tetratricopeptid e repeat
  Pfam annotation: Domain name=TPR_1; Domain location=457-490; Score =25.4; E_value=0.00021; Accession=PF00515.19; Description =Tetratricopeptide repeat
  Pfam annotation: Domain name=TPR_1; Domain location=49-82; Score =12.4; E_value=0.17; Accession=PF00515.19; Description=Tetratricopepti de repeat
  Pfam annotation: Domain name=TPR_1; Domain location=493-526; Score =16.5; E_value=0.055; Accession=PF00515.19; Description =Tetratricopeptide repeat
  Pfam annotation: Domain name=TPR_1; Domain location=86-119; Score =31.9; E_value=2.3e-06; Accession=PF00515.19; Description =Tetratricopeptide repeat
  Pfam annotation: Domain name=TPR_2; Domain location=120-153; Score =22.4; E_value=0.0016; Accession=PF07719.8; Description =Tetratricopeptide repeat
  Pfam annotation: Domain name=TPR_2; Domain location=192-221; Score =2.0; E_value=17; Accession=PF07719.8; Description=Tetratricopeptide repeat
  Pfam annotation: Domain name=TPR_2; Domain location=268-301; Score =13.3; E_value=0.67; Accession=PF07719.8; Description=Tetratricopeptid e repeat
  Pfam annotation: Domain name=TPR_2; Domain location=302-335; Score =8.5; E_value=2.6; Accession=PF07719.8; Description=Tetratricopeptide repeat
  Pfam annotation: Domain name=TPR_2; Domain location=336-369; Score =10.3; E_value=1.6; Accession=PF07719.8; Description=Tetratricopeptide repeat
  Pfam annotation: Domain name=TPR_2; Domain location=418-451; Score =3.6; E_value=11; Accession=PF07719.8; Description=Tetratricopeptide repeat
  Pfam annotation: Domain name=TPR_2; Domain location=457-490; Score =25.3; E_value=0.00023; Accession=PF07719.8; Description =Tetratricopeptide repeat
  Pfam annotation: Domain name=TPR_2; Domain location=49-82; Score =15.0; E_value=0.29; Accession=PF07719.8; Description=Tetratricopeptid e repeat
  Pfam annotation: Domain name=TPR_2; Domain location=493-526; Score =21.8; E_value=0.0026; Accession=PF07719.8; Description =Tetratricopeptide repeat
  Pfam annotation: Domain name=TPR_2; Domain location=86-119; Score =31.2; E_value=3.7e-06; Accession=PF07719.8; Description =Tetratricopeptide repeat
  Pfam annotation: Domain name=TPR_4; Domain location=192-217; Score =1.2; E_value=28; Accession=PF07721.5; Description=Tetratricopeptide repeat
  Pfam annotation: Domain name=TPR_4; Domain location=268-293; Score =0.2; E_value=37; Accession=PF07721.5; Description=Tetratricopeptide repeat
  Pfam annotation: Domain name=TPR_4; Domain location=336-361; Score =8.6; E_value=3.7; Accession=PF07721.5; Description=Tetratricopeptide repeat
  Pfam annotation: Domain name=TPR_4; Domain location=457-482; Score =6.5; E_value=6.6; Accession=PF07721.5; Description=Tetratricopeptide repeat
  Pfam annotation: Domain name=TPR_4; Domain location=86-111; Score =3.3; E_value=16; Accession=PF07721.5; Description=Tetratricopeptide repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2::TPR_2::TPR_2::TPR_4::TPR_4::TPR_4::TPR _4::TPR_4; Domain location=...
  Pfam module annotation: Domain location=120-153::192-221::268 -301::302-335::457-490::49-82::493-526::86-119::120-153::192-221::268- 301::302-335::336-369::418-451::457-490::49-82::493-526::86-119::192 -217::268-293::336-361::457-482::86-111
MQRAFEIYPYCAMALNYLANHFFFTGQHFLVEQLTETALAVTNHGPTKSHSYYNLARSYHSKGDYDKAGVYYMASVKEVNKPHEFVFPYYGLGQVQIKLGDFKSALSNFEKVLEVYPDNCETLKALGHIYVQLGQTDKGQDFIRKATKIDPRDAQAFLELGELLILSDTGAALDAFKTARTLFKKGGQEVPIELLNNIGVLQFERGEFELAQQTFKEALGDGVWLSFINEEKKSSIDAATSTLQFKDMKLFHDLESNGHHVEVPWDKVTVLFNLARLLEQLNDSGTASILYRLVLFKYPDYIDAYLRLAAIAKARNNILLSIELVNDALKVNNKCPNALSMLGELELKNDDWVKAKETLRAASDATEGKDSYASLSLGNWNYFAAVRNEKRNPKLEATHLEKAKELYTRVLIQHSSNLYAANGAAVVLAEKGHFDVSKDIFTQVQEAASGSVFVQMPDVWINLAHVYFAQGNFTLAVKMYQNCLRKFYHNTDSQILLYLARTHYEAEQWQDCIKTLLRAIHLAPSNYTLRFDAGVAMQKFSASTLQKAKRTADEVRATVAELQNAVRVFSQLSAASNLHIHGFDEKKIDTHVGYCNHLLSAAKVHLEAAEREEQQVRQRQELARQVAFAEEARRKAEEQRKFQMERRKQEDELKRVQQQEEHFRRVKEQWKSSSHSKRRERSDDEEGGGTGEKKRKKGGKRRKKDKHSKSRYDTEEPENDMMDEQEMEDEEADINYREEPQTQMNDDAEENAQGLLAAAGLEDSDADEEAPAPSSSIARRRQALSESDDDEPLIQRQSSPARENSADMQLSDGEIRDGDKTNGDDGSEEEKQY

SEQ ID NO: 163969 - protein, 129 aa, Glycine max
  Coding DNA Sequence Number=SeqID_72284
MIAGGGGDDSDGCGDSCKDDNSGDNDTSDGCDGGNETIMVVVAVAATTIVMMFATVSGDSNNGNIFYDNDSGGGGDDNNGDGDCGGDNDDYNGRSGGCVVVVVTMMMVETIVRVVKAMMAVVVMVTMGD

SEQ ID NO: 163970 - protein, 128 aa, Glycine max
  Coding DNA Sequence Number=SeqID_72285
GEGTKALLVRILSSCRVQTPDTDLYISWLSSFYTKNYTVMLKIATCIILAWHHITVSIMLLSFLENIEEGSCDARKNAWASDLDNAKRRVSTDFDGLERRSLMLRREVMLIELVAMEAVFGSNFLEID

SEQ ID NO: 163971 - protein, 1055 aa, Glycine max
  Coding DNA Sequence Number=SeqID_72286
  Homolog annotation: Hit_ID=A7PE35; Match level="QueryCoverage=97%, HitCoverage=73%, E-value=0.0, Identity=48%"; Hit description =Chromosome chr11 scaffold_13, whole genome shotgun sequence
  Subcellular localization annotation: CTP_CleavageSite=51; ConfidenceScore=5.01e-01
MTTLTLRGGAMKVTWAIILYCHVSLVYRSANGTVGAVKSDGVSQQSGLGIRVSTPRSDLENNSAVNDRRDRPVNSDKERVNFRAVNKATVRDEYNSASPNSSAKMNTTIRAPRTGSGVAPKLSPGVHRASVPNDCEPSQCMTKPPASVGTNNRKRVASARSSSPPVVHWQRPQKSSRTARRTNFVPIVSSNDDSPALDSVSDVTDNDLGLGFVRRLAGNSPQQIKLKGDSLTSATLSESEESGVAEIKPKEKGRKPEEIDQQAGKNVQKVFNLVLPTRKNKLVSGEEHGDGVQRQGRTGRNFPAARSPTPVTSEKLGNIGTVKQLRSSRLGLEKSERAGRPPTRKLSDRKAYARQKHSAISASADFLVGSEDGHEELLAAVKGVINSARAFSSQFWRQIEPFFGLINEEDIGYWKQKINLESSGLMPSPVPSYIDDCKAVANGFGLTGSERDFEPGDQMGAAIVAEQLQLAKGDSNGISLCQRLISALISEECSSESEDIMFDACDTESEADGDLDHHSQSNSHLAFHSPYNGYRITRKSGHDETESDIVDIPSTRLNSSQNMPTLICSELQYATLGMNEKLLLELQSIGISPESVIKISMHLLFLLLFFKPEILQTDDEGICEDITWLEEHCQGQISNRKCLLDRLLKSASVTKELQEKSYWKFNILINRDFEQNALDKLVMMAYEKYMVLEFIILIIVCDLDFLIRLEWDVEVAWLSELTITDWQASRGPSSSGGKNASNKIAKQAALGFVKRTLERCQQFEDTGKSCFNEPLYKDMFLAASSQLSIVRQLDGIEAESTKPCASFSLEARTASMGSQQNPSQFSQNMKNHDLDSSDILPAINGSSEQTSGKEDLWSNKVKKRELSLDDVGGSIGSSSAPSGIGSSLSNSTKGKRSERDRDGKGQSREVLSRNGTTKVGRPAISSAKGQRKLKTKPKQKATKHSVSVNGLLGKLSEQPKTALPSVSKSNEMSTNRTPKEKDEFGMGEFDDHEPIDLSNLQLPGMDVLGVPGDLDDQGADLGSWLNIEDDGLQDHDDFMGLEIPMDDLSDLNMMV

SEQ ID NO: 163972 - protein, 56 aa, Glycine max
  Coding DNA Sequence Number=SeqID_72287
MCKLPSCPILASSTRKEKGDMNFKFEKGFSSTGEVNVATTGSTADDVVMKGGVMSL

SEQ ID NO: 163973 - protein, 169 aa, Glycine max
  Coding DNA Sequence Number=SeqID_72288
MARGLELGFAWYSKILVILKIIKFGCIQLHATRFIGKCCVAIGQMGKGEGFWRCTMSYFLEDFFDICGHEVLDHQLRTCDLRDENHDEEDINYVPFDLGLRASLQKNSVVAGISSEVVFEISHAKERTRGDEGDVSQVEVTQVEEVADSLANFQLSNPKEVEKTTSREK

SEQ ID NO: 163974 - protein, 101 aa, Glycine max
  Coding DNA Sequence Number=SeqID_72289
DFFCPDVSPLLLGQPQQKIGDANQHLISHPYQSVMKNEDVFPQHHRMNVRLQKYQCDDLRRDTDTSVKDTEKMLFQHLTEECETLVLEIDALMLDHVTQAQ

SEQ ID NO: 163975 - protein, 1166 aa, Glycine max
  Coding DNA Sequence Number=SeqID_72290
  Gene Ontology: Mol. function=DNA-directed RNA polymerase activity; Cellular component=nucleus; Biological process=transcription
  Homolog annotation: Hit_ID=P38420; Match level="QueryCoverage=97%, HitCoverage=97%, E-value=0.0, Identity=89%"; Hit description=DNA -directed RNA polymerase II subunit RPB2
  Pfam annotation: Domain name=RNA_pol_Rpb2_1; Domain location=40-458; Score=427.1; E_value=2.5e-125; Accession=PF04563.6; Description=RNA polymerase beta subunit
  Pfam annotation: Domain name=RNA_pol_Rpb2_2; Domain location=209-401; Score=322.7; E_value=6.6e-94; Accession=PF04561.5; Description=RNA polymerase Rpb2, domain 2
  Pfam annotation: Domain name=RNA_pol_Rpb2_3; Domain location=474-539; Score=119.8; E_value=7.9e-33; Accession=PF04565.7; Description=RNA polymerase Rpb2, domain 3
  Pfam annotation: Domain name=RNA_pol_Rpb2_4; Domain location=573-635; Score=118.5; E_value=2e-32; Accession=PF04566.4; Description=RNA polymerase Rpb2, domain 4
  Pfam annotation: Domain name=RNA_pol_Rpb2_5; Domain location=659-710; Score=93.2; E_value=8e-25; Accession=PF04567.8; Description=RNA polymerase Rpb2, domain 5
  Pfam annotation: Domain name=RNA_pol_Rpb2_6; Domain location=715 -1061; Score=563.2; E_value=2.6e-166; Accession=PF00562.19; Description=RNA polymerase Rpb2, domain 6
  Pfam annotation: Domain name=RNA_pol_Rpb2_7; Domain location=1063 -1155; Score=204.0; E_value=3.5e-58; Accession=PF04560.11; Description=RNA polymerase Rpb2, domain 7
  Pfam module annotation: Pfam domain module=RNA_pol_Rpb2_1::RNA_pol _Rpb2_2::RNA_pol_Rpb2_3::RNA_pol_Rpb2_4::RNA_pol_Rpb2_5::RNA_pol_Rpb2_ 6::RNA_pol_Rpb2_7; Domain location=40-458::209-401::474-539::573 -635::659-710::715-1061::1063-1155
MDLEEEQEYDEQMMEEEDDEEEITQEDAWAVISAYFEEKGLVRQQLDSFDEFIQNTMQEIVDESADIEIRPESQHNPGHQSDFAETIYKISFGQIYLSKPMMTESDGETATLFPKAARLRNLTYSAPLYVDVSKRVIKKGHDGEEVTEAQDFTKVFIGKVPIMLRSSYCTLYQNSEKDLTELGECPYDQGGYFIINGSEKVLIAQEKMSTNHVYVFKKRQPNKYAYVAEVRSMAESQNRPPSTMFVRMLSRTSSKGGSSGQYIRATLPYIRTEIPIIIVFRALGFVADKDILEHICYDFSYTQMMELLRPSLEEAFVIQNQQVALDYIGKRGATVGVTKEKRIKYAKEILQKEMLPHVGVGEYCETKKAYYFGYIIHRLLLCALGRRAEDDRDHYGNKRLDLAGPLLGGLFRMLFRKLTRDVRGYVQKCVDNGKDVNLQFAIKAKTITSGLKYSLATGNWGQANAAGTRAGVSQVLNRLTYASTLSHLRRLNSPIGREGKLAKPRQLHNSQWGMMCPAETPEGQACGLVKNLALMVYITVGSAAYPILEFLEEWGTENFEEISPAVIPQATKIFVNGCWMGIHRDPDMLVRTLKKLRRRVDVNTEVGVVRDIRLKELRIYTDYGRCSRPLFIVDKQRLLIKKKDIHALQQRESPEDGGWHDLVSKGFIEYIDTEEEETTMISMTINDLVQARINPEDAYSDTYTHCEIHPSLILGVCASIIPFPDHNQDTLAYVLYYPQKPLVTTRAMEHLHFRQLPAGINAIVSIACYSGYNQEDSVIMNQSSIDRGFFRSLFFRSYRDEEKKMGTLVKEDFGRPDRANTMGMRHGSYDKLDDDGLAPPGTRVSGEDVIIGKTTPISQEEAQGQALRYTRRDHSISLRHSETGIVDQVLLTTNADGLRFVKVRVRSVRIPQIGDKFSSRHGQKGTVGMTYTQEDMPWTVEGITPDIIVNPHAIPSRMTIGQLIECIMGKVAAHMGKEGDATPFTDVTVDNISKALHKCGYQMRGFETMYNGHTGRRLSAMIFLGPTYYQRLKHMVDDKIHSRGRGPVQILTRQPAEGRSRDGGLRFGEMERDCMIAHGAAHFLKERLFDQSDAYRVHVCERCGLIAIANLKKNSFECRGCKNKTDIVQVYIPYACKLLFQELMAMAIAPRMLTKEVKTTNQKKGA

SEQ ID NO: 163976 - protein, 241 aa, Glycine max
  Coding DNA Sequence Number=SeqID_72291
  Gene Ontology: Mol. function=oxidoreductase activity; Cellular component=extracellular region; Biological process=hydrogen peroxide catabolic process
  Homolog annotation: Hit_ID=A2Q692; Match level="QueryCoverage=95%, HitCoverage=64%, E-value=3e-93, Identity=74%"; Hit description=Haem peroxidase, plant/fungal/bacterial
  Pfam annotation: Domain name=peroxidase; Domain location=41-241; Score=284.1; E_value=2.9e-82; Accession=PF00141.14; Description =Peroxidase
MNRSSNANFWLVNFFILSVGVRSQLTPDFYKTTCPDLYRIVRREVQKALKYEMRMGASLLRLHFHDCFVNGCDGSILLDGDQDSEKFATPNLNSARGFEVIDTIKSSVERACSGAVSCADILAIAARDSVLLSGGPFWYVQLGRRDGLISNGTLANLAIPSPFDTLDTIISKFNDVGLDLKDVVTLSGAHTTGRARCTFFSNRLFNSSGTEAPDSTIETTMLTEYCKICAYKTVMRTQPVC

SEQ ID NO: 163977 - protein, 434 aa, Glycine max
  Coding DNA Sequence Number=SeqID_72292
  Gene Ontology: Mol. function=glycylpeptide N-tetradecanoyltransferase activity; Cellular component=cytoplasm; Biological process=N-terminal protein myristoylation
  Homolog annotation: Hit_ID=Q9LTR9; Match level="QueryCoverage=100%, HitCoverage=100%, E-value=0.0, Identity=83%"; Hit description =Glycylpeptide N-tetradecanoyltransferase 1
  Pfam annotation: Domain name=NMT; Domain location=69-230; Score =384.8; E_value=1.4e-112; Accession=PF01233.10; Description=Myristoyl- CoA:protein N-myristoyltransferase, N-terminal domain
  Pfam annotation: Domain name=NMT_C; Domain location=244-433; Score =329.0; E_value=8.7e-96; Accession=PF02799.6; Description=Myristoyl -CoA:protein N-myristoyltransferase, C-terminal domain
  Pfam module annotation: Pfam domain module=NMT::NMT_C; Domain location=69-230::244-433
MGDSSVPSGSPNAKSDLVDRDLAVSNNASSLETIVQSFQDSMSLGKRHKFWETQPVGQYKDVGDSSLPEGPIEPPTPLSEVKQEPYNLPSAYEWTTCDMDSEEICDEVYALLKNNYVEDDENMFRFNYSKEFLSWALRVPGYYQSWHIGVRAKTSKKLVAFISGIPARIRVNEEVVKMAEINFLCVHKKLRSKRLAPVMIKEVTRRVHLENIWQAAYTAGVVLPTPITTCQYWHRSLNPKKLIDVGFSRLGARMTMSRTIKLYKLPDSTVTPGFRKMELRDVPAVTRLLRNYLSQFVVAPDFDENDVEHWLLPNENVVDSFLVESPENHEITDFCSFYTLPSSILGNQNYSILKAAYSYYNVSTKTPLTQLMNDVLIVAKQKDFDVFNALDVMHNESFLKELKFGPGDGQLHYYLYNYRIRSALKPSGLGLVLL

SEQ ID NO: 163978 - protein, 489 aa, Glycine max
  Coding DNA Sequence Number=SeqID_72293
  Gene Ontology: Mol. function=protein serine/threonine kinase activity; Cellular component=cytoplasm; Biological process=protein amino acid phosphorylation
  Homolog annotation: Hit_ID=A7PE52; Match level="QueryCoverage=100%, HitCoverage=100%, E-value=1e-174, Identity=63%"; Hit description =Chromosome chr11 scaffold_13, whole genome shotgun sequence
  Pfam annotation: Domain name=Pkinase; Domain location=9-311; Score =30.4; E_value=1.9e-10; Accession=PF00069.16; Description=Protein kinase domain
MEPRIGNKFRLGRTNNQTNEEVAIKLENVKTKHPQLLYESKLYRVLQGGTGIPDVRWFGVEGDYNVLVMDLLGPSLEDLFNFCSRKLSLKTVLMLADQMINRVEFVHSKSFLHRDIKPDNFLMGLRRRANQVADPVYLFTVLILVWRRNIEIVQPINTFLTGWLFLLLLMLLHVVNAILLFIVIFIKGGCFHMISSEHNYMENKNLTGTARYASMNTHLGIEQSRRDDLESLGYVLMYFLRGSLPWQGLKAGTKKQKYERISEKKVSTSIEALCRGYPTEFASYFHYCRSLRFDDRPDYAYLKRIFRDLFIREGFQFDYVFDWTILKYQQSQLAAPPARAIGPNVGTSSALPPAVTNADRQTGEEEGRPPGLVSGDSTRRRMTGPIPNSVNISKQKNPVTTDAALNKEAMLSRPNVLGQSSGSRRAAVSSSRDAFVGSDLDLRTRTTETNPGTAPKTSSVRNASHVKSYETAVKGIEGLQLENDEKAHY

SEQ ID NO: 163979 - protein, 145 aa, Glycine max
  Coding DNA Sequence Number=SeqID_72294
VHLLRDCYTENKRGYISCGLVQVEGTSTWFFKENKGGYIPCGSLTCKGFYKVERNLKNCRLLGDWMPLDPTSGIRAESKNLSTMSLATLFEKLQEHEMELQRLNQNEESNKRKKGIALKVSSSIQEGSDNKDLDDEEDDSQEIKD

SEQ ID NO: 163980 - protein, 75 aa, Glycine max
  Coding DNA Sequence Number=SeqID_72295
MKNSSRLLLSIQGPGWHDSTLHQKATLISLTEQNVPHMRSAFESKIVRHRHQNDPTTVRKLLEEDLSPADEGEGL

SEQ ID NO: 163981 - protein, 178 aa, Glycine max
  Coding DNA Sequence Number=SeqID_72296
AEVAETLQYIVSPHGRNTWTVDNLVPYVEKITILSKEQVRIIEPVSHGPASERQFPAQEFHILQSNVETQGIGRRREAVEAEEYSQQMVDRGHGMYYTPPTFSQYPSQMYQYPFEGHHIDTFASEHSFGGVAETHPHFSWPTMTPSQQHDVPIVTPNARRNPDRQENDFACVLATAKV

SEQ ID NO: 163982 - protein, 136 aa, Glycine max
  Coding DNA Sequence Number=SeqID_72297
GSTIDVQQKILTELHLYKIDVEHFGSKFAIAQRKTHSPKIDEDDDNDAGNDLVFEDDDALNWATVYEASGVGERRMKQKAVQENDEDLEFEDIELEYEEEEIIVNFEASYGEEGEGDAPIPYDNNEEDYVGIEKDD

SEQ ID NO: 163983 - protein, 394 aa, Glycine max
  Coding DNA Sequence Number=SeqID_72298
  Gene Ontology: Mol. function=aspartic-type endopeptidase activity; Cellular component=small subunit processome; Biological process=DNA integration
  Homolog annotation: Hit_ID=A5C163; Match level="QueryCoverage=27%, HitCoverage=8%, E-value=3e-22, Identity=43%"; Hit description =Putative uncharacterized protein
MVVLESESNYEVIRGGRLKTKQPNNSFSQDDIVFIKEVTNVKEDKVRIIFKGIGPQPFLKNIFKMVKDSNTNPIVSRGEASSSEREEIKIMVPEGEFNHEVIGGGRLKAKQSNNVGSQDDIVFIKEATNVKGEVQCVELKQHQILAFLTKMVQRFDSVEKLMQEVKQEDGLDRPNMVKGHKLSSTNTTPNVGYEQQGLKINDYDVSHAYDVLLEGDFRAWFRRPPPSAAVAAVIFSGETRLRVSSGACSSRAAVPSSESCPSCSSSLVGTSWLPSKWWFSVLTSLCVELWFLGQGYHDHLEKGIDTVPSDRKSEWEKLDYQLCAVLWQSIEADVLEILRSFKTCCSFWKKAREIFANDIQSLFDATMKVTTLKQTSHDMIAHIGKARAAVEELK

SEQ ID NO: 163984 - protein, 251 aa, Glycine max
  Coding DNA Sequence Number=SeqID_72299
  Gene Ontology: Mol. function=nucleoside-triphosphatase activity; Cellular component=cytoplasm; Biological process=response to DNA damage stimulus
  Homolog annotation: Hit_ID=Q9ZUP2; Match level="QueryCoverage=34%, HitCoverage=22%, E-value=2e-35, Identity=84%"; Hit description=DNA repair protein recA homolog 3
  Pfam annotation: Domain name=RecA; Domain location=65-248; Score= -61.8; E_value=2.1e-08; Accession=PF00154.12; Description=recA bacterial DNA recombination prot
  Subcellular localization annotation: CTP_CleavageSite=40; ConfidenceScore=5.35e-01
MASLLRNANISLLKRSLFHSDLLTRFCFKPGVLGTSQVLSFSTRKRRSKSDGSDSGEENLSKKDLALQQAIDQITSAYGKGSIMWLGRSVAPKNVPVVSTGSFALDIALGVGGLPKGRVVEIFGPEASGKTTLALHVIAEAQKQGDLHFTIYIYNFNLSFVNMTTTVISSVIKFFVRLEYSRRGLNGNPLSVFSTLGLYYIRKLSLLSKLKRGKYKRYKALNRAGKQQQQQQQQQRLIPLGGVGYMDQLPP

SEQ ID NO: 163985 - protein, 121 aa, Glycine max
  Coding DNA Sequence Number=SeqID_72300
MKAATAGGIVGLSGDLMLEEIASFSGDLSEAFPEQERVLPLSVFSKLVSMTSFLSCSSNIQSKSGPIDDDVLWMQTKHVSEHIWNEKDDRKLHIKRVVPTYQGQEEIPEEIIPLLRQFGFY

SEQ ID NO: 163986 - protein, 305 aa, Glycine max
  Coding DNA Sequence Number=SeqID_72301
  Gene Ontology: Mol. function=catalytic activity; Cellular component =nucleus; Biological process=red or far red light signaling pathway
  Homolog annotation: Hit_ID=A7PXX5; Match level="QueryCoverage=30%, HitCoverage=33%, E-value=1e-30, Identity=72%"; Hit description =Chromosome chr15 scaffold_37, whole genome shotgun sequence
LADVWSCGVTLYVMLVGAYPFEDPNEPKDFRKTIQSFILTWFILTYNFYLILKIFRNVDHHPAFVVVYNMDTTEILSFYQNSPDELYLLFEQFCDHFHATSRNSMYMNFISSHSNNIHALEQLRSIKDKASSSAVLQFVKNIFESRFIADKAIAEIEAKCGQKIEECKEEQRQQLMRIEDEHTLLIKALRCELEDECQKLEEELHLQKSKEDRQRALLQLQLKVMSDKPKEDQETLSHSLCQGINTLNSNVKSDTAFKGGYYIITVFESRGDVTFKGGYYIITVFECRPDVTFKGGYYVITVFEC

SEQ ID NO: 163987 - protein, 151 aa, Glycine max
  Coding DNA Sequence Number=SeqID_72302
  Homolog annotation: Hit_ID=A5B2I6; Match level="QueryCoverage=74%, HitCoverage=5%, E-value=5e-07, Identity=30%"; Hit description =Putative uncharacterized protein
MEVAIATMQNARIAIITITIEMRNGGNSRFRFLMEKMHLARRIRWNPSMNQSPYELLLSLKHEGIVEEYREKFELYAGLLRGTEPEYLKGIFLNGLKEVVRAELKLHPVNSLPELMDYAQRIDEKNSLIEKVHSMLLMADGGSWRKVKNPP

SEQ ID NO: 163988 - protein, 42 aa, Glycine max
  Coding DNA Sequence Number=SeqID_72303
MDICWECKLWGTRRFHEQRLGVIFYGRGFMGLGFCGNMKNNN

SEQ ID NO: 163989 - protein, 172 aa, Glycine max
  Coding DNA Sequence Number=SeqID_72304
MIAETEPFGSDENGEEEEEEGVIEICVPDRGSTHNRKGEANAKEKDARGSEESVWCLLTRRWKVAIGRGGNVVSTVGGGSMVFAVGGGLAEEEDGLVTLGSKGGIGGDFAKAEDGEGCLGTMVFSIQRMSSSLEAMEVWAAVVEVWIVARLAMVVSRRSTQAVESSVSTIEE

SEQ ID NO: 163990 - protein, 130 aa, Glycine max
  Coding DNA Sequence Number=SeqID_72305
  Subcellular localization annotation: CTP_CleavageSite=32; ConfidenceScore=5.20e-01
MKKPKAEKQPIQVSLPMKGSKAPSLAKQVATKAQNNTNLFPKKMICCFKPTRDMKLGMIELQVCAYVFYKIIDPRIFETFFPNIIVDPEVMAKIASTILDTNMLNLVIIDFENWDILEPKGIPNCGNRFR

SEQ ID NO: 163991 - protein, 146 aa, Glycine max
  Coding DNA Sequence Number=SeqID_72306
MRKNLYISIIGFCFGHQPNCCASDDSRHHAIRVSMTEIYRLKIMVSTRGLDRTLGKVIGRVLGREVSDDDVHEQLEEATVDDVVTDVEGFPGGSHNTSILMDYVYHVATKIWNGDERSELKLCSHERKVEKFGRPAPEIEGLVAAT

SEQ ID NO: 163992 - protein, 524 aa, Glycine max
  Coding DNA Sequence Number=SeqID_72307
  Gene Ontology: Mol. function=carboxyl- or carbamoyltransferase activity; Cellular component=nucleus; Biological process=regulation of transcription, DNA-dependent
  Homolog annotation: Hit_ID=Q52ZH8; Match level="QueryCoverage=99%, HitCoverage=99%, E-value=0.0, Identity=75%"; Hit description=FVE
  Pfam annotation: Domain name=WD40; Domain location=122-161; Score =3.5; E_value=12; Accession=PF00400.23; Description=WD domain, G-beta repeat
  Pfam annotation: Domain name=WD40; Domain location=177-216; Score =15.2; E_value=0.24; Accession=PF00400.23; Description=WD domain, G -beta repeat
  Pfam annotation: Domain name=WD40; Domain location=254-293; Score =30.5; E_value=6.3e-06; Accession=PF00400.23; Description=WD domain, G-beta repeat
  Pfam annotation: Domain name=WD40; Domain location=299-338; Score =36.4; E_value=1e-07; Accession=PF00400.23; Description=WD domain, G -beta repeat
  Pfam annotation: Domain name=WD40; Domain location=348-387; Score =41.7; E_value=2.7e-09; Accession=PF00400.23; Description=WD domain, G-beta repeat
  Pfam module annotation: Pfam domain module=WD40::WD40::WD40::WD40::WD4 0; Domain location=122-161::177-216::254-293::299-338::348-387
METPPPQQGVVKKKETRGRKPKPKDEHGKGLKEGRKTQQQQQQQQQHHHQQQQQQQDQPSVDEKYTQWKSLVPVLYDWLANHNLTDGSVPNTLVIANCEVVKPRVAAAEHISQFNEEARSPFVKKYKTIIHPGEVNRIRELPQNSKIVATHTDSPDVLVWDVESQPNRHAVLGATNSRPDLILTGHQDNAEFALAMCPTEPYVLSGGKDKTVVLWSIEDHITSAATDSKSGGSIIKQNSKSGEGNDKTADGPTVGPRGIYCGHEDTVEDVAFCPSSAQEFCSVGDDSCLILWDARVGSSPVVKVEKAHNADLHCVDWNPHDDNLILTGSADNSVRMFDRRNLTTNGVGSPIHKFEGHKAAVLCVQWSPDKSSVFGSSAEDGLLNIWDYEKVGKKIERSGKSISSPPGDKVVDFHWNAYDPWTIVSVSDDCESTGGGGTLQFLVFVLDLRMLKVEQIHDWHGWGQWQDCFLFLSLAQWGFGDVDYALADQIWRMSDLIYRPEDEVLAELEKFKSHVVACASKTEK

SEQ ID NO: 163993 - protein, 473 aa, Glycine max
  Coding DNA Sequence Number=SeqID_72308
  Homolog annotation: Hit_ID=A9PJ05; Match level="QueryCoverage=24%, HitCoverage=75%, E-value=5e-31, Identity=56%"; Hit description =Putative uncharacterized protein
MPGTIMVSVLEFMDLPLSSSTFIRASLGKIEYQVNDKGNLSFPLTSLRDDLIFQILDSEGNEISHTGVQIKLILEKGVLEDNFPLGGGHLRLKLQFILSDEERDRIRSLRQSALKKKHDELLSSSRRGEESDSRTVIGNAALPFRRNDEVSESPKIQHQHEADPQSRGPAGSGDGKESETRSVVGAQLEQKKQLTTNIADQYRESSYTKPVSQNVTLTQLQQKGKKPAYQSSSPDRSPSEKHPQRGIGSEEIAVLFGSEKKDALTSNLTQPKIEESDLQYSKKRTSLGRIPSNVKKMISAFEGGLDQDKRPQIKPPPTKQQESSIERRDSSKTQHLEQDKSKNIDPADLQERVKSASLDMVQLKELSTLNILNRHIQMAEINPNKSVRGYCGKSRRLDFSKIENVEKNEANDGTGTEESEYEKIQETKESKPKTSDNNGDENSGGPFNQNFDPVNYIISCINLLVKESNALQN

SEQ ID NO: 163994 - protein, 37 aa, Glycine max
  Coding DNA Sequence Number=SeqID_72309
NKVGNLGFKTYTGENIGSTDKERLQQLLLADAMLLPV

SEQ ID NO: 163995 - protein, 219 aa, Glycine max
  Coding DNA Sequence Number=SeqID_72310
MMLVKGSSLRESFGGESEIRGYDDIDFEVLSNSHSLGLVFSSLTDRSASTRSSDLSTFLSQLLANTAEKVAPSAEREVSASPIMLLKYTWVDGEHYDGSRDVPDHSPHGLVECDTTHEVHLGVGNAWALLALLQQPLAGNGSVDIIDLAVEASFFRPFYFLLQKFQNWLLKVTIRLGICSGWHVFPEERKTSSRHTKWVVKSSDLTTMSFTQTSRFRPS

SEQ ID NO: 163996 - protein, 119 aa, Glycine max
  Coding DNA Sequence Number=SeqID_72311
MYHICMRDLRLNYVHLFENISKQDVGRASLIYKGLLDDGVDYFDTNSHWIICTGYGQHVRYSVPRDHIDGPNLPKVSLSFEGSGPTPSEAYGYGFYDSPRLVERSLFSLPGVTSTTSPC

SEQ ID NO: 163997 - protein, 123 aa, Glycine max
  Coding DNA Sequence Number=SeqID_72312
  Subcellular localization annotation: CTP_CleavageSite=35; ConfidenceScore=5.10e-01
LGERRTKTEARSWGTWKNPSCDGGSKFLSLRGTTRGFLGAGGHTNGSCFKVVLTVGTTVLMGVVLKERQIYERDRVEGGGCCVGGMEMEHNLDLTQSHMISSDAVHVVASATLPGLVFADLPD

SEQ ID NO: 163998 - protein, 59 aa, Glycine max
  Coding DNA Sequence Number=SeqID_72313
MTFKGNNFKTKNIKISTLNNQKEVQYNKPTKIEELSDQLIPVPEPDMYSAIRHEIEAGS

SEQ ID NO: 163999 - protein, 308 aa, Glycine max
  Coding DNA Sequence Number=SeqID_72314
  Gene Ontology: Mol. function=sequence-specific DNA binding; Cellular component=nucleus; Biological process=regulation of transcription, DNA-dependent
  Homolog annotation: Hit_ID=A7LHH9; Match level="QueryCoverage=100%, HitCoverage=97%, E-value=2e-91, Identity=62%"; Hit description=WRKY42
  Pfam annotation: Domain name=DUF746; Domain location=30-90; Score =2.1; E_value=0.014; Accession=PF05344.2; Description=Domain of Unknown Function (DUF746)
  Pfam annotation: Domain name=WRKY; Domain location=223-296; Score =117.2; E_value=4.8e-32; Accession=PF03106.6; Description=WRKY DNA -binding domain
  Pfam module annotation: Pfam domain module=DUF746::WRKY; Domain location=30-90::223-296
MALDMIDVVPRTRMEEENIAIQEAASAGLKSMEHLIRLLSPSSSLHNNVNNLNLNHLDCSEITGFTVSKFKQVINLLNRTGHARFRRSPPQAQAQAQAQAQAQTNPQPQPQIQQQGFSLDFVKPTILNSKPINKDETLTLSTTSSSFMSSVTNDASVSDGKIGPFLPPSAAKPPLSSAHRKKCRDAAAALSAKPSCHCSKKRKSRVKRTIRVPAISSKIADIPPDEYSWRKYGQKPIKGSPYPRYYSIPSSIFMLNRGYYKCSTVRGCPARKHVERAQDDPKMLIVTYEGEHRHVLPLTSAAGVSFGH

SEQ ID NO: 164000 - protein, 398 aa, Glycine max
  Coding DNA Sequence Number=SeqID_72315
  Gene Ontology: Cellular component=Golgi apparatus
  Homolog annotation: Hit_ID=A2Q411; Match level="QueryCoverage=97%, HitCoverage=91%, E-value=1e-138, Identity=62%"; Hit description =Hypothetical plant protein
  Pfam annotation: Domain name=DUF246; Domain location=83-392; Score= -51.7; E_value=1.3e-11; Accession=PF03138.5; Description=Plant protein family
MKFFLTFDDEKVNIEAAPASQNASEAVIDQSLATVSHVSKKSLMENGKGLKPCRNPLSLEEAHQSKGFITFSLTNGPEYHISQATQIADAVVVARILGATLVLPDIRSSKLGYSMSLGDIYDVQKIINRLDGLVGVTKTLPVTNGNPPIVKVPNRVSQDYIVRIVKPIYKAKGIVKIESYFSSVNPTIAGNKKNLDSFACQAMFGILQLQAEMLEVVDSMIQKLQSWSQNSNGKFIAVDLRTEMVGRECHKKDVSGRKLCYQPHEIGEFLKKIGFSPETTVVYVTQTKWNSDLDALKDIFPKTYTKETVMAEDKKGKFLRSKSSEFEKVIDFYICSKSEVFVPSIPGLFYANVAGMRILSGKNQILVPAEIAGPSASASDYISSYESQKNHFAYACFC

SEQ ID NO: 164001 - protein, 42 aa, Glycine max
  Coding DNA Sequence Number=SeqID_72316
MTLSLLKAAINWMINGDDMKLESGQKSEKGFVGEARLSTSVE

SEQ ID NO: 164002 - protein, 153 aa, Glycine max
  Coding DNA Sequence Number=SeqID_72317
MYIKSWRKSHVDLFVKIPMKKGVVYVELPEVPVVKGSKSKNVDVREKGGNKIGQSVKDTEHYLRWYQLEKGDGLTLGGMGESNLSGKKWEVVFIEDNVTRCSDAMGMKVIYKISFGVWFETNEDAWVGTRVKLLSVGFEGTHGVGMQLIKYAA

SEQ ID NO: 164003 - protein, 740 aa, Glycine max
  Coding DNA Sequence Number=SeqID_72318
  Gene Ontology: Mol. function=calcium ion binding; Cellular component =integral to membrane
  Homolog annotation: Hit_ID=A7PE01; Match level="QueryCoverage=100%, HitCoverage=99%, E-value=0.0, Identity=57%"; Hit description =Chromosome chr11 scaffold_13, whole genome shotgun sequence
  Pfam annotation: Domain name=MS_channel; Domain location=528-719; Score=31.8; E_value=8.1e-08; Accession=PF00924.9; Description =Mechanosensitive ion channel
MEEDKGVADKKVTKNDEVVLRISDSEEAMHAEKDHRDSRSSLEAEISSLSPQHSTHIGKGFTDSHGELTELENLRNKGQVSSELVTTTKRLMCRSEFSKPKSRLVEPPCPKDATFVVEKAQMTSSNLSARNSSNKNVSEATIVTPRTPLLGTPREEDDDDEEVYKAALIEMTKRSGKKYSVLGFVEWFAFVCIMGFLIASLTDHKLQHWEIWGLELWKWCVLVLVILCGRLVTEWFINVLVFLIERNFLFKKKVLYFVYGVKNSVQGFVWLSLVLLTWVLLFHHDVETARKFTRILNYITRALASCLIGAAIWLAKTFLIKLLASNFQSTRFFDRVQVSIFHQYILRTLSGPPLMDMAETVGNMSSSGRLSFKAMINKNEGKEEQVIDVDKLKKMKQEKVSAWTMKGLINVISSSGLSTISYTPESAFEDESDQKDNEITSEWEAKAAAYRIFRNVAKPGNKYIEKDDLLRFMKIEEVENVLPLFEGAVETGRIKRKSLKNWLVKVYLERRSLVHSLNDAKTAVDDLNMLASVIVIIVITVVWLLIMGFLNTQVLVFISSQLLLVVFMFGNTAKAVFEAIIFVFVIHPFDIGDRCVVDGVQMVVEEMNILTTVFLRYDNEKIFYPNSVLATKPISNFYRSPEMQDSVEFSVDVSTSIESIGALKAKLKAYLESKPQHWCSNHNVLVKDIENNYKERNSRRSELVLELKKILEDLNIKYHLLPQEVHLSYVRSQDSAAHTF

SEQ ID NO: 164004 - protein, 163 aa, Glycine max
  Coding DNA Sequence Number=SeqID_72319
  Homolog annotation: Hit_ID=A2Q1I9; Match level="QueryCoverage=87%, HitCoverage=30%, E-value=6e-52, Identity=70%"; Hit description =Putative uncharacterized protein
AAQLLGRAIGAGLFAITPAGERGMCCKAIKLGTSGWLVLAEELPMKKLYGVIRVAAPLAGIDDKHPRWLHLRIRPSSLPVLDPAKFNPNRKLKTKAFVDGRWTLAFRDEESCKSALSMILEEINFLSDEVHRRLKPLLNLETALDLSGPEEDSSSHSTTPPNS

SEQ ID NO: 164005 - protein, 404 aa, Glycine max
  Coding DNA Sequence Number=SeqID_72320
  Gene Ontology: Mol. function=hydrolase activity; Cellular component =cytoplasm; Biological process=metabolic process
  Homolog annotation: Hit_ID=A7QUC9; Match level="QueryCoverage=99%, HitCoverage=98%, E-value=1e-155, Identity=68%"; Hit description =Chromosome chr11 scaffold_177, whole genome shotgun sequence
  Pfam annotation: Domain name=Metallophos; Domain location=56-330; Score=58.4; E_value=2.4e-14; Accession=PF00149.19; Description =Calcineurin-like phosphoesterase
MDSQNWKHSLLYITFLLAILHLTQNHFCHKLFFANQTVRVKKNPDLPLRFRSDGTFKILQVADMHYGTGTSVTRCRDVLASEFEFCSDLNTTRFLKRIILAENPDFLAFTGDNIFGSSSPDAAESLFRAFGPVMESGLPWAAVLGNHDQESTMDREELMSLISLMDYSVSQINPSDDDLINPSKGGVMTKIDGFGNYNLRVYGAPGSMLANSTVLNLFFLDSGDRSVYQGIRTYGWIKESQLNWLRRVSHEFQGQKRDPLHPTDAISTMKPPALAFFHIPIPEIPHLFYKEIIGQFQEAVACSRVNSGVLQAFVSMGDVKAVFIGHDHTNDFCGNLDGIWFCYGGGFGYHGYGKAGWPRRARIILAELQKGKKSWMDVQRIMTWKRLDDEKMSKIDEQILWQSR

SEQ ID NO: 164006 - protein, 209 aa, Glycine max
  Coding DNA Sequence Number=SeqID_72321
  Gene Ontology: Mol. function=nucleotide binding; Cellular component =Golgi apparatus
  Homolog annotation: Hit_ID=A7QSM8; Match level="QueryCoverage=64%, HitCoverage=38%, E-value=6e-51, Identity=72%"; Hit description =Chromosome undetermined scaffold_161, whole genome shotgun sequence
  Pfam annotation: Domain name=DUF246; Domain location=1-124; Score= -195.5; E_value=0.003; Accession=PF03138.5; Description=Plant protein family
MTILVDDKRLPLEEETTMWKRLTLEGEMCWVTSVRSPYVVARGPQVKKDTLLTWDDLRQFQNHSSQMAALDFMVSEASNTFVPTYDGNMAKLVEGHRRTILLDRKKVVELVDMHQNGTLSWIEFADAVRRVHETRIAQPTRRRVILDKPKEEDYFYANPHECLCEENNCDDLLGPHNSSQDVKADKHRENYLGHSIKAPVGRWQKDIAS

SEQ ID NO: 164007 - protein, 57 aa, Glycine max
  Coding DNA Sequence Number=SeqID_72322
MQDDHIMMTVWKHLEQQDVRVFKKGPPKARKLLVSVSCPTLLARTTSFLPGKLDAHA

SEQ ID NO: 164008 - protein, 130 aa, Glycine max
  Coding DNA Sequence Number=SeqID_72323
MIMPWSHHWVLPREPQLHSHASWMSHPHASSIIPTQIMVVGDAILSPMASSPSFLSKAHSWWRSSFFHGLFPSGCHLLSPLLLYLSLHLHGGKSPLKDFIESQRSSLHRGSTSKLPSSGIRAQELQVDAP

SEQ ID NO: 164009 - protein, 248 aa, Glycine max
  Coding DNA Sequence Number=SeqID_72324
  Gene Ontology: Mol. function=nucleic acid binding; Biological process= DNA integration
  Homolog annotation: Hit_ID=A2I5F0; Match level="QueryCoverage=31%, HitCoverage=41%, E-value=7e-26, Identity=78%"; Hit description =Polynucleotidyl transferase
MTDSNKFHPALVVSNIKNHISITSEMENVQYAMWAKLFKIHARSHKVFHHIVPPEKGKERVSKTDEEKAWNRLHDIFQDNKNSWVVTLEQEFSRTNMEDFPNASVYCQRLKKLSDQLKNVGARVSNNRLVLQMVADLIEAYNGVATGRGAAMVARNTDNSHPLSKNSHQNQNTHGVTAAIVVGSSNQSTNSGLPNNDSGHGCLGFFNLAYTPHPTAQSPPHIGSDPIFRKPNSARHASLGQNHHKPTR

SEQ ID NO: 164010 - protein, 92 aa, Glycine max
  Coding DNA Sequence Number=SeqID_72325
MDCEAATIADPTSSSTRNKLNDEAALRQTFSISRVMEKWFLILEIARDEWKELLLFVMAVRRRRNKRWREGKNDWDMILDVGDSKSSVKDRV

SEQ ID NO: 164011 - protein, 749 aa, Glycine max
  Coding DNA Sequence Number=SeqID_72326
  Gene Ontology: Mol. function=metal ion binding; Biological process =metabolic process
  Homolog annotation: Hit_ID=Q0KII5; Match level="QueryCoverage=33%, HitCoverage=87%, E-value=2e-77, Identity=58%"; Hit description =Putative mandelonitrile lyase, related
  Pfam annotation: Domain name=Methyltransf_11; Domain location=142 -249; Score=48.8; E_value=1.9e-11; Accession=PF08241.3; Description =Methyltransferase domain
  Pfam annotation: Domain name=Methyltransf_12; Domain location=142 -247; Score=13.9; E_value=0.023; Accession=PF08242.3; Description =Methyltransferase domain
  Pfam annotation: Domain name=zf-C3HC4; Domain location=519-577; Score= 2.8; E_value=0.044; Accession=PF00097.16; Description=Zinc finger, C3HC4 type (RING finger)
  Pfam module annotation: Pfam domain module=Methyltransf _11::Methyltransf_12::zf-C3HC4; Domain location=142-249::142-247::519- 577
MNLHCASLAATISSVCSINEATHKSRTLQKRVNSDAPIKLSTEFLSHDSLEPTTKPCFCGRRHFIEAATLGTTLFPIQPSRATNPPREYTALLKKFHPPRPDWYEEFYASVMNSATKDYEAEVAMYKSQIFGNLKGKGLRILEIGIGTGPNLSYYASGSGVEVVGIDPNPKMEKYARSSAASAGLPTSNFEFIQAVGEAIPLSDASVDAVVGTLVLCSVKDVDMTLKALVASEIKTPLEMRVEGGKLGLLCYSGKIAKTGSLCCVASRPHESNAGSRDWSMGPNEPYWRTNSSYSPPPTRWDFRFQSEGLPYDVNDGVQLYGSSTSSIDKESRGWVRGNHLYDLHYSASDDTGIFLSSPSDLSQGPQWTPPAIQEISIDNYETSTRKDSHPSVDRVSFTPNKEGTSVNPNSGGSTSSQSESSESESTAKSRLSSQRNFSNLRSFMSKPIHPMSFNDLTTTRDAFDPAVTDFTEFDTSTPLRDGHRWSSASSSQEFADITESFELETPGRSHFLSDGFRCGLCERFLTQRSPWSSRRIVRSGDMPTIGVLPCCHAFHAECLEQTTPKTQKSDPPCPVCVKLEEENSPDQRGHLRLRTGFPRLKSSRDDGPSRPWGCVQVGDCVEGALHAPPRNTMLLLNRNRIKKNLSLKGNIGKEFPGKMRKNGTFSSHLFSGSSADGEAVGSSKATAGPSVWRFFFYLHYGRLSGSHLPSSGTGTGTDIASPSSGINAKAGQFGTEAAQILDFFTLII

SEQ ID NO: 164012 - protein, 276 aa, Glycine max
  Coding DNA Sequence Number=SeqID_72327
  Gene Ontology: Cellular component=membrane
  Homolog annotation: Hit_ID=A7QM21; Match level="QueryCoverage=75%, HitCoverage=29%, E-value=4e-76, Identity=69%"; Hit description =Chromosome undetermined scaffold_123, whole genome shotgun sequence
  Pfam annotation: Domain name=DUF221; Domain location=5-276; Score =6.8; E_value=1.1e-08; Accession=PF02714.6; Description=Domain of unknown function DUF221
MYKRVTQLRSDSTQQKNTQRGFPGLFSRKNSVIYYEKKLEDIEENVRLKQLEASLAGEVCVIVQGLTNLNQLEILFPFLTSILTIKFFSQIVTGYLPSLILQLFLKLVPPAMEFLSSIQGYISHSDIEMSASRKVLWFTVWNVFFATVFSGSILSMFNTLLDPKNIPGKLAVAVPAQASFFITYVVTQGWTSVSSELFRVIPFIFSWITRPFTSQDDEFEVPSTPYHKDIPRVLFFGLLGITYFFLAPLILPFLLAYFCLAYIIFRNQVSISLDVI

SEQ ID NO: 164013 - protein, 75 aa, Glycine max
  Coding DNA Sequence Number=SeqID_72328
MAPEVLKYRRYDKKVDVFSFAMSELVLNFKFMILEILLWFRCLKVNPRFQFKNLMMEPNMWQKDKGLLLGQRVIS

SEQ ID NO: 164014 - protein, 396 aa, Glycine max
  Coding DNA Sequence Number=SeqID_72329
  Gene Ontology: Mol. function=nucleotide binding; Cellular component =Golgi apparatus; Biological process=regulation of transcription, DNA- dependent
  Homolog annotation: Hit_ID=A9PD30; Match level="QueryCoverage=76%, HitCoverage=84%, E-value=1e-103, Identity=58%"; Hit description =Putative uncharacterized protein
  Pfam annotation: Domain name=DUF246; Domain location=93-358; Score =288.5; E_value=1.3e-83; Accession=PF03138.5; Description=Plant protein family
MEVRSEGIQVRCDKLQSSVIPRTRLRVWFIRVCSSIVVWTCLVQLMTVSELWHSHLISGITNGIYHIAQVQLPIQGDNGVAQSPPVVLPPSAVFQICDMVTVARFLNLTLVVPELDKTSFWADPSNFEDIFDVKHFIDSLRDEVRIVKRVPKKFSSKHGFSTLEMPPVSWSNEKYYLEQALKFTPQIENLGHKLIQMLHEKGSFVALHLRYEMDMLAFSGCTCGCTDKEAEELKQLRYAFPWWREKEIVSDERRSQGLCPLTPEEAALVLRALGFGRETQIYIAAGEIYGGERRLAQLRASFPQIVIFMLGYKCEVKSHIGSPYVVARDSQVYPSNLPNNWYQSRWFDQVSAQTSIQVPQMARMTSGTMCPVGGAGWLPCGRDSHLRGDVLGYKCE

SEQ ID NO: 164015 - protein, 66 aa, Glycine max
  Coding DNA Sequence Number=SeqID_72330
MKKGLNIVSLRSDHGDSLDKFDGKADEAIFLGYSLHDNSSKEDVGFQQKDSALEDDIKSKELQQSK

SEQ ID NO: 164016 - protein, 123 aa, Glycine max
  Coding DNA Sequence Number=SeqID_72331
  Homolog annotation: Hit_ID=Q5XM22; Match level="QueryCoverage=53%, HitCoverage=38%, E-value=1e-14, Identity=55%"; Hit description =Resistance-like protein HAAS-2
MALMSTIAAADVYQLKIETWIIAARAYLLHLLGCTLFANKSVTHVHVIFLDTLRDLTQSGGYFWGVVALVQIWGPLTVINRPERVVGQFGYIQTIPPHPVASLFFVDKIHDRWMQFGEYITPV

SEQ ID NO: 164017 - protein, 113 aa, Glycine max
  Coding DNA Sequence Number=SeqID_72332
MDKWLYSSEALKVKKIELEIESQFMNEAHLELNNTIEHSIQKDKKEKEILYKKVLELEPEKKVATAARNFKEAARIATKANSLCVEKESIQIDMDMTTLNLELLREKLGLVNH

SEQ ID NO: 164018 - protein, 142 aa, Glycine max
  Coding DNA Sequence Number=SeqID_72333
  Homolog annotation: Hit_ID=A1FUH1; Match level="QueryCoverage=24%, HitCoverage=13%, E-value=2e-13, Identity=100%"; Hit description=Heme exporter protein CcmC
MIAPLWWMVIGTKFWFAGSVLAKARADNLDREAGKAWVGGRVDAARAAGMSDCPLVPPTLPHVGSLVRPSHDPPALCDRRVRRVRAGARRLCHRFVAAPAHGTPVGAGTPAAAADPRRQTGSCSAAVDGAGTMTPVQRRRLA

SEQ ID NO: 164019 - protein, 130 aa, Glycine max
  Coding DNA Sequence Number=SeqID_72334
MDGHIDVALVKEFYLNLYDLEDKSPKQVRVKGKLIKFYATSLNAFLETPPLIQPGDQYPSYSIFCRMRTDPQELASKLCIPGHEFVLNAEGAPWELLRMDLTTLAQTWSVLSYSNLATTSHTFDLNMDRA

SEQ ID NO: 164020 - protein, 201 aa, Glycine max
  Coding DNA Sequence Number=SeqID_72335
MGEVEEIQEKMKADMEAIKEKMATMMEAMMSVKKIMEANAVAIAATSIVAKVNPKSPSGLSQMNHPTSAMVGKDLGSTGGPHYAQSQNKHAFPPYGLPPNYTPPNVAYTPNKNTHEIPHHNLADFEPWLEYATEGQAVGGIPLENTSEGPQYHPQLHLLHSTTSKNPHAMAEMGKLDHLEERLRAIEGSEDYAFANLEEFS

SEQ ID NO: 164021 - protein, 179 aa, Glycine max
  Coding DNA Sequence Number=SeqID_72336
  Gene Ontology: Mol. function=helicase activity; Biological process =viral genome replication
  Homolog annotation: Hit_ID=Q2A9E0; Match level="QueryCoverage=59%, HitCoverage=7%, E-value=2e-23, Identity=50%"; Hit description =Putative uncharacterized protein
MQINHIVDSISRTYSSIYSIFTVESDHSYMTDFRNYFNSTCIGDIDIPNNFIDINCKHAKMHMQMHVPQTISGYSDLGDQAMECRHCNAKMWYDERISKDRNTTSPKFTLCCGDGKVELPLLQSPPKYLERLLFDGKASDSKNYQCNIRTYNMMFAFTSAGIKLDKSINESRGPPTIRI

SEQ ID NO: 164022 - protein, 273 aa, Glycine max
  Coding DNA Sequence Number=SeqID_72337
MSSNGFVRNRNLAFRRQPLWDRKSLGTQEIRIEKLRLITIAVVAQYRHDCMPRTELAGKADCAGNVDAGGAAKAKPFLRHQIEQHRQRFRIRNPIGEVRRKTFQIGGDAPLSDAFGDGRAFGFQHAVLVKFIESRTLGIGKADLDVGVEVAQAIGHARKRSAGTDRANEAVHLAIRLVPDFGGSRFDMGLTVGDIVELVGPDRAVFIGCGKLFCQPDRNLHVIVRVGIWGGRNLDQLGAEKLQRVLLNLALRIGNDDDRLVAQSIGDQRKTDA

SEQ ID NO: 164023 - protein, 64 aa, Glycine max
  Coding DNA Sequence Number=SeqID_72338
MTGWIVIIKKGEIVEAMTSKIILMMPKNQELSKFQRIRSQKLQESSFKESRFKNNQVSRIKIQE

SEQ ID NO: 164024 - protein, 39 aa, Glycine max
  Coding DNA Sequence Number=SeqID_72339
MQTEITKPRSLVKPNQSKLHPQIPLVGLGPIETDLLGLD

SEQ ID NO: 164025 - protein, 54 aa, Glycine max
  Coding DNA Sequence Number=SeqID_72340
MKQNNVALSTAEAECISADTKNQIANIFTKPLPKDFFYTIRRELGLLDASDLDK

SEQ ID NO: 164026 - protein, 107 aa, Glycine max
  Coding DNA Sequence Number=SeqID_72341
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=63%, HitCoverage=52%, E-value=5e-25, Identity=83%"; Hit description =Putative uncharacterized protein
MYPFLFSVKSNESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 164027 - protein, 102 aa, Glycine max
  Coding DNA Sequence Number=SeqID_72342
MAPRKISTKRSRKDAAAEGTSAAPEFDSHRFRSAEHQQRFEAIKGWSFHRERRVQLRDDEYTDFQEEIARRCWTSMVTPMAKFDPDIVLEFYANAWPTEEGV

SEQ ID NO: 164028 - protein, 41 aa, Glycine max
  Coding DNA Sequence Number=SeqID_72343
MAYRIHEDKTILRFPFKHHLKFKLNNLKKCYLEDPLEKGKI

SEQ ID NO: 164029 - protein, 442 aa, Glycine max
  Coding DNA Sequence Number=SeqID_72344
  Gene Ontology: Mol. function=transporter activity; Cellular component= cell outer membrane; Biological process=transport
  Homolog annotation: Hit_ID=A1FRQ2; Match level="QueryCoverage=69%, HitCoverage=37%, E-value=1e-138, Identity=82%"; Hit description=TonB- dependent receptor precursor
  Pfam annotation: Domain name=Plug; Domain location=54-159; Score =51.6; E_value=2.8e-12; Accession=PF07715.6; Description=TonB -dependent Receptor Plug Domain
  Subcellular localization annotation: CTP_CleavageSite=45; ConfidenceScore=5.84e-01
MQERSPGVFVVSAAPAPAKPRTPARAASSAPSSATTTSLARVTVSASTARMPQGETAMPNTITVLTREDIAQQLALGSDVSRVLSSQIPAFAPAREKMSNYGETLRGRGILYMVDGVPQSTPLRDGSRDSHTIDPAMIERIEVIHGANALQGIGGTGGIVNIITRSAPSEPGAFLLDTNVSYSAALPSRHDDNGQRGSALVGVRGEQFDLVAGLAYEKQGLYHDGEGRSIGTNAQGELMDSTSSNVFAKLGWNIAEGHRLQVMANRYELRGMDNYLAINGDYRTGRPTISVPGDTPLDPPMNRSRAGLRGGFRRPLRCQPVGPVGQHRRQRRLGPDPERIGQARLQADPELDPRRRHHAGRDPGPGRPARPHPPGAAGQWHELGAADHLPEPVTAAAAALVADRSPDAVRRPALREGRAGGGVTTPPCPATALARWLAASRP

SEQ ID NO: 164030 - protein, 255 aa, Glycine max
  Coding DNA Sequence Number=SeqID_72345
MGCINCNLVLSIRQLGDPMRGVPSEETIAPFIARDKELGGSSNGVIGGYHQWLKSRTQGITWLPKLKGLNGEEDDMPEESEEVQALKAELEKTRVAKVAITRVRKECDELKDVNMTTVEALERETKKSRKEEWSRNKFRGALWGNSNELKLRKAERDKSRMESMMLEDKLKSCQRLKRSLTEQLSKMEENMLIIIDQYKEKVNLAASHGQMLEDEQAKVSALQVEREVREAVTELLHKVAMRWMDRFDLTLNKSQ

SEQ ID NO: 164031 - protein, 117 aa, Glycine max
  Coding DNA Sequence Number=SeqID_72346
TSKWALAANKDSVDDTVCEKYSISKEKWAQFCHSRRDPSWEDMQKQNTDMVISFIQKQNTVPQVLSRGGYEYLEKKLMDEKTKKKLEEATKLGSTDMVIEGIQCFIFVMKQINIHIS

SEQ ID NO: 164032 - protein, 131 aa, Glycine max
  Coding DNA Sequence Number=SeqID_72347
MNFAAKSLYDSPQIPVSYANLLPYLLDNAMVSITPARIFKYKPLVSLLKRPVLLSFPRPFNQRLLVLHVGGVAVKQHGQPFPCVQESSTTRDSQSLNPFLEVRRREEEISLKRDRLYNEDQSKFLIEYASG

SEQ ID NO: 164033 - protein, 30 aa, Glycine max
  Coding DNA Sequence Number=SeqID_72348
MNGKLPGSYIINRTSKRVKLRPQRETTPEI

SEQ ID NO: 164034 - protein, 318 aa, Glycine max
  Coding DNA Sequence Number=SeqID_72349
  Gene Ontology: Mol. function=transporter activity; Cellular component= outer membrane-bounded periplasmic space; Biological process=amino acid transport
  Homolog annotation: Hit_ID=Q9ZF60; Match level="QueryCoverage=95%, HitCoverage=100%, E-value=1e-147, Identity=86%"; Hit description =Glutamate/aspartate periplasmic-binding protein precursor
  Pfam annotation: Domain name=SBP_bac_3; Domain location=58-288; Score= 189.5; E_value=8.3e-54; Accession=PF00497.11; Description=Bacterial extracellular solute-binding proteins, family 3
MGITSVPGVKDKELDMQLRKLAAAMLVMGVTAGLAHAEDAAPAAGQSTLDKIAKNGVIVVGHRESSVPFSYYDNQQKVVGYSQDYSNAIVEAIKKKLNKPDLQVKLIPVTSQNRIPLLQNGTYDFECGSTTNNLERQKQAAFSDTIFVVGTRLLVKKGGPIKDFPDLKDKAVVVTSGTTSEVLLHKLNDEKKMNMRIISAKDHGDSFRTLESGRAVAFMMDDALLAGERAKAKKPDNWEIVGTPQSKEAYGCMLRKDDASFKTLVDDTVAQAQTSGEAAKWFDTWFKNPIPPKNLNLNFELSDDMKALFKSPNDKALN

SEQ ID NO: 164035 - protein, 367 aa, Glycine max
  Coding DNA Sequence Number=SeqID_72350
ASRLHFQRTTHPSLPRLHALTFRGLHALAFRGLHAHTFIGLHALNFRGLHILALRTTWLHALAFKGLHVLAIRGLHILAFRGLQVLAFRGLHALAFRGLHAHTFIGLHALNFKGLHVLALRTTCPHLQTPACPHTQRATRPRLQRTTRTRLEDYTSSPLEGCTPSPSEDYKSSPSEDCTSSPSEDYTSSPSEDYTAARPHLQRASRPRHQKTTRPRLYRTTRPRLHKTTRLPLQSDTRPRLHRTHVLTFRGLHALALRGLQVLAFRGLHVLAIRGLHAQTFIGLHVLALRNTRPHLQRATRPHHQRTKRPRLQRATHPRLQRTTRLHALTFRGLHVLILKGLHALTFRGQNVLTFRGLHALTIRGLH

SEQ ID NO: 164036 - protein, 48 aa, Glycine max
  Coding DNA Sequence Number=SeqID_72351
RYMEKNEETTMEEKVKLKINGGWIFELQCGPSMVIFHHGDVAEDKGEE

SEQ ID NO: 164037 - protein, 225 aa, Glycine max
  Coding DNA Sequence Number=SeqID_72352
  Gene Ontology: Mol. function=hydrolase activity, acting on glycosyl bonds; Cellular component=cytoplasm; Biological process=response to DNA damage stimulus
  Homolog annotation: Hit_ID=A7MH18; Match level="QueryCoverage=100%, HitCoverage=88%, E-value=1e-105, Identity=78%"; Hit description =Uracil-DNA glycosylase
  Pfam annotation: Domain name=UDG; Domain location=49-211; Score =276.3; E_value=6.4e-80; Accession=PF03167.10; Description=Uracil DNA glycosylase superfamily
MAEKLTWHDVLAEEKEKPYFVETLKAVAEERAAGVTVYPPQKDVFNAFRLTELGDIKVVILGQDPYHGPNQAHGLAFSVLPGVAIPPSLLNMYKELEQDIPGFQRTQHGFLESWAKQGVLLLNTVLTVEAGKAHSHARFGWETFTDNVISAINTHREGVIFLLWGSHAQKKGSIIDAQRHHVLKAPHPSPLSAHRGFFGCQHFSKANALLSQAGQTPIDWTPVLP

SEQ ID NO: 164038 - protein, 47 aa, Glycine max
  Coding DNA Sequence Number=SeqID_72353
MRLFASQLEDADIFGEGADDDSRSEDADISGEVSDGDADISGKVQMT

SEQ ID NO: 164039 - protein, 71 aa, Glycine max
  Coding DNA Sequence Number=SeqID_72354
MKWKLQHPDQNEETDKRKRSIALKASSSIQEEEEEKSDDEEDFSLFVKKFHKVVKNRRMERRHNFNNGKRS

SEQ ID NO: 164040 - protein, 119 aa, Glycine max
  Coding DNA Sequence Number=SeqID_72355
MGTSFVVQVEGTSTWVVVTENKRGYISCGSVQVEDTSTWLFKENKGGYIPCGSLLGKDCHHQKGGDCGSNVFQGYFADAKESRVNKNSRFKNQASRLKILETREDSIKISTKNVFQNIE

SEQ ID NO: 164041 - protein, 275 aa, Glycine max
  Coding DNA Sequence Number=SeqID_72356
  Gene Ontology: Mol. function=zinc ion binding
  Homolog annotation: Hit_ID=A2Q4S5; Match level="QueryCoverage=70%, HitCoverage=35%, E-value=6e-21, Identity=32%"; Hit description=IMP dehydrogenase/GMP reductase, putative
  Pfam annotation: Domain name=DUF1723; Domain location=136-185; Score =49.6; E_value=1.1e-11; Accession=PF08330.1; Description=Protein of unknown function (DUF1723)
MLRTRGLGRALGKVVDRGLGKGDRDDSDGAPQRQRPTASARRQRVPITVADDEPVVPADSLVDTGANTGAEAAADEAEGFPGGPTDTSMLTEYVEHVAASVCMGEQVQKLGRPIPAIEGLVAGTLLSPLIACSVDTGDQGLISSFVERWHRETSSFHLPVGEVIITLDDVASLIHLPIIGEFHTFQALHVDEAMLMLVDLLLVSAEAARAEIGHCHGPYVCLSWLQDMYQCRCQAGYWTAAARAYLLHLLGCTLFANKSATHVHVVFLDALCDLS

SEQ ID NO: 164042 - protein, 173 aa, Glycine max
  Coding DNA Sequence Number=SeqID_72357
  Gene Ontology: Mol. function=phosphopyruvate hydratase activity; Cellular component=phosphopyruvate hydratase complex; Biological process=glycolysis
  Homolog annotation: Hit_ID=A9P745; Match level="QueryCoverage=98%, HitCoverage=39%, E-value=1e-73, Identity=74%"; Hit description =Plastid enolase
  Pfam annotation: Domain name=Enolase_C; Domain location=1-173; Score =159.9; E_value=7e-45; Accession=PF00113.13; Description=Enolase, C -terminal TIM barrel domain
MVQIKIGMDVAASEFYTKDGKYDLNFKKQPNDGAHVHSAQSLGQLYKDFVKEFPIVSIEDPFDQDDWGSWASLLASVDIQLVGDDLLVTNPKRIVEAIKKKACNGLLQKVNKIGTVIESIQAALDAKAAGWGVMIKTGGAPCRSEQLAKYNQLLRIEEELGSVQYAGETFRSP

SEQ ID NO: 164043 - protein, 50 aa, Glycine max
  Coding DNA Sequence Number=SeqID_72358
MWDRHRLKGALKLGVFTLMAYTPKSPSGSLPPDSVLTRRPLRVLALTRRP

SEQ ID NO: 164044 - protein, 49 aa, Glycine max
  Coding DNA Sequence Number=SeqID_72359
  Subcellular localization annotation: CTP_CleavageSite=43; ConfidenceScore=5.18e-01
MCFREENPSRGASVTFPRRFCKRFCGNSSSFFIVLHRSSFVLRRSSVFN

SEQ ID NO: 164045 - protein, 124 aa, Glycine max
  Coding DNA Sequence Number=SeqID_72360
MVWNCSYVAYVEGRDEVDKGTSNTQACSKIHIPMLDSNDPSYVESDSDVHFNVSPQALDKLMCYFLALKVNVQPNFKNVVVLRCSNDLHLISVVMDMLPDAKACSKIHIPMLDSNDPSQVESIS

SEQ ID NO: 164046 - protein, 119 aa, Glycine max
  Coding DNA Sequence Number=SeqID_72361
MEEDGASSSNSLEVFHSFMIKPKVKEDNKMPIFALKADGRGPMTRSRTKQSVDTLQKMVAGILSNAQVEKDEGPSGERRRPKWRRMKAQVEKDERPKWRRMKAQVEKDEGPEADALPRY

SEQ ID NO: 164047 - protein, 266 aa, Glycine max
  Coding DNA Sequence Number=SeqID_72362
MAPKKLPAKSARKEATGEGSSVVPQVEKEVARRHWTPLVESMAKYDPEIVMEFYANAWPTEEGVRDKRSWVRGQWIPFDEDAINQFLGHSLVLEEGQHREFSQRRSQASGFNEEAISQLLCVPGQDFALSVAWRQFAGITSTRHLVDLEKSNRALGFPALIMNLCQFYGVSITPTKLIWPPISRAFIEKNCMPRQAQQQGWAQKELQMHVYMQHVTSQQVANHRATVEWPGDEPDLERGAGLVGALGGEDGAQEDDDMAEVLEYFM

SEQ ID NO: 164048 - protein, 70 aa, Glycine max
  Coding DNA Sequence Number=SeqID_72363
MEATDLNIWEAIEIGPFIPTIEALGRRLQVDWARDPREGPRVLMSLRLSSSFFRNLLKEASQGGELSYER

SEQ ID NO: 164049 - protein, 115 aa, Glycine max
  Coding DNA Sequence Number=SeqID_72364
  Gene Ontology: Mol. function=electron carrier activity; Cellular component=membrane; Biological process=electron transport
  Homolog annotation: Hit_ID=A7PRQ1; Match level="QueryCoverage=92%, HitCoverage=23%, E-value=9e-27, Identity=48%"; Hit description =Chromosome chr14 scaffold_27, whole genome shotgun sequence
  Pfam annotation: Domain name=NHL; Domain location=16-44; Score=23.7; E_value=0.00068; Accession=PF01436.12; Description=NHL repeat
NGEEGLKDGSFDDATFNCPQGLAYNEKKNILYVANTENNVLREIDFVNEKVRTLAGNRTKGSDYVGGGKGDSQIKKLDPTSKRVSTIAGTGKAGSKDGTTVKAQVGKIFCAIFKR

SEQ ID NO: 164050 - protein, 116 aa, Glycine max
  Coding DNA Sequence Number=SeqID_72365
MMEAMLSMKKIMESNVVVVATTSVATEVDPTHPKVEGLGSSSSTSMMEKEMITMIVDTLPVFYYEKLVGYTPSSFADLVLTSERIEVGLRRDKFNYLALMNGEPGENGENKKEGGN

SEQ ID NO: 164051 - protein, 88 aa, Glycine max
  Coding DNA Sequence Number=SeqID_72366
MRTKLGRSATGDLIPTDLEINATCRRRNAERIRKFLQDLEAEATPGEEPRSSEASSRCPILGQSHIDLLDEVIMAEEPRRVTLEDSQV

SEQ ID NO: 164052 - protein, 18 aa, Glycine max
  Coding DNA Sequence Number=SeqID_72367
MVGGICKDTLKLKLEAQR

SEQ ID NO: 164053 - protein, 51 aa, Glycine max
  Coding DNA Sequence Number=SeqID_72368
MKLLKVLFTHFYGNFGAQIVTWMKGVEQIGAFVASRGDFSFDNQQRYSSRE

SEQ ID NO: 164054 - protein, 163 aa, Glycine max
  Coding DNA Sequence Number=SeqID_72369
MVTKDGSAGKKPKEHLPKRKMHGSRHQRLFEENGVALAPTYPQAKGHFGAVAARPGNLKLSAEAMSSPKRVGFFTMKLFGGPVCYVIQGDEVWDYGVWISDLMGEMGLDSHFESAHGDVIIAIVEGSACPLRASAPASKPIRCKEFIGGIPLWVAPLADPDLL

SEQ ID NO: 164055 - protein, 114 aa, Glycine max
  Coding DNA Sequence Number=SeqID_72370
  Subcellular localization annotation: CTP_CleavageSite=66; ConfidenceScore=5.35e-01
MGQVVPLYLSKSKTLNFRGMMTSGTSHNSASFNGPQPFLYMIKFSPFYHSKALPTIKMQGLWLWVKLRALQSVWQGYTTNYLPISGISEVRVTHVPSPWVEGPMPDQIGVVGSQ

SEQ ID NO: 164056 - protein, 134 aa, Glycine max
  Coding DNA Sequence Number=SeqID_72371
  Subcellular localization annotation: CTP_CleavageSite=52; ConfidenceScore=5.20e-01
MMYFDSDFASFSLLSLQSFTCGPQNLPLSPSSRLFIAKQGIYGHDSLPRRVELAQVSCYFIVKQPCLHKRASYFFMKLFGGPGEPKASPGEPGIRKSFEMTLLPSLLAIFRIIFRNIEKPFGLPENWCQPAQFG

SEQ ID NO: 164057 - protein, 282 aa, Glycine max
  Coding DNA Sequence Number=SeqID_72372
MKAYMKGLPAALYQTCLDALTITDVCWMPYGDHQGVRGFDLISCFQGQLRWGPIMVTVLPERVDIDDRWMHYSDHLVAAGEIFVVPGQAGDEPRHPPAPQHEEYVEPGIPEVPVGAEGGLSHASDPPRHVVDGCEGCEAIAERLERVLNLRMVTEGTELHEIMEDCLRISTGKENFDGGGGHLQTPKCSISYTTHGERDQEMRSCILEVEQRCLHVREWVYAFDDLISLYLSRKLSAAAVSIEFFFLPPPPSRPPLPPSATPPPPPSPPSSSLPRLAQRPLK

SEQ ID NO: 164058 - protein, 264 aa, Glycine max
  Coding DNA Sequence Number=SeqID_72373
  Homolog annotation: Hit_ID=Q2HW90; Match level="QueryCoverage=61%, HitCoverage=41%, E-value=8e-15, Identity=33%"; Hit description =Putative uncharacterized protein
MASQEKWVPFADILALLIFGVVLFPNVDGLVDLAAIDAFLAYHHSKESPVVAILADLFDTFDRRCEKNSAQIVCCLPALFIARASKKEESIGTNTWLGTRGCINYNPALAIRQLGYPMRGEPTEDSLSPFLVRDFGAQSLKVVQRVHKAWRSPLRKDKELRGIRNGIIDGYHEWLRVHTRGLDWLSKLKVVNEENFEASEEDEEIQALKLELGKTRLATEKFKSAATNIRKECTELREENAATARALEQETKRARKEEHGRDKF

SEQ ID NO: 164059 - protein, 135 aa, Glycine max
  Coding DNA Sequence Number=SeqID_72374
MGEVEEVQEKVKADMEAMKVQMATMMEAMMSIMEANAVVVAAARAIAKVNPMPPSHINQMNHPTSARGPQFRPQPQPLHFAVGRAPPVMAKKGKLDHIEERLKDIAGGEDYAFANLEELFLVPEGGHSQVQGAGL

SEQ ID NO: 164060 - protein, 84 aa, Glycine max
  Coding DNA Sequence Number=SeqID_72375
  Gene Ontology: Mol. function=nucleic acid binding; Cellular component= cytoplasm; Biological process=regulation of transcription, DNA -dependent
  Homolog annotation: Hit_ID=A8GDH4; Match level="QueryCoverage=63%, HitCoverage=75%, E-value=4e-22, Identity=94%"; Hit description=Cold -shock DNA-binding domain protein
  Pfam annotation: Domain name=CSD; Domain location=26-84; Score=90.8; E_value=4.2e-24; Accession=PF00313.13; Description='Cold-shock' DNA -binding domain
EEHNAEAAAICAFIVSPGAVIFGDQRCESSCKGFGFITPADGSKDVFVHFSAIQSNDFKTLDEGQQVEFTIENGMKGPSAGNVV

SEQ ID NO: 164061 - protein, 70 aa, Glycine max
  Coding DNA Sequence Number=SeqID_72376
MAHSMFAPCHYFRDQQGRELKGFLVIFPKVVISLSMVSRGIIPFEEHIAVVGTTSNDMLSKRKTLDEGSL

SEQ ID NO: 164062 - protein, 67 aa, Glycine max
  Coding DNA Sequence Number=SeqID_72377
MKAMPSKPTRKGRKWYLNPTKDPSGEGRRPKWRKAPEWRRMKAQVEKDEGLEAETLSRLLIVAEVPD

SEQ ID NO: 164063 - protein, 108 aa, Glycine max
  Coding DNA Sequence Number=SeqID_72378
MSLHDVDVCNTVDYDIHHFQSADLENMTDPPMFFASGMTYQFKAVFHVDRNIIEVPSVYHKQWAPDYPNYVVLDYNGKKHHIRVRKFSNRVYIGDGLKHFRRDMGIYE

SEQ ID NO: 164064 - protein, 77 aa, Glycine max
  Coding DNA Sequence Number=SeqID_72379
MAQEEETSTNQIPEPSPTPIPNDAIPSALASELEQLISQDSPVAQPLEENEHVIGSMTENVSQCVRLIVKECIDRIL

SEQ ID NO: 164065 - protein, 130 aa, Glycine max
  Coding DNA Sequence Number=SeqID_72380
MAAQENEDEESKDEEDFSLFVKKFHKFVKKRRIERRQNFNHEKDSKKTLQFLDATSATNLVTSKQIAPQTSIGLRRMRRKVMKKEDPRRRILHGMPMAHPRVRRRRLTFYPRTMRAMRTSLKKTKQKAKV

SEQ ID NO: 164066 - protein, 426 aa, Glycine max
  Coding DNA Sequence Number=SeqID_72381
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A4W683; Match level="QueryCoverage=95%, HitCoverage=95%, E-value=0.0, Identity=89%"; Hit description=PTS system, lactose/cellobiose family IIC subunit
  Pfam annotation: Domain name=PTS_EIIC; Domain location=36-338; Score =246.5; E_value=5.9e-71; Accession=PF02378.9; Description =Phosphotransferase system, EIIC
MSANHAAFNLIFRFVENYVSPIAGRISSQRHVMAIRDGFISAMPFMIVGSFLLVFAYPPFSPDTTWGFARAWLNMAKQFEGQILTPFDMTMGIMSIYICAAIAYNLGKHYVKSHQLDPFMCAMLSLMAFLLVAAPKTKGTLPVDSLGGTGIFTAILVAIYCVEMMRFLKAHNIGIRLPDQVPPMIKNSFDLLIPVLVVAIMSVFKPLVSAADSLPAILLAVLIGHLLWFAGIHGAAIVSGMLQMFWLTNLGANQTALPAGQPLPHIFMEAFWTFFIVVGGSGATMGLVFCYLRSRSAHLRSIGRLSVVPSLFNINEPVIFGTPIVMNPVFFIPFLLAPMVNAVIAWAAMKLDLIGRVISVVPWTAPAPIGGAWALGWDFRAAILVVVLACVSAIIYFPFFKVYEKQLLAQEAEEAQRAAQENEQTA

SEQ ID NO: 164067 - protein, 85 aa, Glycine max
  Coding DNA Sequence Number=SeqID_72382
MITNLVRGSRMTVAGCRDKGYIYLGCYTENKRGYISVGSVQVEGTSTWLFKENKGGYIPCGSLACKEFYKVERNLKNRWLLGDWM

SEQ ID NO: 164068 - protein, 22 aa, Glycine max
  Coding DNA Sequence Number=SeqID_72383
MSDGLVDGFKEPRARRCWDTTL

SEQ ID NO: 164069 - protein, 206 aa, Glycine max
  Coding DNA Sequence Number=SeqID_72384
  Homolog annotation: Hit_ID=Q6WAY6; Match level="QueryCoverage=86%, HitCoverage=36%, E-value=5e-11, Identity=29%"; Hit description =Putative uncharacterized protein
APFIDVLALLIFGGVLFPNVDGLVDLAGIDAFLAYHNHKERPVVTMLADLYDTFDRRCEKSSTRIVTVHAQRKEAQIGTNSYQTKKERLSTGSLDGKKEEPKGCISYNPVLTIRQLGYPMRGAPLEEELALVISRGFSQTNVETLRKVCKAWEVVQKKDKELRGSNNGPIGGYGKWLKAHVQGLDWLPSLRTAKREEVEAPEEDKE

SEQ ID NO: 164070 - protein, 60 aa, Glycine max
  Coding DNA Sequence Number=SeqID_72385
MDFGDQSCILLHKIQDSALEAAERQQLSMEARVHHFERLESDFSIGKYTVALELDRSMTK

SEQ ID NO: 164071 - protein, 111 aa, Glycine max
  Coding DNA Sequence Number=SeqID_72386
MRSREGTSSKLVLAIVVSDSDVVVSRKKNRTEPESLSPTSDPPTHTLSKLNSPSLALCLATNVRFFIIVKPYWVMISVETVAIALIFRRFGDPFAIHDRNQRVAYLEREAQ

SEQ ID NO: 164072 - protein, 397 aa, Glycine max
  Coding DNA Sequence Number=SeqID_72387
RPPPEPGRACSMSGCAASAQRLTCPWRMISISSGLERRADCRFLTAIEQQVAVMRTCVCAKVAICAGTSVQISTRPDAERLAEQRRRYSRTPLPPRPSVVVRPFRLAADKALGDHQRFLQARLQLRPGQFAERGAVRHGAAEVIVGAHHFAHVEPFGLHVAGAQDFNEQQGGHQLPMADQFVGQRRRGGQRRGFRQHGDVFQQAVDLFADHRRRREAIEDGVLDAADLIKPVVALVGLATLGQGDQQVGDARRGGQHHQADLRVGQHDVGAAVHGFKVGDAGAAEFGYHGGILGSGYDTPRSAPPCRSPCGRSPGDNPGDSAPVVDRIMAGHYPTSASLPLGCRQRRNGSSDTLPGRRASSGLRTGAISVQGIAGVEPAPIGCREPSSFWLNNGITP

SEQ ID NO: 164073 - protein, 22 aa, Glycine max
  Coding DNA Sequence Number=SeqID_72388
MNSRNQSRYLGTDASEDGVTTD

SEQ ID NO: 164074 - protein, 176 aa, Glycine max
  Coding DNA Sequence Number=SeqID_72389
  Homolog annotation: Hit_ID=Q6UUU1; Match level="QueryCoverage=48%, HitCoverage=55%, E-value=1e-18, Identity=61%"; Hit description =Putative uncharacterized protein
APMSVSAKNASTDFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMGRVCLIPRLTLSS

SEQ ID NO: 164075 - protein, 104 aa, Glycine max
  Coding DNA Sequence Number=SeqID_72390
GPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTL

SEQ ID NO: 164076 - protein, 90 aa, Glycine max
  Coding DNA Sequence Number=SeqID_72391
MVNNIFTPSRYKEIIMVQPKPSAGLKGKPHQHALIFMPSCIQQSKAWVPRPKSYFGIYPNPPRGWGQCGLPHHFRTQPRPKAIPYNPPIQ

SEQ ID NO: 164077 - protein, 79 aa, Glycine max
  Coding DNA Sequence Number=SeqID_72392
MSYQARLSREGCAKRQHHFVLKSLEVRLAHVVALSLNHSLLSTCCGKNFGVAESANPRCYAKPQMLTRSYNFELGLARG

SEQ ID NO: 164078 - protein, 281 aa, Glycine max
  Coding DNA Sequence Number=SeqID_72393
  Homolog annotation: Hit_ID=Q6WAY6; Match level="QueryCoverage=70%, HitCoverage=36%, E-value=4e-11, Identity=26%"; Hit description =Putative uncharacterized protein
MTPSTEDVKKAMQGLFAVLQLSMWGWFHTFFSKKVGPSIRYKEGRIKILSSCEGCPNVPLMGTRGCINYNPVLAIRQLGYPMRGAPLDESITPFIARGFSDHKREGTPRSSQGMGCGTVRDDEVKASEESDEVQALKAELERARVVEEKFKSIAIKVSKEGSNSEAQAPEEVKGIIHGVKRHDLEGRAKGNMWAIIDKCKEKLNLAVTHEQRLEDEYAKISTEREARERVIDSLHQEATMWPDRFALTLSRSQELPPLLAKAKAVADTYSAPEEIHGLLSY

SEQ ID NO: 164079 - protein, 127 aa, Glycine max
  Coding DNA Sequence Number=SeqID_72394
  Subcellular localization annotation: CTP_CleavageSite=34; ConfidenceScore=5.15e-01
PVPVKKPTPFPYKSDKAVPWNYAAQGPNGRKGVSVVHVKDDLSSAKVTNISSTSGMTHSGQIFVAPELPVQPKDLKGKAKAGVEESDKASLIPNDEVPIGRFAKEEDDFSKNRISAEETTEFLRIIQ

SEQ ID NO: 164080 - protein, 84 aa, Glycine max
  Coding DNA Sequence Number=SeqID_72395
MNVYTYDIIVVHYHQIQQLAVVQSAKCRVRSATSGDDPQLEDASFEDLEFKIRVCACTDIVKEHFRFAELGRSREVLGFENMDL

SEQ ID NO: 164081 - protein, 49 aa, Glycine max
  Coding DNA Sequence Number=SeqID_72396
MGKEILSQTDMWLKLDPLEPLPAGKHRETKGLETHPFIEKKFRVKEQKV

SEQ ID NO: 164082 - protein, 153 aa, Glycine max
  Coding DNA Sequence Number=SeqID_72397
MDYTEQNLGEFCKFADGTGTFSVSNKINRIIKRLGRDRAARSKYYKYPTLCYLFMMNNWNPPNLSQKNDDRGFIHRWIVLKFENHISNPIPSSLTVGNFDIMSELREIPLALEKKESHKDSTSEGFNLFSVSLTFENFIGTARGIIGGIPGNR

SEQ ID NO: 164083 - protein, 714 aa, Glycine max
  Coding DNA Sequence Number=SeqID_72398
  Gene Ontology: Mol. function=RNA-directed DNA polymerase activity; Cellular component=exocyst; Biological process=exocytosis
  Homolog annotation: Hit_ID=Q9FGH9; Match level="QueryCoverage=64%, HitCoverage=77%, E-value=2e-85, Identity=41%"; Hit description =Leucine zipper protein
  Pfam annotation: Domain name=Exo70; Domain location=145-695; Score =101.6; E_value=2.5e-27; Accession=PF03081.6; Description=Exo70 exocyst complex subunit
MTLLAIKMTRWLTQVAVWRFVGFVSTIVGLVCYGLSSSFNYLFGEWSLLKIFLYSGFSLFICLGNLFAKVCRPSTSTSLRFKAHSSFLVLTITSVYSYFADKAMNGKPDVYSLISCVSFAIMSFSLSRQTQCGFEVDLFYFFLGCLIVLLLKIKFALAVVGVGFSYSLIILRSSLDTALHHNLGAQVDQLASTTDTSAVVLFVDQLGRTDIDVAAVQDIVVEGQRDNAQRDNASMMQQLMACIEVLRQGNSNLTNMLLEHTKEYFDDKSELAGVDHNFVIDALPSGKINDLEETIKLMVDDGLEKECCDVYCNWRRESLEQCIINLLRLQGINIEEKLEQREFQYYILRWIKAVNVAHRILFPSERRLCDCIFSRFSSVAALCFNEVCRGALIQLLNFAEAVASGSPSEWRLSKILDMFETLRDLIPEFQSLFPESMVKEVMKVHDKLGEASRVIFMNMENVIFHIPETKVIAPADGRVHLMTKHVIRYLVFTSRAQKILEQILEQYPKFANEVAKSNSVSDQIDQVIKRLETELVTVSKNYDKPALRYFFLMNNWRCVELEAIKLRLNLGCFHKDTTKVQQNLELYQSSSWNMVLNFLKLENNELVEPNANAESLKGSLNLFNMHFKDICSTQSRWLAFDKQLSEKIIMSLQHILLPAYGNFIEKLQDVLGIHASEYIKYGLFDIKDQLNHLFLGSMPMNQYLKDKEKLLKLA

SEQ ID NO: 164084 - protein, 97 aa, Glycine max
  Coding DNA Sequence Number=SeqID_72399
  Homolog annotation: Hit_ID=Q9FGH9; Match level="QueryCoverage=53%, HitCoverage=8%, E-value=2e-07, Identity=50%"; Hit description =Leucine zipper protein
MVLDFLKGREPPNAQSMKENLNLFNMQFEEICSIQSTWYASNKQLSGQIIISLQNMLPEYGIFIGRPTRSTFCYLEACMPMTQKMEAKESRLKLVSN

SEQ ID NO: 164085 - protein, 423 aa, Glycine max
  Coding DNA Sequence Number=SeqID_72400
  Gene Ontology: Mol. function=RNA-directed DNA polymerase activity; Cellular component=exocyst; Biological process=exocytosis
  Homolog annotation: Hit_ID=Q9FGH9; Match level="QueryCoverage=41%, HitCoverage=29%, E-value=1e-29, Identity=41%"; Hit description =Leucine zipper protein
  Pfam annotation: Domain name=Exo70; Domain location=24-391; Score= -213.3; E_value=0.0044; Accession=PF03081.6; Description=Exo70 exocyst complex subunit
MAEEGSSMEICGVRFNYSWTTLLWSQLLLQLSLRRVELVEDLSLHYALIILRSSLYTTPYQNLGVQDEHSVVIDVNSLRTDNASIMPQLMTCIRALPQGNSNVTNMLSKLVKEYLEDNSKPVVIDSNFVIDALPWGKINDLRKTIKLVIGVGFAQECYEVYCNWRRESLKECLINLLGLPEINVEKSRLLAFEDYILRRRIKAIQTSKHNGAGTSSLSLQIDRIMKHLERKWVAESKHLGERRYFFMMNNWRLVELCAEKSGLDVDCFKKYTAKIQQNLKLYQRSSWNVVLDLLKLENDDRFVEPNANAESMKDKLKLFNNHFKDLCSIQSRWVAFDMQLREQIMKSLENILLPAYGNFIGRFQDILGKHAYEYIRYGMFDIQDQINHLFLGTKPMNQYIKETERLLKFVSQTMCSSKKTYGV

SEQ ID NO: 164086 - protein, 209 aa, Glycine max
  Coding DNA Sequence Number=SeqID_72401
MPLESVSKDTTSYQNLGVQDEHSVVIDVNSLRTDNASIMPQLRTCIRALQQGNSNVTNMLLEHVKEYLQDNSNLAVDDGRVTCVKSEEVLERNSVENEGHVSDDIHHMEVRKGNGDRRELYYHYSVKIGDGLEKECCDVYCNWQRESLEECLINLFEVQEINVKQKWEEKQLEEYIIRRWIKALKVIGMRKYSRSTTQGFCLTESVRDC

SEQ ID NO: 164087 - protein, 110 aa, Glycine max
  Coding DNA Sequence Number=SeqID_72402
  Gene Ontology: Mol. function=hydrolase activity, acting on ester bonds; Biological process=lipid metabolic process
  Homolog annotation: Hit_ID=A7NY66; Match level="QueryCoverage=76%, HitCoverage=31%, E-value=9e-17, Identity=40%"; Hit description =Chromosome chr6 scaffold_3, whole genome shotgun sequence
MAYTIYFIILMHFCPFVVAVTTSILVFGDSTVDTGNNNYINNLAKEYHLPYDTVPPFLDPNLSDEELLIGVSFASGGSGFDDFTTALTGAIAVANWILQSRVRLKLKQGL

SEQ ID NO: 164088 - protein, 81 aa, Glycine max
  Coding DNA Sequence Number=SeqID_72403
  Gene Ontology: Mol. function=nucleic acid binding; Cellular component= intracellular
  Homolog annotation: Hit_ID=UPI00015A5788; Match level="QueryCoverage =37%, HitCoverage=10%, E-value=3e-08, Identity=73%"; Hit description =pigpen
  Pfam annotation: Domain name=zf-RanBP; Domain location=46-77; Score =36.9; E_value=7.2e-08; Accession=PF00641.9; Description=Zn-finger in Ran binding protein and others
MSGAYDQEGGYGGAGYGHGGRGGGGFGGRGGDRGGRGGGRGGGSGRDGDWRCPNPSCGNLNFARRAECNKCGAPSPAGAND

SEQ ID NO: 164089 - protein, 71 aa, Glycine max
  Coding DNA Sequence Number=SeqID_72404
  Gene Ontology: Mol. function=aspartic-type endopeptidase activity; Biological process=RNA-dependent DNA replication
  Homolog annotation: Hit_ID=Q69F85; Match level="QueryCoverage=95%, HitCoverage=4%, E-value=9e-12, Identity=43%"; Hit description=Gag -pol polyprotein
MHARIQKEACKRRATQKHESKLKIKEFQVGDLEGPFRITATVQNGTYQLEELIGKVIPTTWNATHLKPYFN

SEQ ID NO: 164090 - protein, 190 aa, Glycine max
  Coding DNA Sequence Number=SeqID_72405
  Gene Ontology: Mol. function=protein dimerization activity; Biological process=response to stress
  Homolog annotation: Hit_ID=A7PJB6; Match level="QueryCoverage=100%, HitCoverage=68%, E-value=2e-58, Identity=47%"; Hit description =Chromosome chr12 scaffold_18, whole genome shotgun sequence
  Pfam annotation: Domain name=Methyltransf_2; Domain location=1-167; Score=146.6; E_value=6.8e-41; Accession=PF00891.9; Description=O -methyltransferase
MSVTPFLHAMLDPVLTNPWNQFSTWFKNGDPTPFETAHGKMFWDYAGADPKLNHLFNDAMASDARFVTSLVIEKWDMFEAIPPADAILLKWILHDWNDKECVDILKKCKEAITRKGKEGKVIIIDMVVEDEKRDDESVETQLFFDMQMMVLVTGKERSKKEWTKLISSAGYNNYKITPVFGLRSLIEIYP

SEQ ID NO: 164091 - protein, 150 aa, Glycine max
  Coding DNA Sequence Number=SeqID_72406
  Gene Ontology: Mol. function=RNA-directed DNA polymerase activity; Biological process=RNA-dependent DNA replication
  Homolog annotation: Hit_ID=A2Q681; Match level="QueryCoverage=64%, HitCoverage=68%, E-value=2e-10, Identity=31%"; Hit description =Ribonuclease H
  Subcellular localization annotation: CTP_CleavageSite=24; ConfidenceScore=5.02e-01
MTYWASSSFKHFNNHHKAFNLVVMGSSLTVINLTYQVKKDPSPIHRQPQRLVTWTSPDGDIIKLNVDGSSLGNLNISGFRGILSNSCGEWLLGFGGNCSFTTNMHAELVNIYKGLRRAWETDYPPWHNYATILNKIKALIGHHLSMTNFS

SEQ ID NO: 164092 - protein, 111 aa, Glycine max
  Coding DNA Sequence Number=SeqID_72407
MTRRLARRGVHRCNIGEEKGLCLIESNRHRAWMKPASLVQLSDYVGNDKASRLLDLNWGGDECDKGSMNKSWNLERMATMAGGVVSSKMGEEDEGGVRSGTRVMWNKADRN

SEQ ID NO: 164093 - protein, 46 aa, Glycine max
  Coding DNA Sequence Number=SeqID_72408
MRGGVKERKRVNENPRRGGSVVPRAQRHVAPSARPALSALLDLSFF

SEQ ID NO: 164094 - protein, 122 aa, Glycine max
  Coding DNA Sequence Number=SeqID_72409
MAANNNIHGNTELFCVYSLMLDLVISSPWILIYQILPFVSTFHWPGTIKVLCIWGLLQCHRKNLGQCDWVVDSLIGLEKLYCSFYCFLDNGDVHIACFEWFCIYSLMLDLVVSTPLIWGHMD

SEQ ID NO: 164095 - protein, 436 aa, Glycine max
  Coding DNA Sequence Number=SeqID_72410
  Gene Ontology: Mol. function=transferase activity, transferring glycosyl groups; Cellular component=integral to membrane; Biological process=metabolic process
  Homolog annotation: Hit_ID=A7NY86; Match level="QueryCoverage=95%, HitCoverage=98%, E-value=1e-102, Identity=46%"; Hit description =Chromosome chr6 scaffold_3, whole genome shotgun sequence
MEAAPSSSTCACSHLVTMPYPARGYINPMMNFCKMLLSNDNTRLILVTFVVTEEWLGFIGSDPKPDIMRFATIPNVVASDHPGFLEAVMAKMEASFEELLNRLQPPPTAIVSDTFLYWAVVVGSRRNIPVALFSTMSASIFFVLHHHHLLVNLSENGGERVDYIPEISSMRVVDFPLNDGSCRSKQLLKTCLKGFAWVSKAQYLLFTSIYELEPHAIDVLKAELSLPIYTIGPAIPYFSLQNNPTFSTTNGTSDSYMEWLQVLFFTSHKGSHFSVSRAQMDEIAFALRESGIQFLWVGRSEASRLKEICGNQHYYKRSILRRMCLVGMKKGVTWCDQQLRVLSHPSIGGFWSHCGWNSTKGVLAGEDVKVNTTTLVKKDEIAMLVQKFMDLDSNLAREIRERSETLRQICSRAITNGGSAVTDLNAFVKDLVQTIH

SEQ ID NO: 164096 - protein, 282 aa, Glycine max
  Coding DNA Sequence Number=SeqID_72411
  Gene Ontology: Mol. function=transferase activity, transferring glycosyl groups; Biological process=metabolic process
  Homolog annotation: Hit_ID=A7NY86; Match level="QueryCoverage=95%, HitCoverage=65%, E-value=6e-58, Identity=42%"; Hit description =Chromosome chr6 scaffold_3, whole genome shotgun sequence
MNVLFHYCKPENGDKRVDYIPGISPMRLVGFPLNDGSCHSTQICLKGFAWVSKAQYLLFTSIYELEPHAIDVLKAELSLPIYTIGPAIPYFSLQNNPTFSTTNGTSHSYMEWLQVLFFTSHKGSHFSVSRAQMDEIAFALRESGIRFLWVGRSEASRLKGICGNKGLVVTWCDQQLRVLSHPSIGGLWMEFNQRSKMIVEDWKVGWRVKEDVKVNNTTLMKKDEIVMLVQKFMDLDCELAREIRERSKTPRQMCRRAITNGGSAVTDLNAFVGDLMQATLIP

SEQ ID NO: 164097 - protein, 482 aa, Glycine max
  Coding DNA Sequence Number=SeqID_72412
  Gene Ontology: Mol. function=transferase activity, transferring glycosyl groups; Cellular component=cytoplasm; Biological process =metabolic process
  Homolog annotation: Hit_ID=A7NY88; Match level="QueryCoverage=91%, HitCoverage=98%, E-value=1e-150, Identity=58%"; Hit description =Chromosome chr6 scaffold_3, whole genome shotgun sequence
  Pfam annotation: Domain name=UDPGT; Domain location=39-480; Score= -107.2; E_value=3.3e-05; Accession=PF00201.9; Description=UDP -glucoronosyl and UDP-glucosyl transferase
MGPLIIGVNIPQVPPNLQPQVHTLVSMDDPIEVPPTTASHVVAMPYPGRGHVNPMMSLCKLLLSKNSDILVTFVVTEEWLGLIGSDPKPDNIRFATIPNVIPSEHGRANDFVTFVEAVMTKMEAPFEDLLNRLLPPTVIIYDTYLFWVVRVANKRSIPVASFWPMSASFFAVLKHYHLLEQNGHYPVNVSEDGEKRVDYIPGNSSIRLADFPLNDGSWRNRRLLELSLNAIPWMQKSQYLLFPSIYELEPRAIDALKSEFSIPIYTVGPAIPSFGNSLIDDIGYFQWLDNQPSGSVLYISQGSFLSFSNEQIDEIAAGVRESGVRFLWVQPGESDKLKEMCGDRGLVLAWCDQLRVLQHHSIGGFWSHCGWNSTREGVFSGVPFLAFPILMDQPLNGKLIVEEWKVGWRVKKEVKKDTLITKDEIANLIKRFMHLGGDEVRDMRKRSRELKQICHRAIASGGSSESNINAFLLHILQDAKPH

SEQ ID NO: 164098 - protein, 114 aa, Glycine max
  Coding DNA Sequence Number=SeqID_72413
  Gene Ontology: Cellular component=exocyst; Biological process =exocytosis
  Homolog annotation: Hit_ID=Q9FGH9; Match level="QueryCoverage=81%, HitCoverage=15%, E-value=7e-14, Identity=38%"; Hit description =Leucine zipper protein
MLDINDSELNVAAELMNDRLHWFNEHFDETCNIQLAWSVCDEELREQIVKSIENVLLPAYGNFFEKFQEFLGKHVYEYIKYGMFEIQDRLNNLFLVRKQMSLMPEEKESLHKLA

SEQ ID NO: 164099 - protein, 119 aa, Glycine max
  Coding DNA Sequence Number=SeqID_72414
MRGYRMVIRTFHQPGANEPVDAQRLTSSSTPFVIQGQQVRWQAEIPYGHPYLSSTKANEFDGFNFCRLETFKPDDARDSSLSGGRRSSSMAWGNVVVVPFYRFQETEVLFTLLMSFLSF

SEQ ID NO: 164100 - protein, 157 aa, Glycine max
  Coding DNA Sequence Number=SeqID_72415
MNFLTAHDKGSEQELSPYNQYKEERTHNLESVFEEFRAYHASSKANQNSMKNHEIHFGKSYSIENFQGRPELQPYYQNEAERGPNLDKLLMQFMETTKSTQRALQSVEIQVGELAEALTQFMSKQEKYFVEVEAQEKSPVKEHESREKDKEKDEEQA

SEQ ID NO: 164101 - protein, 140 aa, Glycine max
  Coding DNA Sequence Number=SeqID_72416
STLEDPTFYVSDKNAASIELRFDYPTATLQASSLDGQGKVVSTQTFILLAESATPPSGSDTKYLYLTKSGELLSKWKNCTPDMSVGCSWGGHQIFITHSADLVVQHATGGAGLAFLLIPFYNSEARLQIFAKVPIGAADE

SEQ ID NO: 164102 - protein, 130 aa, Glycine max
  Coding DNA Sequence Number=SeqID_72417
MRSWVKGQWIPFDADALSQFLGDPLVLEEGQECEFSQRRNRADGFDKEAIAQLLCTPGQDFAQTAAGRRVRIMRTSMTTLTQTWMTLLLSNVLPSDHNSDLPLPKCQLVYAILTWMSVHVAQVCHPPGTL

SEQ ID NO: 164103 - protein, 89 aa, Glycine max
  Coding DNA Sequence Number=SeqID_72418
MSTSYLLLKVRILILSELDAPLSVERPSFDGLEALLVLGTLEMVAIKLGGGTRPFRCGASSIPIRGKLFRSHFLRRQTFGKSIYKEVSF

SEQ ID NO: 164104 - protein, 62 aa, Glycine max
  Coding DNA Sequence Number=SeqID_72419
  Subcellular localization annotation: CTP_CleavageSite=27; ConfidenceScore=5.02e-01
MTSTICRDRTHKTPNGPGKVQQGPGVSGSGYGPLLVLQGARPPSKGSHPQDTLWTRRSPTGS

SEQ ID NO: 164105 - protein, 272 aa, Glycine max
  Coding DNA Sequence Number=SeqID_72420
  Gene Ontology: Mol. function=motor activity; Cellular component=cell projection
  Homolog annotation: Hit_ID=UPI00016621D1; Match level="QueryCoverage =97%, HitCoverage=41%, E-value=2e-21, Identity=33%"; Hit description =UPI00016621D1 related cluster
GLHVLAFRGVHALAIRGLHALTFRELHVLTFIGLHVLAFRGLHALAFRRLHILTFIKLHILAFRGLHVLTFRGLYILIFRELHALTFVGLHALTFRGLHVLGFKGLQGLAFIGLQALTFRGLHVLAFRRLHVLAFRGLHALAFRGLHVFPFRGLHTLAFRGLHVLPFRGLHALAFRGLYILHFRGLHVLAIRGLHVLTFRGLHVLTLRGLLALAFRGLHTLLAFRGLHVLTFRGLHILAFRGLHVLTYRGLYILAFRGLHVLTFREFKVFCP

SEQ ID NO: 164106 - protein, 130 aa, Glycine max
  Coding DNA Sequence Number=SeqID_72421
  Gene Ontology: Mol. function=binding
  Homolog annotation: Hit_ID=A7QWW8; Match level="QueryCoverage=96%, HitCoverage=8%, E-value=7e-30, Identity=55%"; Hit description =Chromosome chr13 scaffold_210, whole genome shotgun sequence
MNVGYLENEVPELDGPGYMEDISGLLSNVLPSSLKDVKCVESILFSSFNPPPRYRRKLIRFSVLFRLVEDSFYLDVTTLEGNVFCITGSTRMFYVNSCTTKTFDPRPSKATLEATTLATLLQKISPRFKK

SEQ ID NO: 164107 - protein, 125 aa, Glycine max
  Coding DNA Sequence Number=SeqID_72422
MGIFILTGFLRFFRRFPQINVGGDSAHLSSIGKRTREPCLARPRNGTLRQGELNCHHKKKGDCRSKDCAFDVLMMPYDRDDLMSYGNALLKLNSRQQSENTRYNIKKMSSILGREFQIEIAKGLA

SEQ ID NO: 164108 - protein, 77 aa, Glycine max
  Coding DNA Sequence Number=SeqID_72423
MSVKNLVRRLGVHDKINHTLARRLVRVTLFCENAPTMWNRHMLKGALKPSVFTSKAYTPKSPSGPLPPDSGPTEKTF

SEQ ID NO: 164109 - protein, 27 aa, Glycine max
  Coding DNA Sequence Number=SeqID_72424
MVTYAPGLISKSVQSEIARSTCLVRVP

SEQ ID NO: 164110 - protein, 152 aa, Glycine max
  Coding DNA Sequence Number=SeqID_72425
RKMQGSCMSKHENKRHENPKNHLFLLAHLGVQCPMCVVKKVIWIFWLPMTKDETNIHRVCDDMMQTTGTHTVCSLRARIIPFEKHIAVVGTTNNNMLSKKKTLDEGSLLSSKSKTQHDHIFTSTPYVPMDSDIGPFFNSPCAQIVLVFVCIK

SEQ ID NO: 164111 - protein, 117 aa, Glycine max
  Coding DNA Sequence Number=SeqID_72426
  Homolog annotation: Hit_ID=A0PAV3; Match level="QueryCoverage=32%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIPGNGAKNLFAAGKCTGSHK

SEQ ID NO: 164112 - protein, 76 aa, Glycine max
  Coding DNA Sequence Number=SeqID_72427
MFLFVGGPPSAAEGKEKLDLIEERLRVVEGFGDYPFVDMTDLCLVSDVVIPSKFKVPNFDRYKRTTCSTKSYKRQA

SEQ ID NO: 164113 - protein, 160 aa, Glycine max
  Coding DNA Sequence Number=SeqID_72428
MGEVEEVKEQMKADMEALKEKMATMMEAMMTKKEIMEVSAAYQTRARARVMGEVEEVHEQMKADMKAMKEKMATRMEAMMSMKKIMQASTVVVATTSAVAKVNPMPPSDLNQMNHPTSDMVGKDLGSRTTPGCANSKRARLPAIWLASQLYATQCDVDSP

SEQ ID NO: 164114 - protein, 30 aa, Glycine max
  Coding DNA Sequence Number=SeqID_72429
AGEERKLQLSELDEILSEAYENSKFYKDTS

SEQ ID NO: 164115 - protein, 273 aa, Glycine max
  Coding DNA Sequence Number=SeqID_72430
MGLYVQSQDCTKLVALGKIHDGPSTIHCVAYANDVVRVSVEKVIDGEAEVPLATSEIKYVRDAINTFIAWPLPLHSGITPDKVSNAAELNNDVPKHDPLRELIKTLVDIYDKPVEFVWDLTEFGIPNRNNIRRQMLEHSHTSIVDHCMDSLSLNLYTMQRTDVGNVKNISKNGLRNRNDNSPIGKRLCCALKTMSWSGFVHAYKKLNTTADGKVPKTGPQWLELKTRIQRGGYECGYYVMHWMWNIIGVELKSDWSVWFGDGSALDPESITTL

SEQ ID NO: 164116 - protein, 152 aa, Glycine max
  Coding DNA Sequence Number=SeqID_72431
MAPTRHPLDPDKSNRALEFPALITGLCQSFGVPVAPTKVIRPPITRAFIEKYCTQRQAQGNAPQAAGAPPPPHQAGPARSFDMDQYLRHLVRQQAANHRAHTSSGQRSHGPRIGPRPKQDRRPREAPGEGEEAHEDEEMADLLDFLGGSGAT

SEQ ID NO: 164117 - protein, 204 aa, Glycine max
  Coding DNA Sequence Number=SeqID_72432
  Pfam annotation: Domain name=RRM_1; Domain location=62-132; Score =41.6; E_value=2.8e-09; Accession=PF00076.13; Description=RNA recognition motif. (a.k.a. RRM, RB
MSGERDSECERNTGWVRVSSRRQKKTRVLREGPSLKAAGNTNGYGRSYRRGNWRDRKDITSFYFTRFPEDVTEEDLWHHFKKFGDVREIFISKKKNSLGRKYGFVRFQGVESLHQLERRLDNTIFGGLKMHVNIPKFGRAHSGQIPSSVTRRESAMQGEDEMVARRQQGQRVRQRSYAEVLQRNITTVQKRRPVTEVCNNKPTS

SEQ ID NO: 164118 - protein, 40 aa, Glycine max
  Coding DNA Sequence Number=SeqID_72433
MCLGMGGTCKVNEKMGVGRKPWATQGRGCVSQVAWAISST

SEQ ID NO: 164119 - protein, 48 aa, Glycine max
  Coding DNA Sequence Number=SeqID_72434
MVAARHSSDDSTAARDPNPGLAGENWPEMAAADGGGRTRSDANLKLKE

SEQ ID NO: 164120 - protein, 365 aa, Glycine max
  Coding DNA Sequence Number=SeqID_72435
  Gene Ontology: Mol. function=carbon-nitrogen ligase activity, with glutamine as amido-N-donor; Cellular component=cytoplasm; Biological process=translation
  Homolog annotation: Hit_ID=A7PJP2; Match level="QueryCoverage=91%, HitCoverage=60%, E-value=1e-150, Identity=80%"; Hit description =Chromosome chr12 scaffold_18, whole genome shotgun sequence
  Pfam annotation: Domain name=Amidase; Domain location=2-348; Score =276.4; E_value=6e-80; Accession=PF01425.12; Description=Amidase
  Subcellular localization annotation: CTP_CleavageSite=78; ConfidenceScore=5.17e-01
MVDVACVEWGDVTANPWDESRVPGGSSGGSAAAVSARQCVVSLGSDTGGSVRQPASFCGVVGLKPTYGRVSRFGLMAYASSLDAIGCFGSSVADTGTLLHAIAGHDRFDATSSKQDVPDFQSHFVAVSSLESKPLKGLRVGLIRETIDDGVDAGVISAIRAAALHFEELGCSVNEVSLPSFSLGLPAYYILAVSESSSNLSRYDGIRYGNQVYADELDSLYGGSRAQGFGSEVKMRILMGTYALSAGYYDAYYKRAQQVRTIIRNSFKEALSQNDILISPAAPSAAYKIGEKKNDPLAMYAGDIMTVNVNLAGLPALVLPCGFVEGGPSGLPVGLQMIGAAFNEVFTFPIHCNGVFVGGVLYCYQ

SEQ ID NO: 164121 - protein, 473 aa, Glycine max
  Coding DNA Sequence Number=SeqID_72436
  Gene Ontology: Mol. function=transferase activity, transferring acyl groups, acyl groups converted into alkyl on transfer; Cellular component=glyoxysome; Biological process=cellular carbohydrate metabolic process
  Homolog annotation: Hit_ID=P49299; Match level="QueryCoverage=98%, HitCoverage=98%, E-value=0.0, Identity=71%"; Hit description=Citrate synthase, glyoxysomal precursor
  Pfam annotation: Domain name=Citrate_synt; Domain location=100-428; Score=406.8; E_value=3.2e-119; Accession=PF00285.12; Description =Citrate synthase
MSKTTTSSEQTARNRLATLAAHLLPSDATSAAAILHPHRLSAPTGDLPPANLKGTLTVVDERTGKKYQIEVTPDGTVRASDFKKISSGKNDKGLKLYDPGYLNTAPVISRISYIDGDAGILRYRGYPIEDLAEKSTFTEVSYLILYGNLPSESQLAEWEFALSQHSAVPQGVLDMIESMPHDAHPMGMLVNAMSALSVFHPDANPALKGLDIYNSKQVRDKQIARVIGKITTIAAAINLRLAGRPPVLPSNKLSYTENFLYMLDSFGVDVYTAIAGAVGALYGPLHGGANEAVLKMLSEIGTVENIPAFIEGVKARKRKLSGFGHRVYKNYDPRAKVLRKLTEEVFSIVGRDPLIEIAVALEKIALSDEYFIKRKLYPNVDFYSGLIYRAMGFQPEFFTVLFAIPRMAGYLAHWRESLDDPDTKIMRPQQVYVGEWLRHYAPINQRTASSNTDKLGQLAVSNASKRRLAGSGA

SEQ ID NO: 164122 - protein, 98 aa, Glycine max
  Coding DNA Sequence Number=SeqID_72437
  Subcellular localization annotation: CTP_CleavageSite=48; ConfidenceScore=5.02e-01
MNPKTKHWLYNTKTTVPLFSYFSLLALSVSTTCMGCCIPPPPHPELERAQEVKVKIKTTGIKVQKECNKLRGVNVATVEALERETEGARKEEYGLNKI

SEQ ID NO: 164123 - protein, 1092 aa, Glycine max
  Coding DNA Sequence Number=SeqID_72438
  Homolog annotation: Hit_ID=A5BLD9; Match level="QueryCoverage=87%, HitCoverage=88%, E-value=3e-78, Identity=28%"; Hit description =Putative uncharacterized protein
GDAYKRKLQNSVHSFTKQGTVGNKKVKLDDIDASSALEKKLGLKTLSEENKEKVKNWDSVGKQQKVVVSPIGGILKNHKHIYGSTSIGSNIQDGTEETHCDVQVPPSDKHVRFSAEDSVLGPEKRSSFDETVFSLSSDMPASSFGEEKLTGNDEGTVNLEENRNGNTAINTDKRKEVCPMVESKQFSNTLGLVAVQNLLKPCTSEEKSKHLEEKSESLSNVTICDNNNLDRFDGGNTTTVHVSSYGDLSRSLSELQGGQSSGISTQPCESEAFSYTGKFIDHLGGPSFQSTNAHTRTYLEPSPSYSASCNEVNNRPEFPLHTYGNDDNNGQALGDRSLSGTFSADMIDNSFLLPGWGRGSIRNNCMEQNFYGLPLNSHGDLINFSSSGKIGMNQPETSCTLRSSLSGLPVNNVIHQSSQECLSIGKRHVVQKTLQDSVNPFPHYSGRLGVRELHGRERGDIYQHNSGWCSNHYVQPLDSELNLMRNPFIEQNQNQNQLEKVPNHEEYGMVSPRGSSGLVSPSCSQPTMRLMGKDVPIGRSSKEKQQFVGGVLWAEEESRRHYSVDAARDNSLLGRCYMPDSASGSQLQRQTENVFQSVKILSKQALQSTLLMNGPNSEFLNQRSNHISQNGSLGVSRNASTNLHTISQVTTSCAIYNRPPEDLPEQFISQGFCFHSQVSSNPCNFNQSTLSSRELNDWKMHHRVANSAFEFPFLHPIVEEHAKSSWFKRSYSSLAPWPLSSTHERPPGSSSSTSFPHNTWRNDSTISSVNHSSDVLYPPTSVATHCPRKTIRYPTSTAHPHPHSRSPYASVSPIIKPPSAIDSGCRNLFKVTDRVKFDDMSARVHHPCTNSRKRPSTSFVDPAKPNKLPNIEVKKNLTGMAVQQNTREVELDLQVGAIGKCCQNEAQNLNPRGFDSFNLDGVVISGPVKLSPGAKHILKPSQNQDNSTPVHSAIPIAVTTDCVFLKDADSRTADEGDDMNEGIRTLPDALGCAALLCQIIHFIETLMPHHRIESEVQQIKSVVDGIMQRVQNYNSLNQLFSKKDKAVMEGPAERIVISVVGMRGLGKTTLASRVFNNGKAGKVDERLVEEVI

SEQ ID NO: 164124 - protein, 40 aa, Glycine max
  Coding DNA Sequence Number=SeqID_72439
MEHHELLKEVSLRVIDGIRGKKDKVKVAEWINVIRVKKTT

SEQ ID NO: 164125 - protein, 258 aa, Glycine max
  Coding DNA Sequence Number=SeqID_72440
  Homolog annotation: Hit_ID=A7PGT2; Match level="QueryCoverage=42%, HitCoverage=30%, E-value=2e-22, Identity=52%"; Hit description =Chromosome chr17 scaffold_16, whole genome shotgun sequence
MALLARLRVLVQQILLDVVSLFNMVSSLSISKQSIKITHNGIEVFRDFYPVSDDFVTLECVWKSDKFILLERKHKTNDESHVEDSGGNVSVQTSDVNYNSIESFLGDDQLFHERVEADVVAKEDPNHIDDMNTDLLTGSSQIDDKETRYSDQDTTKAFINESSQEAGLPASSRSSTNDKLQSCPKKEMIHSELDSENIDFTVIDDVGSESLGPGIRRELSFSRWCDDDGRIHLDQQLGNEDVSVEDDSDFELPFPEKT

SEQ ID NO: 164126 - protein, 235 aa, Glycine max
  Coding DNA Sequence Number=SeqID_72441
  Gene Ontology: Mol. function=nucleotide binding; Cellular component =mitochondrion; Biological process=defense response
  Homolog annotation: Hit_ID=A5BN98; Match level="QueryCoverage=65%, HitCoverage=14%, E-value=6e-20, Identity=35%"; Hit description =Putative uncharacterized protein
  Pfam annotation: Domain name=NB-ARC; Domain location=2-235; Score= -82.4; E_value=5.1e-05; Accession=PF00931.13; Description=NB-ARC domain
MSQEERVEESQCCSNLTFNYSLAKDVICIAQQMNVLNNNNKFKPFSHPIQLSSMNYFFLKDFLALDSKKPVYEELKAIQDQTELGKALWLSHRLKIEKILIILDGVWEKLDLEAIGIPLNENDKRYCILLTTCNQAICTSMNCQSMIELSMLNEDEGWTLFKQRAQIDDDSLEDLREVAKRVFDKCKGLLVAIVTVARTLKEKTCTSWELTFLRLETSESIDVQEGLTSTYNCNE

SEQ ID NO: 164127 - protein, 32 aa, Glycine max
  Coding DNA Sequence Number=SeqID_72442
MWTMSDLAKLITTLSMAKPSCIEKIRLFSHAL

SEQ ID NO: 164128 - protein, 58 aa, Glycine max
  Coding DNA Sequence Number=SeqID_72443
MKAANFYTCIVPNLEGRMKNLWNNTQTERDIKYQQRKLHILNIKLEQDKADDEDCSDE

SEQ ID NO: 164129 - protein, 394 aa, Glycine max
  Coding DNA Sequence Number=SeqID_72444
  Gene Ontology: Mol. function=motor activity; Cellular component=cell projection
  Homolog annotation: Hit_ID=P15305; Match level="QueryCoverage=91%, HitCoverage=91%, E-value=3e-13, Identity=20%"; Hit description =Dynein heavy chain
VDPWVLHALAFRGLHVLAFRGLHVLTFRGLHVLAIRGLHVLPFRGLHILAFRGLHDLAIRGLQALTFRGLDALAFRRLHALAFRGLHALTFRGLHVLPFKGLHVLPFKGLHVLTIRGLHVLTFRGLHTLAFRGQHVLPFRGLHVVTFRGLHILTFRELRILLGLHVLTIRGLHVLAIRGLHVLDFRVLHALAFRGLHILNFKGLHRTTCPRLKRATRPHALTIRGLHVLAFRELHTLAVRGQHAFAVRGLHVLPVRGIHVLVFKGLHALTFRGLDALAFRQLQRLDAISFRGLHALALRGLHALPFRGLHVLPFRGLHILTFRGLYVLAFRGLHALAFRELHVLPFRGLHVLAFLGLHALTLSPLEGFMLSPSEDYTPSPSEDYTPSPSEDYTS

SEQ ID NO: 164130 - protein, 182 aa, Glycine max
  Coding DNA Sequence Number=SeqID_72445
SEETIKKIKVKVRGVNSLPRELRIIVNFDDQGQAIGEAQALLAGFLGTLAADCKLFPMDYDRWSGPSGVPKAYFDNCFETILKELCWRNKEIRSKQVIPHTGGSKANPRRRNELLLETGKLPSHGQLYIETHKRKDGSFVNEAAKTIAEQIEVGLTQSIVDESEVSPLDVVGRVLGLEHSGR

SEQ ID NO: 164131 - protein, 74 aa, Glycine max
  Coding DNA Sequence Number=SeqID_72446
MLQDGESGGATSSSDDSSKMIIRGGAGAGGGDNISSSGEKGGSTTGGSGSAGIGSVLASAGSGGTTSWDLSNGS

SEQ ID NO: 164132 - protein, 35 aa, Glycine max
  Coding DNA Sequence Number=SeqID_72447
MPTSSRRLGGSSPELHFLHPAAVILLPRTMFVIIT

SEQ ID NO: 164133 - protein, 66 aa, Glycine max
  Coding DNA Sequence Number=SeqID_72448
MEITKSLVSNNNNKKNKCTPSRLVGPDGVGLLVLPRKVELKDDSSLLVATYQPLPAAFTKLNTLVM

SEQ ID NO: 164134 - protein, 111 aa, Glycine max
  Coding DNA Sequence Number=SeqID_72449
  Subcellular localization annotation: CTP_CleavageSite=66; ConfidenceScore=5.49e-01
MSPPPLEPQSLTDSSHALKMASSSHSVLCHTTLARLARISEFRLSARLVAQRMDSSSALSGISPCLANMHNSSFFQILPRAQPRNVVLSEWLTKPKDWLSERMKSALHKYG

SEQ ID NO: 164135 - protein, 692 aa, Glycine max
  Coding DNA Sequence Number=SeqID_72450
  Gene Ontology: Mol. function=transporter activity; Cellular component= integral to membrane; Biological process=transport
  Homolog annotation: Hit_ID=O87757; Match level="QueryCoverage=39%, HitCoverage=67%, E-value=4e-94, Identity=66%"; Hit description =Putative uncharacterized protein
  Pfam annotation: Domain name=MFS_1; Domain location=18-349; Score =44.7; E_value=3.3e-10; Accession=PF07690.7; Description=Major Facilitator Superfamily
MLSRFATLGRIPRGVWVLGGVSLLMDVSSEMIHSLLPLFMATTLGASVIVIGLIEGLAEATALIVKVFSGVLSDYLGKRKGLALLGYGLGAISKPFFAIASSSGMVMSARLLDRVGKGIRGAPRDALVADVTPPEIRGAAFGLRQSLDTVGAFLGPLLAVGLMLLWHNDFRAIFWVAAIPAALAIALLFFGLKEPAAAITHKRTNPITRANLRLLGRGYWWVVGIGAVFTLARFSEAFLVLKAQQGGTPLALIPLVMVAMNLVYACSAYPFGKLIAESRAAGADRRRCGVGAERSLGRGAVWRGAVGRAHGHDAGTVGGDGGAYRAGAPARHRVRHVQSDQRRGAAAGESRGRNPVGAVRFRLHLLRRGAHLRGDAGWHATGAVRRTAGRLTAVDKLRHRLQQLGHPLGFHSPAEQITLADMETGFAQRLPLLLGFHALGDDIDRQFLAEDADAFHDRQDRRFGIHPLNEVAVQLNAVQRVIHDMAEGGVAGAEIVQRDADAHLLEHLQRAQHVLRAVLVERVFGHFQFDQRVGNVELQQALQEAGDIGEDLQLHGLADLGRQFVVVERLAYRCRQLHAVDRAVPAQQRFKADDAAVGQADLRLVAGTDAVVAHDLACVVELAGAGARLVHHFAVEHIDTAAAAVFQLIQRDGAAKAHAAMQRLAAVGDRRLQLQQKLVGDAENILLVFDVA

SEQ ID NO: 164136 - protein, 522 aa, Glycine max
  Coding DNA Sequence Number=SeqID_72451
  Gene Ontology: Mol. function=peptidase activity; Cellular component =integral to membrane; Biological process=protein secretion
  Homolog annotation: Hit_ID=A1G1J5; Match level="QueryCoverage=100%, HitCoverage=96%, E-value=0.0, Identity=70%"; Hit description =Putative uncharacterized protein
MELGTALSRRHARALWGSWLLASAPLFVIFNALGWWLDAFGWAWLAMWWCKPLFERAPLYVLSRGIFGEPVGTLAALRAQRHWGNSGFWGYLGWRRFSVLRSLCLPVNLLEGNTPGQRGPRRRAVAAGAAGAALVLTVTCMAFEAVLVSGAIGAVFMFMPLELMSESWRAAWDMIGQDTPAWARLGFNLACWLASVLIGPFFVGAGFGLYLNRRTQMEAWDVEIALRRLRERLLPAASTLALLLCLALPLVSAPVHAQDTDAEPERAMGKPNDRGIDAEEGDEAPTIDPANTPAMIFGGTPVDTAGFRQAVNRAYEDPLQRPTRQVTRWKPIEQAEEEKKEDKQLRSDTNSNGERKARKDGIAWLARLAEWGLWGLLGVLLLVLLLTARLWLPWLRGSGRRKAEAAPPVVEEQVELPVVLPPDVATQAGLLWDQGRPRQALALLYRASVRTVGERSGIALPPGATEAQCLRASRRMPEASDRDLFARIVRMWQYAAYGGRLSSRADFDALADTLRQQYRWQA

SEQ ID NO: 164137 - protein, 76 aa, Glycine max
  Coding DNA Sequence Number=SeqID_72452
VLELSALITGLCQFYGVHVAPSKVIRPLTNRAFIKKYCTPMQAQGETPQQPGDGRKWATDAPPPPLEFTLAHPRKG

SEQ ID NO: 164138 - protein, 104 aa, Glycine max
  Coding DNA Sequence Number=SeqID_72453
MGEVEKVQEQMKADMEAMKEQMAHISQTMGETHEIPHHNLADFEPWLGYATEGQAVGGIPLENTSEGPQYHPQLHLLHSTTSKNPPAMAEKGKVGSYRGKAQGH

SEQ ID NO: 164139 - protein, 679 aa, Glycine max
  Coding DNA Sequence Number=SeqID_72454
  Gene Ontology: Mol. function=transcription factor activity; Cellular component=intracellular; Biological process=regulation of transcription, DNA-dependent
  Homolog annotation: Hit_ID=A8GGZ7; Match level="QueryCoverage=32%, HitCoverage=66%, E-value=1e-75, Identity=66%"; Hit description =Transcriptional regulator, LacI family
  Pfam annotation: Domain name=LacI; Domain location=463-488; Score =45.1; E_value=2.5e-10; Accession=PF00356.12; Description=Bacterial regulatory proteins, lacI fa
  Pfam annotation: Domain name=ROK; Domain location=164-342; Score =90.1; E_value=6.9e-24; Accession=PF00480.11; Description=ROK family
  Pfam module annotation: Pfam domain module=LacI::ROK; Domain location= 463-488::164-342
VLIVTVADLMSSMKGTFSGGSDLTEERLLQDLSHVDLLVIDEIGMQSESRYEKVIINQIVDRRSSSKRPTGMLSNLDPAGMNTLLGERVMDRMRLGEGAMKAAGKGPAVLRLNNLKRVMTQLRTTRITSRQDLALALDLSKNTVSLIIDDLLAQGLIHELGPVSVAAAGDSLAGGDYFSRVVAEQTWRTETADADGLLHELTEVCQTLRAAHPALLGVAIGFPGIIDSQRGRVHFSAPLGWQDVDVLTPLRRGVELPLRIMNNVKAAALLAVQQLELNKAQSHFYLRIADGVGGALVERGEVFSGSSWTAGEIGHLSVQPNGARCSCGRQGCLETLVSLPAIQQQLARRKPGLRWQSGDSEPEIVYELMAQTGRYLGHALSQVMQLVNPASIIIDGPWNAQPAFVQAVQQAAQAGTLAFTFAHTALHFLPQRIDPANGLALAVIEHYERAALFADRAMKTQRITLDDIATLAGVTKMTVSRYLRTPEKVRAETAAKIASVMAEIGYVAEQENTAASRHPPPRIGVLIPSFNNQIFADLLAGIESVTSAHGYQTLVVNYDYNPQREEEQIATVLAFNVQGLILTESVHTVRAEKYLNAATIPVAEVMGLSETRGRINVGFDNYRAGYDMTAMLLASGKQRVIYFGSMSDRRDQQRYAGYCDAVAAAGLPAGRIVPNKVSS

SEQ ID NO: 164140 - protein, 144 aa, Glycine max
  Coding DNA Sequence Number=SeqID_72455
  Homolog annotation: Hit_ID=Q51617; Match level="QueryCoverage=28%, HitCoverage=57%, E-value=4e-09, Identity=80%"; Hit description =Putative uncharacterized protein
MTVKTSDTCSSRRRSQLVCKRMPGADKAPSGRVSGVLAGVGGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLN

SEQ ID NO: 164141 - protein, 237 aa, Glycine max
  Coding DNA Sequence Number=SeqID_72456
  Gene Ontology: Cellular component=integral to membrane
  Homolog annotation: Hit_ID=A4W8D0; Match level="QueryCoverage=99%, HitCoverage=73%, E-value=4e-89, Identity=68%"; Hit description =Putative membrane protein precursor
MMLVSFICYAFNLTLSTWVGGVAMRYRLYSRLGLPGGTITRIFSLSIATNWLGYILLGGVVFVAGMVPIPPGWFIGEGTLRVIGAVLLAMVAVYLWACAFAKKRRWTVKGQHLQLPSLRMALFQFAVSCANWMVMGTIIWLLLAREVDYPIVLGVLLISSIAGVIIHIPAGIGVLEAVFLALLSGQHASHGEIIAALLAYRVLYFILPLLLALVLYLWLESRAKHLRQKNERKMAAR

SEQ ID NO: 164142 - protein, 183 aa, Glycine max
  Coding DNA Sequence Number=SeqID_72457
  Homolog annotation: Hit_ID=P58586; Match level="QueryCoverage=42%, HitCoverage=25%, E-value=1e-34, Identity=93%"; Hit description =UPF0052 protein ybhK
MGEACRTPGADVARHAVAIGGHGDLADCRVVAHGGNDIGEVAPHRGFAAGQAHFFGARRRKGTRHATNLIQREKTFVVHAVRPVAVGQAVVERRLHLTCGVLRSSMNRTLADLDRVVALGGGHGLGRVMSALAPLGSRLTGIVTTTDNGGSTGRIRRSEGGIAWGDMRNCINQLITEPSVASA

SEQ ID NO: 164143 - protein, 378 aa, Glycine max
  Coding DNA Sequence Number=SeqID_72458
  Gene Ontology: Mol. function=excinuclease ABC activity; Cellular component=excinuclease repair complex; Biological process=response to DNA damage stimulus
  Homolog annotation: Hit_ID=Q57RF9; Match level="QueryCoverage=100%, HitCoverage=56%, E-value=1e-178, Identity=83%"; Hit description =UvrABC system protein B
  Pfam annotation: Domain name=Helicase_C; Domain location=170-251; Score=75.5; E_value=1.7e-19; Accession=PF00271.22; Description =Helicase conserved C-terminal domain
  Pfam annotation: Domain name=Synaphin; Domain location=242-340; Score= -39.8; E_value=0.022; Accession=PF05835.3; Description=Synaphin protein
  Pfam annotation: Domain name=UVR; Domain location=338-373; Score =58.7; E_value=2e-14; Accession=PF02151.10; Description=UvrBuvrC motif
  Pfam module annotation: Pfam domain module=Helicase_C::Synaphin::UVR; Domain location=170-251::242-340::338-373
MMNELGYCSGIENYSRYLSGRGPGEPPPTLFDYLPADGLLVVDESHVTIPQIGGMYRGDRARKETLVEYGFRLPSALDNRPLRFEEFEALAPQTIYVSATPGNYELEKSGGDVIDQVVRPTGLLDPILEVRPVATQVDDLLSEIRKRVEINERVLVTTLTKRMAEDLTEYLEEHGEKVRYLHSDIDTVERMEIIRDLRLGEFDVLVGINLLREGLDMPEVSLVAILDADKEGFLRSERSLIQTIGRAARNVNGRAILYADKITPSMARAMEETERRREKQQRYNEERGIVPQGLNKKITDILELGKNVVKTRGKGKTASRTAAEAEASYLALTPQAMQKKIHELEGQMQQHAQNLEFEEAARVRDQLHELRELFIAAS

SEQ ID NO: 164144 - protein, 112 aa, Glycine max
  Coding DNA Sequence Number=SeqID_72459
GVESSSSGDEVQAFRDFTKVARDATSYKEFVSHKWKELMVEAEREVERLDVLGESNMLDDVKNLVVTRSADFDLLAKPICRLSEPSAERTTLEVEREEESGRRMSWTYVLSE

SEQ ID NO: 164145 - protein, 197 aa, Glycine max
  Coding DNA Sequence Number=SeqID_72460
  Gene Ontology: Mol. function=helicase activity; Biological process =viral genome replication
  Homolog annotation: Hit_ID=Q2A9E0; Match level="QueryCoverage=98%, HitCoverage=19%, E-value=7e-39, Identity=34%"; Hit description =Putative uncharacterized protein
  Pfam annotation: Domain name=DUF889; Domain location=30-185; Score =117.5; E_value=3.9e-32; Accession=PF05970.5; Description=Eukaryotic protein of unknown function (DUF889)
MCHKFIFQALDKSLKDIMHNDRPFGGKVIVFCGDFSQILPVVPRDIGDGKLREPNDGYVEISIPNEFLIKHFNDPTQAIEKENCSVDSVDKSDELLNPAFGVLTPEFLNSLKTSRIPNHKLKIKIGTPIILLRNLDQADGLCNGTRLIVTRLGAHVVEAEIITGSNIGHRTYIPRMNMSPSDSPWPFKLIRRQFSFM

SEQ ID NO: 164146 - protein, 108 aa, Glycine max
  Coding DNA Sequence Number=SeqID_72461
MFGSKGENLGEPRRIGSVHRCPGTLDLRSGPLSKRGWGVHKAWELVRKKDKELRGSGNGAIGGYHRWLKAIAQGLDWLPRLRATKEVEFEASKEGEEVQVLRTELGKA

SEQ ID NO: 164147 - protein, 39 aa, Glycine max
  Coding DNA Sequence Number=SeqID_72462
MYNHHEKGRAPDLESVLADFMTYQASSKEVGIVGARYAG

SEQ ID NO: 164148 - protein, 103 aa, Glycine max
  Coding DNA Sequence Number=SeqID_72463
SFAIGVGAVTSFGYRKDRDGQWLKKDTLPQQDERTPSPPPQRDDSLALMNEVLSKLRGLYTYVGERFDSLDGRFEGMDTRITQLEEDVTYLRRCFDLPPPSKS

SEQ ID NO: 164149 - protein, 190 aa, Glycine max
  Coding DNA Sequence Number=SeqID_72464
  Homolog annotation: Hit_ID=Q6UUU1; Match level="QueryCoverage=54%, HitCoverage=93%, E-value=2e-20, Identity=46%"; Hit description =Putative uncharacterized protein
  Subcellular localization annotation: CTP_CleavageSite=27; ConfidenceScore=5.12e-01
LDCSGIISASSALTVSRYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVLPFGLPVSFRCMA

SEQ ID NO: 164150 - protein, 105 aa, Glycine max
  Coding DNA Sequence Number=SeqID_72465
  Subcellular localization annotation: CTP_CleavageSite=57; ConfidenceScore=5.25e-01
MTNRLRILLILPFPLSKRFQRTNRLRYLLSPLTKIQRTNRLRILCPNTLEGTSFEVQVEVQVEGISTWFFKENKGRYIPCGSLACKGFYKVERNLKNCRLLGDWM

SEQ ID NO: 164151 - protein, 194 aa, Glycine max
  Coding DNA Sequence Number=SeqID_72466
ELAKRTYHAKRVHLVRMNTHPPVEILVAKRVYLSLLRYAKRTMFRQVMASRKRVRTEDIPSSSNPSALTDAMEPDAQQAHSLIPMLQSLFRGQPIISMEQFLEKVAWPEAQLPLERAHKVVPPRPIPAKTEPTSVEPQPPVVDPPASLELETLSPPAPPLIIIPDDSVDEATAPPDSPSCNIDNGSDFSDWMDC

SEQ ID NO: 164152 - protein, 160 aa, Glycine max
  Coding DNA Sequence Number=SeqID_72467
  Pfam annotation: Domain name=Transposase_23; Domain location=1-71; Score=-6.3; E_value=0.0058; Accession=PF03017.5; Description =TNP1ENSPM transposase
MGDSDKCGLYIEENHSRLVALGKVYEGSTAVHNIPLLHGQVKDGVEEVKDADAPVPVPTDEVILVGQTLNTFLAWPTHLVKFVSPAKPADKPNLEVYDLLYLMTLAIPQFFLKPLQVMWDATVFGVFNEDFPLYIKHEDLSEIAHGGQCLNIFVIQLWIL

SEQ ID NO: 164153 - protein, 100 aa, Glycine max
  Coding DNA Sequence Number=SeqID_72468
MLKLSDNIIRFHRRVILGMLEVVSSPWRYTVGNWLCNSDLVSPTGIEQVLTEKDLLADSYSDLEAFILDEKEFLLLKAISTFPELSCLMSSIIGAGRGSD

SEQ ID NO: 164154 - protein, 66 aa, Glycine max
  Coding DNA Sequence Number=SeqID_72469
  Homolog annotation: Hit_ID=A5APK5; Match level="QueryCoverage=95%, HitCoverage=5%, E-value=2e-10, Identity=58%"; Hit description =Putative uncharacterized protein
MANSYSVTDGVYKAREQIHRRMVDRQLLAILASCKFLELAHPRGIAILCPVHCSTCVAQGRKGMMT

SEQ ID NO: 164155 - protein, 80 aa, Glycine max
  Coding DNA Sequence Number=SeqID_72470
MDTSKPYTGAMRGIMHEPQGGPLGTSTLTFRGLHVLAIRGLHALAFRGLHVLTFRGLHVLAFRGLHTLSFSGLDVLTFKG

SEQ ID NO: 164156 - protein, 42 aa, Glycine max
  Coding DNA Sequence Number=SeqID_72471
MGLRIKVENGELANSARQSILRAPDSKGSRLEGGGHMNSARQ

SEQ ID NO: 164157 - protein, 60 aa, Glycine max
  Coding DNA Sequence Number=SeqID_72472
  Gene Ontology: Mol. function=hydrolase activity; Cellular component =cytoplasm
  Homolog annotation: Hit_ID=A7NWE4; Match level="QueryCoverage=98%, HitCoverage=25%, E-value=3e-18, Identity=68%"; Hit description =Chromosome chr5 scaffold_2, whole genome shotgun sequence
MSGPECCSNPPVLNPNAGAGHVEKLGGLNSYLSGSPNSIAIFLISDIYGYEAPNLRPCAL

SEQ ID NO: 164158 - protein, 112 aa, Glycine max
  Coding DNA Sequence Number=SeqID_72473
MRSFNGDFPPWRCSGRQRRRGEGRRHPLGKKPWKKELCHQECALDKKLGEDASMEEKKEREKERREHEIEGGKGGEKLNFELCLTRFPFIKVTTSIIHASIYKLGSFLEKLS

SEQ ID NO: 164159 - protein, 114 aa, Glycine max
  Coding DNA Sequence Number=SeqID_72474
MISESDSDPPSPRSTKLMASLDKQMGSDDGFEEGRRHRHKRNKDGMDDVKVKIPKFLELQSYNHVDELIHRVVKVEQQLKRKQTYKKTSYTYSSWKDKDTSKKEGSSSQQLSLM

SEQ ID NO: 164160 - protein, 98 aa, Glycine max
  Coding DNA Sequence Number=SeqID_72475
MDELIHRVVKVGQQLKRKKTYKKTSYTYSYWKDKDTSKKEGSSSQQLSMIHEIAFEMHLMQSYLARALDRRLQEDWARDAREDPRVLMSLRIDFGPMG

SEQ ID NO: 164161 - protein, 443 aa, Glycine max
  Coding DNA Sequence Number=SeqID_72476
MNSVSKLFEFDSNVFCHFKDRFFKFLATDVVADGMPLLFNRDWEPRFPFYWQFDPTSAPSSILVKKKRDDVAGPLGRKKSKAPMSLCALRQVVGLGLTAGRLTIMQDVPPAPQTVKAPATAQTPATAQTPATLSPDVQVTQAESIMVPSSTIVAPLLSVGVATTGVLAMLPLSSSTVVALPATILASMASPSLSSCPRVSLDHLYTSSDVDLLWGATYKLEQKTLVNFVSAFDKNLFRLAGVLNDTNFAKVFLQRSLAILEENGLRHQEAVQKVASLEADVAKWRATARTLWRVEHPKVANATIGFVEDRLAKRIAKLEARIKVSESRLEESELRASKEREASKELEEELILYKKEATEQYDKGFQKTVRQADFFANDLVLGLFDPFKDVKEGVLLDEEEIDVKEQAADEGDLPSWGQAFLLGDPFWLPLGLIIQGRRAERLV

SEQ ID NO: 164162 - protein, 146 aa, Glycine max
  Coding DNA Sequence Number=SeqID_72477
  Gene Ontology: Mol. function=nucleoside-triphosphatase activity; Cellular component=integral to membrane; Biological process=lipid transport
  Homolog annotation: Hit_ID=A7PQV3; Match level="QueryCoverage=92%, HitCoverage=19%, E-value=4e-38, Identity=59%"; Hit description =Chromosome chr6 scaffold_25, whole genome shotgun sequence
  Pfam annotation: Domain name=ABC2_membrane; Domain location=1-138; Score=-25.8; E_value=0.037; Accession=PF01061.15; Description=ABC-2 type transporter
MMKLVFYRERLNGYYGVAAYILANFLSSFPFLVLIALTSCTIMYNMVKFRPGINHFVFFFLNIYSCISVIESLMIVVASLVPNFLMGIITGAGIIGIMMMTSGFFTLLSDLPKPVWRYPYLYISYGSCLLGQYRWSLFGYMGTQYS

SEQ ID NO: 164163 - protein, 78 aa, Glycine max
  Coding DNA Sequence Number=SeqID_72478
MVGVLQSKQSQGVAKNLMMWKKMCFTKKDVEGGPEEVDEPEEPKQHVQVQEEKEEVLAEDNQEMELEDDFDVSSSKED

SEQ ID NO: 164164 - protein, 73 aa, Glycine max
  Coding DNA Sequence Number=SeqID_72479
  Gene Ontology: Mol. function=RNA-directed DNA polymerase activity
  Homolog annotation: Hit_ID=Q2HSQ4; Match level="QueryCoverage=91%, HitCoverage=71%, E-value=1e-11, Identity=52%"; Hit description=RNA -directed DNA polymerase ; Zinc finger, CCHC-type; Peptidase aspartic, catalytic, putative
MDRFFNGLNRDIQDVVELQSYNNMDELTHSVVKVGQKLKRKQTYKKTSYTYSSWKDKDTSKKEGSSSQQLSLM

SEQ ID NO: 164165 - protein, 69 aa, Glycine max
  Coding DNA Sequence Number=SeqID_72480
  Subcellular localization annotation: CTP_CleavageSite=38; ConfidenceScore=5.61e-01
MTLSLAHQWAKHTSTAKRSFSVLSATKESGRASISRPRAKHEISALSTVVVFSQAQRTTGAMLKSTYSR

SEQ ID NO: 164166 - protein, 88 aa, Glycine max
  Coding DNA Sequence Number=SeqID_72481
  Subcellular localization annotation: CTP_CleavageSite=57; ConfidenceScore=5.39e-01
MVKAVSRIFPLDLMMKNVQFQLNLAHQWAKCASTTKRNFSVLSAIEESGRASISRPRAKREFSALSATVVFSQAQRTTGTKLKSTYSR

SEQ ID NO: 164167 - protein, 39 aa, Glycine max
  Coding DNA Sequence Number=SeqID_72482
MYKRKLNDGTLVAIKHVKKDLQNKNLAEFKNEINTLSKI

SEQ ID NO: 164168 - protein, 448 aa, Glycine max
  Coding DNA Sequence Number=SeqID_72483
  Gene Ontology: Mol. function=protein binding; Cellular component =cytoplasm; Biological process=red or far red light signaling pathway
  Homolog annotation: Hit_ID=A5AG46; Match level="QueryCoverage=56%, HitCoverage=55%, E-value=7e-22, Identity=30%"; Hit description =Putative uncharacterized protein
MVISTATSNNNNIHQLQSFNSHNNNYHLRDASFSSYLNNKEEILAESGHGYVNNRKDPLGVKKEYDGEIGVFEAEKYFNGEEIESPPRVANNDANKHRPQKDEQTTLVTRKYKVQNGTPSVRSESSLNSQSALLRSAVTNSSRNMKSKLHRKSFLVGLGCKCYCSDKNYVDISHHAGEISFSKNSSHGKTTSRNMFNADPKANHSVKVTRPHAAEISINKDVYFQSPEKLGVGLSKENSLALLGLNSSLGNNPAKMQLLQVEKSRNSLEVFGSPILSSRSKAPTALINRLTTTQRQFLWGGSFEGKKIAWVAWRQVCASRDLGANLGDKDMLPALAASVCCQAADLLTVCAHHSPMITISIFEYEYLTNHAALVEEIADKKVAAPEAWIEALKASEEEILMETKITQRELKESKLEQELEVYTKEKMLSRRVSSSEEFIQELHSLIAK

SEQ ID NO: 164169 - protein, 118 aa, Glycine max
  Coding DNA Sequence Number=SeqID_72484
MRGHPIGDSSLEGARHETSDSEPTSSERFKSFDEDLLTIVERVDKAILDQFSVLLDARAILSLPSTNNPLSALHDIMGDFAWKPLVKPIGPIGGDMSSFAAKNRVNLLLRLTLMMMKF

SEQ ID NO: 164170 - protein, 131 aa, Glycine max
  Coding DNA Sequence Number=SeqID_72485
  Gene Ontology: Mol. function=glutathione transferase activity; Cellular component=cytoplasm; Biological process=aromatic amino acid family metabolic process
  Homolog annotation: Hit_ID=Q9FQD3; Match level="QueryCoverage=61%, HitCoverage=42%, E-value=5e-13, Identity=43%"; Hit description =Glutathione S-transferase GST 25
MKVLGALVSLMIHYAGCMSRLNTIYPLGLQVRSLDNKRVVSYKMQFLKLNLIGFILMLLDGDSTQSLIPSSSQSHIQYLEDKYPDPPLLPHDIHQRAINFQKYIGQKVGVDEKLPWTQSVIGKGSVWFFKY

SEQ ID NO: 164171 - protein, 132 aa, Glycine max
  Coding DNA Sequence Number=SeqID_72486
  Subcellular localization annotation: CTP_CleavageSite=32; ConfidenceScore=5.17e-01
MGTSEDVAPKSVLLGNDAFVRKLLLAKPFSERSSRVSSTRYFSDESSAVPFTWEEKPGTPKKSPTLDFVPPLTSPPPVTLRPLHGPKIPSPTTHRRSCFFKSPWRILKTKKVGKAFIKGNDQHDDALREFRS

SEQ ID NO: 164172 - protein, 193 aa, Glycine max
  Coding DNA Sequence Number=SeqID_72487
  Gene Ontology: Mol. function=hydrolase activity; Cellular component =extracellular region; Biological process=carbohydrate metabolic process
  Homolog annotation: Hit_ID=A7NT93; Match level="QueryCoverage=50%, HitCoverage=22%, E-value=1e-23, Identity=54%"; Hit description =Chromosome chr18 scaffold_1, whole genome shotgun sequence
DKGRNQHQPFKDFAHGDNAEDLDVTLSLDLGGNGGEAAELILSGDEVLLECHVDAGEGADRGDGGGGMRKMHLIFLQLFPLIFAPLPFSPSNGPWLNEHIQDAENTLHKPLLFGQFGISTRSYGGNSRPRDQLFNMVYSTIYSSASSGGVAVGGLFWQLMAQVMDAYRDGYEVVLDESPSTANLIAPESQKLN

SEQ ID NO: 164173 - protein, 27 aa, Glycine max
  Coding DNA Sequence Number=SeqID_72488
MSLWKAKAAREEPMVRRGEAEAPSRRG

SEQ ID NO: 164174 - protein, 242 aa, Glycine max
  Coding DNA Sequence Number=SeqID_72489
MNLIIIINGKEHALKRPYRTRARARVMGEAEKVQEKMKVDMEAMKEQMATMIEVMMGMKKIMKANAVAVAATSAVAKVNPMPPSDLNQMNHPTSYMVGKDLGSTGGPYYVKIRNEHAFPPYGLPPNYTPPNVAYTPNENVNNSTPILIESRQPQTDHAHVSQTMGETHEISHHNLADFEPCLRYATEGQAVDGIPLQNTLEGPQYHSQPHPSHSTAVKNPHAMAEMRKLDHLEERLRAIKEG

SEQ ID NO: 164175 - protein, 82 aa, Glycine max
  Coding DNA Sequence Number=SeqID_72490
MESSTVTTYPSARRRCGAHGCVFQERKMRRVATNIYSRKMSEKLERREALRRCTINDLLEWSTKVGFLLPRILNYDEEIRPT

SEQ ID NO: 164176 - protein, 131 aa, Glycine max
  Coding DNA Sequence Number=SeqID_72491
  Subcellular localization annotation: CTP_CleavageSite=35; ConfidenceScore=5.79e-01
MGSPLASTPPPPLPPPSSPSPPPPPPTSDASVAPSAVKRTRKASRLRLLSTRPPGAERPVVHVDPATEKADDPHRKKLRTYLGIVARDKVDITYENWKEAPTAQKDLIWEDIQAEFDIPEASDSRTNRKLL

SEQ ID NO: 164177 - protein, 91 aa, Glycine max
  Coding DNA Sequence Number=SeqID_72492
MQQLLMTSLGKIETWCCLRWDLSPMGLPWSHASSNQLLLHYGQLLNQVHFAWTNLGIPGVLGGRKQTSKRTIEGTNQRPKSKTIKHLVDSL

SEQ ID NO: 164178 - protein, 125 aa, Glycine max
  Coding DNA Sequence Number=SeqID_72493
MEAEAENNDVKKEENNNDNNNNNESNGKIGNSSECLSKPKRQMKMPFQLEMLEKAYVELLVRDYEGGVVGEVGVVGLAFVDVVLSQAVEGQEGVAGKEAAKGSGVAGFSGGGAQVGFYGICNSTV

SEQ ID NO: 164179 - protein, 145 aa, Glycine max
  Coding DNA Sequence Number=SeqID_72494
MNSIWIPWDVGYKPRLSGGVGTKAELSKKKFWVKKDREDANNLLTVGKNLGVSMAEKHTAMVEKLVFMEPWDINRPESWKVCRGMHGRGGDRDVVLVSIYLPYDLVGKRRLWDELKVIKEDSNVTRWHVMGDFNCIRKRGDKSLG

SEQ ID NO: 164180 - protein, 68 aa, Glycine max
  Coding DNA Sequence Number=SeqID_72495
MDVSVGSNSELCVQVTGPESWSSLDHYSSTKWTFDFNIYWTRQLQGTMQLQKVGVTDCTGKLSHQTQF

SEQ ID NO: 164181 - protein, 38 aa, Glycine max
  Coding DNA Sequence Number=SeqID_72496
MDWKRKLVHCLKEDLSLGGVLGVSKRPPKSLFVYDSLV

SEQ ID NO: 164182 - protein, 128 aa, Glycine max
  Coding DNA Sequence Number=SeqID_72497
MNHSVFRSGRQKIPRKEGKRSCAKREKRTLALAKRDLQIINTFFNVKNMISPLSSSPNATQTLTPPSPPPTTTSGHHEPPFLAAKPPCQEECCNRSGILRILLKDSMEKIPSILHYIASDVPSFSSIF

SEQ ID NO: 164183 - protein, 31 aa, Glycine max
  Coding DNA Sequence Number=SeqID_72498
MQAWKRNHDSKVKKKVKFSNVVEVLGDTSVG

SEQ ID NO: 164184 - protein, 610 aa, Glycine max
  Coding DNA Sequence Number=SeqID_72499
  Homolog annotation: Hit_ID=UPI00006A2D9E; Match level="QueryCoverage =32%, HitCoverage=100%, E-value=1e-15, Identity=22%"; Hit description= UPI00006A2D9E related cluster
  Subcellular localization annotation: CTP_CleavageSite=40; ConfidenceScore=5.22e-01
ATLPQLQRTTCPRLQRATCPHLQRGTRPHLQRITRPRHQRAARPRHQRTTRPHLQRATRPHLQRTTCPRLQRTARPLLQRTTCPRLERAARPRLLRTKCPPLQRTTRPHLQRTTRPHLQRATPPHLRGLHALPLRRLHVLTFRGLHVLAFRVLHALTFRGLHTLTFRGLHVLAIRGLHTLSIRGLHVLAIKGLHALTFRGLHVLDFRGQHVLPCRGLHALAFRELHVLTFRGLHVLAFSGPYVLTFQRVERPHLERGFTASPSEDYTSSPSDVYTMSFSKDYTSSPSEGYMPSHLQRTSHPRHKRTTRPDHLRTTCPRHQRTTRRRLQKAAYPRLQRTTCPRLERVARPRLQRTTRPPFQRTTRPLLQRATHPHLQRTTPPHLRRLDALTFRGLNVLTFRGLHVVAFRKPHALAFRGLHDYMSPPSEGYTSSTSEDYTSSPQRATCPHNQTTTPPHLQRSTRPPLQRTTRPRLQRSTRPPLQRTTRPRLQRATCPHLQRVTRPHLQRTTRLCHQRTAHPGHQRTTCPRHQRPTRLRLQRTTHHPLQRTTRPHPRGLHTLSFRGLHVLTFRGLHLLTSEGYMPSPSEDYTSSASEDYMSSPLEYYTSSPSE

SEQ ID NO: 164185 - protein, 158 aa, Glycine max
  Coding DNA Sequence Number=SeqID_72500
  Pfam annotation: Domain name=Transposase_23; Domain location=46-112; Score=-9.3; E_value=0.012; Accession=PF03017.5; Description =TNP1ENSPM transposase
PDVVPVAITDPITETSLPPEPEVGPSAARVSTKGSCVDPSSTVLETGDSNKCGLYIEDNPSRLVTLGRVYEGSTAVHNIPLLHGQVKVGVEEVKDAEAPVPIPTHEVILVGQLFLKPLQVMWDATVFGVFNQDFPLYIKHEDLYEIAHGGQCLSISVT

SEQ ID NO: 164186 - protein, 436 aa, Glycine max
  Coding DNA Sequence Number=SeqID_72501
  Gene Ontology: Mol. function=DNA topoisomerase (ATP-hydrolyzing) activity; Cellular component=chromosome; Biological process=DNA unwinding during replication
  Homolog annotation: Hit_ID=Q1H0N1; Match level="QueryCoverage=100%, HitCoverage=53%, E-value=0.0, Identity=80%"; Hit description=DNA gyrase subunit A
  Pfam annotation: Domain name=DNA_gyraseA_C; Domain location=121-170; Score=52.5; E_value=1.5e-12; Accession=PF03989.4; Description=DNA gyrase C-terminal domain, beta-propeller
  Pfam annotation: Domain name=DNA_gyraseA_C; Domain location=171-223; Score=60.3; E_value=6.4e-15; Accession=PF03989.4; Description=DNA gyrase C-terminal domain, beta-propeller
  Pfam annotation: Domain name=DNA_gyraseA_C; Domain location=227-274; Score=52.8; E_value=1.2e-12; Accession=PF03989.4; Description=DNA gyrase C-terminal domain, beta-propeller
  Pfam annotation: Domain name=DNA_gyraseA_C; Domain location=275-324; Score=55.1; E_value=2.4e-13; Accession=PF03989.4; Description=DNA gyrase C-terminal domain, beta-propeller
  Pfam annotation: Domain name=DNA_gyraseA_C; Domain location=326-376; Score=53.6; E_value=7e-13; Accession=PF03989.4; Description=DNA gyrase C-terminal domain, beta-propeller
  Pfam annotation: Domain name=DNA_gyraseA_C; Domain location=377-426; Score=62.2; E_value=1.8e-15; Accession=PF03989.4; Description=DNA gyrase C-terminal domain, beta-propeller
  Pfam module annotation: Pfam domain module=DNA_gyraseA_C::DNA_gyraseA_ C::DNA_gyraseA_C::DNA_gyraseA_C::DNA_gyraseA_C::DNA_gyraseA_C; Domain location=121-170::171-223::227-274::275-324::326-376::377-426
MIAIIKAAPTPPEAKKELMARSWHSPVVEEMLKRAAMEASRPEGLSVDFGLTPKGYKLSDVQAQEILQMRLQRLTGLEQDKIVNEYKEVMDIIADLLDILAKPERVTAIIVEELNEIQKQFDVVVTLSHTGYVKSQPLDEYRAQRRGGRGKQAAATKEDDFIDKMFVANTHDYILCFSSRGRVYWLKVYEVPQGSRVSRGKPIVNLFPLEEGEKINAILPVKEFDENHYVFMATAKGTVKKTALTEFANPRKSGIIAINLDEGDYLIGAEVTNGQNDIVLVSNGGKAVWFTEDDVRPMGRATRGVRGMKLAAKQQVLSLLIAENDQQSVLVATENGYGKRTVLSEFRHSGRGTQGVKAIAISERNGLAIAAKLVTADDEIMLITTGGVLIRTRVKEIRDMGRAAQGVTLINLGEGEKLSGLEKIVETDDDGDDSEE

SEQ ID NO: 164187 - protein, 103 aa, Glycine max
  Coding DNA Sequence Number=SeqID_72502
MPFYSNNEGGGCCPARPGELGSFHLKQPPSKIFQMGPGLGCRRPCWSLRAIGLDCLQDSKREPSCIIRLDCLWMTKEAAKNLQMIRNGRPSLSPIPSDSLVSG

SEQ ID NO: 164188 - protein, 36 aa, Glycine max
  Coding DNA Sequence Number=SeqID_72503
MVYKGWSFDGASMVRKKKGIATPSRFSAPVGASFRK

SEQ ID NO: 164189 - protein, 296 aa, Glycine max
  Coding DNA Sequence Number=SeqID_72504
MKDTTREGSSTATQADTDFDTHRFWSTEHQQHFETIKGWSFLKERRVQLRDDEFPNFQEEIARRRWAPLLHPWGPVDSFRHRCPQSVPGAPLILAEGQQCEYSQRRRQVSSFDEEAIAQLLCILGQDFARTAVGRRVSVHVAQLISDVVYQFAGVAPTRHPVDPEKSNKALGFPALITNLCRFYGVPVTPSKVIQPPINRAFNEKYCTPKQAQGQAPQQLKEDQQPTIDAPLPPQEERIKLQMHRYMCHMTSQQAANHKGQRQLNETLYRYNLHQQSQDPSPFPWPTPKQFEATVA

SEQ ID NO: 164190 - protein, 37 aa, Glycine max
  Coding DNA Sequence Number=SeqID_72505
MEVEEPWLGLWLPLHYHVDKGGGVWYRMCGKQALWMI

SEQ ID NO: 164191 - protein, 42 aa, Glycine max
  Coding DNA Sequence Number=SeqID_72506
MALVRASMALVSGDGEEAHEDEEMADLLDFLGGSGDTAYIFV

SEQ ID NO: 164192 - protein, 189 aa, Glycine max
  Coding DNA Sequence Number=SeqID_72507
HEGSSPTKDTEAVEAVNDVVVDDPLRELIKSLVDIYEKPVELVWDVTKFGIPNAVASLFVTCADVNEIISGVQCLNIVILQLWTIYMDQFSQSDGLGSVYGFLEPQAILNANDRRGQCEEYIEKLLKESNRDAYLGAYLNHAFKTLETKSDGKFGHNTPRWIEVKWFSDGTPLDINIMTTLRKNGQNIL

SEQ ID NO: 164193 - protein, 92 aa, Glycine max
  Coding DNA Sequence Number=SeqID_72508
VSICDVLEWDVRVKSYDEDMTKSKGKDPLEGLGGPMTRARARKAKEALQQVLSILFEYKPKFQGEKSKVGPIGNLGISLLGDQMVADLLAVG

SEQ ID NO: 164194 - protein, 164 aa, Glycine max
  Coding DNA Sequence Number=SeqID_72509
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPKPDVTITSADSDTEFDEEDDSRETCRASCINESANARGEAVCVLGALPLPRSLTRCARSFGCGERYQLTQR

SEQ ID NO: 164195 - protein, 175 aa, Glycine max
  Coding DNA Sequence Number=SeqID_72510
MKADMGAMKEQMTTMMEAMMSMRKMMEINTTTIVVVSTATEVDPTHPSGLNQVNRLVSELVGQGGGALGSTGGPHFVQVQSKHSFPSYGLPPNYIPPNVAHAPDENVDNSAPIPIESQQPQLGHAQVPQPMGETHEVPRDHTLADFEPHLGYAIEGAGILWHTPAKHFRGPSVFP

SEQ ID NO: 164196 - protein, 32 aa, Glycine max
  Coding DNA Sequence Number=SeqID_72511
MEVLMIQAKIEKDEEEFVEMEDLLLKAIHVEQ

SEQ ID NO: 164197 - protein, 173 aa, Glycine max
  Coding DNA Sequence Number=SeqID_72512
MDASDHTIMHDRTDIPTKRSLLELSSQDALLAQNKLLSKQLETLTETLSKLPNQFNANQPSHSDVLQVEGCSICGGAHESRCCIPFDDSAQEVNYMGGSQPIQGQWRAYPDNQFNKEHGGPFNRPQQQGPSLYERTTKLEKTLDQFMQVSMSNHKRTKSAIKNLEIQVRQLAK

SEQ ID NO: 164198 - protein, 210 aa, Glycine max
  Coding DNA Sequence Number=SeqID_72513
  Subcellular localization annotation: CTP_CleavageSite=68; ConfidenceScore=5.89e-01
MQRNSPASSSDTSFLPQLSLFSGRPFTGISSFGVRVVLSFCSSTIFVFPLTFAGCVGRSGGANTGLLRVMPLSPVILVTLADNKLMSVASSFLSLGGAYLHGTAWLFRYGNGTGLTIEGYWGVWGAASLVKYTTKGLGLPKLLSSADCIHICCSSLPSSPTSSRPRSIIYCNRSSTAKHVSMLCSSPGCIKQESSPCPPWGITPPFCRAS

SEQ ID NO: 164199 - protein, 172 aa, Glycine max
  Coding DNA Sequence Number=SeqID_72514
MFSKKDEMMRILKLAKYRLKAQVEKDEGPSREGQSPRVEKDEGLSGEHLSLEDYTSSPLEDYTSSPSEDYTSSPSDDYPSSTSEDYTSSTSEDYTCSPLEDYTSSPLEGYTPSPLEDCISSPSEDYTSSPSEDYTSSTFRGLHILPFRGLHVLSIRGLHVLPFRGLHVLTFR

SEQ ID NO: 164200 - protein, 275 aa, Glycine max
  Coding DNA Sequence Number=SeqID_72515
CTKFESFHFRRAAAVADAWPAFAAAGPLLRAHLQTGLRMVPDPGRRADHRRAPGLPALARGHLRGGQLRRLGAAEHGQQALLPAPAPQPVGIDRAGIDVQLPQRPRDGLDDPGGDPGTAGLEHPLALAGAAAGAGIQPAGQRVPGLSGGALPLRYPGRMVCRAGLGGRVLSGHVQSPAPLATSRPAASEGQRSIITGGLTFCKTGGKHNARYCDAQGRLPGSHSERACRGIGTPPSLTCNGRIRRGGGRSRDRRGRAARGPPDAAGRSAVRPASA

SEQ ID NO: 164201 - protein, 293 aa, Glycine max
  Coding DNA Sequence Number=SeqID_72516
  Homolog annotation: Hit_ID=A5B939; Match level="QueryCoverage=29%, HitCoverage=66%, E-value=4e-24, Identity=60%"; Hit description =Putative uncharacterized protein
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRAADATLGSPETSAGPRKELSFLFNSLPTLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLK

SEQ ID NO: 164202 - protein, 151 aa, Glycine max
  Coding DNA Sequence Number=SeqID_72517
MGGTDEVQERIKADLEAMKEKMATMMEAMMSMKKIMEVNAAAVAATSAVAQVDLTPTSGLNQINRAISDMVGQRGKELGSTSGPYFVQVLNKHSFLPYGLAPNHTSPMFHTLPMRMSTTLHPFPLRANNPKLIMHMSLNPWGRHVKYPAII

SEQ ID NO: 164203 - protein, 299 aa, Glycine max
  Coding DNA Sequence Number=SeqID_72518
  Homolog annotation: Hit_ID=Q6Z8F0; Match level="QueryCoverage=21%, HitCoverage=58%, E-value=4e-21, Identity=79%"; Hit description =Putative uncharacterized protein P0459B01.18
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 164204 - protein, 167 aa, Glycine max
  Coding DNA Sequence Number=SeqID_72519
ADTVVSDGKQRPSLVILHPRYAEIPYGYLHPFARQTQLCPMASRDQVWSFCTQDTRRYLTVICTPLLGRHSCVRWQAETKFGHSAPKIRGDTLRLSAPFCHPEAAGPMTSRDQVWSFCTQDTRRYLTVIRTPLLGRHSCVRWQAETKFGHSAPKIRGDTLRLSAPLC

SEQ ID NO: 164205 - protein, 58 aa, Glycine max
  Coding DNA Sequence Number=SeqID_72520
MDSGRFQVSVPGVYHQLLALPWHIRGKARSRLDCGGEFHVSPPRFKRHVHDQIEVVGS

SEQ ID NO: 164206 - protein, 81 aa, Glycine max
  Coding DNA Sequence Number=SeqID_72521
  Subcellular localization annotation: CTP_CleavageSite=48; ConfidenceScore=5.18e-01
MTSPATDTISDGGITQISDGPALNNNNSSLLLPSKMLLVQAGHTFLLQCNNNKCNSSHNHRNNNSHNNRGYNQLRPLLNLP

SEQ ID NO: 164207 - protein, 178 aa, Glycine max
  Coding DNA Sequence Number=SeqID_72522
GGPWVLVTLTVERTTRPRLERTTRPHHQRAERPHLQRTTCPRLERATRPHLGGLHVLTIRGLNALTSRGLHVLALRGLHALTLGLYVLTIRGLYVLAFKGSCTFNFRGLHVLTVKGSWLHALTLGTSYPHRQRTTRPRLERTIRPHHQAAPHLRGLYVLALRGLYLHLGYYTFPHRQR

SEQ ID NO: 164208 - protein, 49 aa, Glycine max
  Coding DNA Sequence Number=SeqID_72523
MDKSLKDAKIPKGEGKINGVLCFLKINGSGMEKKKDDWRLHFKERMSQE

SEQ ID NO: 164209 - protein, 166 aa, Glycine max
  Coding DNA Sequence Number=SeqID_72524
  Homolog annotation: Hit_ID=A7QL08; Match level="QueryCoverage=22%, HitCoverage=50%, E-value=3e-10, Identity=91%"; Hit description =Chromosome undetermined scaffold_116, whole genome shotgun sequence
MVGAGLKKDLRVSRVVPGGSLNAFLFLLIGVISQRLAMESIDSLPIGWTVGAMIYFTGEVSAQLVELRSCNWVVAITEDRNMPLKDSTETRRAVKNVEEGFLIWDPGEEDQAGPCEQLDALSPFNPLSEMWQKEKESMDRPHRLHPVGTTRSPQGRLRHPGVADRP

SEQ ID NO: 164210 - protein, 96 aa, Glycine max
  Coding DNA Sequence Number=SeqID_72525
STQLVALEKVYDSSSTIHNVPYADDVVRDSPKHLPKPVGYAEMDNVVATVDPLGELVKNLFDVYQKPIELSWDGSKFGIPNVKDGFFITRVDVKLR

SEQ ID NO: 164211 - protein, 1073 aa, Glycine max
  Coding DNA Sequence Number=SeqID_72526
  Gene Ontology: Mol. function=4 iron, 4 sulfur cluster binding; Cellular component=nucleus; Biological process=regulation of transcription, DNA-dependent
  Homolog annotation: Hit_ID=A5BYI7; Match level="QueryCoverage=84%, HitCoverage=39%, E-value=2e-57, Identity=34%"; Hit description =Putative uncharacterized protein
MEVGEMDRKETQVEVPWSPGPPIKPVPMKPVPIYMPEERNQMDHLANGAVACAEFSLGQDKIGGSGDGSNVAGYSGKTCEQIVSDAVSSYRKLGFCEQLLAVEAESRNISVTQGNNDGLKNPFVPPLVLDNVLDPQETYIACCSMKSSQDTSYILDNANKEESRQIASMQVNMEEKDPGREERNVTANKLDNNVAPNSKELCDPAMEFAAVSSPVKENHNPDNGSSHDTDLNKTPQQKPRRRKHRPKVIKEGKPKRTRKPATPKPVQSKEKQPVKRKYVRKNALNKTSTPPTEETGELTKEMSCKRSLNFDIGTTYESSAAIENTRTLLGKENGVLVQETNVGPAFDLNTSMKQASNSYMSLPEDTQALNTSSGRKSSGTKPEENPPPKRKYVKRKGVNKTSAPPIEVPGNLTEETTSASAQTSCTGSINFDERASEQSYAVKENPTGHPGSEIGVVMKEMNVGLAYDLNTSMKQALNDDMTLPKDTQAPSSSSKIKLPGTKRKENLTGKRKNARKKGSNPSPIPPTEMTELTEAMILESNMSWRRSLNFDIGNVGRENLDLDIGKENMVLEERKVGPTYKDTWLKEAVNICMSLPEETQHPSTSISKCTSPGAKLNANSVEKKNKKGRATAWGGNISNSQSSSIRLQMVGSKRKHSDTFNRADDSSMNLIGVQYNGLPSYQHLSTSISKCTSPGAKLNANSVEKKNKKIRATARGGNISNSQSSSIGLQMVGSKRKHSGTFNRADDSSLNLIGVQYNGLPSYHTSLCLQFPKIQKKRRTEKGNATKEVQLTCPQEDALGHPYASSSSCWTYGSGYNTARVPATSIDNTQTFNEFLLSLKRLAETSQTSTCDRGSLTRIRNCDTEPNYTAKQVGVPGKETFGDAIGALVAETCTPPTKKRQNRKKSVLSSSAHSTTNEMLHHHNFTLENCPLPMGKPSDIVPEVLWNTMNNIDALTLQFRQLNLNAEARDLAFHEENALVPYKQKNSLIHGDGVIVPFHIKKQHLRPKVNLDDETDRVWKLLLLDINSHGIDGTDEDKAKWWEEERNVFRGRADSFIARMHLVQGIMFDIIHL

SEQ ID NO: 164212 - protein, 73 aa, Glycine max
  Coding DNA Sequence Number=SeqID_72527
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLRPAFIVVFVPIIMGFS

SEQ ID NO: 164213 - protein, 169 aa, Glycine max
  Coding DNA Sequence Number=SeqID_72528
  Homolog annotation: Hit_ID=A2Q454; Match level="QueryCoverage=81%, HitCoverage=67%, E-value=5e-22, Identity=36%"; Hit description =Retrotransposon gag protein
MTTRMNERVDALEGRMLMLEESFRLRMEEFQKVMMEEFARMRNPPSSEGISSVSADENSEFRMTVKKVELPSFDGGDPVGWITRAETYFEIHGSSEDVKIRLAKICMEGATIHWFNLLTETEDNLTWDKLKKMMVDRYGGRRSQTRNSGKGQNPKSSKPASSHENGAGY

SEQ ID NO: 164214 - protein, 1035 aa, Glycine max
  Coding DNA Sequence Number=SeqID_72529
  Gene Ontology: Mol. function=nucleic acid binding; Cellular component= intracellular; Biological process=intracellular protein transport
  Homolog annotation: Hit_ID=A7PPJ3; Match level="QueryCoverage=46%, HitCoverage=90%, E-value=1e-136, Identity=56%"; Hit description =Chromosome chr8 scaffold_23, whole genome shotgun sequence
  Pfam annotation: Domain name=DUF618; Domain location=137-197; Score =8.8; E_value=0.00079; Accession=PF04818.4; Description=Protein of unknown function, DUF618
  Pfam annotation: Domain name=zf-C2H2; Domain location=881-903; Score =19.0; E_value=0.018; Accession=PF00096.17; Description=Zinc finger, C2H2 type
  Pfam module annotation: Pfam domain module=DUF618::zf-C2H2; Domain location=137-197::881-903
MENSRRPFDRSREPGPKKPRLMEELDRASNSGARQFHQRQVASGITTLSSARFRTNDRDLESSDFGRRGGAGGGGGGYQPQPLPFQELVAQYKAALAELTFNSKPIITNLTIIAGENQAAEKAIAATVCANILEVPSDQKLPSLYLLDSIVKNIGRDYIKYFAARLPEVFIKAYRQVDPSVHQSMRHLFGTWKGVFPPQTLQVIEKELGFTPAVNGSSSASATLRSDSQSQRPPHSIHVNPKYLERQRLQQSSRTKGVVDDITGAISNTNDDPEMPGRTLGVGRPWVDPSVTVNIHSRENEQCAHRGAFNDSVLEKSIGASYGSNEYGSNISRNLGLGIRRPGGRVTESGHDKSWYSKSGVVAGTMSGQGNGLGLKYSFLNTEAPKSMILDVHHQPTQNISSTRTSVISASWKNSEEEEYTWDEMNSGLTVHGASTVSNLSKNSWTADDENLEAEDCLEIRNPFRANVDREMSIESQATEKKQLPSSHHHPSLSWQLQEQQSIDELNRKAGHSDRFVSTHGAIPANANSSAARMVNQPFLSNATIGLPGIAGQFHSLGAENPSGQSPLQQRSPSPPVSVHPSHPLQNLAEQDLPQNHKASQFLGGLQSQYIKDSSPAPPPSIQVGNLQSSQLKNLQGPFSSTTFQARHQHQLGSSHNEVTVKTEKPPMSEVPLARETKSNLDTGNLPSRLGVRPSRSGGPSPATLISSVSKIASPSSLGPSSDNVSVLPKIPLRKAGPPRASTLPPASSNVSSASAQTSSDTNNTLNPIANLLSSLVAKGLISAETESPAKVPSELLTRLEEQSDSITTTSSLPVASVSGSATVPVPSTKDEVDDTARTPISLSESTSPGIRNLIGLEFKPDVIREFHSSVVSGLFDNFPHQCSICGHKLRFQEQFNRHLKWHATRESEENGLISASRWYLKSNDWILGKAEYPSENEFTDSVDTYGKEADKSQEDAMVLADEKQCLCVLCGELFEDFYCQETGEWMFKGAVYLANSDSKSEMGIRDVSTGRGPIIHASCLSDNSVSSVLETGQD

SEQ ID NO: 164215 - protein, 189 aa, Glycine max
  Coding DNA Sequence Number=SeqID_72530
  Homolog annotation: Hit_ID=Q2HTA0; Match level="QueryCoverage=70%, HitCoverage=24%, E-value=3e-08, Identity=33%"; Hit description=IMP dehydrogenase/GMP reductase, related
  Pfam annotation: Domain name=DUF1723; Domain location=103-151; Score =7.8; E_value=0.063; Accession=PF08330.1; Description=Protein of unknown function (DUF1723)
MIMVETRGLDQALDRVIGRALGRDHVEHADDKVHEQPEEAVVDDVVPDAKGFLGGSHDTSVLMDYVYHLAPTERPELKLSSHGKKVEKFGRPALEIEGLVTGKRLIPLITCLLDTGDQGLIFHLPIGEVTITLDDVASLLNLPIIGVFHSFEPLHVGDVIFLLVKLLEVSSKEARAETVQCHGAYVRLS

SEQ ID NO: 164216 - protein, 89 aa, Glycine max
  Coding DNA Sequence Number=SeqID_72531
  Subcellular localization annotation: CTP_CleavageSite=53; ConfidenceScore=5.33e-01
MTVYAYVPSVTILRFSNLFSLSAVNKNQTRLICFKINTRLLQQANPCFKINSRSSLAIETKCFQDIQGSGNQLPGNVIDYQKTGLRKSC

SEQ ID NO: 164217 - protein, 97 aa, Glycine max
  Coding DNA Sequence Number=SeqID_72532
  Gene Ontology: Mol. function=peptidyl-prolyl cis-trans isomerase activity; Biological process=protein folding
  Homolog annotation: Hit_ID=O81864; Match level="QueryCoverage=31%, HitCoverage=13%, E-value=3e-09, Identity=90%"; Hit description =Peptidyl-prolyl cis-trans isomerase
MAGWQLNKDGALTQPMTTKITMVIPIRLSLSLALARKIFLLLNFGHGHVRSMKVGGIRRVIIPPSLGYQNTSQEPIPPNEYLNSPHLSPSRLPSPLD

SEQ ID NO: 164218 - protein, 592 aa, Glycine max
  Coding DNA Sequence Number=SeqID_72533
  Gene Ontology: Mol. function=DNA binding; Cellular component=nucleus; Biological process=regulation of transcription
  Homolog annotation: Hit_ID=A7PPI6; Match level="QueryCoverage=97%, HitCoverage=98%, E-value=1e-140, Identity=51%"; Hit description =Chromosome chr8 scaffold_23, whole genome shotgun sequence
MEDHQHQHHHHHFGMNDLRQVVNNGPRPAHTTFPSMPPHPTEELFPGHHHRNLTPLPTHHPQQQQHFEVMMFGRDIMPPGLHDFASTPHDSAVATTTITLPTPPVTCGFDAAEGAGCIGGDPFTGRWPRQETLTLLEIRSRLDPKFKEANHKGPLWDEVSRIMCEEHGYQRSGKKCREKFENLYKYYKKTKEGKAGRHDGKHYRFFRQLEALYGENSNTVSVPETNVVVGSIHFQGPSQTNQDNNKFQSHNNNNNRHCDSLSLTNSTNFDTSTSEGHDGNDHSMENESMEKRIKRKSGRSWKVKIKDFIDSQMRKLVEKQKEWLDKLVKTLEEKEKERMLREEEWRKQEANRLEREQKFWAKERAWIEARDAALMEALHKLTGREIMKVETDPEGTINVMTAAEVQNQNNEDESEILNSSNVIRGADSWQESEITRLEQLRAEMETRFPYSEISEEVSWDVVATKMADFGYERSALMCKEKWESINKEEKNSKNRKENLSRNCFYFKNNHEDQQQSSLYDQGSAYCDDDVNEQGKEIERLQTNNGSSSPSKSNIVGNVVPSDSCFPFLMGADQGGNLWENYGLKLNKENQNH

SEQ ID NO: 164219 - protein, 103 aa, Glycine max
  Coding DNA Sequence Number=SeqID_72534
  Homolog annotation: Hit_ID=A7UQU7; Match level="QueryCoverage=75%, HitCoverage=13%, E-value=4e-07, Identity=34%"; Hit description=IMP dehydrogenase/GMP reductase, putative
CEEVLEYDHEQPLATRWRPLRDTNKVDSTKEVLERLQLTGVVWSPYASQRDLRPFKDQTYYSGNIRVGTNISLYLPERVLRKFRGNFRINQKGTHVGSANSNP

SEQ ID NO: 164220 - protein, 88 aa, Glycine max
  Coding DNA Sequence Number=SeqID_72535
  Subcellular localization annotation: CTP_CleavageSite=59; ConfidenceScore=5.31e-01
MPCRPTPNNTVLQFWLLPIKTGDSLNTLFQPRYPSFPTPSWLTPETLHTPQFSNNWFALSSATSSPAFNKWLPSITFEFHSQHNFSYT

SEQ ID NO: 164221 - protein, 497 aa, Glycine max
  Coding DNA Sequence Number=SeqID_72536
  Homolog annotation: Hit_ID=A7PPI3; Match level="QueryCoverage=99%, HitCoverage=98%, E-value=2e-47, Identity=33%"; Hit description =Chromosome chr8 scaffold_23, whole genome shotgun sequence
MAEKLHLREFLQEDQEPFLLKHYISERRSQLKRVTPSPNSTLQQHLKKNPQNSNFPLNKCFLTSLQNATKSPLLLSPKKSTPLTLRPSNAKTASLLLEAALRIHTNKNAKPKPKPNRALGIFGSLFKKLTNRKRETIEGGAVAKVNKDSDDDDVVVVGSCEVGFTCSCNGRPSSAVWSESNEDKSLDLESSSSGNSFDDSVVEEIEFLNKGKLINADDHGFFCQSPFRFSLQRSPDYSGRRTPVFSSPAAAPCRRKTEDKEINGADGVNKFHSGEEEEDKEQCSPVSVLDPPFDDDNDDGHDHDNGDDVFDLDCSYANVQRTKQHLLDRLCRFEKLAELDPVELEKRMLDHEDREYETFTEEDDDHEDVDSETACEENILRGEMFEILCCRSSVQQDTQQAQAEDLKRLVYDLIKEEETTQVNNNCSDMVIRRVLRKLELWKEVESNTIDMMIEEDFSREQCRWKKNDEHTKELAVEVELAIFCFLVEELSEELLIC

SEQ ID NO: 164222 - protein, 130 aa, Glycine max
  Coding DNA Sequence Number=SeqID_72537
MTRRRETVEAESYLYPQMVECGHGMYYTPPTFSQFSTQMYQYPFEGHQSDTSTSEHSVGGVAKTYPNFSWSTMTPSQQHDAPIPTLNAPLGTQWNVPELKRGHIGAEEILIDKHGDGNDHAAHPHGHHND

SEQ ID NO: 164223 - protein, 217 aa, Glycine max
  Coding DNA Sequence Number=SeqID_72538
  Gene Ontology: Mol. function=structural constituent of ribosome; Cellular component=intracellular; Biological process=translational elongation
  Homolog annotation: Hit_ID=A7PPG7; Match level="QueryCoverage=52%, HitCoverage=100%, E-value=4e-21, Identity=51%"; Hit description =Chromosome chr8 scaffold_23, whole genome shotgun sequence
  Pfam annotation: Domain name=Ribosomal_60s; Domain location=120-216; Score=117.9; E_value=3e-32; Accession=PF00428.10; Description=60s Acidic ribosomal protein
SEEPSSGKTIYVLPEEPFSESFPEEPSSGSFPEEGSSGRTNCCSSEKFPEEGSSGRTIYSSGRRFFRMNNLFYRKNLLSKTFRKKVLPEKLSGRTSSVCNFRKMKVVAAYLLAVLGGNNTPSADDIKEILGSVGIEADEDRIESFLSEVKGKDIVELIAAGKEKLASVPSGGGGAVAVAAAPGGGGGGAAPAAEVKKEEKVEEKEESDDDMGFSLFD

SEQ ID NO: 164224 - protein, 101 aa, Glycine max
  Coding DNA Sequence Number=SeqID_72539
MHNHQFSLFKRRSCGHNLFKQFRFDFVVYGLDFVVATSFFVVAYIVVTCMAKSSNGDLCSDGGQPIMVASGVVCAWWLCWVEVGCDSVDDYGCAGKEGGVD

SEQ ID NO: 164225 - protein, 97 aa, Glycine max
  Coding DNA Sequence Number=SeqID_72540
MAMGRVGYGYCLPNPLPRPDGFEFIVSFSYPSDFKWRGGFGFGVGTGLIISYPYPYPTFGYREKPELEPIPGQLRYYPSKSGRIRACTHGYGFSCHV

SEQ ID NO: 164226 - protein, 82 aa, Glycine max
  Coding DNA Sequence Number=SeqID_72541
MRKGPLEKGGTKAIDSVETLRTCLEFIFILGLFGDKQNTKNEGTLSKNGNRKEEKEGIQKQAQPNSDAKRASGAKRATNCRR

SEQ ID NO: 164227 - protein, 223 aa, Glycine max
  Coding DNA Sequence Number=SeqID_72542
  Gene Ontology: Mol. function=delta14-sterol reductase activity; Cellular component=integral to membrane; Biological process=steroid biosynthetic process
  Homolog annotation: Hit_ID=Q9LDR4; Match level="QueryCoverage=43%, HitCoverage=26%, E-value=2e-42, Identity=81%"; Hit description =Delta(14)-sterol reductase
MASHLLSPEDISSVFYRGEENALVLVVYGQVCSHNVCITLSFFSRGRNINWDIIAERLGFMLVFGDLVWIPFTFSIQGWWLLMNSVESTPAAIVANCFVFLIGYMVFRGANKQNHVFKKNPKARIWGKPPKVIGGKLLASGYWFLGRGKGENRVSHSEIDLHYDVLQCHTKHKHFTNSILLSSLSSYSVNLEREGMKLVVQRNENGMVKAPRLIKSNSVMFPV

SEQ ID NO: 164228 - protein, 167 aa, Glycine max
  Coding DNA Sequence Number=SeqID_72543
MVCTDQAEMTGRLLADSLTFECRIMYYLIVCILLPRSSNLAQVSEEDLIVMWAFLTGRQIDWAHLVRSFYIGAGVVTSFGYRKELDGSWVKKDVQPQPANECIPSPPRHDSSMLLNDILTELRSLRAHFDDRLDRIDTHFEEMDIRIDQLADDMSYICRYFDLPADP

SEQ ID NO: 164229 - protein, 25 aa, Glycine max
  Coding DNA Sequence Number=SeqID_72544
STLEDPPEARDQCRKSQGPVRLIRV

SEQ ID NO: 164230 - protein, 50 aa, Glycine max
  Coding DNA Sequence Number=SeqID_72545
MFRGSKMFGQDELKADANNETIEYHFSCQNAQHDTTMYAMNQYSSWQQPL

SEQ ID NO: 164231 - protein, 133 aa, Glycine max
  Coding DNA Sequence Number=SeqID_72546
MLRNLTDYVIIPFLPSRTLRNFMDCALTPPFNFRHVTELHGLCYNAFLLASGMSRNFTNCLTMGAKYLEVVKRGSHPNKGGPRTKLGYDRVGKIGTSSSTPIENVLVVEEDIKYLLILKNVLLSMSMTKILNI

SEQ ID NO: 164232 - protein, 128 aa, Glycine max
  Coding DNA Sequence Number=SeqID_72547
MSALKDQMASMMEAMLKIQKSIEDNVMAAATNTTREAEPVLQPTMNSGRDRSATGFNRRYSPQAYPYGLPPDFTPRTAPDNLSQAPTFEGQLPPHANYPLEEDDEGDAHLGPLLPPREPAPMSGPNQT

SEQ ID NO: 164233 - protein, 43 aa, Glycine max
  Coding DNA Sequence Number=SeqID_72548
MCEHLCYMIVDSAYDLEKYVSGECLCVWIPQATVHTEIWTIAI

SEQ ID NO: 164234 - protein, 39 aa, Glycine max
  Coding DNA Sequence Number=SeqID_72549
NRIVSGHGQKSRQVNGRNQPRQIEDRVTADRRLFPALDK

SEQ ID NO: 164235 - protein, 82 aa, Glycine max
  Coding DNA Sequence Number=SeqID_72550
MVIDYRFLCKARNHSVFRLGRQRISRKKGKRDFSLVFLDPSLPEPPNDFKVKNPARLSKLMTSGVSLSSPGRAASPQSDPFQ

SEQ ID NO: 164236 - protein, 61 aa, Glycine max
  Coding DNA Sequence Number=SeqID_72551
MCDCSGAHGSSTLSAYTEAVRELACEILELIAEGLGVPDTWIFSSRKCSRFSMKGPFLNVP

SEQ ID NO: 164237 - protein, 127 aa, Glycine max
  Coding DNA Sequence Number=SeqID_72552
MVGVEEIRDVDAPILVPTKEGAVRPAKPADRPDDEVDDPLYLMTLTIPQLFLKPLQVMWDATLFGLFNENFPLYIKHEDLSKIAHGGQCLSISVIHCGFLCSLRQVCDWNQKRLKDSFAHQNGQSTI

SEQ ID NO: 164238 - protein, 127 aa, Glycine max
  Coding DNA Sequence Number=SeqID_72553
  Homolog annotation: Hit_ID=Q2HW90; Match level="QueryCoverage=59%, HitCoverage=14%, E-value=2e-10, Identity=49%"; Hit description =Putative uncharacterized protein
MALANQGEWASFFDILALLIFGVILFPNVKGLVDLAAIDAFLAFHHGKESPVVAILADMYDTFDWRCEKSSTRIVCCTLALYVWLVSHLFRQEGRPICPLQGHRSCAEKGKANWDQLLASMEGGGVR

SEQ ID NO: 164239 - protein, 93 aa, Glycine max
  Coding DNA Sequence Number=SeqID_72554
MACRSLAEVKGSGPCPKTVADGCQAWPATSMPEQGPARACLGRLRRSGLVPSGLQYFSAFCCPWAEFFGREPYHKKRFSRGAAGRLGSAGGGT

SEQ ID NO: 164240 - protein, 92 aa, Glycine max
  Coding DNA Sequence Number=SeqID_72555
MVNPTQFQAKEEKVKATDDSLSKVDPLSKMHPLSEASSSLSGWETLEEDKPEICMPSTQPACSVRTLSLLTLSAPILAKRKFTNSRLVSHAR

SEQ ID NO: 164241 - protein, 116 aa, Glycine max
  Coding DNA Sequence Number=SeqID_72556
  Subcellular localization annotation: CTP_CleavageSite=30; ConfidenceScore=5.33e-01
MYPLLFSVTTTQVDVSSTYTAKDVPSNVLRQSSQAVSPLKLCEGKTKDISGGRRETQKEFRRLVIGEFFLAKGEGNKRYSTLLFSRFGKPENFRKLLQRKKKKKKFKKMFKEIQRL

SEQ ID NO: 164242 - protein, 91 aa, Glycine max
  Coding DNA Sequence Number=SeqID_72557
MGPKSTLRLMRTLGSSTISLAQSSWSLLAMALVMGPFFRRIASLKDKIEELVQVGYLAQFIKKSDDNKLEANIDRINKDHRRRRDTNRRRD

SEQ ID NO: 164243 - protein, 115 aa, Glycine max
  Coding DNA Sequence Number=SeqID_72558
MGSNQAHAFKKRVSSSQGQVGKKEGALRCPYQMHAKARVMSEIEEVQEQMKAYMKVMKEQITTMMEAMMSMRKIMEVNMATVVAASTASEVGPTHPSGINQAIHPVEASFMMNQD

SEQ ID NO: 164244 - protein, 94 aa, Glycine max
  Coding DNA Sequence Number=SeqID_72559
  Subcellular localization annotation: CTP_CleavageSite=58; ConfidenceScore=5.84e-01
MASSPGSPPLSPSPPPPPPPPPPPPLDASASSSTMKRTRKAIRLRFLSTRPPGAERPMVNIDPATNKADGPQRKKLKTYLGIVARDKLDVTYEN

SEQ ID NO: 164245 - protein, 86 aa, Glycine max
  Coding DNA Sequence Number=SeqID_72560
  Gene Ontology: Mol. function=DNA binding; Biological process =regulation of transcription, DNA-dependent
  Homolog annotation: Hit_ID=A9DJ33; Match level="QueryCoverage=84%, HitCoverage=64%, E-value=5e-17, Identity=50%"; Hit description =Transcriptional regulator, MarR family protein
  Pfam annotation: Domain name=DUF24; Domain location=3-81; Score=63.3; E_value=8.4e-16; Accession=PF01638.8; Description=Transcriptional regulator
MSSLGSKWKPVIVMIAARIHVISRKVLTDQLREMVEDGLLIREEFKELPPRVEYTLTEKGLALLPILNLLEDWERNYETKEVLAEA

SEQ ID NO: 164246 - protein, 117 aa, Glycine max
  Coding DNA Sequence Number=SeqID_72561
SDLTMKWAPTTGKGSVDDTVCQKYDISKEKWTQFCQSHRDPSWEASQGSFVAHGRQDVLTVAIGRLEHPRRICVARVGPLSSVESASDADIISSGESTSGVGPHHPLGSQGHPQQFR

SEQ ID NO: 164247 - protein, 150 aa, Glycine max
  Coding DNA Sequence Number=SeqID_72562
  Subcellular localization annotation: CTP_CleavageSite=46; ConfidenceScore=5.01e-01
MPPTRHPLDPDKSNKALGFPALITSLCQSFGVPVTPSKVIRPPITRAFIEKYCMPRQAQGDAPQAASAPPPPHQADPAGSFGMEQYLQHLVRQQAANHRGQFRAEVTWPGDWPEAQPGEAPAGAPDDAEEARMDEEMTDLLGFLGGSGAT

SEQ ID NO: 164248 - protein, 409 aa, Glycine max
  Coding DNA Sequence Number=SeqID_72563
  Gene Ontology: Mol. function=aldehyde dehydrogenase [NAD(P)+] activity; Biological process=metabolic process
  Homolog annotation: Hit_ID=A3TFY4; Match level="QueryCoverage=98%, HitCoverage=67%, E-value=1e-122, Identity=57%"; Hit description =Putative uncharacterized protein
  Pfam annotation: Domain name=Aldedh; Domain location=1-381; Score= -267.7; E_value=0.0022; Accession=PF00171.13; Description=Aldehyde dehydrogenase family
  Subcellular localization annotation: CTP_CleavageSite=17; ConfidenceScore=5.31e-01
SPARCGSNPGITPHAARASAGLAQRTPSRSGGAGLVLGAGNVTSIPVLDVLYELLAHNRTALLKVNPTQDALVPVYKRALAPLIEPGFLRIVRGGPAVGAYLTTHPGLVHVHITGSAATFDTIVWGPSKGEGAAATKRRRRENRPRLKKPITAELGGVSPIIVVPGKWTDADLTYQAEHVATMRLQNSGHNCIAGQVVIMSSDWEQADAFRAALRRAYANAPERPTWYPGSPSRMELASDAYPDALVLGDRLLIEIDADDDPAALETTEYFAPVLGLVTLPGTGQQFLDAAVAHANDRLQGTLGANLLIDPETEKSLGAGFERAITALHYGSIAINGWTAFGFITPTLTWGAFPGGTIADVGSGIGVVHNALLLDGVERSIVRGPFRPFPRSLPIANGGGRLTILPKPP

SEQ ID NO: 164249 - protein, 174 aa, Glycine max
  Coding DNA Sequence Number=SeqID_72564
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
MRGAPTEESLSPFLVSNFGTQSFKIIQRVHKAWESPLRKDKELRAIRNGIIDGYHEWLKIRTRGLDWLSKLKIINEENFEAPEEDEEVRALQTELGKARLAKERFKLVATDVRKECAGRPAGMQAWHWPSFYNVVTGKTLALPNLIALQHIPLSPAGVIAKRPAPIALPNSCAA

SEQ ID NO: 164250 - protein, 91 aa, Glycine max
  Coding DNA Sequence Number=SeqID_72565
MLGFTSDSPQISASLHQLDFAPYASRSYSAQWNVPELLHDMHMLRLSRILGKMEVEEPWQWLWLPLHYQAGLVADLGMAFVDDWVRRIVIG

SEQ ID NO: 164251 - protein, 99 aa, Glycine max
  Coding DNA Sequence Number=SeqID_72566
  Homolog annotation: Hit_ID=A5C120; Match level="QueryCoverage=48%, HitCoverage=6%, E-value=8e-08, Identity=54%"; Hit description =Putative uncharacterized protein
MDPKKIKVIPEWPTPPCIREIWGFNDLTNFYKRFVPYFSILVAPLIELERILEFQEPMDLRSNPFQGGVNDAILPPQEHWIEDSKKIGPEMQEKALRFS

SEQ ID NO: 164252 - protein, 192 aa, Glycine max
  Coding DNA Sequence Number=SeqID_72567
MAEPLKKRKGSSSRSQRHSEAQDTPIPSSISSSSLFSSKEKHTRYGFLYDESFECIQAFQNSNPIPFMSLKLPVYSELVKAFYSNLEIQESTLISEVFGIKMVIDQSLFYDLTQLSSKGVPFEGALDDDWKFVFSIFDACRLVCTNQADMTRRLLAGSLALESRILLYLIVHILLPRSSNLAQVEEDLHSHS

SEQ ID NO: 164253 - protein, 148 aa, Glycine max
  Coding DNA Sequence Number=SeqID_72568
MKLDRFRCRCCYWWRHLNLVAIPQAICPSDLSDSEWRFLSLAEIAYSGWSFASLTLLRKVEEKPQLLVIFVVTAAAVAALEEEHMACLDQQHSRKEGQAVVVVEDLSISDLDDSSNLDCICCLKGHNYSTVVGFATEEVYYKCLQHKL

SEQ ID NO: 164254 - protein, 974 aa, Glycine max
  Coding DNA Sequence Number=SeqID_72569
  Gene Ontology: Mol. function=metal ion binding; Cellular component =late endosome membrane; Biological process=intracellular protein transport
  Homolog annotation: Hit_ID=A7Q339; Match level="QueryCoverage=97%, HitCoverage=98%, E-value=0.0, Identity=79%"; Hit description =Chromosome chr12 scaffold_47, whole genome shotgun sequence
  Pfam annotation: Domain name=Clathrin; Domain location=401-552; Score= -15.2; E_value=0.068; Accession=PF00637.11; Description=Region in Clathrin and VPS
MYQWRKFEFFEEKYGAKCAVPENDEDDGVVAAERKIECCSSGRGKLVTGFDDGVVCFFDRGLKFNYSFQPHSSSVLFLQQLKQRNFLVTIGEDEQLTPQQSALCLKVFDLDKMQPESSSTTSPDCVGILRIFTNQFPEAKITSFLVLEEVPPILLIAIGLDSGSIYCIKGDIARERITRSKLQVENNHLDKTLSAVTGLGFKVDGQSLQLFAVTPCSVSLFSLHDQPPRRQTLDQIGSGVNSVAMSDRSELVIGRPEAVYFYEVDGRGPCWAFEGEKKLLGWFRGYLLCVIADQRTGKHTFNIYDLKNRLIAHSALVKEVSYMLYEWGNIILVMNDKSALCIGEKDMESKLDMLFKKNLYTVAINLVQTQQADAAATAEVLRKYGDHLYSKQDYDEAMAQYIHTIGHLEPSYVIQKFLDAQRIYNLTNYLEKLHEKGLASKDHTTLLLNCYTKLKDVKKLNLFIKSDDSIGELKFDVETAIRVCRAANYHEHAMYVARKAGRHEWYLKILLEDLGSYEEALEYISSLESSQAGMTIKEYGKILIEHKPVETIQILIRLCTEDGNKRGRSNGVYMSMLPSPVDFLSIFIHHPQSLMDFLEKYTNKVKDSPAQVEIHNTLLELYISNELNFPSMSQVNDGGNYLNGASAKTMILSAQSNGNIGDHKSSEQGKDHLERREKGLRLLKSAWPQETEHPQYDVDLSIILCEMNAFKDGLLYLYEKMKLYKEVIACYMQAHDHEGLIACCKRLGDSVKGGDSSLWADVLKYFGELGEDCSKEVKEVLTYIERDDILPPMIVLQTLSRNPCLTLSVLKDYIARKLERESKMIEEDRQAIEKYQEDTLAMRKEIQDLRTNARIFQLSKCTACTFTLDLPAVHFMCMHSFHLRCLGDNEKECPECAPEYRSVLEMKRNLEQNSKDQDRFFQQVKSSKDGFSVIAEYFGKGIISKISNGSTSGPRSGTASSTSGSSLLLVDWGP

SEQ ID NO: 164255 - protein, 468 aa, Glycine max
  Coding DNA Sequence Number=SeqID_72570
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=99%, HitCoverage=83%, E-value=0.0, Identity=76%"; Hit description =Glucosyltransferase-13
  Pfam annotation: Domain name=UDPGT; Domain location=5-465; Score= -72.2; E_value=5.7e-07; Accession=PF00201.9; Description=UDP -glucoronosyl and UDP-glucosyl transferase
MEKTVHIAVVPGPGFSHLVPILQFSKRLVHLHQNFHVTCIIPSVGSPSCASKSILETLPPNITSIFLQPVKPENLPQEVAIEAQIQFTVTFSLPSIHQTLKTLTSRTHFVALVADSFAFEALDFAKELNMLSYIYFPTSATTLSWYLYVPKLDKETSCEYRDFPEPIQIPGCVPIHGRDLNNQAQDRSSQAYKLFVQRAQRLPLVDGIFMNTFLEMETSPIRTLKEEGRGSPLVYDVGPIVQGGDDDAKGLDLECLTWLDKQQVGSVLFVSFGSGGTLSQEQITELACGLDLSNHKFLWVVRAPSSLASDAYLSAQNDFDPSKFLPCGFLERTKEKGMVVPSWAPQIQVLSHSSVGGFLTHCGWNSILESVLKGVPFITWPLFAEQRMNTVLLCEGLKVGVRPRVGENGLVERVEIVKVIKCLMEEEEGEKMRERMNELKEAAINAIKEDGSSTRTLSQLALKWKSLA

SEQ ID NO: 164256 - protein, 343 aa, Glycine max
  Coding DNA Sequence Number=SeqID_72571
  Homolog annotation: Hit_ID=A7QB55; Match level="QueryCoverage=17%, HitCoverage=27%, E-value=5e-08, Identity=50%"; Hit description =Chromosome chr4 scaffold_73, whole genome shotgun sequence
MEAGNTYISHEMRRLYYYSPRRLCIVRPQEGEIKGSLVKLSWLAHHFAQINNDDDEEQVRRFARAWILRFIGGVLFVDKSSNKVSLRCAMPPIIKLNQSEVCASYYKCGHENDVQPWLQRGLLPKWLRRGNQYIDNDDVRVFRRKLDIMKRHEPYPSTVISLLPPVCLVGSLTWYAVAEVAETLQYMVSPQGRNTWTVDDLVPYVEKITILSEEQERVTELGIDRRRETIEAEEYSQQMAERGHGMYYTPQTFAQYPTQMYQYPFQGHHTDTSASQQSFGGVAETQAHFSWPIMTPSQQYHGPIPTPNAPLGTQWNVPGQIPNTGDLFGVEMRSIHLAMAGLN

SEQ ID NO: 164257 - protein, 83 aa, Glycine max
  Coding DNA Sequence Number=SeqID_72572
MEWEKEAWKRERKRETKAISFRRIKVLLSGDGDGKMLFGGGWSLVTVDEGWEEMCYLVVIRGWSCWGVGDYGGAVTFKGDCGD

SEQ ID NO: 164258 - protein, 172 aa, Glycine max
  Coding DNA Sequence Number=SeqID_72573
  Gene Ontology: Mol. function=methyltransferase activity
  Homolog annotation: Hit_ID=A2Q1F1; Match level="QueryCoverage=39%, HitCoverage=25%, E-value=1e-20, Identity=58%"; Hit description=SAM (And some other nucleotide) binding motif
MPGGVVDSAASPRFVVTSPGSRGRVESPTSGDLSDAFEEKIVVLLGILCEMHDFQEQVEPIVAMSVQIGDGDDDVVLEALLPEGMIIPSAFETLVALDKNKPSIQTIVNKIDTIQNEYKTIQLEVLAGNHSLVTTVVENGIRFARKKDQMEEVKHKNICIPVTVLNQGNLDS

SEQ ID NO: 164259 - protein, 119 aa, Glycine max
  Coding DNA Sequence Number=SeqID_72574
MDSCKPTGTLVECKMKLSKFDKAEKVDATNFKSLPQDQVVGIFTKQLKQEDSIKLRSLLGMVWLAILSHQKATYAIFSHHSLVHIANQGYYFIPWNKDNAHQNCRGTEEVQNNIIPDPK

SEQ ID NO: 164260 - protein, 252 aa, Glycine max
  Coding DNA Sequence Number=SeqID_72575
MVMRTEYKLHLIEGLVLPNSVVEVCLVELRPWTMVVVVAASERTKRAYQGRALDFVNLWGLPSAEIGFDKFTMQVVVFLHTWHSPWVACTRDDACAHISWVARTGGLVGCLCAHITRRRWHVLEVCSMLLHICDSLWVTYTGVMVGYDPEGTFPVGAKLSHLGIFSGFTSNSPHEALRLVKSSTQGLEDDSEVFVSLSFELSVDVGDNGLWETVPLDESMATSKYLTTVGAFGSGPSMFIPYMAKGQGELRL

SEQ ID NO: 164261 - protein, 77 aa, Glycine max
  Coding DNA Sequence Number=SeqID_72576
MTHIRGATKNYRKIIDEDMARTKGKESLEGLGGPMTRPRTKKAKEPLQEVLTMLFEFRPKLQVKKLRIVNCTMFQEE

SEQ ID NO: 164262 - protein, 240 aa, Glycine max
  Coding DNA Sequence Number=SeqID_72577
  Gene Ontology: Mol. function=transcription regulator activity; Cellular component=nucleus; Biological process=regulation of transcription
  Homolog annotation: Hit_ID=A7QGX8; Match level="QueryCoverage=51%, HitCoverage=39%, E-value=4e-20, Identity=44%"; Hit description =Chromosome chr3 scaffold_95, whole genome shotgun sequence
MSMKKLGSMKNEDERVKVLENENKRKTTYSKIFIKKSQVCSREEATSSCETNSNYRSTPPPLPQVEARMLEKEVLIGIHCQKQKDIVLKIMALLQNLHLSLASSSVLPFGTSTVKVTIIAQVAVHDVLIVEVGLLTFGLMIVEDRAVQSVWIMVWCLEEKKVGEGWVQSIGDEAANEVGNNYDSCHHFMKLVVTARSVWGAHFTVRLDSSLGLTARSGTRRVPMGLHSVDNGDVKHYVSL

SEQ ID NO: 164263 - protein, 55 aa, Glycine max
  Coding DNA Sequence Number=SeqID_72578
MKLQFAKFCKKRKKRFCTRGYQMCKTERENHPILGGDEFIGVEKMRDKKKREKDR

SEQ ID NO: 164264 - protein, 82 aa, Glycine max
  Coding DNA Sequence Number=SeqID_72579
  Homolog annotation: Hit_ID=A7PVR3; Match level="QueryCoverage=65%, HitCoverage=6%, E-value=6e-07, Identity=46%"; Hit description =Chromosome chr8 scaffold_34, whole genome shotgun sequence
MSSSGRGEDGVECGVERVERGFHDDGACGEGGVCASDEGWFSQELPTPRCCPGAMESTVMADLKVGMCEGEGENVNGVRVNE

SEQ ID NO: 164265 - protein, 207 aa, Glycine max
  Coding DNA Sequence Number=SeqID_72580
MENNPSRAQKKAKSSKRKQGECSQAALTKLDTCGSLSKGLTFHLLEAHSLSKLMQMKGTFYLELVKVFYTCARADLEVWKAVAGLDMGGVRKFEESDDGYNKMQTYRGMLLDLTRNLRNCLVTDDDLQIVYGLKYGIKMNWVLWIEDIMLKSHRLVDYEFLYVVLASIFIDYFNVDVSNEIVDFTKASSEITKRNLKKNGMMFVEHE

SEQ ID NO: 164266 - protein, 59 aa, Glycine max
  Coding DNA Sequence Number=SeqID_72581
MTTNSNQSHEDNEEEVEPDSLITTIPPYYIPPYTHNAEEFNFEDFECGHYTSLQVSSGK

SEQ ID NO: 164267 - protein, 216 aa, Glycine max
  Coding DNA Sequence Number=SeqID_72582
  Subcellular localization annotation: CTP_CleavageSite=33; ConfidenceScore=5.20e-01
MTLQLNFYADFSSAMVKMGNLSPLTGKSGLIVLIAARQEPTSSQSSITIVIVQLDPSLASSPSQANNGPSPQTSSSSSESSPTNNDPKPAQVSLQPTLPYRQQQSSQTQSVTIELVQLDPPPQPSPQQIPSPSQTNINPEQGQPSTQQTPTNNSNSTPPASPSNGHVQPLTSQNIITSENQGHANRWNRFERFCRMYLLDDGNWMVDIKTREQLRE

SEQ ID NO: 164268 - protein, 428 aa, Glycine max
  Coding DNA Sequence Number=SeqID_72583
  Gene Ontology: Cellular component=chloroplast envelope
  Homolog annotation: Hit_ID=O80503; Match level="QueryCoverage=100%, HitCoverage=100%, E-value=2e-98, Identity=45%"; Hit description =Expressed protein
MAKLKTGIDSAFWDLNVASPQLHDGWAKSVPGDPFPLDGSVASRVLRPRQLSVIGNGLPLPVIIPSLSPTSPKDLGSFSLQSLLLKLANPRWWLTMTGQFRPRKLIADVKNEISNAEEFDLSTVKDVVKHFINKSLYSFGLTSQFAFPPSTSLLLAIEGHGEKERLRRKMMLKRQHSLQLHDHDLTLEAAWPQLFVDHKGKYWDVPESLSVDLSSLVSESGLRYHFGIHKNGGNPQAMNATDGNPPLSLLPGLCAKVAVSYEKIKYFWRDKGAAEQENEEALPYDVRLKEPHAAVAPLLPGFGMEGACLASIQEKIKRVDARLDISSASAFAKKILNGSSSSTADVSKQPSASPRLNLIFQQQVAGPVVFRADSRIALESFARKNGVSVEDFICSLSYSLKDLQSGKIVAWYSPKRKEGMVEFRMYEF

SEQ ID NO: 164269 - protein, 35 aa, Glycine max
  Coding DNA Sequence Number=SeqID_72584
MELMTKGRTKQSENTRQGLSGEGRRPRGTPKNLDC

SEQ ID NO: 164270 - protein, 322 aa, Glycine max
  Coding DNA Sequence Number=SeqID_72585
  Gene Ontology: Mol. function=receptor activity; Cellular component =late endosome membrane; Biological process=protein transport
  Homolog annotation: Hit_ID=A7QCS8; Match level="QueryCoverage=99%, HitCoverage=31%, E-value=1e-150, Identity=83%"; Hit description =Chromosome undetermined scaffold_79, whole genome shotgun sequence
  Pfam annotation: Domain name=Clathrin; Domain location=1-182; Score= -11.6; E_value=0.034; Accession=PF00637.11; Description=Region in Clathrin and VPS
MFLTSDKREIELSPDEVVTTIDPQKAEILQRYLQWLIEDQDCNDTQLHTLYALSLAKSAIEAFESENISENLDSGNIETRSLAMLKNSIFQIPVRERLQIFLQSSDLYDPEEVLDLIEGSELWLEKAILYRRLGQETLVLQILALKLEDSEAAEQYCAEIGRADAYMQLLEMYLDPQDDKDPMFTAAVRLLHNHGESLDPLQVLEKLSPDMPLQLASDTLLRMFRARVHHHRQGQIVHNLSRAVDIDARLSRLEERSRNVQINDESLCDSCDARLGTKLFAMYPDDTVVCYKCYRRQGESVSVSGRNFKEDILIKPGWLVSR

SEQ ID NO: 164271 - protein, 446 aa, Glycine max
  Coding DNA Sequence Number=SeqID_72586
  Gene Ontology: Mol. function=pyridoxal phosphate binding; Cellular component=cytoplasm; Biological process=amino acid metabolic process
  Homolog annotation: Hit_ID=A8G9C3; Match level="QueryCoverage=100%, HitCoverage=100%, E-value=0.0, Identity=87%"; Hit description =Aminotransferase class-III
  Pfam annotation: Domain name=Aminotran_3; Domain location=35-388; Score=410.3; E_value=2.8e-120; Accession=PF00202.12; Description =Aminotransferase class-III
MAAENHPLNSLDAEGLEAHWMPFTGNRNFKAQPRIITQAAGTYYTSHDGRKIFDGLSGLWCCGLGHGRQEITDAAQRQLATLDYSPAFQFGHPLSFELANKIKALTPAGLDYVFFTGSGSEAADTSLKMARAYWRAKGQAGKTCFIGREKGYHGVNFGGISVGGIAGNRKTFGAGAEADHLPHTLLAGNAFSRGMPQQGAELAEELNRIIALRDASTIAAVIVEPFSGSAGVIVPPVGYLQRLREICTQHDILLIFDEVITAFGRCGAMTGAEAFGVTPDIMNIAKQVTNGAQPMGAVVVRPEIYQTFMNGGEPDYQLEFPHGYTYSAHPVSCAVALATLDILQREQMVERVQALAPYFERAVHSLQGAKHVADIRNIGLAAGITLAARPGEPARRPFEAAMRCWESGFYVRYGGDTLQLAPPFISSEAQIDALINAVGDALNATE

SEQ ID NO: 164272 - protein, 71 aa, Glycine max
  Coding DNA Sequence Number=SeqID_72587
MYVNVCRDDSRGTPSPGPRESHLTDLSSLAHEAPGFVFVARTRRPGARGAVVIPSLPTVHLRKPCYDFSFL

SEQ ID NO: 164273 - protein, 107 aa, Glycine max
  Coding DNA Sequence Number=SeqID_72588
  Subcellular localization annotation: CTP_CleavageSite=60; ConfidenceScore=5.68e-01
MQTQSFTNPQFLKISLTHKKFPSGVANCRNVPFCGRARRGSRVRFPKEERCAESPPTFICGKRRKNQRKLVKMKILSSGVVFTLEEGRQKRGFCSYVPSIEEEIRPT

SEQ ID NO: 164274 - protein, 120 aa, Glycine max
  Coding DNA Sequence Number=SeqID_72589
MGGGAKEGQRTQEQWLKAHVQGLDWLPSLRTAKTEEVEAPEEDEEVQALRAELEQAQTVKERFKSAALKIRKENAELRDINIATARALEQETKRARKAEHGRDKFRGALWGSNNELKLRM

SEQ ID NO: 164275 - protein, 194 aa, Glycine max
  Coding DNA Sequence Number=SeqID_72590
  Pfam annotation: Domain name=Transposase_23; Domain location=73-143; Score=14.0; E_value=3.5e-05; Accession=PF03017.5; Description =TNP1ENSPM transposase
  Subcellular localization annotation: CTP_CleavageSite=56; ConfidenceScore=5.19e-01
MTMITNSSSVAAAIGCPEHPGAGVTIKQYFGSTPRTSRSSSSLPPKELQQLTQQIRDQLEESITERGTRDPETGDSDKCGLYIEADPARLVAMGRVYEGSTVVHNTPLLPGQVKVSVEEVTDADAPVPLPTDEVSLVGQALHTFLDWPTHLVKFLSQQLAVSPAKPPPKPDPEVDDPLYLMTLTIPEHFLRPYQ

SEQ ID NO: 164276 - protein, 30 aa, Glycine max
  Coding DNA Sequence Number=SeqID_72591
MVRVDARPVISMLSPRIQLQTIKKHYWEAA

SEQ ID NO: 164277 - protein, 141 aa, Glycine max
  Coding DNA Sequence Number=SeqID_72592
  Homolog annotation: Hit_ID=A5BP71; Match level="QueryCoverage=53%, HitCoverage=19%, E-value=5e-12, Identity=48%"; Hit description =Putative uncharacterized protein
  Pfam annotation: Domain name=zf-CCHC; Domain location=114-131; Score =18.9; E_value=0.0021; Accession=PF00098.14; Description=Zinc knuckle
MKDKYIVQSLLKNLEKIKNKLVRTSFACMISTPQACGYVSINYYQYIDVVYTNEHILKAYSAQWWPLGNEAAIPPSNDAWTLIPDPTTIRAKGRPKSTRIRNEMDWVEPSEHRQKCSRCGAEGHNRRRCPMQSEHGSCSNH

SEQ ID NO: 164278 - protein, 52 aa, Glycine max
  Coding DNA Sequence Number=SeqID_72593
MWSRQLSQPTLRREGDAGLVGASSKKGKCAELPPMFIRGKRQKNQKGVVYKL

SEQ ID NO: 164279 - protein, 201 aa, Glycine max
  Coding DNA Sequence Number=SeqID_72594
MKTVISIPLINCDFAGGEHHQDSCYFYSINNFDRRQEPVMYNYHKKGRDLDLENVLADFMTYQASSKGDYYSMQQRGTQFERDYSSADYQWESEWQPYYHNEAEGLSNLDDMLMQFKDTIDLMQQAFKRTETQIGKLVDDMTKVVVRKEEEYAEIEAHQESILQVTKIHHQLINEEEKDEVSRTPEYPCMAIVGYVVGKDK

SEQ ID NO: 164280 - protein, 132 aa, Glycine max
  Coding DNA Sequence Number=SeqID_72595
MGLSTSRMSSEACMPPNNGPRTKLGYKQTMLGLYTHFSRKMIENHVNMVVEVLVIKIFILANIGSHQAHAFKKRFSSSQGQVWKKKCTLRCPYRTRAKARVMSELEEVQEQTKVDMEAMKEQMTKMMEAMMS

SEQ ID NO: 164281 - protein, 191 aa, Glycine max
  Coding DNA Sequence Number=SeqID_72596
MDDQKETQEQMKVDMLALKEQMASMMEAMLGMRQLMEKNVATTAAVSSTAEADPTLLATSHHPPPNAVGRERSTLGHTNNPHLGYNRVAYPYGLPPNYMPPVMNDDASHVSSPILEREPPRQPDEVHEDHREYAQGDVDYYPPDPRRGVGTQHIDSAQPHSTTNILVHRRTTPDGRRKKETRSPLGEIESY

SEQ ID NO: 164282 - protein, 191 aa, Glycine max
  Coding DNA Sequence Number=SeqID_72597
  Gene Ontology: Mol. function=helicase activity; Biological process =viral genome replication
  Homolog annotation: Hit_ID=Q9LX60; Match level="QueryCoverage=64%, HitCoverage=6%, E-value=5e-18, Identity=38%"; Hit description =Putative uncharacterized protein F4M19_60
DSVHASVNPASSHTEDHYNQPKTPPHSVHATVNRASHDAEDHFNVSGSSENENSRSIEESQTISSVGYLNCESPHHDSSMDAGEYFDLGDQLMQYRHCNAKMWFNESILKCSNTLSPRFSLCCGDDKVKLPLLQNPPKFLQQVLFEQNTAHAKNYQQNIRTYNMMFAFTSAGIKFDKTISPSRGPPTIRIQ

SEQ ID NO: 164283 - protein, 100 aa, Glycine max
  Coding DNA Sequence Number=SeqID_72598
  Homolog annotation: Hit_ID=A5CA23; Match level="QueryCoverage=68%, HitCoverage=27%, E-value=7e-09, Identity=36%"; Hit description =Putative uncharacterized protein
MKKSDWKTFKDKKAKKTYITWEDNDMDSSGDSENEIVNLSLMTKNYESEEDDFLKKSWYIDSGWSKHITGDASKFTHISPKNSGHVTTTKIKHQIMFNAF

SEQ ID NO: 164284 - protein, 155 aa, Glycine max
  Coding DNA Sequence Number=SeqID_72599
MAPKKLYTKRSRRDTIREGSNAASEFDSHRFQSVEHQQRFGAIRGWSFHRERRVQLREDEYTDFQEEIALRRWTPLVTSMAKFDPEIVLEFYANAWPTEEGVRDMHSKANSVSSARGGAGPTVSMRKPSPSCCAYRGRIFPEPLYGGGCGSCTPA

SEQ ID NO: 164285 - protein, 75 aa, Glycine max
  Coding DNA Sequence Number=SeqID_72600
  Gene Ontology: Mol. function=aspartic-type endopeptidase activity; Biological process=DNA integration
  Homolog annotation: Hit_ID=Q69FA4; Match level="QueryCoverage=89%, HitCoverage=5%, E-value=2e-20, Identity=67%"; Hit description=Gag -pol polyprotein
MGVTIQVNKDMVRLRFIIANYYCWIMNEEKDIKVQINEYHKLLEDLKTENIYFPNEFIFELLIKKLSESWTDYKQ

SEQ ID NO: 164286 - protein, 72 aa, Glycine max
  Coding DNA Sequence Number=SeqID_72601
MGEKLATQLAQASLACPGEQGCFLQKQQPSGGRSWKAQLSKKLWKLTDCAKTSLFDFRHITEFHGSCKPASF

SEQ ID NO: 164287 - protein, 98 aa, Glycine max
  Coding DNA Sequence Number=SeqID_72602
MESPTVATYPSAGGRRETHGCVFQGRKMRGVATNVYLRKMLEKPKVGLRILRTKVWELFTCEEERGSCSYVSSIAMRNSDLRSSFKARKLCGVLILDF

SEQ ID NO: 164288 - protein, 257 aa, Glycine max
  Coding DNA Sequence Number=SeqID_72603
  Gene Ontology: Mol. function=transcription factor activity; Cellular component=chloroplast; Biological process=regulation of transcription, DNA-dependent
  Homolog annotation: Hit_ID=A4WD78; Match level="QueryCoverage=82%, HitCoverage=67%, E-value=7e-79, Identity=69%"; Hit description =Transcriptional regulator, LysR family
  Pfam annotation: Domain name=LysR_substrate; Domain location=41-243; Score=142.7; E_value=1e-39; Accession=PF03466.11; Description=LysR substrate binding domain
RLVERTGRGIRVTAAGEALLAHGERIQQAVDEAIRAVSAFSHDVSGTITLGTGATACIHLLPPLLEQLRRDYPLLNVGVTTGNTLDIVRAIEENRLDMGLVTLPVSSRALDVLPVMEEEFVFIASREQQEAFRAFTPEALYAHPLIAFESGSGTRALIEGWFAASGSGIAPVMQLGSIEAIKRMVRAGLGYSIVPRMAVEQEADRDGLCVSAKLSGELAVSRVDGQAGLLRLEFVLMVIPGANRRVNEAAKEKEEAD

SEQ ID NO: 164289 - protein, 189 aa, Glycine max
  Coding DNA Sequence Number=SeqID_72604
MELIEDMVVSDHAILSDRAHIPTKRSLLELSSQDALLAQNKLLPKKLEALTETLSCAICGGAHEFGYCISTKDTTHEVNYIGNQPRSNFNANQGGPSNRPQQQGPSLYDKTTKLEETLAQFMQLSMSNQKSTKPAIMNLEVQAVMTRSKMVSMNEGEKMIGEEKQQLVTEPAIDPVVEPLSGTEEESGK

SEQ ID NO: 164290 - protein, 125 aa, Glycine max
  Coding DNA Sequence Number=SeqID_72605
  Gene Ontology: Biological process=DNA packaging
  Homolog annotation: Hit_ID=P03708; Match level="QueryCoverage=77%, HitCoverage=15%, E-value=1e-52, Identity=95%"; Hit description =Terminase large subunit
  Subcellular localization annotation: CTP_CleavageSite=25; ConfidenceScore=5.05e-01
MTMITPSLHAGLCSRRASAWPKSIRGSTPKVRGTCQIERAASESPHFMRFHVACPHCGEEQYLKFGDKETPFGLKWTPDDPSSVFYLCEHNACVIRQQELDFTDARYICEALGLGPAPAATEYHE

SEQ ID NO: 164291 - protein, 45 aa, Glycine max
  Coding DNA Sequence Number=SeqID_72606
MAEEQPRRVTLEDYSSTFVPQFFTSIAWSKHKPVPTSSPQATCGP

SEQ ID NO: 164292 - protein, 79 aa, Glycine max
  Coding DNA Sequence Number=SeqID_72607
MPVYPSWYSKTKKKESNEVRKKHGKELENHGEARVMQEEVECDGVDGGKQVSRRTYIKLDIITYFFASFQLSAGGDECF

SEQ ID NO: 164293 - protein, 121 aa, Glycine max
  Coding DNA Sequence Number=SeqID_72608
MGEKHVQFHQTPKKLKWVVGNRLKDRNFALNFKHLDAVGKWEKRVASASATERREDYKGDREVSRIEVPCGKGDMVSFALGYGRNEASRRDEGGGRKQCRTMVRVDMQGKPLMVMEKQWFY

SEQ ID NO: 164294 - protein, 137 aa, Glycine max
  Coding DNA Sequence Number=SeqID_72609
  Homolog annotation: Hit_ID=P93204; Match level="QueryCoverage=23%, HitCoverage=4%, E-value=4e-08, Identity=81%"; Hit description=SBT1 protein
MSTERHVNYRYDVLQTLQQCQQLLLCKLVIPSTHVASTAASSAVSNATLLGYAIGTAHGMASQARMAAYKVCWTGDCFASRSPLRPIELVRQHLHVWFAQPEERAQDDTRKHDGERRGTGGGQSLGGRRCGGGIRGG

SEQ ID NO: 164295 - protein, 410 aa, Glycine max
  Coding DNA Sequence Number=SeqID_72610
  Gene Ontology: Mol. function=beta-pyrazolylalanine synthase activity; Cellular component=cytoplasm; Biological process=cysteine biosynthetic process from serine
  Homolog annotation: Hit_ID=A3RM06; Match level="QueryCoverage=62%, HitCoverage=66%, E-value=8e-61, Identity=51%"; Hit description =Cysteine synthase
  Pfam annotation: Domain name=PALP; Domain location=50-352; Score =113.8; E_value=5e-31; Accession=PF00291.16; Description=Pyridoxal -phosphate dependent enzyme
MWELSVRNRVKEDLFQAKKEAHLVVDKFFLGFILTIQCSGATKIASNWKHSIVCGLHCCKVGINGTLLKCQRQEFRIALSMIEDAEDNGLITPGMTVLVETTGGNTGIGLTFIAALKGYRLILAMPALMSLERRIVLRALGAELHLTDPAMGFRSSLQKAEELLRETCDAFMSHQFENPANPKIHYETTGPEIWRDSGEKVDALVAGIGTGGTITGAGKFLKERNSKIKVPFLVNTFLWIEESLKCMQLPSLLMLCVFIKVYGVEPVESAVLSGGQPDCKPDMLHECVKGGHLIQGIGAGIVPAVLDSAKCISLKTAQLIQSAQVLLFILANSITLPRKGVTDHPSSHQVSKSKDVIFHEIEYFFVAPQPQGKCNWLSELSKFGKLDLDFPLLNCLYILMQLKELIVCLE

SEQ ID NO: 164296 - protein, 59 aa, Glycine max
  Coding DNA Sequence Number=SeqID_72611
MKQYNTCFYQNLKPWHIRVDMIKWGPELHTSTLRDVFYRRGTYKTWDSDAQGLLLGAYR

SEQ ID NO: 164297 - protein, 570 aa, Glycine max
  Coding DNA Sequence Number=SeqID_72612
  Gene Ontology: Mol. function=ATP-dependent helicase activity; Cellular component=nucleolus; Biological process=ribosome biogenesis and assembly
  Homolog annotation: Hit_ID=A7QMH0; Match level="QueryCoverage=84%, HitCoverage=95%, E-value=1e-165, Identity=63%"; Hit description =Chromosome chr19 scaffold_126, whole genome shotgun sequence
  Pfam annotation: Domain name=DEAD; Domain location=86-255; Score =216.5; E_value=6.4e-62; Accession=PF00270.20; Description=DEADDEAH box helicase
  Pfam annotation: Domain name=Helicase_C; Domain location=325-401; Score=116.2; E_value=1e-31; Accession=PF00271.22; Description =Helicase conserved C-terminal domain
  Pfam annotation: Domain name=ResIII; Domain location=82-250; Score= -17.0; E_value=0.0013; Accession=PF04851.6; Description=Type III restriction enzyme, res subunit
  Pfam module annotation: Pfam domain module=DEAD::Helicase_C::ResIII; Domain location=86-255::325-401::82-250
  Subcellular localization annotation: CTP_CleavageSite=57; ConfidenceScore=5.48e-01
MEQPQLLHDPNFPLFKTPSSPAVTTTATHKPLSTTPITTTSNGERREDHSVETAATVAADAEAFGDLGLAEWAVKTCRELGMRRPRPVQRRCIPRVLEGRHVLGIDETGSGKTAAFALPILHRLAEHPFGVFALVVTPTRELAFQLAEQFRALGSAVHLRITVVVGGMDMLRQTKELAARPHLVIATPGRIHALLRNNPDIPPVFSRTKFLVLDEADRVLDVGFQEELRFIFQCLPENRQNLFFSATTTSNLQKLRERYQDKMYVYEAYEGFKTVETLKQQAIFIPKKVKDVYLMHILAKMEDMGIRSAIVFISTCRDCHRLSLMLEVLDQEAAALYSFKSQAQRLEALHQFKSGKVSILLATDVASRGLDIPTVDLVINYDVPRFPRDYIHRVGRTARAGRGGLALSLVTQNDVDLIHEIEALIEKQLEMIEYKENEVLSLMKKVFSAKNVAEMKMIDDGFEEKAKERKKQKLKMLADKGLLNKRSKKRKRNKEFAEEGEEQKNEVFTVRNVTEMKRMDEDGIEEKAEEGGIQKLKMRTQKDEGKKQKKEKVEALADIETPKKRSKKRQ

SEQ ID NO: 164298 - protein, 84 aa, Glycine max
  Coding DNA Sequence Number=SeqID_72613
MDGRDSEVEECAFEIEECVELCSGERKRESAFLRASFSGRRVVDDESSDIQRAFSGPRGEKIVVAAAFVWTTATFLGVDSSACA

SEQ ID NO: 164299 - protein, 157 aa, Glycine max
  Coding DNA Sequence Number=SeqID_72614
MGNLFGKNKKRDTESANNNKGRGGRIYTAVTTRGLPPHFPTQLPHSQPPPLLYPTLEPPPPPPPPPPPPALPQSMSKKPSFARVFAKQSSSVMNNNQSAAKKYALIRDNFSTLEQRSEKLACKSNCKKKYGSLAPSVTGATHVAINSCQIKIVVLRV

SEQ ID NO: 164300 - protein, 105 aa, Glycine max
  Coding DNA Sequence Number=SeqID_72615
  Subcellular localization annotation: CTP_CleavageSite=23; ConfidenceScore=5.39e-01
MSFFISFLYRDLSITGNCIPLATATHKRSRGKARPETPTARSCTRSTTLLRFLTFSTAPQDCGYCHIGLEGGWMRWKDAEKELSHACLECHGKMLTQVFLVGSEL

SEQ ID NO: 164301 - protein, 100 aa, Glycine max
  Coding DNA Sequence Number=SeqID_72616
MSPHGGDMDGGEKRKERDGVSLAFGIAGPGGRPARRAISSVVERAPDNCVVVPGLVRFGLNGKNGAPNNVSSQTKNYEIAPFILGDQEIGSSHKKNRMLG

SEQ ID NO: 164302 - protein, 102 aa, Glycine max
  Coding DNA Sequence Number=SeqID_72617
MWSHQLSQPTLQREGDAGLTGASSKKGKCVESPPTFIQGKRWKNRKGCGLRTLSVKGSGVVFTHREGFKRGYDVKDRLDFILTGTKRYYNSNDRWKFILLLD

SEQ ID NO: 164303 - protein, 598 aa, Glycine max
  Coding DNA Sequence Number=SeqID_72618
  Homolog annotation: Hit_ID=A7MNJ6; Match level="QueryCoverage=28%, HitCoverage=61%, E-value=6e-69, Identity=73%"; Hit description =Putative uncharacterized protein
  Pfam annotation: Domain name=Serglycin; Domain location=107-236; Score=-59.1; E_value=0.078; Accession=PF04360.3; Description =Serglycin
MAGAFFHHRDATRSGEFTTERGGWATARRDSAGLAPDPQRFASEAIVQVYAAPTYGWKGAVAVHPWIIFKRAGETRYNRYEVISWGSGDKVRRNSNLPDGYWYGARPRLLVSHRGAAAQAMIPQIEAAIQSYPWPNTYHAWPGPNSNTFLAHIGREVPALKLDLPANAIGKDFPVAARRAGRHAGSGRGRGGESAGTESGAGFHPVASAAAVYRRNAEIPVFMIEIDAVGLHLDLFFDRIVNAGAPQRIARNAQHLHFWTTVAVQQKQRGQTEEDKEAAGIGDGGDQYAGADRRVAFEFGHNQRNQHAHQRRQQQIQHHRQHHHAAQLQIVVHQPGYAAHDAAPEQAVKQRHAEFTRNQKRKVAGFNLMQRQRAHDHGDGLIAGITANAGDNRHQRGQRHQLRNGVLKQTNDARGDKRRTQVNGQPGPALSYRFAHRCKHVFTLADAAHLTDVAFVLFVHQVNHIFHGDTANQLAFGIGHRSRDQVIAFEGAGGLFRFVIQLESGYRSAPVHPAADCVRRPTKILSVPSGMLLRLRRKRCTVASVTSERTAGIERGEQAAGEIAWQITRQIDLIVNIQRLDGAQDFAVGHLFRQAGPH

SEQ ID NO: 164304 - protein, 49 aa, Glycine max
  Coding DNA Sequence Number=SeqID_72619
  Subcellular localization annotation: CTP_CleavageSite=13; ConfidenceScore=5.09e-01
MSSSAPFVNPGTMSQVAGGDTLWLSAPFVNQGERVRRFLLSSSRDIQAR

SEQ ID NO: 164305 - protein, 112 aa, Glycine max
  Coding DNA Sequence Number=SeqID_72620
MARSGDGGGDYHQLEESQHLSLNVMTTQMQQLLSCNNKELYRRIEGLENQINPNAGRPFGGNRRVNNGPNRIEGQNKIEGVKLNVPHFKGRSDPDAYLDWEMKIQHAFSCND

SEQ ID NO: 164306 - protein, 98 aa, Glycine max
  Coding DNA Sequence Number=SeqID_72621
KSNKVLGFPALITGLCQFYKVPVAPNKVIRPPTNRTFIKKYCAARQAQGETPQQPGDGQQRATDAPLPPPKPLSSSTKARALPMTRGRPAGDQVQSQR

SEQ ID NO: 164307 - protein, 64 aa, Glycine max
  Coding DNA Sequence Number=SeqID_72622
MTTHKRKLKGNGRISMGRNVSALIGKSVPHIPEKCKDLDVVIHLANRSVAYPAGFVEDVLGSGW

SEQ ID NO: 164308 - protein, 258 aa, Glycine max
  Coding DNA Sequence Number=SeqID_72623
  Gene Ontology: Mol. function=oxidoreductase activity; Cellular component=cytoplasm; Biological process=metabolic process
  Homolog annotation: Hit_ID=A6TFC4; Match level="QueryCoverage=97%, HitCoverage=100%, E-value=1e-100, Identity=75%"; Hit description =Oxidoreductase
  Pfam annotation: Domain name=Epimerase; Domain location=12-253; Score= -66.3; E_value=0.031; Accession=PF01370.12; Description=NAD dependent epimerasedehydratase family
  Pfam annotation: Domain name=KR; Domain location=13-196; Score=-55.6; E_value=0.00041; Accession=PF08659.1; Description=KR domain
  Pfam annotation: Domain name=adh_short; Domain location=10-182; Score= 89.7; E_value=9e-24; Accession=PF00106.16; Description=short chain dehydrogenase
  Pfam module annotation: Pfam domain module=Epimerase::KR::adh_short; Domain location=12-253::13-196::10-182
MTKGFLMTQRIALVTGGSRGLGKNAALKLAAKGTDIILTYHSNQQAAREVVREIEQTGAKAAALPLNVGDTASFAGFVQQLTQCLKEKWQRDSFDYLLNNAGIGLTAPFSETSEGQFDELMNIHFKGPFFLTQQLLPLLKDGGRILNVSSGLARFALPGYSAYAAMKGAMEVLTRYQAKELGARGISVNIIAPGAIETDFGGGAVRDNAPLNQHIAAQTALGRVGLPDDIGDAIAALLSDELGWMNAQRVEVSGGMFL

SEQ ID NO: 164309 - protein, 94 aa, Glycine max
  Coding DNA Sequence Number=SeqID_72624
  Pfam annotation: Domain name=zf-CCHC; Domain location=75-92; Score =31.8; E_value=2.5e-06; Accession=PF00098.14; Description=Zinc knuckle
EHEMELQRLNQNEETDKRKRSVALKATSSLQEEEEDEEDFSLFVKKFHKFVKMRRIERRQNFNHGKRFQEDSPTLRCYKCNQIGHIKANCPSNE

SEQ ID NO: 164310 - protein, 196 aa, Glycine max
  Coding DNA Sequence Number=SeqID_72625
  Homolog annotation: Hit_ID=Q6WAY4; Match level="QueryCoverage=85%, HitCoverage=30%, E-value=5e-21, Identity=36%"; Hit description =Putative uncharacterized protein
MGTNQIGKRFYQVKIKGLDVTSLKELGRLMGSLQRKAFRRVYGKILDLAIAEVFTKAVVSLAQYYDQPLRCFTFGDFQIVPTVEEFEEILGCPLGGRKPYLFSGFLPSLSKIAAVVRDSARELDRMKQTRNGIVGLLWKYLEGKARDMANQEEWVPFADILALLIFGVALFPNVDGLVDLAAIDAFLAYHHSKESP

SEQ ID NO: 164311 - protein, 101 aa, Glycine max
  Coding DNA Sequence Number=SeqID_72626
MTLIEAPRSSMASVKVQSLMVQETLKVSGSLHFNGKVDGGMAMTKVIKLAILGRLVRLRKLDSYNRIVNSHWTINDLLGWSTKAGLLLLRILNCDEEIRST

SEQ ID NO: 164312 - protein, 117 aa, Glycine max
  Coding DNA Sequence Number=SeqID_72627
MEKAFPSQPVPLPTDEVSLVGQTLHTFLAWPTHLVKSLSQQVVVSPAKPPPKPDDPLYLMTLTIPELFSRPYQVRWDATVFGVFNLDFPLYIKHEDLSEIAHGGQCLSISVLQLWIL

SEQ ID NO: 164313 - protein, 83 aa, Glycine max
  Coding DNA Sequence Number=SeqID_72628
MITRGQDIYSSQDKATTSPSSSESEKAKGEESSEEIYPQEEGQPLVVKEKCKEVSVSSKRYYDAPNPYDRWYDECVEWCNPLM

SEQ ID NO: 164314 - protein, 130 aa, Glycine max
  Coding DNA Sequence Number=SeqID_72629
MWAFLIGRQIDWAHLVRYRMNKALRSNAPLPYPHLIYLFLHHFERDGSWIKKDAQPHDAEGCSPAREDSSLLQSVMDRFNSLQTYVGERFDSLESQVDIQFGEMDYRITKIEGDITFIRDCFDLPLPPST

SEQ ID NO: 164315 - protein, 354 aa, Glycine max
  Coding DNA Sequence Number=SeqID_72630
  Subcellular localization annotation: CTP_CleavageSite=51; ConfidenceScore=5.14e-01
MATTATPSRWATRTASPPPRWLPARCWWPARTDTGKGGGQPPPPVIMVRSPASEAVGRLHIHPSWLAGEMPVAFNEATGRVHLVEQVLDVGLELPLLPRGLPAHVEHGVGLDRLPIQADALANMIRAKADGGVDRRQVITRPQSQLVARRIGESVAGGVGDAIRPGVLHPRIVVGVGQVQHPALGEVGQKVQLHAGTAHQAQRGQLVHATDHLAGGLHDVTAVDPVGRHVQGHTVGQQRLHAHFPLLAALGIERSASGRVLVGGTLRHETIGDVGVDIQALAHGERATQPPAEIVAIHAAATHAVLILEAIPAQSDQHMPARAQCQFVLQVAAIALAAGGRAAPGQGRQVVVVP

SEQ ID NO: 164316 - protein, 131 aa, Glycine max
  Coding DNA Sequence Number=SeqID_72631
  Gene Ontology: Mol. function=nucleic acid binding
  Homolog annotation: Hit_ID=A5C3F7; Match level="QueryCoverage=63%, HitCoverage=9%, E-value=2e-16, Identity=48%"; Hit description =Putative uncharacterized protein
MEKSEKKNFSEKKMKKAYITWDDNDMESSEDSENEEINLCLMAKIYESDEEKKKWYIDSGCSKHMMGDVSKFTHISPKKSGHATYGDNNKGRILGVGKIGTDSSTPLKMFYLLKALSTTCLVLVNYVIKAI

SEQ ID NO: 164317 - protein, 99 aa, Glycine max
  Coding DNA Sequence Number=SeqID_72632
EIFLRRFRGRTQEVPNQWYQNYDREHTKSTIQDLLVQQGLDQTLEDERSAFINETEWTKIQRRDVSRIRLALAPKIKHNMLKETTLKALWEKLENIYVS

SEQ ID NO: 164318 - protein, 72 aa, Glycine max
  Coding DNA Sequence Number=SeqID_72633
MEFGVMVARRGKLLLQPEVTLLAQLAFNTVSRLARIKRSTNDSPRTTLGYDKDIIINMFTIRNLKKKIWFGK

SEQ ID NO: 164319 - protein, 92 aa, Glycine max
  Coding DNA Sequence Number=SeqID_72634
MSFAIKIYNIRSVATYPSAGGRRETRGMRVPRKEYARSRHQRLFEENVGKTGKDAIYELLSERFGSCIYAWGRVFPFAPTYSSIRDEEIRPT

SEQ ID NO: 164320 - protein, 104 aa, Glycine max
  Coding DNA Sequence Number=SeqID_72635
MAAFHLCDAGLELAESIVVHHGRQRGISIFWGWLSPKTESCTNHKCGWPRGRFYYGPTVGAKCTYPNLEWTGDRVDCRQNGLHNLQCHTCRGLGSLIVGVVITV

SEQ ID NO: 164321 - protein, 133 aa, Glycine max
  Coding DNA Sequence Number=SeqID_72636
  Gene Ontology: Mol. function=aspartic-type endopeptidase activity; Biological process=RNA-dependent DNA replication
  Homolog annotation: Hit_ID=Q69F85; Match level="QueryCoverage=45%, HitCoverage=3%, E-value=2e-09, Identity=45%"; Hit description=Gag -pol polyprotein
MASEVEKLNWKHLIYRYNLPYVIVTDNGTQFKTYTYENFRTRRGIQHIVISIEHPQTNGHAEIGWNLKPPKKSKKWQGLEKKLPNSKLLGEMIQRFNREPFNLATSYGESEVKPEKIPERESLAPTGKVPSGS

SEQ ID NO: 164322 - protein, 139 aa, Glycine max
  Coding DNA Sequence Number=SeqID_72637
  Gene Ontology: Cellular component=chloroplast
  Homolog annotation: Hit_ID=Q49KT9; Match level="QueryCoverage=42%, HitCoverage=52%, E-value=6e-13, Identity=69%"; Hit description =Putative uncharacterized protein ORF113
MSPHGGDMDGGEKRKERDGVSLAFGIAGPGGRPARRAISSVEEDGAIQVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 164323 - protein, 333 aa, Glycine max
  Coding DNA Sequence Number=SeqID_72638
  Gene Ontology: Mol. function=transcription factor activity; Cellular component=intracellular; Biological process=regulation of transcription, DNA-dependent
  Homolog annotation: Hit_ID=A8GDJ4; Match level="QueryCoverage=100%, HitCoverage=100%, E-value=1e-149, Identity=79%"; Hit description =Transcriptional regulator, LacI family
  Pfam annotation: Domain name=LacI; Domain location=2-27; Score=51.1; E_value=3.8e-12; Accession=PF00356.12; Description=Bacterial regulatory proteins, lacI fa
  Pfam annotation: Domain name=Peripla_BP_1; Domain location=60-331; Score=206.6; E_value=5.9e-59; Accession=PF00532.12; Description =Periplasmic binding proteins and sugar
  Pfam module annotation: Pfam domain module=LacI::Peripla_BP_1; Domain location=2-27::60-331
MASLKDVAKLAGVSLMTVSRAINEPGKLRPETYRRVKQAIDQLDYVPDLSARRIRGDGNRVQTLGVLALDTATTPFSVEMILSIEKTARERGWNSFVVNLFADDNAEQTVDLLLAHRPDGVIFTTMGLREVTLPAKLLDKKLVLANCVSPAHSIASYIPDDEQGQYDAMRALIAKGYRAPLCIHLPADTLAAGLRRRGLERAWREAGRDVEQLRQYHLDLSGGDQSYRDCVALLERHFSAGRRDCDVVVCGNDRIAFLVYQVLLAQGWRIPQQVAVLGYDNMVGTGELFLPALTTVQLPHYELGRLAALHVIEQREQRETVKVPCPLLERGSL

SEQ ID NO: 164324 - protein, 433 aa, Glycine max
  Coding DNA Sequence Number=SeqID_72639
  Gene Ontology: Mol. function=transporter activity; Cellular component= integral to membrane; Biological process=transport
  Homolog annotation: Hit_ID=A8GDJ7; Match level="QueryCoverage=69%, HitCoverage=68%, E-value=1e-111, Identity=71%"; Hit description =Major facilitator superfamily MFS_1
  Pfam annotation: Domain name=MFS_1; Domain location=22-426; Score =43.8; E_value=5.9e-10; Accession=PF07690.7; Description=Major Facilitator Superfamily
  Pfam annotation: Domain name=Sugar_tr; Domain location=17-422; Score=- 36.6; E_value=1.5e-07; Accession=PF00083.15; Description=Sugar (and other) transporter
  Pfam module annotation: Pfam domain module=MFS_1::Sugar_tr; Domain location=22-426::17-422
MGTGMNQQTLDARRSRQALLAGSVGNFIEWYEFGVYGFLATVIAANFFTLQGENEITSLILTYAAFALAFFCRPIGAVIFGRIGDRIGRRPTLIAVLLLMTLATALIGVMPTYASIGVAAPLLLTLLRMLQGLFAGGEFGGAVSLMTEFAPKGKRGLFGAWQSLTVALGLLAGAGLVALLAALLSVQQLHDWGWRIPFLLALPLGAVALWLRLKLEETPTFTQAQQHAEHAAAPPEAKLGGVVKTILIGIGRMMGWSAAGYTFLVVMPSYLQTSLHATFQQALVATVLANVGFALTILPAGIVSDKLGRCAEFTVGQRAGGHDRRCRGRPAGRSRPGDAGGDVPDPGALYRLGAGLLAVQCGVFRLGRADYHRPHQTDRQYRHSRLLRGRHLGGQPVCADDAAPRRSSALAERTLILRGRIAPLPTRDLDHKA

SEQ ID NO: 164325 - protein, 146 aa, Glycine max
  Coding DNA Sequence Number=SeqID_72640
MEIIISIPPITYDFCRREHYQDNCYMYSTNNCGWRQELTPYNQYEEERAPDLDNYQREPESQFYYQKEAERSFNLDILLMQFKDTIGSIQRAFKSAEIQVGKLVEEMNQAMSRREEEIVEVDTQEESPMNEHDLEEEDEEKVKQRE

SEQ ID NO: 164326 - protein, 120 aa, Glycine max
  Coding DNA Sequence Number=SeqID_72641
  Pfam annotation: Domain name=DUF784; Domain location=23-120; Score= -27.5; E_value=0.003; Accession=PF05617.2; Description=Arabidopsis thaliana protein of unknown function (DUF784)
MATFSNISLMVLCFIISSSLMVKIGLSQDAPEPSNAPGPMSSYVKYLANCGSHLSPNCGDEVFSAIFFGNKTVSNGCCDKLVNDVGKVCHDDMTKYILTLPKFRAHKIQILKRSEKSTIG

SEQ ID NO: 164327 - protein, 69 aa, Glycine max
  Coding DNA Sequence Number=SeqID_72642
MESNIEVIYLRFQGNEIDANKLCKCFPTCIEGQQSHHNLNCKKHMLQLPASKKFEVPEILHNHTTICSI

SEQ ID NO: 164328 - protein, 94 aa, Glycine max
  Coding DNA Sequence Number=SeqID_72643
MFLIFNTSALKGLDDTPQLKSKAVARWIVVKCNRQKGITECGYYVMHWMSTIILGSFRNNWETYFNEVRPLEAERFKALRIQWAQYYLKVRNQT

SEQ ID NO: 164329 - protein, 44 aa, Glycine max
  Coding DNA Sequence Number=SeqID_72644
MAMGKSEEACPIGDARTDDDSQRKTLTEHHSIIGPIFVGKGLTL

SEQ ID NO: 164330 - protein, 216 aa, Glycine max
  Coding DNA Sequence Number=SeqID_72645
MKNSWWGKKLHPYNQYEEETTLNLESMFTEFVAYHASSKANQNSTQNQEIRVGKNYSMENCQWEQELQPYNQHEEERSSNLDNLLMQFKESTESTQQAFKSLEIQVGKLAKEVAKFMSTREENFVEVEAQEESLVEEHDSREKDEEKINTPPHQLIIKEERHGEHDKSLSVILSLNTNTSLAMIWKVFLEYMSFMESIAKRRKCKEDEFYVTFMPP

SEQ ID NO: 164331 - protein, 38 aa, Glycine max
  Coding DNA Sequence Number=SeqID_72646
MGEGYCTQPYPCICKEAVSGFEPMTNSIQAQVEQEFYS

SEQ ID NO: 164332 - protein, 110 aa, Glycine max
  Coding DNA Sequence Number=SeqID_72647
MKERRKTIAAWKVEEEEEPQGTTMNMNDDRKKKHRRKRKTNKKPRMKRKTKGRRNKKRKKKDIFAISPYMLGASTKMLGAPSNTLKTIVYISRKALDKCTSQFAKLTPSY

SEQ ID NO: 164333 - protein, 178 aa, Glycine max
  Coding DNA Sequence Number=SeqID_72648
  Homolog annotation: Hit_ID=Q2HTA0; Match level="QueryCoverage=68%, HitCoverage=23%, E-value=7e-13, Identity=31%"; Hit description=IMP dehydrogenase/GMP reductase, related
  Pfam annotation: Domain name=DUF1723; Domain location=90-139; Score =51.8; E_value=2.4e-12; Accession=PF08330.1; Description=Protein of unknown function (DUF1723)
MTAAHDEPVIPMPDVQDDPMEAPTAVEDIVADIPADTGTEAAEDEHEGFSGGPSNPSVLTQYADHVACSVWTGEERPELKLSSHGRKVNTDNRGLLSAFVKWWHRETSSFHLPVGELTITLDDVSSLLHLPVVGDLHAFEPLHVDDAVQMLVDLLMVSAESARAETAQCRGPSVRLQW

SEQ ID NO: 164334 - protein, 49 aa, Glycine max
  Coding DNA Sequence Number=SeqID_72649
MGSKIYPKVHENPKAFFISSSPILLESLAHGSGNRVMTSLTKEINAFMN

SEQ ID NO: 164335 - protein, 295 aa, Glycine max
  Coding DNA Sequence Number=SeqID_72650
  Gene Ontology: Mol. function=aldehyde dehydrogenase [NAD(P)+] activity; Cellular component=chloroplast; Biological process =aldehyde metabolic process
  Homolog annotation: Hit_ID=A7NVF3; Match level="QueryCoverage=96%, HitCoverage=58%, E-value=1e-124, Identity=74%"; Hit description =Chromosome chr18 scaffold_1, whole genome shotgun sequence
  Pfam annotation: Domain name=Aldedh; Domain location=2-253; Score= -128.7; E_value=1.4e-08; Accession=PF00171.13; Description=Aldehyde dehydrogenase family
MIPRSDNILYLMARIVMAAASKHLTPVVLELGGKSPVVVDSNINLKVATRRIIAGKWGSNNGQACISPDYIITTKDYAPKLVDALKTELEKFYGKNPLESKDLSRVVNSNHFNRLTKLLDDDKVSGKIVYGGQKDENKLKISPTVLLDVPRDSLIMNEEIFGPLLPILTVDKLEESFDVINSGPKPLAAYIFTNNKKLKEQFVMTISAGGLVVNDTTLHLAVHTLPFGGVGESGVGAYHGKFSFEAFSHKKAVLYRKFIGDAPVRYPPYTNTKMRLLKAIIGGGIHGIVRALFGW

SEQ ID NO: 164336 - protein, 182 aa, Glycine max
  Coding DNA Sequence Number=SeqID_72651
MISCFSGQLRWGPIVVRYRSERVMRQFGYVQCIHAHPVHSWVSYDDVDDTWTHYSDHLAVTGDLCVVPGQCAPDYIDWFFVISHPFMTAPQTDPPRDAYATQPSHIPHEAALTSTHMDPDADEPRHVVACHAIAEALEQHLNAPDTSTHEEVIQKCLRIARGVTEDRNVYVRSRHRRRTDQQ

SEQ ID NO: 164337 - protein, 242 aa, Glycine max
  Coding DNA Sequence Number=SeqID_72652
  Gene Ontology: Mol. function=RNA-directed DNA polymerase activity; Biological process=RNA-dependent DNA replication
  Homolog annotation: Hit_ID=Q949K7; Match level="QueryCoverage=23%, HitCoverage=100%, E-value=4e-09, Identity=42%"; Hit description =Putative gag polyprotein
MGDIDEVQEQMKDDMVALKDQMASMMEAMLSMKRLIESNAATTAATEADPNLSFATNQAYQPAPNMGGQGGEILGSTGGPHLGYNINAYPYGLPLNFTPPTMHENVDHAVPITFEAFHAMPQPNTVGASQPRSIQPLHFYVGGPPPIVEGKGKLNLTEERLRAVEASGDYFFVDMTDLCLVPDVISPKFKKLLMHFFQDSLAGAANTWYTSLEPSQIHSWKDRMVSFVRQYQYNADMAPDRM

SEQ ID NO: 164338 - protein, 330 aa, Glycine max
  Coding DNA Sequence Number=SeqID_72653
MEDLAAQVAPPMMEREMITMIVETLPVFYYEKLVGYMPFSFADLVFAGERIEADWGKEERRGCSRRNLGFCLAKTPINPSQYSLVCPIPSELFGPHGKPLQLGTRPAKDICPTTKSPRLSPRSCKASSRRRFQSWHKFQFGEDPSSEEAFRVCTNSDVIRELVSILNRQLVGSGNPQKNLPVSFPEVVQPRRDLRVSRRYSGHSIEQCMALKHKVQSLIDAGWLTFQEDGLNVKTNLLANHGGSVVNAIEARGLERPKQMKDVVTSRRFIFEALQEAGMVSFDGHKGDPCLMHPDASHDMETCSTVEELLQQMMDQGRFEISEENKGEQN

SEQ ID NO: 164339 - protein, 164 aa, Glycine max
  Coding DNA Sequence Number=SeqID_72654
MEENVLQEELEHIVVDKCVNQNPSGVVVVIEKILIGEVLKQLHDVNGDVGVVVVEEVNDGENRIEVDEVRVELQCASEDLWLLKLFMEFCFGIGKVIWLVRVFKKQQRRWEGEKGFRSLFRVLRVWSLESKRDSERERENEHETVAKGTHSNITNNGKSSKTVL

SEQ ID NO: 164340 - protein, 218 aa, Glycine max
  Coding DNA Sequence Number=SeqID_72655
MHLCLELTFVLGGHVWQDIVGVVVDLIDVKTVNPPHRMTVRLRDNRLYVNANIAEIQQFRLSLCVPFYCGGITHDKGGSQSQSSQSNLVEKFLHNARVVSIGEINNLRQDCYCLTVGTVDEIIIDAPWSYDSCLNCTTTFDPSKGDSACRSCQNSVTDTVPRMEHNGDKGNFLFWDATCIKLFGKTAAECRDELIAAGDDIKVFPTCVDEILSKTWAI

SEQ ID NO: 164341 - protein, 81 aa, Glycine max
  Coding DNA Sequence Number=SeqID_72656
  Subcellular localization annotation: CTP_CleavageSite=54; ConfidenceScore=5.18e-01
MVASLVLSRAPSLVALLGFLCIRKEKGTKVFCKSCSSKSFYKQRSTRDVPSLVLFETLVDVPSTRTDPQEMYHLLFLVKPK

SEQ ID NO: 164342 - protein, 469 aa, Glycine max
  Coding DNA Sequence Number=SeqID_72657
MGGSDFEGSIRQPLVEQEVVPIGDSSSKDVPHKGNLVTVEGVRKGEVRVFLRNRRRCGGEMPHSLHSLLVLSGEYEYSFMHHVPDCPFYFYVYRVCSRDFDILCSFFNIRPSVHVLMYFFQMKLIERRVASIIFPSTSNRTLKGIMSDFEWHPLVKQVEPVDDVLPPPTSADVVEVTPNMTHSAAAKRKHGEKTPNPRSPPSTPSIVQTTATTVNAYNPLAPPPLSTLVVSVSLPYTLVTFAPTPVVLASISSLAPPLLSVGLTKVQNSNGATKVFLQKSLAILEESENKHKEAMDIIASLERPKVADVTVAFVEAIKSNHQLSFRVNDVFAKLVSEVKRSARERETLDVTMAEFARVIANLQAQLRDSELTTSNLQAKLKKFELEVAREKEANKELNDELIMFKKEPVQQHEKGFFKVVRYEGLFSKGLDLNLFDLFKDVKDGKLLDEDEITAIEESNGGEEDDRVDV

SEQ ID NO: 164343 - protein, 60 aa, Glycine max
  Coding DNA Sequence Number=SeqID_72658
MTTKDDDKGDDKKLKGQSKNEFKIFKRSGFQESRFKTQDSRIKKKLNQDKYEKIIVIDYQ

SEQ ID NO: 164344 - protein, 85 aa, Glycine max
  Coding DNA Sequence Number=SeqID_72659
  Subcellular localization annotation: CTP_CleavageSite=54; ConfidenceScore=5.07e-01
MSDGDVGFTLATTLVAALATALASIIFFTLIMASIIAAICSFMASIIAAICSFMASMSTSLYSCTSSVLPITLAPYRFGHEVESI

SEQ ID NO: 164345 - protein, 120 aa, Glycine max
  Coding DNA Sequence Number=SeqID_72660
  Subcellular localization annotation: CTP_CleavageSite=38; ConfidenceScore=5.11e-01
MPISLCGSISWSVPSRHRDRAHKTPSGPGDVQQGPGVSSSGYGPLSILQGARTPPARSCHPNIGIALERTLGGPKEVQQGPGFPALITGLCQFYGVPVTPSKVIRPPTNRAFIKRYCAPR

SEQ ID NO: 164346 - protein, 78 aa, Glycine max
  Coding DNA Sequence Number=SeqID_72661
MAARLGKLRLTPEVTVSPRRAGSFTLKSFEGLGELEASLAELGSRKLNEKTLLPLYFGIFRILDQNIERSFVLCDNRC

SEQ ID NO: 164347 - protein, 206 aa, Glycine max
  Coding DNA Sequence Number=SeqID_72662
MDFFSNENFECIQAFQNSNLIPFISLKLPVYSELVKAFYSNLEIQEGTLISEVYGIKMVIDQSLFYDLTQLSSEGVPFEVTLFLQHFNIPLDFEPYIPIKRSFLIGAAVIATFGYRKEHDDSWVKKGAQPIDDEGHLPVGEDSSLLQRILDRFDGLQTYVGERFDALELQVDMRFNEMESRITKVEGDVTYIRICFDLPPALPPSS

SEQ ID NO: 164348 - protein, 421 aa, Glycine max
  Coding DNA Sequence Number=SeqID_72663
HAVLAPVGQQVQLDVQAPEDLFRHAQVACLGRRQQAGLRHRAPVLAKTGRAHHPQDHSQVAQAAARFLAVGFERVGRVLVARVALLHLDALGAEEGARIQSRLGGGFELLHQRAAARQPARFEQRGLDRDVGVGLAFAVLDGAHDMAGFQAQVPERGDQALDGGLVFGGGRVRQQDQQVDVRMRVQLAAAVAADRRQRGAGRQGGVLDQVAQRRVDDAAQVAQQGVGALVFAELGHRGPPGFLNAFAQGAEDIGGHGGGLAGGQDLVAGVGDADSMLPLRRQAMVARHDRPAVGQLADLAAAGVDHGLDGEQHTRHQFHAGARLAIMQHLRVFVEALADAVAAEFAHHREAVGLGVLLDGVADVAQCGPVFDLLDAFPHALEGDVGQAARQDRLLAHGVHAAGVAEPAVLDDGDVDIEGVP

SEQ ID NO: 164349 - protein, 71 aa, Glycine max
  Coding DNA Sequence Number=SeqID_72664
  Subcellular localization annotation: CTP_CleavageSite=25; ConfidenceScore=5.06e-01
MYPLLFSVKPNVATYPSAGGRRVTRGMRVPRKEYARSRHQRLFEENIGKTGKDAIYELLSDRFGSCIYVRG

SEQ ID NO: 164350 - protein, 76 aa, Glycine max
  Coding DNA Sequence Number=SeqID_72665
  Subcellular localization annotation: CTP_CleavageSite=24; ConfidenceScore=5.01e-01
MTQPQMLMNSCKNTRVIGSKTMVMIMTPLSGRKDATCLLPTNQYSNEVGNLGMIGNRIKSQSKFTTLRNLPKSLKK

SEQ ID NO: 164351 - protein, 93 aa, Glycine max
  Coding DNA Sequence Number=SeqID_72666
  Gene Ontology: Mol. function=sequence-specific DNA binding; Cellular component=nucleus; Biological process=regulation of transcription, DNA-dependent
  Homolog annotation: Hit_ID=A7R428; Match level="QueryCoverage=78%, HitCoverage=10%, E-value=3e-15, Identity=63%"; Hit description =Chromosome undetermined scaffold_610, whole genome shotgun sequence
  Subcellular localization annotation: CTP_CleavageSite=71; ConfidenceScore=5.45e-01
MDGTTNSGEPRSSSVLQNTGASEDPNRSGSGQNSMARYKLMSPAKLPISRSPCITIPPGLSPTSFLESPVLLSNMKGFVFSERKWIRRRKATQ

SEQ ID NO: 164352 - protein, 130 aa, Glycine max
  Coding DNA Sequence Number=SeqID_72667
AEMTGRLLAGSWTLDNRIMHYIIVRILLPRFSNLAQASEEDLILMWAFLTGRQIDWAHLVRYRMHKALRANAPLPYPQLVNLFLRHFQIPLDDEPFVQVKRSFAIGVGALEEDVGYIRQSFDLPPPPPPS

SEQ ID NO: 164353 - protein, 48 aa, Glycine max
  Coding DNA Sequence Number=SeqID_72668
MEDCLEGPHLGIMKHSSKLEGGGHMNSETGCSGLFLFVHMGWDITSRE

SEQ ID NO: 164354 - protein, 114 aa, Glycine max
  Coding DNA Sequence Number=SeqID_72669
  Homolog annotation: Hit_ID=A4EB57; Match level="QueryCoverage=49%, HitCoverage=35%, E-value=4e-16, Identity=69%"; Hit description =Putative uncharacterized protein
MKLKGIDGGPHKRWSMWFNSMQSEDLTRLDMPRILLKEGVPSGTRTQVVHGLSSARAFGTPEQTAGDKPEEGEDDVKSSCPLCPGRHTCYNGRDKGSRSREGELTPKTRPQFGL

SEQ ID NO: 164355 - protein, 16 aa, Glycine max
  Coding DNA Sequence Number=SeqID_72670
MANSSDSIVSSTIGSA

SEQ ID NO: 164356 - protein, 120 aa, Glycine max
  Coding DNA Sequence Number=SeqID_72671
MGDIHERLIRVLMRTCHSSWVTYTGVTMLGEGLTKGGPWVLRASESTTLGLECRSAEVELQVSYDPEGTFPVGTKLSRSGIFSGFTSDSPYEGPEDDSISYLCLSVSLRMFDRDDYVLDA

SEQ ID NO: 164357 - protein, 166 aa, Glycine max
  Coding DNA Sequence Number=SeqID_72672
  Gene Ontology: Mol. function=RNA-directed DNA polymerase activity; Biological process=RNA-dependent DNA replication
  Homolog annotation: Hit_ID=A5BSW9; Match level="QueryCoverage=40%, HitCoverage=5%, E-value=2e-08, Identity=42%"; Hit description =Putative uncharacterized protein
MVKEECKEVNVSSKRTLVSTTTPLGLEVIPQVKELLDEGLVHKSLNLCALLVPKIVIIRHQIPKIGGMMNMFSDATLFGKITHEPNTFKIHVHRDSLGSDQGVPMLPKRIKVIPKWPTAPSIREIWGFHDLTNFYKRFVPYFSILVAPLIELVRNHVPSWEDAQEK

SEQ ID NO: 164358 - protein, 169 aa, Glycine max
  Coding DNA Sequence Number=SeqID_72673
MTLLQSNILPRDHNSDLPLLKCQLVYAILTQVSVHVAHLISDAIYQFAGIVPMRHLVDPKKSNRVLGFLALITGLYQFYGVPVAPNKVIRPPINKAFIEKYCTPRQAQGQAPQQLEEDQQLAANAPSPPQEEVPSLRSISDHLRRIELQMHRYMHHVTSQQATNHRGQV

SEQ ID NO: 164359 - protein, 98 aa, Glycine max
  Coding DNA Sequence Number=SeqID_72674
MLSKRKTLDEGLLLSSKSETHHDHRFTSTPYVPMDLGIGPLFNSPPQWSRQLSQPTLQREGDAGLTGASSKEGKRAESPPTFIRGKRQKNWKGVVYEL

SEQ ID NO: 164360 - protein, 97 aa, Glycine max
  Coding DNA Sequence Number=SeqID_72675
VATDISEDTDILVILGRPFMLTTSCIVDMGKRKLELGFEDQKIDFDLFVENKPALEHNVYLQVMEGGQEVLKPTKLAKDELSQLQFDLNLAKLQPDR

SEQ ID NO: 164361 - protein, 101 aa, Glycine max
  Coding DNA Sequence Number=SeqID_72676
  Homolog annotation: Hit_ID=Q6WAY4; Match level="QueryCoverage=74%, HitCoverage=13%, E-value=1e-07, Identity=40%"; Hit description =Putative uncharacterized protein
MGSSQAPWLKKRFYQVNIKSLGVASLKELGQLMGQLQRQAFRKAYGKIWDLTLAEIFTEAAASLAQYYDQPLRCFTFGDFQLTPTVEEFEEILGCPLGGRK

SEQ ID NO: 164362 - protein, 68 aa, Glycine max
  Coding DNA Sequence Number=SeqID_72677
PSINIFSWIGSENPWVGVLLRLLPLNEWSHLLASPASENENRLSLIALSGTPAIITVLQISINVAKYA

SEQ ID NO: 164363 - protein, 317 aa, Glycine max
  Coding DNA Sequence Number=SeqID_72678
  Gene Ontology: Mol. function=nutrient reservoir activity; Cellular component=extracellular region; Biological process=cell wall organization and biogenesis
  Homolog annotation: Hit_ID=Q9SC38; Match level="QueryCoverage=57%, HitCoverage=93%, E-value=9e-83, Identity=83%"; Hit description =Germin-like protein
  Pfam annotation: Domain name=Cupin_1; Domain location=59-210; Score =176.5; E_value=6.7e-50; Accession=PF00190.13; Description=Cupin
  Pfam annotation: Domain name=Cupin_2; Domain location=94-172; Score =35.3; E_value=2.3e-07; Accession=PF07883.2; Description=Cupin domain
  Pfam module annotation: Pfam domain module=Cupin_1::Cupin_2; Domain location=59-210::94-172
MKVMYFLVAVLALAFSVASAYDPSPLQDFCVTVNGTKDGVFVNGKFCKDPKLVKAEDFFRHVEPGNTSNPNGAQVTQVFVDQLPALNTLGISLARVDFAPKGLNPPHTHPRGTEILIVTEGTLYVGFVTSNQDGNRLFTKVLNKGDVFVFPIGLIHFQRNVGYGNAVAIAALSSQNPGTITIANVLFKANPPISSEVLTKAFQVDKKVRQHSMIAFPKMVLEELGAAKIESGTKLYLFNLDHGVADDDIKIGRSKGTTEVVFVRHSNALAAIKKYNNMSDGKLLQIEFVGTYACSATPVVTPLCQTNLMGRPNDVHL

SEQ ID NO: 164364 - protein, 814 aa, Glycine max
  Coding DNA Sequence Number=SeqID_72679
  Gene Ontology: Mol. function=extracellular-glutamate-gated ion channel activity; Cellular component=integral to membrane; Biological process=ion transport
  Homolog annotation: Hit_ID=A5AIT1; Match level="QueryCoverage=97%, HitCoverage=88%, E-value=1e-134, Identity=36%"; Hit description =Putative uncharacterized protein
  Pfam annotation: Domain name=ANF_receptor; Domain location=1-323; Score=24.7; E_value=1.4e-07; Accession=PF01094.19; Description =Receptor family ligand binding region
  Pfam annotation: Domain name=Lig_chan; Domain location=472-733; Score= 121.5; E_value=2.5e-33; Accession=PF00060.17; Description=Ligand -gated ion channel
  Pfam annotation: Domain name=SBP_bac_3; Domain location=367-688; Score=-38.8; E_value=2.1e-05; Accession=PF00497.11; Description =Bacterial extracellular solute-binding proteins, family 3
  Pfam module annotation: Pfam domain module=ANF_receptor::Lig _chan::SBP_bac_3; Domain location=1-323::472-733::367-688
MDLTQSMRVLAIIGTITHNEATLASELNYTINKVPTLSLTSPTARTKLLSPQLPHFIQIGDDVRIHMQCVAAIVGEFRWKKVTVIYELNNWLSSDPGMLLDLTYALRQVGSEIDNHLALPSLSSLSDPKSNIENELKKLKSKSNRVFLIVHSSLELANILFEKAKQIGLMEKGSVWVISDGVVGLLDSVNPSAISNMQGVIGFKTNFMEVSETFRQFKFKFQRNFASEFPEEEKINPSFFALQLYDATWAIAQAAKESQGKFTPEQLFKNYLSRNDKLQQSPTFNIINVIGKSYRDLALWSPKLGFSKNLITQQLTEVNTDTTSTKVLSTVYWPGGLQFVPKGSTRSTEERTLQIGVPANGVFRQFVNVTHDQNTNNTSITGFSIDVFKAVVNTLPYDLKYTFVPFNGSYDEMVEQVHNKTLDAAVGDTAIMAYRYHLVDFTQPYIESGLDMVVKEKSAKSKETWIFLDVFTKEMWLMIVALHIFVGFVIWFIERRHNAELKGLGSMLWFLVSVIFYAHREPITSPLARTVLAPWLFVILIATSTFTASLTSMMTVSQLEPSVLDIQTLQERNSPVGCNGNSFIVKYLIDILKFKPENIKKINSIGDYPAAFQNKDIEAAFFVTPHAKIFLAKYSCKGLIKAGSTFKLGGFGFVFPKGSTLATDLSEALLKVIEKRETEQLEKDMLLIGGNANCSPSESKAKGRSSTGFQPFLGLFLICSSVAILALLYNMICVFKISVEIFSSYMHVTLTKLKSMWRCTTTCFTWSCSRLQSGSMRSISTATVTRNAEETVISDQQSTMNVELIDVVLAAHAS

SEQ ID NO: 164365 - protein, 70 aa, Glycine max
  Coding DNA Sequence Number=SeqID_72680
MASIKMHQEEGNEQKASPGTVVAGKEERVVENRIRSRKVDRDVERRVTSREVHQNAEKKWKKSPEKVPRV

SEQ ID NO: 164366 - protein, 611 aa, Glycine max
  Coding DNA Sequence Number=SeqID_72681
  Gene Ontology: Mol. function=kinase activity; Cellular component =intracellular; Biological process=DNA mediated transformation
  Homolog annotation: Hit_ID=A7PLT9; Match level="QueryCoverage=99%, HitCoverage=80%, E-value=1e-171, Identity=53%"; Hit description =Chromosome chr14 scaffold_21, whole genome shotgun sequence
  Pfam annotation: Domain name=Bromodomain; Domain location=180-269; Score=110.4; E_value=5.6e-30; Accession=PF00439.16; Description =Bromodomain
MVISKSRLSGGYFGNALDTAGESEGSGSSGRIDTEITVSEDSSIPTRKCISLNSSRHDAFGAPVQVVPLSNMPLSQRKDLVQRLRSELEQIRLLQKKIEQQRTNGVALSSSSDILSCSNGNNGHRVERDKKPSMSSSAPGNKVKPSGNKNQKSRGWNRGSSGKFESAVQSASPSTANAMLMKDCELLLKRLMSHQYAWVFKTPVDVVKLNLPDYFTIIKRPMDLGTVKSKLAAGEYAGPLEFADDVKLTFSNAMNYNPSGNDVHLMADTLNKYFELRWKAIEKKLPKSDVLPIPAKPDNSEGVKTKRQAPPSKKRKIASLPPQPKVMPPTKKVMSDQEKHDLGRELESLLGEMPMHIIDFLKEHSSNGRECGDDEIEIDIDDLSDDTLFTLRKLLDDFLQEKQKNKAKVEACEVEVLNDSGPSNSSLQPFKGNDPADEEVDIGGNEPPVSSYSHVEIEKDTTYRVNKSLSPGSSNDTDSDSSSDSEADDVKASPANVAKAPENLGSEAQLDEMTMAAATLERNQSVSGLDQLEDNSQHKPSSFDSDCQQDGDSAPTERQVSPDKLYRAAVLKKRFLDTILKAREKTLTQGEKGDPEKLRQEREKLEMEQKK

SEQ ID NO: 164367 - protein, 44 aa, Glycine max
  Coding DNA Sequence Number=SeqID_72682
MPGSVRSIVDLCKFESETFIARQRNRVPAMRREKVTKGGVTSMY

SEQ ID NO: 164368 - protein, 63 aa, Glycine max
  Coding DNA Sequence Number=SeqID_72683
RGTCLGPPLVDAPGRLPLVDVPGATTSRCAWQATTSGRAWGPPLVVAPGRPPLSPLSHRPVKS

SEQ ID NO: 164369 - protein, 484 aa, Glycine max
  Coding DNA Sequence Number=SeqID_72684
  Gene Ontology: Mol. function=L-isoleucine transmembrane transporter activity; Cellular component=integral to membrane; Biological process=peroxisome organization and biogenesis
  Homolog annotation: Hit_ID=A7QBQ6; Match level="QueryCoverage=89%, HitCoverage=98%, E-value=0.0, Identity=78%"; Hit description =Chromosome chr1 scaffold_75, whole genome shotgun sequence
  Pfam annotation: Domain name=Aa_trans; Domain location=72-471; Score =568.6; E_value=6.4e-168; Accession=PF01490.9; Description =Transmembrane amino acid transporter protein
MMNVNYTHVYLDEDQNFLFTSYDQLGFVGPTRISLDILAYSLLYLPLLIKQTEEELQRQKAINDWLPITSSRNAKWWYSAFHNVTAMVGAGVLSLPYAMSELGWGPGVTVLILSWIITLYTLWQMVEMHEMVPGKRFDRYHELGQYAFGEKLGLYIVVPQQLVVEIGVNIVYMVTGGKSLQKFHDTVCDSCKKIKLTFFIMIFASVHFVLSHLPNFNSISGVSLAAAVMSLSYSTIAWAASAHKGVQENVEYGYKAKSTSGTVFNFFSALGDVAFAYAGHNVVLEIQATIPSTPEKPSKGPMWRGVVVAYIVVALCYFPVALIGYWMFGNTVEDNILISLEKPKWLIAMANMFVVIHVIGSYQIYAMPVFDMIETVMVKKLNFKPSMTLRFIVRNLYVAFTMFVAITFPFFGGLLGFFGGFAFAPTTYFLPCVMWLAIYKPRRFSMSWWANWICIVFGLLLMILSPIGGLRSIIISAKDYKFYS

SEQ ID NO: 164370 - protein, 71 aa, Glycine max
  Coding DNA Sequence Number=SeqID_72685
MASSNGNFPASMPVLVDETNLSISRCDKVVQEGVKELDKNPTDAQKVAHCDLMKKDTKTLFIIHQCVCRCR

SEQ ID NO: 164371 - protein, 469 aa, Glycine max
  Coding DNA Sequence Number=SeqID_72686
  Gene Ontology: Mol. function=hydrolase activity; Cellular component =nucleus; Biological process=metabolic process
  Homolog annotation: Hit_ID=Q9LK21; Match level="QueryCoverage=98%, HitCoverage=100%, E-value=1e-164, Identity=66%"; Hit description =Genomic DNA, chromosome 3, TAC clone:K17E12
  Pfam annotation: Domain name=Abhydrolase_3; Domain location=161-435; Score=241.6; E_value=1.8e-69; Accession=PF07859.4; Description =alphabeta hydrolase fold
ECEREMPSVAVKLYSVFFKFLLKHRLQNRIQTTSDHSDPFGVTTRPEESVAPANPSFSDGVATKDIHIDLLTSLSIRIFLPESALTPPEPHSKPRPDPEPRSARANPVSRRNSYGPPLREELRSNSFGGRSGVDGLNLMSDGVYRGYAPGKRGEQRRLPVMLQFHGGGWVSGGSDSVANDAFCRRIAKVCDVVVVAVGYRLAPENRYPAAFEDGVKVLNWLAKQANLAECSKSMGGGKSGGHGVGGEFKKSDSHKHIVDSFGASMVEPWLAAHADLSSYGLCLKAWVGQGMPELGFASCGANIADYVARKAVEGGKLLEPVKVVAQVLMYPFFIGSVPTRSEIKLANSYFYDKAMCMLAWKLFLPEEEFSLDHPAANPLVPGRGPPLKLMPPTLTVVAEHDWMRDRAIAYSEELRKVNVDAPVLEYKDAVHEFATLDVLLKSPQAQVCAEDIAIWAKKHISLRGHEFSY

SEQ ID NO: 164372 - protein, 377 aa, Glycine max
  Coding DNA Sequence Number=SeqID_72687
  Gene Ontology: Mol. function=nutrient reservoir activity; Cellular component=extracellular region; Biological process=cell wall organization and biogenesis
  Homolog annotation: Hit_ID=Q9SC38; Match level="QueryCoverage=44%, HitCoverage=87%, E-value=1e-74, Identity=84%"; Hit description =Germin-like protein
  Pfam annotation: Domain name=Cupin_1; Domain location=58-201; Score =151.8; E_value=1.9e-42; Accession=PF00190.13; Description=Cupin
  Pfam annotation: Domain name=Cupin_2; Domain location=93-171; Score =34.5; E_value=3.8e-07; Accession=PF07883.2; Description=Cupin domain
  Pfam module annotation: Pfam domain module=Cupin_1::Cupin_2; Domain location=58-201::93-171
MKVVYFLVAILALTSSLVSASDPSPLQDFCVAAKEKDGVFVNGKFCKDPKLVKPEDFFLHVEPGNTDNPNNAQVTPVSVDQLPGLNTLGISLARIDFAPKGINPPHTHPRATEILLVLEGTLYVGFVTSNQDGNRLFTKVLNKGDVFVFPIGLIHFQLNVGYGNAVAIAALGSQNAGTITIANALFKANPPISPEDGSIEKEPPDKNDDNTRQKYVSFRDKTMVNRPTPPAKPRVDLLKEKLDRIDSEDGNPLKSMDAFVIKMVDIGNQYFMVKFDREEDQLKAKIERTLVWTHFSGLNLVFYDKSILLVMAMMIGKMKVTMNTLDACQYKGLPRVCGTCECYGHLTRECKQFPMQIAKDGVGDSPSQPITASSSMV

SEQ ID NO: 164373 - protein, 32 aa, Glycine max
  Coding DNA Sequence Number=SeqID_72688
MLASPSGMWEDRTRFHHCGDTTFRIQKVLSLW

SEQ ID NO: 164374 - protein, 84 aa, Glycine max
  Coding DNA Sequence Number=SeqID_72689
MSNQKSTESTIKNLEVQVGQLAKQLADRPSSSFGANTEKNPKEECKAVMTRSKMVSMNEGEKRIGEEKQQLVTEPKIDPVGVYE

SEQ ID NO: 164375 - protein, 128 aa, Glycine max
  Coding DNA Sequence Number=SeqID_72690
MAQKLSGKNSKSNYGNYLRKHMEDECSEATIPEPFTTEEEADDTQTTQVAAATPERSLEAILEPSTPSVDPSSPQHATNPSTPVLEIPEGQTTPVLTLDTSPPATPVLHLTDEEDVQTQDTQDQSHEF

SEQ ID NO: 164376 - protein, 135 aa, Glycine max
  Coding DNA Sequence Number=SeqID_72691
  Subcellular localization annotation: CTP_CleavageSite=40; ConfidenceScore=5.48e-01
MVEPSKKRKGSSSTTTAVGQCRHDTSGDPPTPPSPSFSSPASKVHQSLFYSLTKLSSQGVPFEGTLVDDWKHVYSSHDACKMVCNDYADMTGRLLAGSFTFECRIMHYILCRILLPWSTNLAQASEEDLVLLWAL

SEQ ID NO: 164377 - protein, 85 aa, Glycine max
  Coding DNA Sequence Number=SeqID_72692
MGVKHFEVVKRRSRADKQWSPYEIRILPKRNVKLYITEFDEFRREIERRNWHKELTNFSEGSINVALVKEFYANLYDIEDISPKQ

SEQ ID NO: 164378 - protein, 108 aa, Glycine max
  Coding DNA Sequence Number=SeqID_72693
MGNRLQGLKIETGHSVASGNRLPMVCNRLHSVICYWFQCAKAVEIRFWALIVMSVQLIHDCVVMECLEGVWETLEGNERCRFRGTIRLTATSLVHPEQPARTLQQPVE

SEQ ID NO: 164379 - protein, 107 aa, Glycine max
  Coding DNA Sequence Number=SeqID_72694
  Subcellular localization annotation: CTP_CleavageSite=21; ConfidenceScore=5.45e-01
MEAQTRTPQTRTGQCGCSHGSAAQFATNTNSGRRRNNNNALGVPFPGLFPFLLFFDLRNGKGDLHKHDIHNVVAVTEAQASLTQRRSQAEGERRRTIGFKRAGCAIS

SEQ ID NO: 164380 - protein, 355 aa, Glycine max
  Coding DNA Sequence Number=SeqID_72695
  Gene Ontology: Mol. function=motor activity; Cellular component=cell projection
  Homolog annotation: Hit_ID=UPI0000DC1FFC; Match level="QueryCoverage =68%, HitCoverage=94%, E-value=6e-14, Identity=15%"; Hit description =UPI0000DC1FFC related cluster
LQALTFKDYTSSPSEGYTLLPSKGWMPSPYEGYTSLPSEDYMSSPSEGYKATRPRLHRIARPRLKRATCPRLAFRGLHALDFRRKHILAFRGLHTLAFRGLHALAFRRLHVLLHVLAFVGLDVLAFIGLHALTIRGAHVLAFRGLHALVFRGLHVLDFRGLHALAIRGLHVLAFRKLHVLAIRGLYNLAFRGLHARTFKGLHVLPFRGLHALAYRGLHVLPERVGLHVLAFRGLHVLAFRGLHALAFRGLYILSFRGLHALALRGVHVLTFRGLDFLAFRGLHLLAFRGLHILAFRGLHVLTFRGLHVLAFRGLQALAFRGLHVHIFRGLHALAFRGLHVFVFRGLHDLAFRGLH

SEQ ID NO: 164381 - protein, 30 aa, Glycine max
  Coding DNA Sequence Number=SeqID_72696
MGEDVIFPFLVKEGKESEMPPPWKLLELFR

SEQ ID NO: 164382 - protein, 89 aa, Glycine max
  Coding DNA Sequence Number=SeqID_72697
MLVHQNENSVEDDKEGRIGVGDAPVAPGRGVLVAAAEVYGQEGFHSQIVVASSIISVHNNCRQKYIPLLQWMKQHYFVSYYAKRLEQIQ

SEQ ID NO: 164383 - protein, 50 aa, Glycine max
  Coding DNA Sequence Number=SeqID_72698
MAARGDHWWSWVVEEEISLSEIVSLSGNPLLALSATIRAQCNSLSGRNCA

SEQ ID NO: 164384 - protein, 185 aa, Glycine max
  Coding DNA Sequence Number=SeqID_72699
  Subcellular localization annotation: CTP_CleavageSite=51; ConfidenceScore=5.48e-01
MTEPSKKRKGIATSSTVTRTRSHKTSKEQTSQIPPSISSPTLFSSKEQCIRYNSLFSSRSIIDPKFVDLAFFDDEVFDCFQAFQNFGLIQFISMKLPFYPELVKAFYSNLEIQEDSLISKVYKIKMIIDHSLFLDLTQLSSDGVPSKGSLDDEWKFDFSVSDAPRMVCTKPSRYDRKASCLFIGI

SEQ ID NO: 164385 - protein, 100 aa, Glycine max
  Coding DNA Sequence Number=SeqID_72700
MTLPFAVAPNRLCPAEKNSAPLNDQHHLDTTEFVPLGRRKNDHNLSLRANGLACLWLTKSCADDHNLSPRAIRLDRLWMAKRCADDHNLSAHVIGLAASG

SEQ ID NO: 164386 - protein, 50 aa, Glycine max
  Coding DNA Sequence Number=SeqID_72701
MGRLAGFTKNNTRLSDTGVSLSGNCYGLANRNAQLSKCRKDFRLAQEILA

SEQ ID NO: 164387 - protein, 102 aa, Glycine max
  Coding DNA Sequence Number=SeqID_72702
MPHEAQLPTNIRCALVKVKGSVFIVAVVGSSAAAYEIDEDQWMYDTIMSEEVDMNDQNEQECGVNEPHVDCSNAFNTSQVFSSRDDVLQWARSVAHENGFVA

SEQ ID NO: 164388 - protein, 153 aa, Glycine max
  Coding DNA Sequence Number=SeqID_72703
MALARDFCKETTHGAFWFVHILYSFPKKARVIAPQYVLSLGTKIVCTKNTRGDAYRVLEIPRCAHVQFLVPQNALSMHVCKFSQGDVCDEMAPRKLASKRSRKDKAAEGTSSAPEYDSHRFRSAVHQQRFEAIKGWSFLRERHVQLKTLKKRY

SEQ ID NO: 164389 - protein, 234 aa, Glycine max
  Coding DNA Sequence Number=SeqID_72704
  Gene Ontology: Mol. function=fructose-bisphosphate aldolase activity; Cellular component=cytoplasm; Biological process=thiamin biosynthetic process
  Homolog annotation: Hit_ID=A8G8F0; Match level="QueryCoverage=66%, HitCoverage=59%, E-value=3e-69, Identity=86%"; Hit description =Thiazole biosynthesis protein thiG
  Pfam annotation: Domain name=ThiG; Domain location=3-208; Score =257.1; E_value=3.7e-74; Accession=PF05690.5; Description=Thiazole biosynthesis protein ThiG
  Subcellular localization annotation: CTP_CleavageSite=40; ConfidenceScore=5.11e-01
MLKIADTTFTSRLFTGTGKFATPALMLEALAASGSQLVTMAMKRVDLRGGNDAILAPLQQLGVRLLPNTSGAKTAAEAVFAARLAREALGTHWVKLEIHPDVKYLLPDPIETLKAAETLVKDGFVVLPYCGADPVLCKRLEEVGCAAVMPLGAPIGSNRGQGAGGGRRRHRRAEPRAGSDGAGRRRGAGEYRHRRGARPGANGTGVSPGAGGRPSWRAAPDWVPASTLRPPPAR

SEQ ID NO: 164390 - protein, 113 aa, Glycine max
  Coding DNA Sequence Number=SeqID_72705
MAGILFLLKQQNSLEVTSVIILGTPHIPWHDPTHCYFIGTSRGTRTHASANYGVDTTYTYSISTSGASPSDREGDEDPLPDVDSLEDVMSASEADSTEESGPGGTATSGDSSS

SEQ ID NO: 164391 - protein, 212 aa, Glycine max
  Coding DNA Sequence Number=SeqID_72706
  Subcellular localization annotation: CTP_CleavageSite=15; ConfidenceScore=5.39e-01
LSILLAKPFMSSSVVALSAFGRAKRNLVFVVELGSVSLLAKPILQKNFDLCQFAKRAKRICRAKRPMASRKRKAIASRPQPHYDTYRLTYEDTWNCCADNILGQNILLERNAKLFVTKFDEFRIELVRRNWHRTLTNLMEGSIDVALVKEFYANRYDPKDKFPKQVRVRGHLIKFDADSLNTFLETPVVLEPGETLPAYSRFCRLRPDPQEL

SEQ ID NO: 164392 - protein, 433 aa, Glycine max
  Coding DNA Sequence Number=SeqID_72707
  Subcellular localization annotation: CTP_CleavageSite=30; ConfidenceScore=5.34e-01
MRKLAHQTSLPGRCCSGSWLPAGLPNRRTPCMPARGWPRHRKVTRECPSDRGSTMGVPSSCTRRQKASAATPAPAPRWIACARARSRGLCSAGGSEVAEALLPAGARLEVSRSAKRPASCASPPERGSARATRLATSRCRPAPSVTHISDCAPPSARARRRRCRPWTSSRSRATPCPSNSPWTTWPAGRSTRQNSRPPAARTPVAAWPGASVPGRAARACRDAAAVMSSAAWTAAPSRHSSEAATHRPCRAACAMASEVHRGRDTHRARAARGGEVVVETAGPVGLVEQVLHRGAEGDGFGRDAGGIARAHVHAGPAGHLQRVGRIHPLRARVDQAAGERGARQRGHIPLAAQVGRPARHAVDAVAVARAALGLALDGLRIGQAAQHARAAQRLAEHIPLQPRLRCSPSISRRLVAVSPRTKAARSGTARPSA

SEQ ID NO: 164393 - protein, 182 aa, Glycine max
  Coding DNA Sequence Number=SeqID_72708
MVSTWPSKVYLYVTWNMNLLRIFQNKKVLSSQKAKSSYPLKIPWAIHLQFNKQLFECSNCSIYLFQERFLLLFTLILKKGLRDRGSLVVKKYEHKGRVVLVWFRTCKGILQDSGTLKQVACGLDVGTRENYKQLGLNPELGFDAILPRKGPITRTMSKRLQEDWARAAEEGPRVLMNLRVDF

SEQ ID NO: 164394 - protein, 116 aa, Glycine max
  Coding DNA Sequence Number=SeqID_72709
MGEVEEVQEQMKANMEAMKEQMATMMEAMRSMKRIMEANAVAVAATSAVAKRTLPVRMTITPLPYSLRVDNLVMYMSLNPWGRHMKILHHNLVDFEHCLGYATEGQAVGGIPLQNT

SEQ ID NO: 164395 - protein, 65 aa, Glycine max
  Coding DNA Sequence Number=SeqID_72710
MRENENEIVTLASPVGTIVYGKLKKLLAESRTMSLSLRRFVALSKIVQADYQPRRPQDKTAQITV

SEQ ID NO: 164396 - protein, 1324 aa, Glycine max
  Coding DNA Sequence Number=SeqID_72711
  Gene Ontology: Mol. function=nucleic acid binding; Cellular component= intracellular; Biological process=regulation of transcription from RNA polymerase III promoter
  Homolog annotation: Hit_ID=A7PCK1; Match level="QueryCoverage=99%, HitCoverage=76%, E-value=0.0, Identity=52%"; Hit description =Chromosome chr17 scaffold_12, whole genome shotgun sequence
  Pfam annotation: Domain name=JmjC; Domain location=1-47; Score=-16.6; E_value=0.02; Accession=PF02373.13; Description=JmjC domain
  Pfam annotation: Domain name=zf-C2H2; Domain location=1208-1233; Score=21.0; E_value=0.0043; Accession=PF00096.17; Description=Zinc finger, C2H2 type
  Pfam annotation: Domain name=zf-C2H2; Domain location=1236-1255; Score=7.9; E_value=1.6; Accession=PF00096.17; Description=Zinc finger, C2H2 type
  Pfam annotation: Domain name=zf-C2H2; Domain location=1261-1285; Score=20.7; E_value=0.0056; Accession=PF00096.17; Description=Zinc finger, C2H2 type
  Pfam annotation: Domain name=zf-C2H2; Domain location=1291-1317; Score=24.1; E_value=0.0005; Accession=PF00096.17; Description=Zinc finger, C2H2 type
  Pfam module annotation: Pfam domain module=JmjC::zf-C2H2::zf-C2H2::zf- C2H2::zf-C2H2; Domain location=1-47::1208-1233::1236-1255::1261 -1285::1291-1317
MSPEVFISAGVPCCRLVQNAGEFVVTFPRAYHTGFSHGFNCGEAANIATPEWLRFAKDAAIRRASLNYPPMVSHFQLLYDLALALCSRIPAGISAEPRSSRLKDKKKGEGETVIKELFVQDVLQNNDLLHFLGQGSAVVLLPRSSVDISVCSKLRVGSQQSINVSNSEGMHSSKGFVSDDLAFNRSHGIKQGKSFYSVKDKFSTLCERDRISSFDVNDNISISSSNPLQRDTERETCQGDGLSDQRLFSCVTCGILSFSCVAIVQPREPAARYLVSADCSFFNDSVVGSGISKNKFTIAREEAIIPEPNIYTGRKISITFLKRQILSIMSPHPRYLPCLCLMLIRKHVYLFGWMKKNVQDGIHDVPFQSSQVALNMVSENGNTALALLASAYGNSSDSEEDQIAVDSHESNVINSASESLLSYTRDSHASPMTALDRGDYIPSKSSSYEDFIHRRLECFENTRTVANSTSNCSQDAHNAERSLSNNAMMVPFDNKKASMVLQSDEDSSRMHVFCLEHAAEAEQQLRPIGGANLLLLCHPDYPKIEAEAKMVAEDLGIDYMWKNIEYSHASKEDEEKIQSALDSEEAIPGNGDWAVKLGINLFYSANLSRSPLYSKQMPYNSVIYSAFGCSSPASSPVEPKVYQRRVNRQKKIVAGKWCGKVWMSNQVHPLLAKRDFEDIEDEKLLIGLILPDDKIERSESTPKSEATSRKSGKKRKKTAENGRFRKGSYANKNLLSDNSTEDKPNLLPRSILRSKKVRHVERDCAALKGGYSPPYHHRKPSNNQTNFTESYAVSDDSLDDDDHMQQRRNVKIEKAKFMDNDVVSNDTMDNDSDWQQREDVSSKQVEDTEGDAISEDSLDVGSLQLQRKTSKGKHPKYIGEEDIISDDQMESHFQKRQKRIPESRQGKYLTGKDIISDDQLELKMKKQQRRNPKSRQAKYLNEEDIASDDQLEGHYRRYQRKNPKGRQATCVAGEDQMSDDQLENHCQKQQTSFYRKRQNKGIEREVKNEMSDDHLEDHFLKQQQRFPKSRRNKHTDKEDTDDLAENNSHLLRRTPKRKQAKCMEDDDMNSDDEMEDDQQLRRTLRSKQAKPKTLQQMKQANSLQAKKQASRPIKQCSRMLVKSKAPQQIKQPSHLPNKQSNNTQEFSLDMEEEEEGGPSTRLRKRATKAQESERKLKDKQTKRKKVKNAAAAKVSVGHAKMKDGEAEYQCDIDGCTMSFGSKQELMHHKRNICPVKGCGKKFFSHKYLVQHRRVHEDERPLKCPWKGCKMTFKWAWARTEHIRVHTGARPYVCAEPDCGQTFRFVSDFSRHKRKTGHSAKKNCQ

SEQ ID NO: 164397 - protein, 105 aa, Glycine max
  Coding DNA Sequence Number=SeqID_72712
MANNVNCGIQGSNRFLMHCVKALHLIDNKESMIQGSHWLGVSKPPHGHRIQAANSRKGRLVLNLNVLEAMKMPNMVEMVTLMEGGRSEMSVHFNWNQDQFGSIQF

SEQ ID NO: 164398 - protein, 154 aa, Glycine max
  Coding DNA Sequence Number=SeqID_72713
MYDCMIMIRTRGLGCTLDRVIGRALGREDHHDADDVSQRRRPTISARRQRQAAPIAEDDPVVTEDVHAHAEEAVDDAEGFSGGPCDPSVLADYGDHVAVIVWNGELSSHERKVQKFGRPTPKIEGLVAATRLSPLIACSVDTGDRGLISAFLER

SEQ ID NO: 164399 - protein, 123 aa, Glycine max
  Coding DNA Sequence Number=SeqID_72714
MQWFFMISHLFMTPAQSADPAKYPPMTQDDTFVESHILEVLVAPAAAPAHAPSNVEQPKHAMINNEACQAIAERLERLFNLRIVTASTKIHEVMEECLRITRDVTPDDNVYVSSRRRQRTDQP

SEQ ID NO: 164400 - protein, 976 aa, Glycine max
  Coding DNA Sequence Number=SeqID_72715
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI00001623CC; Match level="QueryCoverage =90%, HitCoverage=53%, E-value=0.0, Identity=67%"; Hit description =ATGSL08 (GLUCAN SYNTHASE-LIKE 8); 1,3-beta-glucan synthase/ transferase, transferring glycosyl groups
  Pfam annotation: Domain name=Glucan_synthase; Domain location=63-870; Score=492.4; E_value=5.5e-145; Accession=PF02364.6; Description=1,3 -beta-glucan synthase component
MTQFVVLLITQSLLRENLDTWNILARARDEGRLFSKIVWPNDPEIKELVKRLHLLLTVKDSAANVPKNLEARRRLEFFSNSLFMDMPSAKPVSEMLPFSVFTPYYSETVLYSTSELQKENEDGISILFYLQKIFPDEWENFLERIGRGASTGDAELQESSSDSLELRFWASYRGQTLARTGNKFLAAFWRADHWEVVAYEHFALQFVILIFILMKFDMDICWQSVVSIVDNYSQNNFITSQDFESSREARAQADLKFTYVVSCQIYGQQKQRKAPEAADIALLLQSLKGGDLASYCGGGIWVEFIGNEALRVAFIHVDESTTDVNTSKVFYSKLVKADINGKDQEIYSIKLPGDPKLGEGKPENQNHAIIFTRGEAVQTIDMNQDNYLEEAMKMRNLLEEFHANHGLRPPSILGVREHVFTGSVSSLAWFMSNQETSFVTLAQRVLANPLKIAPVSLVLTGVASILVEAMEMDQSALDTIFIVGPPAFATLKVGSFGHEEECWKAALLAASIVGFTEPALVAASLGVGKGRDVGLNQIALFEGKVAGGNGEQVLSRDIYRLGQLFDFFRMLSFFFTTVGYYVCTMAFSGLDEDVSKNAKLQGNTALDAALNAQFLVQIGVFTAVPMIMGFILELGLLKAVFSFITMQLQLCSVFFTFSLGTRTHYFGRTILHGGAKYRATGRGFVVRHIKFAENYRLYSRSHFVKALEVALLLIVYIAYGYAEGGAVTYVLLTLSSWFLVISWLFAPYIFNPSGFEWQKTVEDFDDWTSWLLYKGGVGVKGDNSWESWWDEEQTILSARFFLFQYGVVYKLHLTGNNTSLAIVWSLGMWDSVREFARMYDAGMGMIIFAPIAFLSWFPFISTFQSRLLFNQAFSRGLEISIILAGNKANVESAALVEVKVLWVSGDCCGGWFVVEGECVNNAVWALEQFRGLFLRRDALPGVIVTDRDLALMNAVKTVFPKCTNLLCKFHINKNVN

SEQ ID NO: 164401 - protein, 89 aa, Glycine max
  Coding DNA Sequence Number=SeqID_72716
MKALVQTRSFLLKDQKPKGERRGRHKITREFDETTGGNQARFWPREGGAWRSRAGVWQALERHVAALLVKRSVRLGCALRGAQNPVVVG

SEQ ID NO: 164402 - protein, 114 aa, Glycine max
  Coding DNA Sequence Number=SeqID_72717
  Homolog annotation: Hit_ID=A7PCJ5; Match level="QueryCoverage=36%, HitCoverage=4%, E-value=1e-10, Identity=73%"; Hit description =Chromosome chr17 scaffold_12, whole genome shotgun sequence
MAKELDAILDHGEAAPAVSCITDDGSAKFLEKIICPIYQTLDAKYNISVKYSFPQISISSIESLFFPVLSIVDHVLSIQISELNMEELVTWETIYAQETLGAGDSKRNRTLGSD

SEQ ID NO: 164403 - protein, 579 aa, Glycine max
  Coding DNA Sequence Number=SeqID_72718
  Homolog annotation: Hit_ID=A2WY33; Match level="QueryCoverage=96%, HitCoverage=84%, E-value=7e-20, Identity=23%"; Hit description =Putative uncharacterized protein
  Pfam annotation: Domain name=B3; Domain location=494-572; Score=6.7; E_value=0.014; Accession=PF02362.12; Description=B3 DNA binding domain
  Pfam annotation: Domain name=B3; Domain location=8-85; Score=33.8; E _value=6.5e-07; Accession=PF02362.12; Description=B3 DNA binding domain
  Pfam module annotation: Pfam domain module=B3::B3; Domain location =494-572::8-85
MGSDLYIPPAFSSTVSDLVNKKIALNDSSERQWNVKVSGFNGSFAFMEGWSTFSLNHGVKVGYLLVFNYVKDLHFDVKIYDPSACEKLNFPKTRNQKKRSRGRSGSPVRDCMLVGQESNALVVTQHYVPKMKSQRSEVDLVVRKNGEESGQLMCISELHEDPCYSTSLEFDQSHGVNGTMKIVNGDLKVSNVDYGSHIFENDAIVCSKDTMFEGIFSMAAALDISEFEMSGRSTSLGEADKSTHDKTSTLNIEENKESKAIMYSGEAQECQFSNVLESDQAAISKKEPALHIDGSCNTKNKFNEISNHLDTYIHNGEMKKLPVDKTPKLYSSVDKLNVTGLPKETKGKLDHYSDPFNQDNESHFKTAPPLMSNGEAQECQFSEGLESDQAAISKKEPALHICGFSDTKQNFDGISNDLDGHIYNGEMKKLPMDMTPKLCGSMDKLNITELPKEIKDSDISNQDDESHFKTAPPLSCVVTNDNDNVSLKLPEYLPLTRRVKPFTHKKMVVLLRDSQMRLWPVFYHEQPRLLTHGWLDFSRANNIQPEDECIFEVEPDPESRYQRILAYILGSYTTMTSRQ

SEQ ID NO: 164404 - protein, 82 aa, Glycine max
  Coding DNA Sequence Number=SeqID_72719
  Homolog annotation: Hit_ID=A7QZ26; Match level="QueryCoverage=46%, HitCoverage=3%, E-value=5e-07, Identity=65%"; Hit description =Chromosome chr17 scaffold_263, whole genome shotgun sequence
MSVQVRTGLRNLCRYEFAENGQKKCNAALLLEKGHNHPGILNTVQRLLSVWSKKEFVQTAPIEQQVCILFNCTNVLSEKHVE

SEQ ID NO: 164405 - protein, 1041 aa, Glycine max
  Coding DNA Sequence Number=SeqID_72720
  Gene Ontology: Mol. function=histone acetyltransferase activity; Cellular component=nucleus; Biological process=regulation of transcription, DNA-dependent
  Homolog annotation: Hit_ID=Q93ZR1; Match level="QueryCoverage=54%, HitCoverage=96%, E-value=0.0, Identity=84%"; Hit description =Elongator complex protein 3
  Pfam annotation: Domain name=Acetyltransf_1; Domain location=477-574; Score=24.4; E_value=0.00042; Accession=PF00583.15; Description =Acetyltransferase (GNAT) family
  Pfam annotation: Domain name=HemN_C; Domain location=870-991; Score =47.5; E_value=4.6e-11; Accession=PF06969.7; Description=HemN C -terminal region
  Pfam annotation: Domain name=Radical_SAM; Domain location=109-311; Score=54.0; E_value=5.1e-13; Accession=PF04055.12; Description =Radical SAM superfamily
  Pfam annotation: Domain name=Radical_SAM; Domain location=612-797; Score=90.1; E_value=7e-24; Accession=PF04055.12; Description=Radical SAM superfamily
  Pfam module annotation: Pfam domain module=Acetyltransf_1::HemN _C::Radical_SAM::Radical_SAM; Domain location=477-574::870-991::109 -311::612-797
MAAAAVAEVRKAPRPGKGGYEAHGLSEEEARVRAIAEIVSSMVDLSHKGQNVDLNALKSAACRKYGLSRAPKLVEMIAALPDAERETLLPKLRAKPVRTASGIAVVAVMSKPHRCPHIATTGNICVYCPGGPDSDFEYSTQSYTGYEPTSMRAIRARIDQLKRLGHSVDKVEFILMGGTFMSLPADYRDYFIRNLHDALSGHTSANVEEAVAYSEHGATKCIGMTIETRPDYCLGPHLRQMLSYGCTRLEIGVQSTYEDVARDTNRGHTVAAVADCFCLAKDAGFKVVAHMMPDLPNVGVERDMESFREFFESPMFRADGLKIYPTLVIRGTGLYELWKTGRYRNYPPEQLVDIIARILAMVPPWTRVYRVQRDIPMPLVTSGVEKGNLRELALARMDDLGLKCRDVRTREAGIQDIHHQIKPEEVELVRRDYMANEGWETFLSYEDTRQFITGLVPSLIANQEGCVSNTAMTLCELSACKQDILVGLLRLRKCGRNTTCPELMGKCSIVRELHVYGTAVPVHGRDADKLQHQGYGTLLMEEAERIACREHRSTKIAVISGVGTRHYYRKLGYELEGPYMAITNTFFTSSTTHVRHNAPLNPTTPPPPSSAYIHLPFCRKRCHYCDFPIVALGSASTQTNDDPRVSNYIHWLCREISATNVDQPADASTITPLKTVYFGGGTPSLVPPRMVASVLDTLRLKFGLREDAEISMEMDPGTFDAEKMREMVVLGVNRVSLGVQAFQEELLRACGRAHGLKEVHEAIDVVKLCGVENWSIDLISSLPHQTSEMWEESLRLAIESQPTHVSVYDLQIEQGTKFGRLYSPGEFPMPSETQSAEFYKMASRMLSDANYNHYEISSYCKSGYECKHNFIYWKNKPFYGFGLGSTSFVGGLRFSRPRKVNDYINFVQNLENGLVNSSVKGHISGKDTIMDVVMLSLRTAQGIDLKSFQESFGSSVVLSLLEAYKPYVESGLVVCLDEHRRTIRIDDLNSSLSKTNAEGRVAYIRLSDPEGFLLSNELIALAFGVIDSWKDMPPYKEAEAT

SEQ ID NO: 164406 - protein, 764 aa, Glycine max
  Coding DNA Sequence Number=SeqID_72721
  Gene Ontology: Mol. function=protein serine/threonine phosphatase activity; Cellular component=protein serine/threonine phosphatase complex; Biological process=protein amino acid dephosphorylation
  Homolog annotation: Hit_ID=A7QZ26; Match level="QueryCoverage=69%, HitCoverage=51%, E-value=1e-179, Identity=61%"; Hit description =Chromosome chr17 scaffold_263, whole genome shotgun sequence
MASSVALALSKTIDPKNPLYLEDSCSGETIDWEFGFTIPKKGNLAASNCGGKSVEGTKISTVSGPERDFDSPSNKEKSINVKGRKKLLDFNGLDPDEIIDLASLNLESDDNHEDVDDSASENSYSSNDSSLQPYDLSDDDSDLKRKISQLADVVAALRKSDDADGVERAIDVAEKLIRASPDELKHAARDLTRTLVQVRCSDIALEGAEESTEDKRQRSLVALAVTCPFESLETLNKLLYSPNVDISQRIMILDVMTEAAQELAESKIMKPKHQISSLISVVSDTRPWFLPSSTGTPGAGSWKEISGTGSFLNWSNSYERELPTKPNQIKKGKTRQWSLQSPAQQNQMEYSHNKFPMYAAAFMLPAMEGYDKKRHGVDLLGRDFIVLGKLIYMLGVCMKSVAMHPEASVLAPSLLNMLRSREVCHHREAYVRRAVLFAAACVLVALHPTYISSALLEGNVEISTGLEWIRTWALDVAESDTDKECYTMAMTCIQLHVEMALQTSRALESVRNSLKADPSLYFSVVSVKQERKINLGWRNKKTKVLKDVMESDFWSNVPQRLRTKRKSKFNGKEALSTPKVVLSKSKETISRSNKALSTLKEALSRPNKALSTPKEVLSTLKEALSRPKEKLNSGDFDIYLKAAPSKDKVLTWIKKEPIFSKSYVFVPIVCWGHWSLLILCHFGESLESTTKSRCMLLLDSLEMTNPRRLEPEIRRFVLDIYKTEDRPEAKHLVSQIPFLVPKHAPDNFSMEGYPYFVSYLICCS

SEQ ID NO: 164407 - protein, 205 aa, Glycine max
  Coding DNA Sequence Number=SeqID_72722
  Gene Ontology: Mol. function=nucleotide binding; Cellular component =intracellular; Biological process=small GTPase mediated signal transduction
  Homolog annotation: Hit_ID=O82481; Match level="QueryCoverage=94%, HitCoverage=77%, E-value=2e-81, Identity=78%"; Hit description=Rac -like GTP-binding protein ARAC10
  Pfam annotation: Domain name=Miro; Domain location=11-150; Score =45.5; E_value=1.8e-10; Accession=PF08477.4; Description=Miro-like protein
  Pfam annotation: Domain name=Ras; Domain location=11-205; Score =179.3; E_value=9.7e-51; Accession=PF00071.13; Description=Ras family
  Pfam module annotation: Pfam domain module=Miro::Ras; Domain location= 11-150::11-205
MAAATAPRFIKCVTVGDGAVGKTCMLICYTSNKFPTKVTQLLSCEASPLGLSDFASPYVDHQDYIPTVFDNFSANVVVEGITVNLGLWDTAGQEDYNRLRPLSYRGADVFVLAFSLVSRASYENVLKKWIPELQHFAPGIPLVLVGTKLDLREDRHYMADHPGLVPVTTEQGEELRKHIGATYYIECSSKTQQKLAFLSTYDASY

SEQ ID NO: 164408 - protein, 238 aa, Glycine max
  Coding DNA Sequence Number=SeqID_72723
  Homolog annotation: Hit_ID=A2Q4S5; Match level="QueryCoverage=59%, HitCoverage=21%, E-value=1e-11, Identity=32%"; Hit description=IMP dehydrogenase/GMP reductase, putative
MSWGIRTPIVATIYLSERFPRLGSEWKLRIGSCCPNCWIYEHFSSIVESLTDPDYDEMSPYACRWISTKAFSKSLPASMYRKRLDGLTIVDVYWMPYDDHRIVWDFDLISCFSCHIRWGPVVAKHRLERVVGQFGYVQTIPPQTTGSMLSFEDIDDKWMHFSDYLAPMGQICVVLRQCASDYMHWFFMISHPFMTPTQLADLVRHPSVTQDDTYVEPHIPEVLVAPATTPAHALSDVE

SEQ ID NO: 164409 - protein, 111 aa, Glycine max
  Coding DNA Sequence Number=SeqID_72724
MYVCENLQIMVRTRGLGRALGRVIDRALGREDHCHSDDVSQRRRPTTSAHRQREAASVAKDAPDVADVTEDVFRHAKEVVDDAKGFLDGSCDPLVMTAYGDHVAVIVWNEE

SEQ ID NO: 164410 - protein, 354 aa, Glycine max
  Coding DNA Sequence Number=SeqID_72725
  Gene Ontology: Mol. function=metallopeptidase activity; Cellular component=vacuole; Biological process=proteolysis
  Homolog annotation: Hit_ID=Q8LF32; Match level="QueryCoverage=54%, HitCoverage=42%, E-value=1e-86, Identity=77%"; Hit description =Aspartyl aminopeptidase-like protein
  Pfam annotation: Domain name=CGI-121; Domain location=229-331; Score =143.6; E_value=5.5e-40; Accession=PF08617.1; Description=Kinase binding protein CGI-121
  Pfam annotation: Domain name=DUF509; Domain location=205-344; Score= -33.2; E_value=0.059; Accession=PF04416.3; Description=Protein of unknown function (DUF509)
  Pfam annotation: Domain name=Peptidase_M18; Domain location=1-199; Score=-48.9; E_value=3.1e-14; Accession=PF02127.6; Description =Aminopeptidase I zinc metalloprotease (M18)
  Pfam module annotation: Pfam domain module=CGI-121::DUF509::Peptidase_ M18; Domain location=229-331::205-344::1-199
MLECYDPSESQIVVIVCYIRALIDATSSDSSLEEESGVRMVALFDHEEVGSNSAQGAGSPVMLNAVTRLLEKAVQLSYLVSADMAHALHPNYMEKHEANHQPKLHGGLVIKTNANQRYATNVVTSFIFREIASKHKLPVQDFVVRNDMGCGSTIGPILASGIGIRTVDVGAPQLSMHSIREICAVDDVKHSYEHFKAFYEEFSHVDELLESMQAGTLEPEVAFLNALLIPDIFPVLAAAHKTLVAKSRDSLTTRTLHSELVYNYSGSKHITESLKRCGISDSTTCILAARFDASPDEIKAIGKLINGKEIDLEELEGRANQSQIQKIYKISSSELGVSSLADAITCRIAARDAL

SEQ ID NO: 164411 - protein, 121 aa, Glycine max
  Coding DNA Sequence Number=SeqID_72726
MPSSCYLPSLTAKEVAEVLSEKFSNFMDFHHKKLLRDTGFSQNQTQVLFYLPSLIQGSQQVSRDIFAIFDKIRLKSISEPALYRGNYLHFTWVCIRKGCRGSGSQMHNVEGMTISNITDCQ

SEQ ID NO: 164412 - protein, 258 aa, Glycine max
  Coding DNA Sequence Number=SeqID_72727
  Gene Ontology: Mol. function=cycloeucalenol cycloisomerase activity; Cellular component=integral to membrane
  Homolog annotation: Hit_ID=A7PHF1; Match level="QueryCoverage=87%, HitCoverage=43%, E-value=3e-36, Identity=83%"; Hit description =Chromosome chr17 scaffold_16, whole genome shotgun sequence
MTLRRLRHFIADLPEKLKWATEAAWILALAYFIAYLETLAISNICFTITAPSPPSSPDITTTANTTIPTQMSPPLTIKPQTRTAATSTSQSRTPPSLNQPYRRTHHNPCLLNVEHRYCLVIPTPRSVIVVGFGFLEVMEAPAEFPYYQFVDRDSMYKVGSLFYAIYFIVSFPMFLRIDEKPGDKWDLPRVAVDALGAAMLVTIILDLWRIFLGPIVPIADTKQCPQAVDKAGYTVFIAGMEIHVIEKDSFVVVDFVIC

SEQ ID NO: 164413 - protein, 296 aa, Glycine max
  Coding DNA Sequence Number=SeqID_72728
  Gene Ontology: Mol. function=hydrolase activity; Cellular component =cytoplasm; Biological process=mRNA processing
  Homolog annotation: Hit_ID=A7PHF3; Match level="QueryCoverage=92%, HitCoverage=32%, E-value=1e-141, Identity=89%"; Hit description =Chromosome chr17 scaffold_16, whole genome shotgun sequence
MVLNLPIPIRYETSSHAYIPTVIPALDSNTPIFASSFTLEEHGIFVPSRLKVFRTRKKFVAGPFEIEPIRVTHSIPDCCGLVLRCSDGTILHTGDWKIDETPLDGKVFDREALEELSKEGVTLMMSDSTNVLSPGRTISESVVADALLRHISASKGRVITTQFASNLHRLGSVKAAADLTGRKLVFVGMSLRTYLDAAWKDGKAPIDPSTLVKAEDIDAYAPKDLLIVTTGSQAEPRAALNLSSYGSSHAFKLTKEDVVLYSAKVIPGNESRVMKMLNRISEIGSTIVMGKNEAQN

SEQ ID NO: 164414 - protein, 425 aa, Glycine max
  Coding DNA Sequence Number=SeqID_72729
  Gene Ontology: Mol. function=nucleoside-triphosphatase activity; Cellular component=protein complex; Biological process=cell division
  Homolog annotation: Hit_ID=A7PHF9; Match level="QueryCoverage=94%, HitCoverage=33%, E-value=0.0, Identity=85%"; Hit description =Chromosome chr17 scaffold_16, whole genome shotgun sequence
  Pfam annotation: Domain name=AAA; Domain location=146-331; Score =278.9; E_value=1e-80; Accession=PF00004.20; Description=ATPase family associated with various cellular activities (AAA)
  Pfam annotation: Domain name=AAA_2; Domain location=142-273; Score= -50.6; E_value=0.079; Accession=PF07724.5; Description=ATPase family associated with various c
  Pfam annotation: Domain name=AAA_3; Domain location=146-272; Score= -9.9; E_value=0.0041; Accession=PF07726.2; Description=ATPase family associated with various
  Pfam annotation: Domain name=AAA_5; Domain location=146-278; Score =9.8; E_value=0.00052; Accession=PF07728.5; Description=ATPase family associated with various
  Pfam module annotation: Pfam domain module=AAA::AAA_2::AAA_3::AAA_5; Domain location=146-331::142-273::146-272::146-278
MAVLSRCGVECEGLETLCIKDQTLSIENAEKIVGWALSRHLMQNAETDPDAKLVLSCESIQYGIGILHAIQNESKSLKKSLKDVVTENEFEKRLLADVIPPNDIGVTFDDIGALENVKDTLKELVMLPLQRPELFCKGQLTKPCKGILLFGPPGTGKTMLAKAVATEAGANFINISMSSITSKWFGEGEKYVKAVFSLASKIAPSVIFVDEVDSMLGRRENPGEHEAMRKMKNEFMVNWDGLRTKDTERVLVLAATNRPFDLDEAVIRRLPRRLMVNLPDAPNRAKILKVILAKEDLSSDINMDAIASMTDGYSGSDLKNLCVTAAHRPIKEILEKEKKEQAAAVSEGRPAPALSGSADIRSLNMEDFKYAHQQVCASVSSESINMTELQQWNELYGEGGSRPAYMKLFASLIMLAGLDAELFRL

SEQ ID NO: 164415 - protein, 235 aa, Glycine max
  Coding DNA Sequence Number=SeqID_72730
  Gene Ontology: Mol. function=protein kinase activity; Cellular component=integral to membrane; Biological process=protein amino acid phosphorylation
  Homolog annotation: Hit_ID=A7PD42; Match level="QueryCoverage=98%, HitCoverage=41%, E-value=2e-77, Identity=57%"; Hit description =Chromosome chr17 scaffold_12, whole genome shotgun sequence
  Pfam annotation: Domain name=Pkinase; Domain location=2-223; Score= -55.9; E_value=2.9e-05; Accession=PF00069.16; Description=Protein kinase domain
  Pfam annotation: Domain name=Pkinase_Tyr; Domain location=5-220; Score=-122.7; E_value=6.8e-05; Accession=PF07714.8; Description =Protein tyrosine kinase
  Pfam module annotation: Pfam domain module=Pkinase::Pkinase_Tyr; Domain location=2-223::5-220
MLDNGVLLAVKRIKDWGISKQDFERRMNLIAQVKHPRVLPPVAYYCSQQEKLLAYKYLQNGSLFMLLYGSQSGHSFDWGSRLNVAAKIAEALAYVHEEFLENGIAHGNLKSSNILFVHSHNKGLKSKDLIASIFKADVHAFGSILLELLTGKVIKNDGFDLVKWVNSVVREEWTFEVFDKSLISRGASEERMMSLLQVALKCVNPSPNDRPSMSQVAEMTNSLIEEEEKSISFDT

SEQ ID NO: 164416 - protein, 354 aa, Glycine max
  Coding DNA Sequence Number=SeqID_72731
  Gene Ontology: Mol. function=nucleoside-triphosphatase activity
  Homolog annotation: Hit_ID=A7PHF9; Match level="QueryCoverage=96%, HitCoverage=28%, E-value=1e-133, Identity=72%"; Hit description =Chromosome chr17 scaffold_16, whole genome shotgun sequence
MHTFFIDVQLKHFFTGNTGLSSKEAELLKDGFSADKSCGYAKQSPTATDMARCMDPSASEPETPNSSNAPTPYGFESQPKLEADNVPSTSGTAKNCVFKLGDRVKYSSSSGGLYQLQTISSSNRIFRGPANGSRGKVVLLFDDNPLSKIGVRFDKPIPDGVDLGGLCEPGQGFFCNVTDLRLENSGIEELDKLLINTLFEVVVSESRDAPFILFMKDAEKSIVGNGDPFSFKSRLENLPDNVVVIGSHTHTDSRKEKSHPGGLLFTKFGSNQTALLDLAFPDSFGRLHDRGKEAPKPNKTLTKLFPNKVTIHMPQDETLLASWKQQLDRDVETLKIKGNLHNLRTASTSGTEST

SEQ ID NO: 164417 - protein, 275 aa, Glycine max
  Coding DNA Sequence Number=SeqID_72732
MSNVEVRVSEIEGPVEMDDKSDSESKSDVYLDDSEEDMILGLDDGFGDYATMNLTPKEVIEKLNNDLQHGVNPTFTKDMEGDYKKLGKNFKFQLEMKFNSLVDFKDAMREYLILIRMELKLGEQRKWLKRTLMEMQQSHVACCIAGCQPFIGVYGCHLKTKYGDVPVEIENENDNQVPQNGNEDVGHANDEVARGGNRGSKVNITTEIDAATEIVAYNNQFDFTLDNAKKLTSKDDNKIGALRNKHNHNKNGNNDKNDINKGDKGKACRSDMLLN

SEQ ID NO: 164418 - protein, 269 aa, Glycine max
  Coding DNA Sequence Number=SeqID_72733
  Homolog annotation: Hit_ID=A9P0B1; Match level="QueryCoverage=68%, HitCoverage=92%, E-value=1e-54, Identity=56%"; Hit description =Putative uncharacterized protein
MEQTIWGHLPVLVRANSKESIEYILQALWRTRKTGLGTTERCIIQEMLQLQNESDLDPLLVCLRMLIRRCVYENTSKEDIPKLFPSEVLPELQKLLMLLLHKFQQEWQEDVMKDQTIVPQLKTMTWNMANLDKESADPAAVINLKLQNDALFHSGEQDMKFQLATDSIDMMLKAMHCIRDQFSTVENIDERPRQGESKVDQSLVGRCVIIRAKASTDQIIWRVGFSLVLPLFSQLNWCKHKHDACTSIVDYFASAKHNVHWITGLELGA

SEQ ID NO: 164419 - protein, 236 aa, Glycine max
  Coding DNA Sequence Number=SeqID_72734
  Gene Ontology: Mol. function=oxidoreductase activity, acting on paired donors, with incorporation or reduction of molecular oxygen; Cellular component=chloroplast; Biological process=carotenoid biosynthetic process
  Homolog annotation: Hit_ID=A7PE45; Match level="QueryCoverage=51%, HitCoverage=23%, E-value=4e-47, Identity=80%"; Hit description =Chromosome chr11 scaffold_13, whole genome shotgun sequence
  Pfam annotation: Domain name=Lycopene_cycl; Domain location=1-164; Score=-181.0; E_value=0.0045; Accession=PF05834.3; Description =Lycopene cyclase protein
MPMSRTKVFFEETCLASKDAMPFDLLKKKMFSRLNTMGIRIKKTYEEEWSYIPVGGSLPNTEQKNLAFGATASMFLSTGYSVVRSLSEAPKYVSVIASILKDNHAKDIITQKRRKENLSMQDFSFGLFSGGLSNPRLVAVSNSISFANPKAPVYPRLALGRSWDEMTVTWTSGYDIDEGLLLNGVPKEKSKHTLLEKVVFTMLILNWLIENRLRKKCDDIFVNKYNYSKTILQKPP

SEQ ID NO: 164420 - protein, 73 aa, Glycine max
  Coding DNA Sequence Number=SeqID_72735
MVVAAVLVMTFSDGDSNVNGTSDDSNDNDNNVGDVGYNNVGIELVVMTITCVIALVNHTYDQDKKYPQKFYSP

SEQ ID NO: 164421 - protein, 537 aa, Glycine max
  Coding DNA Sequence Number=SeqID_72736
  Gene Ontology: Mol. function=voltage-gated potassium channel activity; Cellular component=integral to membrane; Biological process=potassium ion transport
  Homolog annotation: Hit_ID=Q9SU64; Match level="QueryCoverage=95%, HitCoverage=77%, E-value=0.0, Identity=65%"; Hit description =Putative cyclic nucleotide-gated ion channel 16
  Pfam annotation: Domain name=cNMP_binding; Domain location=311-412; Score=31.9; E_value=2.4e-06; Accession=PF00027.20; Description =Cyclic nucleotide-binding domain
MRREKLITEKLENITSNIVIWFVIPAVKDSTAAHIFPLQRRILKTSGLIAKTALAGALYNLGSYMLASHVLGASWYVSSIQRQYECWRITCKKEMNRTHSPSCNPSFLDCGTITNYERQAWFKRTRVLSDCDALNDKNEFQFGMFADAFTDHVSSSRFFQKYFYCLWWGLKNLSSYGQNLQTSTYSGETLFSSFICIAGLILFAHLIGNMQNYLQSSTAKVEEWRLKQKDTEEWMNHRQLPPELQQRVRRFVQYKWLATRGVDEEAILRALPLDLRRQIQRHLCLDIVRRVPFFGQMDDQLLDAICERLVSSLNTKDTFIVREGDPVREMLFIIRGQVESSTTDGGRTGFFNSITLRPGDFCGEELLTWALMPSSSSLNLPSSTQTVKTLTEVEAFALRAEDLKFVASQFKRLHSKKLQHAFRYYSHQWRAWGAHFIQAAWRRHRKRKLAMELLEKENLYYTNVMEDDDEEEGSAGESSMAGHAQNFGATFLASKFAANTKKGAVKKVTINLPDAGSLKMPKMFKPTEPDFSIFHDD

SEQ ID NO: 164422 - protein, 81 aa, Glycine max
  Coding DNA Sequence Number=SeqID_72737
  Homolog annotation: Hit_ID=A9PDM5; Match level="QueryCoverage=100%, HitCoverage=100%, E-value=5e-13, Identity=51%"; Hit description =Putative uncharacterized protein
  Pfam annotation: Domain name=DSS1_SEM1; Domain location=7-77; Score =96.5; E_value=8.4e-26; Accession=PF05160.4; Description=DSS1SEM1 family
MATEPKAATEDVKIDLFEDDDEFEEFEINEVMVFESSSEWDDKEEGKEVTQQWEDDWDDDDVSDDFSLQLRRELESNTEKN

SEQ ID NO: 164423 - protein, 48 aa, Glycine max
  Coding DNA Sequence Number=SeqID_72738
MGEGWLRWRLPEDPFRILPELLEDFRKKGSSGRTGLPEVVLPGSFRKN

SEQ ID NO: 164424 - protein, 53 aa, Glycine max
  Coding DNA Sequence Number=SeqID_72739
MSEEVDMNDENEHETDVNEEQHVDCSDAFNISQVFVTRDDVYERKDFICVNWL

SEQ ID NO: 164425 - protein, 90 aa, Glycine max
  Coding DNA Sequence Number=SeqID_72740
  Gene Ontology: Mol. function=helicase activity
  Homolog annotation: Hit_ID=Q2R1R7; Match level="QueryCoverage=93%, HitCoverage=5%, E-value=1e-10, Identity=41%"; Hit description=AT hook motif-containing protein, putative
MYNNKHVLNEDIIIAIKNMLKNNNHYAQKFRMASDKLQSSIVSNLKLKLIYDRQSDGRLYNLPNTAEVAALIVGDEHTSNHMDIIIEMQT

SEQ ID NO: 164426 - protein, 56 aa, Glycine max
  Coding DNA Sequence Number=SeqID_72741
MIGTRYVADSSMPLAKQWFRQSTWRYSSGRHVGLGTQGAGGGGWWWVNTSRAVEYS

SEQ ID NO: 164427 - protein, 120 aa, Glycine max
  Coding DNA Sequence Number=SeqID_72742
  Gene Ontology: Mol. function=protein serine/threonine kinase activity; Biological process=protein amino acid phosphorylation
  Homolog annotation: Hit_ID=Q8LES3; Match level="QueryCoverage=91%, HitCoverage=28%, E-value=9e-28, Identity=60%"; Hit description =Protein kinase
MNEGNDGFVRADQIDLKSIDEQLERHLSKVLMKQKEEDDAGSDHSRHSSSFATATKFKSVAGSAGATTFKKQRQEWEIDPSNLIIKSVIARGTFGTVHRGIYDGQDVAGKFDPLKHACFF

SEQ ID NO: 164428 - protein, 585 aa, Glycine max
  Coding DNA Sequence Number=SeqID_72743
MKKVTHHIIHAPSPRVLGVKGNRKERRARVRLRETEGPDLIIEGLATGQRQSHMRVNWRDHKDVTSFYFTRFPEDATAKELWIHFKQQGDVREGVRNVQQLQQHLDNMVFRGLKMNVNVPRYGRVKKGESQTGERGRAETSQAQKGRTETYQNRVPEKKMGTQRWSYAEVVNRNIPKSAPRRTPANLECIGSNDTSEVNLETLTTGKRWLKEAWVGRLKNLASFDNIEEDIWWDSGQNISPKYIGDDMVLLLGLTEENAGKLVNEEDEGWGDLFYSIEKWNPSLRPGEMVETDESLEDQRRLDVARILVKTQRKPLIQHTANVHIQGMTFPVHIVEESGPFGVTRQISRDCDFSSSEEIHSDEGDDDLWSESDLQGWRQKPRIRSNEVKIRAEAEGETFMAVDTEEAASEGALMAEEDKCRGPSDVAQSKTQRGASSQTAMMGAAEDTGGGDERSPRGKEKRRVRHACRSGGSAVVLGDELRNDAASGTTNGNDPKDKAIVQWVVKQADQALTGVKCLQTSDREHSEMQEEGKTELGEEEDLGGDVNSDDIGNLHENGMKEQTRNVGGLAYEEEKADFELSSPKT

SEQ ID NO: 164429 - protein, 109 aa, Glycine max
  Coding DNA Sequence Number=SeqID_72744
  Gene Ontology: Mol. function=aspartic-type endopeptidase activity; Biological process=DNA integration
  Homolog annotation: Hit_ID=A5APL5; Match level="QueryCoverage=90%, HitCoverage=24%, E-value=4e-13, Identity=35%"; Hit description =Putative uncharacterized protein
MVNPIVPPQFLTEDDRIMDRINPEYEAWEVQDQTLLVWLQSTLSKSIISHVLDSKHFCQVWEKIHEHFGLHTKSRAHQLQTSMRVVSLEGKTVDEYLHKIKNYVDEWFT

SEQ ID NO: 164430 - protein, 119 aa, Glycine max
  Coding DNA Sequence Number=SeqID_72745
MENSRLDYCIPNMVTGDPWLKEQEAAMNLYGGWESNFIWRRPLFDNEVDTTDGFLGETAQTVVQPHRADIWVWKPDPNGQYSTQSAYNLLLGESREENLDGAFEELGKLRIPTKTSFFA

SEQ ID NO: 164431 - protein, 1122 aa, Glycine max
  Coding DNA Sequence Number=SeqID_72746
  Gene Ontology: Mol. function=phosphotransferase activity, alcohol group as acceptor; Cellular component=chromosome; Biological process= response to DNA damage stimulus
  Homolog annotation: Hit_ID=A7PD08; Match level="QueryCoverage=27%, HitCoverage=21%, E-value=2e-53, Identity=60%"; Hit description =Chromosome chr17 scaffold_12, whole genome shotgun sequence
  Pfam annotation: Domain name=RRM_1; Domain location=479-550; Score =2.3; E_value=0.09; Accession=PF00076.13; Description=RNA recognition motif. (a.k.a. RRM, RB
MILKFHDDPTVNGFEIVVFLRLVSIVSCVLSLCSCSSSAIAPFFSRDTVSLEIQTIVDGFLDLDDNHASASVVDKINIFRPDRVFMFLVEIHYKIAAASHYRHKCHRLAGIEVLISILGQRAAVLSTSNLSTDVTSMLGEQLQELEPLPELKIFDEIRKFHEELCHTYSIRDHLLKFVKKSCYLPPRLLLSSLQALQKKLLNVETFQRGGKAEVFSKDRYWHGDHEIVPAVWKLVHMCGSDDASEVRELVSDFISRVGAGDPYSVVFHLPGETSHLRLGKSIDISSAMEISSDLDACISEELLVVLLKFLMKYLMDDSVKIVDMASQTLRGILSTERGQSALQSFDSYQRSLIERERERGRTRERVSLRGRPRRRAHDSVRGSARDRVRGRARVGESENGGQLHYRASAGQHGGRGFAESRRATYEVDNSPIGTDERWVEVSHRRKKKTDVDRGISVLNKRQRQDRRGTWRDKEDVTSFYFSRFPDGVNEKYLWQIFQRWGKVWEVFIHKAKNKAGHRFDFVRFKEVQDVQRLERQLDNSIVLGGIKMFVNKPKFERDNVNRGHPHGTPTHGKGKPQEVDNGRQRTYDTGGRLRSYVEVARGVTPLGITLSNDNRLVLSPVILNPTIEHTEWLHKAWVGRLKNKGMFENVKEELRWVLDPDINPRYWVDDWVILPNLEDDKALRLMNEERTKGSTPILDLQKWSPHIPPTHRLAWVLLWGLPPTVWEVVYMEKVVAELGELVEVDEMVEERGRMDTARILIRTNLRPGIEKAVPAVIDGVDVIIHIVEDMQGLGRKTKPKQSPMWYPPSPLSTEPNSLTTYAGRTPGDDTDGASLDGGLGGSDGGLSGHWHRTRSFLAGRVLRTQPTHNGHIDWSDAVKPDVAQSCGDNHRVEDQSQQGPNNGHLRQEGKVFKASSHSGCCVDAQMEKAILTQTGAAKEQKEDTAVVADFNQNEKGVVALSGSKDGMLEGEKQIIDPFDERIACSRGQYNCLQTSTPLTVGPSHSQREGGELGQQIIGPFNPGTKVYVRIKEFKDAKTEAQSVLPSHKEIAYQPYEAHLKADMKDPRANICKQASLEDQIALVSDMGLTYGQETQKIKELMIYMEQRDNSVAVEKGIKNHQS

SEQ ID NO: 164432 - protein, 365 aa, Glycine max
  Coding DNA Sequence Number=SeqID_72747
  Gene Ontology: Mol. function=phosphotransferase activity, alcohol group as acceptor; Cellular component=chromosome; Biological process= response to DNA damage stimulus
  Homolog annotation: Hit_ID=Q9M3G7; Match level="QueryCoverage=99%, HitCoverage=8%, E-value=3e-95, Identity=50%"; Hit description =Serine/threonine-protein kinase ATM
MVHSKGVNIELVENLLLDLERKSKAEAISLEKSPVWVTDGKTFDMWICPLVYSLTVYCNDVILRLCQDIIWFKGEVAELLLPSIFVNIAARKDLEVDLHKLICLQLEEHVFTESNKLMKSIQVVLNCLNELRIRHVMERFSFVPSKSEVSKNSRPSSYSSKTRSTPAKARESAVVSYALSKSPSSWEKVYWLSIDYLLVAKLAALVEHTAGTSQSCGSYFTSVMYVEHWCEEQFKTLTIGGPDFSHNEMLPDHIEILVSAVTRINEPDSLYGILQSHKLTSQIITFEHEGNWGKALEYYDLQVQSDASVQKDGCSKSMSLKQTGAANPSSFASEVDEMRQSRPYKGLIRSLQQIGCTHVLDIFLI

SEQ ID NO: 164433 - protein, 95 aa, Glycine max
  Coding DNA Sequence Number=SeqID_72748
MELQKWHLQKQVRSGPKSKALVDGFWHDKDHVRGARKTPVEEVVVEKGQIGFWQVEWWGHLPERSPEHMQLEKTQIFVVPWMLELGDIVLHEEAH

SEQ ID NO: 164434 - protein, 164 aa, Glycine max
  Coding DNA Sequence Number=SeqID_72749
VFHTFDTLDVDQVVNLLVELLEVSTKEAKDKTEQCRGAYVCLAWLRDIYRDKCDHFLTITSIVADGDYHKRKPRACRWKSGKALPMLMYRKHFDRLTPDVVCWIPYEYLAPFGYIYIAPRQCAADYMEWFYRIFHPFMSLTQLGDPSRHPHVMHDDTFIVPDPI

SEQ ID NO: 164435 - protein, 177 aa, Glycine max
  Coding DNA Sequence Number=SeqID_72750
MFCWSRYKLVVKMKQNGEKANFHFWDAVCIKIFGKTADECCQELIASGDEIKVFPACVDQLLGKTWVVRFKHRIQMHQSSVLDFSEQEHHIQSVISTLGLQDEQCISNKSLAVGAASSSQQDYHPTPSLSQSSEYDPGNAAFVTPAKRTSDQQESSQFDSDDFATYELSTNKHIKAE

SEQ ID NO: 164436 - protein, 277 aa, Glycine max
  Coding DNA Sequence Number=SeqID_72751
  Gene Ontology: Mol. function=helicase activity; Cellular component =nucleus; Biological process=viral genome replication
  Homolog annotation: Hit_ID=A2Q378; Match level="QueryCoverage=100%, HitCoverage=23%, E-value=4e-67, Identity=48%"; Hit description =Putative uncharacterized protein
  Pfam annotation: Domain name=DUF889; Domain location=30-193; Score =150.3; E_value=5.2e-42; Accession=PF05970.5; Description=Eukaryotic protein of unknown function (DUF889)
MCHRYSIEALDKSLQDIMHNSNPFGGKVIVFGGDFRQILPVVPRATYPDLLHNYNNGDFLQKRVVLASTKDVVDKINDYVLSLIPGEEKEYCSADSIDKSDELLNPAFGVLTVEFLNSLKTSGIPNHKLIIKVGMPTILLRNLDQADGLCNRTRLIVTRLGSSVVEVEIITGPNIGHRTYIPRMNLSPSDSPWPFKLIRRQFPFMVSFAMTINKSQGQSLALVGLYLPTPVFSHGQLYVALSRVQSKKGLHILIHDNQGTPKNTTINIVYKEVFANL

SEQ ID NO: 164437 - protein, 299 aa, Glycine max
  Coding DNA Sequence Number=SeqID_72752
MAGLYQSDIEHQGDLLFEFSFLEMWVAIFGNWVMMEVIWGGVGVSWKCNGEDEVLGGSRQVKELSNVELDKIMSTALVDQDNKAMLGRGGPSVRKGCQNLMQRVRCPHRQLKYAIEVYNDGQESICHPNDNKVPGHAREPFPRKGKLGLGMLGNKAVVGDKSCNGGQEVLFPGAWPGTRLVSMMKVGGPAPPDASPGILVICWAKRDSRASSIPVQDSKNYKALKIHSTGSRPSKCGTSNFIWGQEGDGEVSIGKEEGKDWPWFKRVTASSKRSMVACLVLCSGGSIREGRTSCYDPIL

SEQ ID NO: 164438 - protein, 42 aa, Glycine max
  Coding DNA Sequence Number=SeqID_72753
MALVIGVAFAPPAGMQRSPSLFFHSINPTMHVDDSSYGSKFL

SEQ ID NO: 164439 - protein, 94 aa, Glycine max
  Coding DNA Sequence Number=SeqID_72754
MILLPMEQTGRIKENSAYAGHGGGGGGGFGGGGRCGDGVAADIVADDGQSKRLKVDDANHSENGRCKKEPNKDRARDRDCERSSSRHRSERERD

SEQ ID NO: 164440 - protein, 104 aa, Glycine max
  Coding DNA Sequence Number=SeqID_72755
MASLNGNFPASMPVLIGKNYGDWCAQMKKSYVGDRKLKKVKLQTLRRQYELLQMSDQESIVVAIEQGQDLEEMKIEELQGILKAQEMRLNERNSQRSVEQELQA

SEQ ID NO: 164441 - protein, 72 aa, Glycine max
  Coding DNA Sequence Number=SeqID_72756
MSRTPCPTFFALQKRWANANPGLAPFNYLDPLAIDITAPPLFFCCSLGFRYSIVYGLQMRDFSSHKGGSFKV

SEQ ID NO: 164442 - protein, 41 aa, Glycine max
  Coding DNA Sequence Number=SeqID_72757
MAQLQLAVENFTGTTMSNERKYICRHPAGNTWKVVSVVTAR

SEQ ID NO: 164443 - protein, 46 aa, Glycine max
  Coding DNA Sequence Number=SeqID_72758
  Gene Ontology: Mol. function=adenosine kinase activity; Biological process=purine ribonucleoside salvage
  Homolog annotation: Hit_ID=A7PI27; Match level="QueryCoverage=100%, HitCoverage=13%, E-value=5e-15, Identity=84%"; Hit description =Chromosome chr13 scaffold_17, whole genome shotgun sequence
MKLYPVILLPKGKLVDTNGAGDAFVGGFLSQLVDQKSIEECVRAGC

SEQ ID NO: 164444 - protein, 43 aa, Glycine max
  Coding DNA Sequence Number=SeqID_72759
MERGRKERPKEVKSYFSPLSRKSKCTKEKFLWRKVQVFPWKKQ

SEQ ID NO: 164445 - protein, 242 aa, Glycine max
  Coding DNA Sequence Number=SeqID_72760
  Gene Ontology: Mol. function=phosphoprotein phosphatase activity; Biological process=intracellular signaling cascade
  Homolog annotation: Hit_ID=A7R8Y3; Match level="QueryCoverage=74%, HitCoverage=56%, E-value=4e-27, Identity=36%"; Hit description =Chromosome undetermined scaffold_3090, whole genome shotgun sequence
MWAWERCPTLAPKRTPSQVENTPLGHRWLRHGNQHIGNDDVRVFRRKLDIMKRHEFVWEPYPSTVISLLPPVCLVRSHAWYEVVPLICFQVIEWHQLDRVLRQFGMQQPIPESPSQPLNIHGITLKWKHDENWGQLFAPMIDQWNNRHAFRVDAYPRQEGLLSFNSDYMVWLKLRRHYNTWCLLKGGIHGQLMISCLMWKKLQFYPKSKRDSLSQCHMVLHLSDNFPHNSFICFSQVLKLRA

SEQ ID NO: 164446 - protein, 349 aa, Glycine max
  Coding DNA Sequence Number=SeqID_72761
  Homolog annotation: Hit_ID=A5B5G7; Match level="QueryCoverage=62%, HitCoverage=15%, E-value=7e-07, Identity=24%"; Hit description =Putative uncharacterized protein
MASRKRKATASRLREPYDMTRFIYEVAWECYEQNVHSRNILPVRNITLYVTEYEEFRREFERRRWHKALTRQPDGRIDVALVKEFYANLYDLDDKSPRQVRVWGKLIKFNGESLNAFLETPVVLEPGEHYTTYSRFCHTHPDSQELASKLCIPGCGFVLNTEGVPWKLLRKDLTTLAQTWSVFSYSNLAPTSHTFDLNMDSARLVYGLVKKMDMDVGSFILDTPVSSSAPPAPAPSPPSPPAPFGTSAQSSDAIMLMLESLHHALCLVMQSIHDLAQHRPIISMEDFRAQVAWPGVQPSSLGGGEAPTAQEPLLEPEATLEATPEETPEDNPAATPTEDTDYAADMAAA

SEQ ID NO: 164447 - protein, 136 aa, Glycine max
  Coding DNA Sequence Number=SeqID_72762
  Homolog annotation: Hit_ID=A2Q1D6; Match level="QueryCoverage=97%, HitCoverage=22%, E-value=7e-11, Identity=31%"; Hit description =Ovarian tumour, otubain, related
MKLLDMLSRYALNQIVVEFERVHYADKNPSYCGCIMRTTHSLPCTCELVRYVVDTIPLDTIHMFWRRLSFTYQGLSEPKVSIIEEMKTISKQFKEFDVCGKVTIKSKLREIAYPYVNSMFALSEKAEKRWHPNKWA

SEQ ID NO: 164448 - protein, 74 aa, Glycine max
  Coding DNA Sequence Number=SeqID_72763
MMLHRALTYVPSSTSHPNSNPPTTLSTSEKIEICESRLGLFGSCLVDRDEHGGGGGTHNDVVDGGNWVAAIVHA

SEQ ID NO: 164449 - protein, 61 aa, Glycine max
  Coding DNA Sequence Number=SeqID_72764
  Gene Ontology: Mol. function=nucleic acid binding; Biological process= DNA integration
  Homolog annotation: Hit_ID=A5BW89; Match level="QueryCoverage=100%, HitCoverage=5%, E-value=2e-12, Identity=57%"; Hit description =Putative uncharacterized protein
MDQVFIASAANVFAQVNNIPMLNETNFKVWKEVVEIVLGCMDLDLALRMERPTSTPEASNE

SEQ ID NO: 164450 - protein, 74 aa, Glycine max
  Coding DNA Sequence Number=SeqID_72765
MEEENSAKAKHQQHSTRRTLKKYSTMEKSKATEKAEALKPCKPLKLHVKPGLSRQHCGRVPRGPISPSLWASPT

SEQ ID NO: 164451 - protein, 129 aa, Glycine max
  Coding DNA Sequence Number=SeqID_72766
  Gene Ontology: Mol. function=transferase activity, transferring glycosyl groups; Cellular component=chloroplast; Biological process =tryptophan biosynthetic process
  Homolog annotation: Hit_ID=A7PCX5; Match level="QueryCoverage=73%, HitCoverage=24%, E-value=6e-35, Identity=77%"; Hit description =Chromosome chr17 scaffold_12, whole genome shotgun sequence
  Pfam annotation: Domain name=Glycos_transf_3; Domain location=16-128; Score=-80.3; E_value=0.0001; Accession=PF00591.12; Description =Glycosyl transferase family, ab domain
MAQCEGGKEGHSRLELLVSLDNTFVEGVKRCVNEAGMGFMMSLKYHPTMKIVIPIRKKLKIKTIFNILGPMLNLAHVPFAVVGVYTEDLVFKMAKAFNRFGMKGALIVHSGLDEMNPLVPIPRNYLIIP

SEQ ID NO: 164452 - protein, 584 aa, Glycine max
  Coding DNA Sequence Number=SeqID_72767
  Homolog annotation: Hit_ID=A7PCX3; Match level="QueryCoverage=99%, HitCoverage=53%, E-value=1e-174, Identity=55%"; Hit description =Chromosome chr17 scaffold_12, whole genome shotgun sequence
MQRILSHIQVFALSRWLTVKLPVEFYEFARHLQWTVPYFPVPWEAEPMNLFMVGSNPFGSSNFITKAPATIPKKFLDKSLNLAASVYGSPLTSSEYLQYFESENMKPEAEYLLDSQHSAGWTEFYRSMFWLAVICGGLMVLHAFLLIVLKFGKRNSEKDKIHGALTFPRFEMFLIFLALPNVCKSSGVLLQGGSPSGLAVGILLLVFVGTVLLALFMFLSIGITFGKLLQYKEVHQEGETFHWYQELVRVTLGPGKRGQWTWKEQPKSVNLTIFGPLFEDLRGPPKYMLSQIAGGSGNPPSQRDCIIASDDETEDAEAPFIQKLFGILRIYYVFLESIRRVSLGILAGLFVLTQPSKSPVIIVLSMTSFQLFFMLLKKPFIKKRVQLVEIISLACEVTLFATCLVLLKKDISVSAETKYGIFMLVLFLIGYCAQITNEWYALYIQAKMLDPEEKSLLTGLKNASIGFLLYFVPQKCIKDLEKRLPQNDNVNEEPRDTASGADRSRRSSSRSSGTPDGAWLKQLRGFAKSSFGRERSGTRNDPSTSGTTGWSGLWGNKRSGSSSSEFKSKSSSLYKDLEAIFASK

SEQ ID NO: 164453 - protein, 165 aa, Glycine max
  Coding DNA Sequence Number=SeqID_72768
MAARRLQKKDEKALARACAMCYQSGVQRHKKGVWTLGSEVSIEEEEKIKLESGIEGVNGVNVANGDWRIGAYPRDDDEDGQCDPDYGGCSYAHDKDSESCDAIRDTVGMFSKDKRGTVGGFLDDSDNHESLKANGDAEDRVIEHIVERSSPARTVVLIVVVTSSE

SEQ ID NO: 164454 - protein, 337 aa, Glycine max
  Coding DNA Sequence Number=SeqID_72769
  Homolog annotation: Hit_ID=A7PCW3; Match level="QueryCoverage=100%, HitCoverage=97%, E-value=1e-109, Identity=62%"; Hit description =Chromosome chr17 scaffold_12, whole genome shotgun sequence
MPNLKGRLQKQHYALFVVSEDQSQYCELETTALVLENSNTVAEDISPASNSYFHLSGSDGKPGLLSFYNRPYRRDSKILLPNSERSQNSILWFLGPAVLVASFIFPSLYLRKVLSIIFEDSLLTDFLILFFTEAIFYCGVGVFLYLLDHVRRPLLVDIAANNSDTLPPQLGQRVSSVATLVLSLVIPMVTMGLVWPWTGPAASATLAPYLVGIVVQFAFEQYARYRKSPSWSAIPLIFQQMLVVNMLVRGIQTHDLSLSLSSFNHQVYRLHQLNRAAQLVTALSFTVRGAEMTSHNMAINSSLGTLLNVLQFLGVICIWSLSSFLMRFIPYASTTKQ

SEQ ID NO: 164455 - protein, 62 aa, Glycine max
  Coding DNA Sequence Number=SeqID_72770
MSAFSATGNIFDLEITVNDEIIKSSRSYADPVVGFEEQSSNGSTPPADSQANIPNGKHVVKN

SEQ ID NO: 164456 - protein, 210 aa, Glycine max
  Coding DNA Sequence Number=SeqID_72771
  Gene Ontology: Mol. function=hydrolase activity, acting on ester bonds; Biological process=lipid metabolic process
  Homolog annotation: Hit_ID=Q65X52; Match level="QueryCoverage=91%, HitCoverage=95%, E-value=2e-24, Identity=35%"; Hit description =Putative uncharacterized protein OJ1123_F01.15
  Pfam annotation: Domain name=Lipase_GDSL; Domain location=31-192; Score=33.7; E_value=6.7e-07; Accession=PF00657.13; Description=GDSL -like LipaseAcylhydrolase
MKIFILFSITFAYGFLGNVVSNANPLPYEAIFNFGDSISDTGNAATYHPQMPSNSLYAEAYGMPMLSAYLNLTKAQNIKKGVNFAFAGSTALDKDFLQGKRIHVHEVAYSLSAQLDLFKKLKPPLCKSKEGFSSGKIETFRACCGKGEPYNLSLQIACGSPTATVCPDPSKRINWDGPHFTKATYRLIAKGLLEGPFANPSLRSPPFKIA

SEQ ID NO: 164457 - protein, 125 aa, Glycine max
  Coding DNA Sequence Number=SeqID_72772
  Gene Ontology: Mol. function=oxidoreductase activity; Cellular component=endoplasmic reticulum; Biological process=metabolic process
  Homolog annotation: Hit_ID=Q45NH9; Match level="QueryCoverage=93%, HitCoverage=49%, E-value=4e-31, Identity=62%"; Hit description =Ribitol dehydrogenase-like/short-chain dehydrogenase/reductase family protein
MARNARVTINAVHPGIVKTGIIRAHKGLITGRFPIFYCIKVTQNDITVCNISHYDGGNNVNACAQGASTTCYVALSPKTEGISGKYFADCNECKCSSLANDESEAQKLWNNTHALLHKRLRQATI

SEQ ID NO: 164458 - protein, 590 aa, Glycine max
  Coding DNA Sequence Number=SeqID_72773
  Gene Ontology: Mol. function=nucleic acid binding; Cellular component= intracellular
  Homolog annotation: Hit_ID=A7PCU6; Match level="QueryCoverage=90%, HitCoverage=97%, E-value=1e-111, Identity=45%"; Hit description =Chromosome chr17 scaffold_12, whole genome shotgun sequence
  Pfam annotation: Domain name=G-patch; Domain location=545-589; Score =53.7; E_value=6.4e-13; Accession=PF01585.14; Description=G-patch domain
MTKILAFRNNQPKGRNLEVQEATAVFALLLRSLQEFVSEDSNDNKREIQQLNEVQTEAMDADSEYRENSDSSFVWDENSQLYFHASSGFYHDPNAGWYYSNKDGAYYKFEDGNYVLLGTKEDDNVEMYQCKETTKENPQQIYDGNNNEDHPSFLESKFETNQQIGTLADEAPADTPNSVSSPTCEDPPPPPSEWLEDTLIDLYLSGYKNIEVSEADAVTVPFETDDRYNSLAADAYSKTYEVEGEWILEPGDENGLADNRSTVDEGIPYSNTYELEEGEWIPDMEDEYGIADRSTIDEAISLDEEKWRAQYGQVTESGKDLVSEVPIVDLWDWEMVTGSKRDGKDKMARLVGRLVKPSAKQHPSIPFSGGKLRSAPICEAHLDLQYWDFQYRARGQLYRLRNPSAKYVASLSTYDSSNPTEHWDFPQLSPNRKIKRHSKSSESSASALDETPIEKDLSALPSQLSASKSCGLGKLREYNDMENNSKLKIKHQYRDRAAERRILHGGFGMGPGQKNLSDIYNTPSSPVDDCPQEATAEALEMSFGAGSYARKLLKSMGWKEGEGLGSSTKGLVEPIQPVGNVGTSGLGWSR

SEQ ID NO: 164459 - protein, 559 aa, Glycine max
  Coding DNA Sequence Number=SeqID_72774
  Gene Ontology: Mol. function=histone deacetylase activity; Cellular component=nucleus; Biological process=regulation of transcription, DNA-dependent
  Homolog annotation: Hit_ID=Q9FML2; Match level="QueryCoverage=68%, HitCoverage=78%, E-value=0.0, Identity=79%"; Hit description=Histone deacetylase 6
  Pfam annotation: Domain name=Hist_deacetyl; Domain location=26-344; Score=553.6; E_value=2.1e-163; Accession=PF00850.10; Description =Histone deacetylase family
MARGERAETESGVSLPSVGTDAKKRRVTYFYEPCIGDYYYGQGHPMKPHRIRMAHNLIVHYGLHRRMQVNRPFPAAEADIGRFHADDYVDFLSTVSPQILSENSHSHYRQLKRFNVGEDCPVFDGLFDFCRASAGGSIGAAVRLNREDADVAINWAGGLHHAKKAEASGFCYVNDIVLGILELLKVHRRVLYIDIDVHHGDGVEEAFYTTDRVMTVSFHKFGDFFPGTGHIKDIGVGAGKNYSLNVPLNDGLDDETFRGLFRPIIQKVMDVYQPDAVVLQCGADSLSGDRLGCFNLTVKGHADCLRFLRSFNVPLMVLGGGGYTVRNVARCWCYEVPFFTYLDGNTAVAVGVEPSPKLPYNEYYEYFGPDYNLHVEPSTMENLNTPRDLEKIRCQISKATIARFLSYVPEARGQGLNLSRIRASDFSCCHAYSAHISLSGCLCWWGVGLHWEVVTTYNFDYDLYPNAFSCLPADLTWSFPTPDYNIYAKNTLLEQLSRLPHAPSAPFQTTPSVIEVPEEEEEDMDVRPKRRIWSGEDFDSDHDDDMASSKNSDLTAQTR

SEQ ID NO: 164460 - protein, 148 aa, Glycine max
  Coding DNA Sequence Number=SeqID_72775
  Gene Ontology: Mol. function=carbon-sulfur lyase activity; Cellular component=vacuole
  Homolog annotation: Hit_ID=A7PCU3; Match level="QueryCoverage=68%, HitCoverage=22%, E-value=3e-37, Identity=69%"; Hit description =Chromosome chr17 scaffold_12, whole genome shotgun sequence
  Pfam annotation: Domain name=Alliinase_C; Domain location=2-144; Score=-108.2; E_value=4.3e-08; Accession=PF04864.4; Description =Allinase, C-terminal domain
MFCSGDPTAYERFWRQTGDKSTITIQGWQSMSYFSDVTNICWFLEAEFGREVVRLHNVVGNAVTEGRHIVVGTGSSQLFLAALYALSPTDSPEPISVVCATPYYSLCSCTNYHNSFSCYKRYFDHFKLYIEGILAWPRNSFLDVHDGL

SEQ ID NO: 164461 - protein, 62 aa, Glycine max
  Coding DNA Sequence Number=SeqID_72776
MLIQDKDTLNVSHALSTRINAILAKRGKHVQHEGCVKTKLTCIYKRSSVEKHYFLIELRKNI

SEQ ID NO: 164462 - protein, 183 aa, Glycine max
  Coding DNA Sequence Number=SeqID_72777
  Gene Ontology: Mol. function=amine oxidase activity; Cellular component=cytoplasm; Biological process=amine metabolic process
  Homolog annotation: Hit_ID=A7QXZ7; Match level="QueryCoverage=68%, HitCoverage=18%, E-value=7e-54, Identity=74%"; Hit description =Chromosome undetermined scaffold_235, whole genome shotgun sequence
  Pfam annotation: Domain name=Cu_amine_oxid; Domain location=1-183; Score=-229.9; E_value=0.00021; Accession=PF01179.11; Description =Copper amine oxidase, enzyme domain
MELLKVATAARYFKEAARISIKAKLLYVEKKTIQIDMNMITLNLEPPRKKLGGHSSPINYVVEVNIKVEEPGEKNVHNNAFYAEETLLRSELEAMRDCNSLTARHWVVRNTRTCNRTGQLTSYKLVHGSNCLPLAGSEAKFLRRAAFLKHNFWVTTYSRRVGEGLATWVKQNRCLEEINVVLW

SEQ ID NO: 164463 - protein, 101 aa, Glycine max
  Coding DNA Sequence Number=SeqID_72778
MEIRFLVSGKYVALQISDDEDVETMIESGSMFHAANSVTSCGRNVSHHESELPRNISNLHDDEDDDDDDYLASNSYIEESFDEDDSDDEISDTDDEVTDSQ

SEQ ID NO: 164464 - protein, 384 aa, Glycine max
  Coding DNA Sequence Number=SeqID_72779
  Gene Ontology: Mol. function=transferase activity, transferring glycosyl groups; Cellular component=cytoplasm; Biological process =metabolic process
  Homolog annotation: Hit_ID=A7NY88; Match level="QueryCoverage=95%, HitCoverage=78%, E-value=5e-92, Identity=48%"; Hit description =Chromosome chr6 scaffold_3, whole genome shotgun sequence
  Pfam annotation: Domain name=UDPGT; Domain location=1-369; Score= -130.5; E_value=0.0005; Accession=PF00201.9; Description=UDP -glucoronosyl and UDP-glucosyl transferase
MEPPFDHLLRRLHPPVTALVADVELHFPVAVARRSNIPVALLWTMSASFYLTLHQLGSLVRNHSLKVDVLGRVSKVTAKYDYEEHIPGISAAQLADLRTVLRENDLRFLQLELECISVVPKADCLIVNTVQELEAEVIDSLRAMFHFPICRIAFPYFKHETCHFVTNDSDYNVDYLNWLDHQPSMSVLYISLGSFLSVSCAQMNEIVSALNTSGVCYLWVVRGEVSWLKEKCGDRGLVVPWCDQLKVLSHPSVGGFWSHCGWNSTLEAVFGGIPMLTFPLFLDQVPNSRQILEEWKNGWELKRSDLGSAELITKDEIVQVIREFMDLGKRKEIRDRALEFKGICDRAVAEGGSSNVNLDAFIKDVLCVQRSLRGRGYVMYKIGK

SEQ ID NO: 164465 - protein, 362 aa, Glycine max
  Coding DNA Sequence Number=SeqID_72780
  Homolog annotation: Hit_ID=A5ASR8; Match level="QueryCoverage=65%, HitCoverage=54%, E-value=7e-10, Identity=22%"; Hit description =Putative uncharacterized protein
  Subcellular localization annotation: CTP_CleavageSite=41; ConfidenceScore=5.32e-01
MAEPSKKRKGSSSTAAAAAHRRHGPSEAPTAPIHPSLSSPRSSTLFSSDDQRLRYLSQFSSRIILDPKYLDVDFFNDETFDCYQVFQNSGLVDFMSLKLSHYPELVKVFYCNLKIQDDIISSEVHGIPMIIDQSLFFSLTHLPSQSAPFEGTIFDDWIFDYSSHDARRMVCNDQAEMTGRLLAGSLTFDNRIMHYIIVRILLPLSSNLAQAFEEDLILMWNFLPALWANAPLPYPQLITLFLRHFQIPLDDEPFVQVKHSFAIGAGAVTSFGYRKDRNGQWLKEDTLPPQDERTLSSPPRRDDLALMNEVLSELRGLCSYVDERFDSLDTRFAGMDIRLTQLEEDVGYIRQSFDLPPPPPPS

SEQ ID NO: 164466 - protein, 74 aa, Glycine max
  Coding DNA Sequence Number=SeqID_72781
MAVRSIHDQYTGPCKIGSMTKQLDLLQMEKEREGEGARMRKKKEARTRREREKEGGVRNFEVGGRRIISREVEV

SEQ ID NO: 164467 - protein, 89 aa, Glycine max
  Coding DNA Sequence Number=SeqID_72782
MVVEYSFSVVVHGHAGNVLIGATLCLVAVFNGCERRMKVAGIFMVVAGGDALIPKGERRATGGDGVRERKPKSKATTRKAWLMVKEGRL

SEQ ID NO: 164468 - protein, 191 aa, Glycine max
  Coding DNA Sequence Number=SeqID_72783
MTRRIDLVVDFGNRKLEWGKIIPRDRRQYTHESTIEYLMDNIQEKVDLDGQDKGYRVVLDEKRFLRKKGISREGSRSRLDDNTTSYLGGNSKVGYEEDIVSKFVSMEERDKKENRDEGVCKEGSCGITIVNAYSLYDLPNKRFVQFVNDAWKRLDVQGWGAYVLKEKFKGIKKELKVWKKDVFGNLELRYK

SEQ ID NO: 164469 - protein, 44 aa, Glycine max
  Coding DNA Sequence Number=SeqID_72784
MEEEKEKHEGDGFDGEGSTTVARRWWHNSRVELTKRGRRKRRSP

SEQ ID NO: 164470 - protein, 409 aa, Glycine max
  Coding DNA Sequence Number=SeqID_72785
  Gene Ontology: Mol. function=ubiquitin-protein ligase activity; Cellular component=plasma membrane; Biological process=cytokinin metabolic process
  Homolog annotation: Hit_ID=A7P478; Match level="QueryCoverage=93%, HitCoverage=95%, E-value=1e-128, Identity=59%"; Hit description =Chromosome chr1 scaffold_5, whole genome shotgun sequence
  Pfam annotation: Domain name=Copine; Domain location=111-249; Score =247.7; E_value=2.6e-71; Accession=PF07002.7; Description=Copine
MGGSISKRRRSKQHSSNFFPRYQQPHFPQSQDNGSVGHYGYSPQSYGGGRAPEQGKSLDRKYSRIGDDYKSLDQVTDALAKAGLESSNLIVGIDFTKSNEWTGGRSFQRRCLHHIGHEQNPYEQAISIIGKTLSSFDEDNLIPCFGFGDASTHDQEVFSFYPDERFCRGFEEVLERYRELVPQLKLAGPTSFAPVIEMAITIVEQSGGQYHVLVIIADGQVTRSVDTEHGQLSAQEKKTVEAIVKARHVSSVKKLSVSCAEHEIMSKNMDRSRKETEFALAALMEIPSQYKATLELNILGACRGKDIDRIPLPPPLYGAASFNSPKTSRQYSSRPSAPSSRHDVSTNPPATSASDNQVCPICLTDPKDMAFGCGHQIGRTCGLISHTIDITLKFSCNCVSVGNVNEGTG

SEQ ID NO: 164471 - protein, 145 aa, Glycine max
  Coding DNA Sequence Number=SeqID_72786
  Homolog annotation: Hit_ID=A7PLZ1; Match level="QueryCoverage=69%, HitCoverage=14%, E-value=4e-13, Identity=42%"; Hit description =Chromosome chr14 scaffold_21, whole genome shotgun sequence
  Subcellular localization annotation: CTP_CleavageSite=73; ConfidenceScore=5.29e-01
MTCILILINRMIALAFVLYSLASKYNHVYSNQTLISLPLSFLMSNMSNPKMQQRRERRMFSTSDDSAMTKQVEATHAPDGREIDVKPILQIVDEILVRFIARTVEGHEVKRDQDALEMTAALAEFDMLDSLAYIINKISCEVVFI

SEQ ID NO: 164472 - protein, 365 aa, Glycine max
  Coding DNA Sequence Number=SeqID_72787
  Subcellular localization annotation: CTP_CleavageSite=70; ConfidenceScore=5.14e-01
MDSPAVSSIHFHNAHVLPEPDLFMHTPGGFGIPSFRKRHCVQPSRQNPRRSRRRRHGLRSVPLLLQELIGCAQVHGGGHGQVRNPPSSIVARVFGAAAEAEVHQGTGPALEHGERGGRVATLSALRRTGSLPQVREAPQEPFQSREGNRGLEIPREPRPLARTRRSPPHGRTRKEEEEGEEVEGGGEVVRAAERGDGVFGAHMHGGVYGGGAIRGGGWTTKNAVLKVRHVSGFAGSSKEGVCGVSVCGSSSGSTPPFAYARIHARNIGRSTYRVKDAQDRTNTVYSYYLLDPTSVSVSWVGNKPNMRASVTVNLAVLAECDRQIRLKMEQENMKDDARWKLLVRKVASAKALSSLALPKRKLDQS

SEQ ID NO: 164473 - protein, 128 aa, Glycine max
  Coding DNA Sequence Number=SeqID_72788
MGIGICCGKVSSKSQADVMEGYLLEATWGCEESNGSNNVGTQGHKQNHRGPRGGGSNSYSTVNVANSSHGDNQQDIGISSSSNSSHGISKEQPQQIAHALSMMNATGNMMLMQMLQDLATGSMIGSGE

SEQ ID NO: 164474 - protein, 192 aa, Glycine max
  Coding DNA Sequence Number=SeqID_72789
  Gene Ontology: Mol. function=cysteine-type peptidase activity; Cellular component=cellular_component; Biological process=ubiquitin cycle
  Homolog annotation: Hit_ID=Q9STL8; Match level="QueryCoverage=52%, HitCoverage=15%, E-value=6e-49, Identity=90%"; Hit description =Probable Ufm1-specific protease
  Pfam annotation: Domain name=Peptidase_C78; Domain location=3-180; Score=137.8; E_value=3.1e-38; Accession=PF07910.4; Description =Peptidase family C78
MLAVTSVVMLKNFRVPYLSQGWGCAYRSLQTIISWFRLQNYTSIEVPSHREIQQTLVEIGDKDPSFVGSRDWIGAIELSFVLDKLLGVTCKVINVRSGAELPEKCRELAMHFENQSTPVMIETNDKVLQPAGRLIPVLIVGEVENGPRELDEDLFSGGRGTGVVRQVVFDELSSSQYQLRGRERSRVDQEEW

SEQ ID NO: 164475 - protein, 566 aa, Glycine max
  Coding DNA Sequence Number=SeqID_72790
  Gene Ontology: Mol. function=binding
  Homolog annotation: Hit_ID=A7PCL0; Match level="QueryCoverage=91%, HitCoverage=79%, E-value=0.0, Identity=68%"; Hit description =Chromosome chr17 scaffold_12, whole genome shotgun sequence
  Pfam annotation: Domain name=TPR_1; Domain location=137-170; Score =18.4; E_value=0.027; Accession=PF00515.19; Description =Tetratricopeptide repeat
  Pfam annotation: Domain name=TPR_1; Domain location=228-261; Score =14.8; E_value=0.089; Accession=PF00515.19; Description =Tetratricopeptide repeat
  Pfam annotation: Domain name=TPR_1; Domain location=262-295; Score =22.4; E_value=0.0017; Accession=PF00515.19; Description =Tetratricopeptide repeat
  Pfam annotation: Domain name=TPR_1; Domain location=351-384; Score =22.0; E_value=0.0023; Accession=PF00515.19; Description =Tetratricopeptide repeat
  Pfam annotation: Domain name=TPR_2; Domain location=137-170; Score =19.1; E_value=0.016; Accession=PF07719.8; Description=Tetratricopepti de repeat
  Pfam annotation: Domain name=TPR_2; Domain location=228-261; Score =19.8; E_value=0.01; Accession=PF07719.8; Description=Tetratricopeptid e repeat
  Pfam annotation: Domain name=TPR_2; Domain location=262-295; Score =21.1; E_value=0.0042; Accession=PF07719.8; Description =Tetratricopeptide repeat
  Pfam annotation: Domain name=TPR_2; Domain location=351-384; Score =22.7; E_value=0.0014; Accession=PF07719.8; Description =Tetratricopeptide repeat
  Pfam annotation: Domain name=TPR_2; Domain location=431-464; Score =0.3; E_value=28; Accession=PF07719.8; Description=Tetratricopeptide repeat
  Pfam annotation: Domain name=TPR_2; Domain location=480-513; Score =10.4; E_value=1.5; Accession=PF07719.8; Description=Tetratricopeptide repeat
  Pfam module annotation: Pfam domain module=TPR_1::TPR_1::TPR_1::TPR _1::TPR_2::TPR_2::TPR_2::TPR_2::TPR_2::TPR_2; Domain location=137 -170::228-261::262-295::351-384::137-170::228-261::262-295::351 -384::431-464::480-513
MAEKLGAAEESSNSKAFHHTATKLVVLADLNVDPPEAEAEEVDSSLVPPPPITILGNDENSQDKSSLSKDTDSIEGESKKLNKLSKSRSRKTDSSLDCVADVDGDQHVQGPPSSREEKVSSVKTGLVHVARKMPKNAHAHFILGLMYQRLSQPQKAVLAYEKAEEILLRPEAEIDRPELLSLVQIHHAQCLILESSSENSSDKELEPHELEEILFKLKQSVRSDIRQTAVWNTLGFILLKTGRMQSAISVLSSLLSIAPENYDCLGNLGIAYLQIGNLELSAKCFQELILKDQNHPAALVNYAALLLCKYASVVAGPGAIAAEGALTDQIMAANVAKECLLAAVKADSKSAHVWANLAYAFSISGDHRSSSKCLEKAAKLEPNCMSTRYAVAIHRIKEAERSQDPTELLSCAGNEMASIIRDSDSSLVEIPIVWSGLAMVHKAQHEIAAAYESEQNGLREVEERAVCSLKQAIAEDPNDAVQWHQLGVHSLCARQFKTSQKYLKAAVACDKDCSYAWSNLGMLSLSTVICMLSSSNSILPLVFPTVVWHFSSLTGSLSPRRTFLII

SEQ ID NO: 164476 - protein, 397 aa, Glycine max
  Coding DNA Sequence Number=SeqID_72791
  Gene Ontology: Mol. function=cysteine-type peptidase activity; Biological process=ubiquitin cycle
  Homolog annotation: Hit_ID=A7PCL4; Match level="QueryCoverage=93%, HitCoverage=72%, E-value=3e-63, Identity=52%"; Hit description =Chromosome chr17 scaffold_12, whole genome shotgun sequence
MADDSNRSVRLLCRPKQLNTKGSDPGIHFWLIGSPFFPPLTVASFLRRIHTLPSSASPDLPKESEDLRTLIPKGFEVVGALASGDDTHARTAVDAARALMNLLYGDGTDRPVIGAVCGSDSGELRFVVSESENATGLESVSSVIEERDSEKFVWENGCLLHCELPIKLPLYYSLKNPTDVEKSYAQVTESVIAKLRDPQAVYMLEMSNKASRDISPPVIIRGVQLDFSTDLSKIKPLAEDDDGFNASSLSCSYFSISSKAGSPVFSAENADTIQVSVLFNSLGSSSASTVPVAEYFPVEVRRSLHSRLGLPYDRPLLRISNALDFSKLKNNDMVSLQKGSTLLRDVHIGIPSSGVTGGTVSLVQGSYEYFHYLHNGYNDSATEIWMTPLPMKEDKSG

SEQ ID NO: 164477 - protein, 179 aa, Glycine max
  Coding DNA Sequence Number=SeqID_72792
  Homolog annotation: Hit_ID=A7PJU2; Match level="QueryCoverage=81%, HitCoverage=91%, E-value=5e-53, Identity=64%"; Hit description =Chromosome chr12 scaffold_18, whole genome shotgun sequence
MKLKVMIAVLLATAGAIMSIKNFNNLFNNSHQRLGVALYGVIWLQVLLGIFRPQRGSKRSVWFFAHWILGTAVTFLGVLNVYLGLGAYHQKTSKGIKIWNILFTVQISLIVFFYLFQEKWVYIQNQGVVLGNEIKTPSCNEGDPDEKEKEIRNNFYCFCQKWQSHSKITNAADAIVVAL

SEQ ID NO: 164478 - protein, 458 aa, Glycine max
  Coding DNA Sequence Number=SeqID_72793
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A7PJU9; Match level="QueryCoverage=100%, HitCoverage=24%, E-value=0.0, Identity=68%"; Hit description =Chromosome chr12 scaffold_18, whole genome shotgun sequence
MNQISLFEAKVACENGEQTLSRDVYRLGQRFDFYRMMSFYFTTVGFYFSSMVTVLIVYAFLYGRLYMVLSGVEREILQSLNIHQSKALEEAMATQSVVQLGLLLLLPMVMEIGLERGFRTAVADFIIMQLQLASVFFTFQLGTKAHYYGRTLLHGGSKYRPTGRGLIVFHVKFADNYRMYSRSHFVKGLEILLLLIVYELYGESYRSSHLYLFIIISIWFLATSWLFAPFLFNPSGFDLLKTVDDWTDWKRWMGYPDGIGISSDRSWESWWDEQNEHLKYSNLRGKIIEIILAFRFFMYQYGIVYHMDITHHNKDLLIVSIERQRFGTDFQLTIRILKALLFLAFLSVMTVLFVVCGLTISDLFAAIIAFMPSGWGIIQIAQVCKVCFKGAKLWDSVKELSRTYEYVMGSIIFLPIVILSWFPYVSEFQTRLLFNQGFCRGLQISMILAGRKDTYKSD

SEQ ID NO: 164479 - protein, 325 aa, Glycine max
  Coding DNA Sequence Number=SeqID_72794
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A7PJU9; Match level="QueryCoverage=62%, HitCoverage=10%, E-value=6e-58, Identity=56%"; Hit description =Chromosome chr12 scaffold_18, whole genome shotgun sequence
MLISEFCFSILTPYFKEDIQYSDEEINKENEEGISILFYLTKIYPDEWSNFHERLKSEEVLEENKEELIRQWASYRGQTLYRTVRGMMYYRQAMILQCFIESAADIALSEGYSETNKKLLEEAQTMADLKFTYVVSCQAYGYQRKSKNARDKNCYINILKLMLTWNIPCRHSSLRVAYIDEIEEKTEDGKSQMVYFSVLIKGGKKYDEESSSCDQGNSRFLSEYKDQAAGVLFLVLSLLHCIKNTQEIMSNTIRIEKFKGKNNFNLWRIKMHALLKEQRVWAPVAFASVKKEVASESKEKVSISKTEELAEQEKKGSLTNLAFLV

SEQ ID NO: 164480 - protein, 95 aa, Glycine max
  Coding DNA Sequence Number=SeqID_72795
MLKPIEPEVPKHDKQDSQSLHCYWRVNEIAEEFQDLQQIDEVDVLLALEKLIGEEADVDCINTEVANSGRQRNEEKLAEMAERLLCHDHETEKWR

SEQ ID NO: 164481 - protein, 105 aa, Glycine max
  Coding DNA Sequence Number=SeqID_72796
MTLIVKKWSILSRRPRRLQVLQETAEPLPTYVHSSTTIDTTYEKALHWMYVRDGGFTVDRSSGRGEGSMVQWKQKGRSAGSKSPASFTQQAVGWCWSGPVAKYKK

SEQ ID NO: 164482 - protein, 141 aa, Glycine max
  Coding DNA Sequence Number=SeqID_72797
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LYS6; Match level="QueryCoverage=50%, HitCoverage=3%, E-value=3e-09, Identity=51%"; Hit description =Putative uncharacterized protein F17J16_150
MVVVTEVGCRAQSTYLVWECQAWSRTKVGMHVDLFKVGGVRSGEGKGRWRQKIEAEVGGVHGGEGGGRTMASTSGTKGGPFEMGRQPSKRMVRAPTRNVELGNDEGVVDSEIVPSSLAVLVPILRAALEIEEENPRVAYLC

SEQ ID NO: 164483 - protein, 759 aa, Glycine max
  Coding DNA Sequence Number=SeqID_72798
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=UPI000034F02F; Match level="QueryCoverage =97%, HitCoverage=41%, E-value=0.0, Identity=62%"; Hit description =ATGSL11 (GLUCAN SYNTHASE-LIKE 11); 1,3-beta-glucan synthase/ transferase, transferring glycosyl groups
  Pfam annotation: Domain name=Glucan_synthase; Domain location=324 -759; Score=140.5; E_value=4.8e-39; Accession=PF02364.6; Description =1,3-beta-glucan synthase component
MGMSIDNYQWHEFFPENETHNICIVIAIWAPIMLVYFMDAQIWYAIYATLFGGIIGAFSHLGEIRTLGMLRSRFQSVPIAFSQRFWTGRDRKTKQEESVWNEFINSMREEDLISDRDRDLLLVPYSSSYVSVIQWPPFLLASKIPIAVDMAKDYKKETDDDLVRKIKSDGYMYSAVVECYETLRDIILNLLLDEDDRRVVMRICGRVEECIHEEKFVKEFNMSGLPSLSEKLEKFLTLLRSEDGKLESQIVNVLQDIVEIIIQDVMFDGHLLLQTPQQTPHEYHVERGQKFVNIDTSFTHNTSVMEKVIRLHLLLTVKESAINVPQNIEARRRITFFANSLFMNMPKAPKVRDMLSFSVLTPYFKEDVLYSDEELNKENEDGISILFYLKKIYPDEWANFNERVKSDYLEEDKELIRQWASYRGQTLYRTALSEGYRTMDSYEKNKKLLEEAQAMADLKFTYVVSCQVYGSQKKSKNTRDRSCYTNILSLMLTHSALRVAYIDETEDTKDGKSQKVYYSVLVKGGDKYDEEIYRIKLPGPPTEIGEGKPENQNHAIVFTRGEALQTIDMNQDNYYEEAFKMRNVLEEFRRGRSGQRTPSILGIREHIFTGSVSSLAWFMSNQETSFVTIGQRILANPLRVRFHYGHPDIFDRLFHITRGGISKASKVINLSEDIFAGKGRDVGMNQISLFEAKVANGNGEQTLSRDVYRLGRRFDFYRMLSFYFTTVGFYFSSMFKAIKNGTLLECILSNWSIWCFLPI

SEQ ID NO: 164484 - protein, 351 aa, Glycine max
  Coding DNA Sequence Number=SeqID_72799
  Gene Ontology: Mol. function=hydrolase activity, acting on ester bonds; Cellular component=cellular_component; Biological process =lipid metabolic process
  Homolog annotation: Hit_ID=A7PXB4; Match level="QueryCoverage=89%, HitCoverage=89%, E-value=1e-109, Identity=61%"; Hit description =Chromosome chr12 scaffold_36, whole genome shotgun sequence
  Pfam annotation: Domain name=Lipase_GDSL; Domain location=30-326; Score=142.1; E_value=1.5e-39; Accession=PF00657.13; Description=GDSL- like LipaseAcylhydrolase
MGGKGYALWLFIIEILVHFSTSRSAKVPSIIVFGDSSVDSGNNNFIPTIARSNFEPYGRDFFNGNPTGRFSNGRIAPDFISEAFGIKQSVPAYLDPAYNISDFASGVCFASAGTGFDNATARVADVIPLWKEIEYYKEYQKKLRAHLGDEKANEIIREALYLVSIGTNDFLENYYTLPERRCEFPIVQQYEDFLLGLAESFFKEIYGLGARKISLTGLPPMGCLPLERATNILEYHNCVEEYNNLALEFNGKLGWLVTKLNKDLPGLQLVDANAYDIILQIVKHPSRFGFEVADTGCCGTGRFEMGFLCDPKFTCEDANNNHATSIEDKPRTTIRPVRVTTKPRYLQDYVS

SEQ ID NO: 164485 - protein, 120 aa, Glycine max
  Coding DNA Sequence Number=SeqID_72800
MPGSRQARQGASAGVAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQDFLIKTI

SEQ ID NO: 164486 - protein, 56 aa, Glycine max
  Coding DNA Sequence Number=SeqID_72801
MSVKNLVGHLGIHDKTDHTLVRRPARVTLFCETAPIMWDRHMIKGAFKLGVFTPKG

SEQ ID NO: 164487 - protein, 78 aa, Glycine max
  Coding DNA Sequence Number=SeqID_72802
MALRRKVHVSPCGDDATRIHSGNHRCRVMVAKHIYHTFSWPLSQIETLPGEEEVVRNGNSEVQPKGGMARLKREGRLG

SEQ ID NO: 164488 - protein, 277 aa, Glycine max
  Coding DNA Sequence Number=SeqID_72803
  Gene Ontology: Mol. function=catalytic activity; Cellular component =soluble fraction; Biological process=cellular metabolic process
  Homolog annotation: Hit_ID=A7P285; Match level="QueryCoverage=98%, HitCoverage=52%, E-value=2e-63, Identity=59%"; Hit description =Chromosome chr19 scaffold_4, whole genome shotgun sequence
MDWYVKNPDWWGDVSGALLPHPRMLTMPGVEKYCYDDIDNVTQIASDGDVNHSNQNRMVVVSATRNNVSPHKASLKFLIYGGAGWIGGLIGNIYVCRDHGLPMMNYAFCGNFEDKTNSTDSFYFRTQAKVEGLLKEYENVCTLRIQLPVSSDLSNPHNFIIKITRSDKMANIPNRITVLDELVPISVEMAKRNCRGIWNFTNPGIVTCNEILEMYKDYVNPTFRWVNFTPEQQAHFTSPSTNEMDSSKLKKEFSELLPIKDSLIKYVFEPKKKSSGF
